United States Patent 7,868,149 (PLANT GENOME SEQUENCE AND USES THEREOF) - sequence listing, part 12

SEQ ID NO: 5693 - DNA, 13560 bp, Oryza sativa
actttacatcagaggaaaacatggcttggcaatgaatgatgtgaaattttgtctacaaaagataacttatcaattatccactacttggacacatgactaatacccaattcaatactagcatcttttaatccattcaagcgtgcaaaaatgtttgatagaatgaacagaacataacaagttaatcgaatgaatatacaaactcaccagctgaagctggaattaggtatacccccatcctaatcttgtggactgtgctaaatagttgacataatagtgcgcattacccaccagctaggttcatatcatccagctgcaattataacaaacctttccataccattaagtaaatatgtggtagatcagaaggatctgtacaattattcgagttgaatcattaactaactcatcacaaggatcttggagacatacatacaactttagagggaaaaaaatctatatttatcagagagttacaaccctgttaaccagtaagcatataagtgcaaaaagaaaggaaggcaagacttctaactgaaaattgcattgatatatcacatgctacaatcacttttacaccatacaaagctacatcaatctgcatttaatcagtcaagtataaccattgtccatttcaagcagcaatggagaatccgattggaacgatgagcaggatgctgcgcagaaagcagagtatgcaaggccatccaatttctttaattatactgcctaatcactaggaaagtatgaatgtgaaacccccattttcttaaagagtcagaggtatttatccttgattaattttagtatctcctcaattcttttgatgattttagggttcatcaagtcccttgcttgcctaaggagagtgccttctctgctgttataatatgcatcaacaatagcactggcccaagtgtgtaatacctctggactcctgcaatccactaactatgtcaccaagacttgacaagagaaaggaagaacagccacagaatctattatgaaagggatttcaatatattgaacacttacgtgtataatgtatcaacattatccccctgaagttcaggcccaggagtaaatgcgtcattcaatgcactcaagcgttcttctggatcctcaatcattataagatgctttagtattctgatatcctttggcatttgtctctggagattggctactgcagtcatgtatagatgaaacattatatctttagcctgcacaatgtattgcattccagtgagcactcaaactgatgaatttgtaaattaggtacatatatggcatagctactctatgttccaaatggtacttgaatgcttttctgttttacctcagattttgtgatgtcagtaccctttgcagctgaccaagcttttgaaagcattaagactaacgcagaatccaattcctttttctcagctaagtcatctatctttctgcatgcagcatccacggaaggtgaattcagtatatctttcaactttaattcagcagcactcagagcttcaagactcccagatgtgtcatcatgagcttgtagagcatctacacaatcatttccaagttgtgccaattctgcaagcaaaccagtcaaaaaggaaaatgataagctcccaaaatactaatggctgaaaataaagggaaaaaaatatgttccaactatacaagcaagtagacccatgctacatattgtacaatagcatgatatacattcagtaaggactgagaaaactagaaaatagctgttgttggtggtgtagtgtatctatattcctcgacatgtgattcatatgggaagttactagggccttaatacaaggaaagctatgcagagtaccaacatatgttacaataaaaggccaaatgttgcaaatagacgttcttgtgtatgtctcacctctttgtttttcagggtcatcatgataagactctgcaacataataaaggtggttgaaaaattccaccgtgaaatctttatggcgcttagcaataacagaaccaatttcatcagatggtgtagattttactacttcaagtagttcattatgcctttgtacatcttcatctatctgaaaagtgagcgaggaaaaaaactgttatgaataaaggctaaatttaatagttgaaataaagcatagataggcttcctggaaaccactaaagtgaatcacctctttcagttttctagcaagcctgagaagattgtgcttcatctcagggtttgattctgcatctgctctttcctgacagcgtttgaaaaaatgtggccttatgttatcccattccctgctaaaagacaataactttctccaatctgttggtgtaggcttatcgaccataaatacaccaattaacttgtcagatattttaatcattttttggttttctttagacgtctggtttgtcttggcaacccttcctgccagattatcttcatgtgatgaaatactcgtagcaacatttgtagatccactgcttgagggcatgttttctgtataatcctcaggaactgctgtcacatcaccaactgcttctagattagaggttcgtggttggcgttgactaagaaacaggtgacctgtgatcagaaaataaacacattgagggtaaaaccttcaaaattagatagatgccccatatacaaaaaatctatggagaccatcagatacaagaatagagccattacagatggttacactgtggcaccatgcagtgattcgtgcatgcctaataggttgacacaagagagactaatgctgagatttgattgtttcattgggcacatggtaaatcctgaagggatcaaatgccagcaggataaagacttcgtttcaagtggtaaacctgaattctaacacacaaaaactagagcaaccacagatagaattccagaatatacagtatggtcacaggaaacaaccatatagggcatatgcatgaactattgatgctgttaattttcaagactattgaacttatcagtaaaattttgcacctacaggagtactacagaagaagaagaagaagaagaagaagaagataacacggcactaaaaccttaaaacttatagatgttgaaggaaaacaagaataggctagcagaccattagaggatcacaaagtaagttttggttacagaattggttaatcgtctagtttgatctagtttcagagcagattgattctcaacaaaggactcaaatcctcagtaaagttaaacatcataccagcaaccatatttacgctaaaccttcgtcctcactcatcattgctatttacacagcgctattaatttgaaattcaaaatggaaaagaaccgaaaaccatatgacgctgaactctccccctgtggtaagaaacaccggactcacgaccgattcagaaatgccaaaaaatcttaatggtacgagctccaatcgtatgcgcaccataagctattcaactggaagtaacggtggatctacttttgagctctaattgcaacgattcccgctcaggtgaagtccaattttgcaacaactcacctttggaggcgacgggggcggcggcggcggcgccatgggagcggaggcgacgggcgaaggagagggtgcgggcggcaggaggtggggtgagcagggggaggccggtgggcggcgcctggcaggaaggggcggccggcatcgccattggcggcggcgagaggaggcgggcgtttgctagggtttaagcggaggcgtacaagtgggggcaaggagtggctgggtggataggggagaggtgacgacaccgcgagcgaggtgatctcaccctctcgcctcatcactttctttgtcatcttgttgggttctgaattgcgaaacacaccctggaatttagaagaatctacaaatcaggtgcccgattcgtagtaaaaaaaaaaaagttaattcgctcgacttggcccgtatcgatttgttgacgagctaagccagattcagctaacgagtcaaacacaacagcccaagtatccaactatctaacagtgatgtgttaatatgaccctataaaaatattaccatatggcctaggcgcccagcccatcaaggaaaaaaaaaaggtaaaaaccttataaggagagaagaacatacaggacacctccatccctctttttagcacactcgttcacttgaatatctgctcctctttgctctcgctttcacaccgtcaactaggtcacattgttgaccgcttataggccgtagcggcaccaagcccccaagcgtcaccctattatctttgttggcctcccaccatcgctaacccttcacctcagttggccccagccactagccctcttggccttgcctctgtcagccctggccactggtcctcacctccggcaacaccaagttctaggccctcgacaaccacctgcccagccagagtctgaaatgttttgatgcaatgttttttggacatctattatctagccaattgtctctccgaaagagggttttctgtccattgcccagggtgatttttatgcaggcttggaaaaagtggatatccactgcattgtaagggagatccatttgttctcaaggcctggatgggtttgtccaccttagccaaatccatcttaatcttaaggccgaggagaatttttatagatctatgatttcaagtccacccagctactttggtctgcaaacagtttgccaattcaccaaactagcccctagcttaacattttctggctcctcacctttccaaaggaaagcccttatgagtttattgattcttttgaaaacccatttaggtattaaaagagctgacaaatggtatattggaatggaggacatgactaattttaccagagtttctcttcctgtggagctgaagaatttgcccttccattctggaattcgcgatccactcttttcaattaaaggtaggaagtcaactttcctaagctttcttaagtgaagagggagtccaagataacttgttggaaaagattgtattgagccaggaaaatcttaggtgagtgattgtacatcaatgttgtcacaggcaattggcaaaatctacgttttttttgcacattgttatttaatcccgatgccttgccaaacacctgttagagattaagctttacgataacactcaataacccttgtggtccaacacagaacatcgatgccgggcctcaactaaaccctatcactgatgaggatcatcggtgacgggtgctcacttaccgccagtcactggtgctttcgtcctacgtaccctagctagcggtccgatgacaggcgctgacgttaatctgtcactgcagatgtcgaaccaccgccttctctatccagccggtctatctggggtgaactttctcctaacatcggtaattcactgtgccagtgttatcgcccatcgcccgtatcttctggtggcttgtggagtgggattgggagtgggagcgaggatgggcgaaagtagtgggtagcagtatggctgggttgattgatatggagtacaaactaagtgtagcaatatagtactccgtccgtcctaaaataaatgcagttttgcactattcatgtttaacggttgacggttcgtcttatttgaaatttttttatgattattatttttattattattagatgataaaacatgaatatactttatgtgcgactaattttaaaacaaattcataaaattttcatataagattgatggtcaaacacggattcccacggttgtacttatttaatttgagattgaggtagtacttaataaccactaagggattataatccatcttaagactaggggttacttgcgtatctacagttgactttaactccgtgtgattataactacacatcagcttgctggccagcctctcccatcaagagttcattatgcagcgtagcagtagcactcttgcggtgatggtggtgtcgtttgtagtgctgctcgccggtggtgcaggcgcggcggccgccgccgtggcgcagccggtgccgctcttcgtgttcggcgacggcacccttgacgtcggaaacaacaacaacttgcccggagacgaggacgtcggggatcctcctcgcgccaaccacccttattacggcatcgacttccccggcggcaaggccaccggcaggttcagcaacggctacaccatggccgacttcatcggtaggagcagtatatgcatgtggacaaaacgtctataactttttcgaaaaaaaaaacacaatcatgtacttttttctgtctacaaatatatgctttaaatttgatccataaataaaaccattgctaaggtggtgtttggatccagggaaactttagtctttgtatttaaacactaatttatagtattaaatatagactacttacaaaactaattacataaatgaaagctaatttgtgagacaattttattaagcaatagattcgtctcgcaaattagtctaaaattatggatggattttattaatagtctacgtttaatatttataattagtgtccaaacatcccatgtgatagggacttacaagttttagtctcatctaaacagggtctaattatatattactagtcctatgaatcatatctcgtctaaatttcttcacatctcttcatcccaagcatccttccaacccgatgcattttatatttcccaacaaatggaatatacattagttattaactgttagccaagaaagtgaaatgtttgagtatgttttgagttttgactagtaatgcacgtccatgatgcatatgcccataagctcatttaattatacatgatatgtatggcaatgcggttgaacgcagcaaagtacatgggatatgagatgagccctccagcttacctgtctctctccggtccggtcaacatggacggttttactggagtcaactatgcttctgcagatgctggcatacggaactccacagtgagtcaactctactccttttttcctttttaagcaaaggagcttagagacacagtacgtcagtaccatgtgaaggtgttttttaaacacaaatctacaccactattattgtcacatatcaaatccttatatattattgtgttcattactgatttaataagatttggatgtacgactagtttgcatacattaatagatgatcttttaagaactgagtgagtacaaaataacacatattaaagctacaccatgggattttcgtaattaagtatacatgcacacgttattaagaaggttacagttaggtcaagaattttacgttggtctctattttctaatatttcttccgtcccatattataatacatatattttttataattaaggtatttaatgatattttgaccattatttattctacgttatgttttcaacaaatataaaattagtatcacatgaaaaatactttgaactgtgaatgtagtgatataacatatatatatatatatatatatatatatatatatatatatatatatatatataatatagcataatatggttagtatgattattaatcaaaagttaccgagtttaatttttcttaaaaagatggtgtccctataatttggaatgttaggagtatgtgttaggggcacactcacatactcggtgtccttcacttgtatgcgttctgtgtgtctgtgtctttcatccatcatatatggcgtgacaatgtcaatgttatgaaatcaaatcgcccaataatcagcatgatgcatacagaacgcaggcttgaccatcccactgtcgaagcaaatcagctacttcgccacgacgaggtcacagatggagtccaagctggggcgcctcgccatgagcgacctcctctcgaggtccctcttcctgctcgccgtcggcaccatggacctcctcccggactgcaactacttcctgacgttcccgccgtcgccgccggacaacaagacggaggtgcagcggctcgtggagctctacaacgccagcgtcacgtcgctatacggcatgggcgccaggaggttcgccgtcgtcaacgtcggcctcgtcgggtgcgggccgacggtggacacgcgccgcggtggcggcagcggcggcggcggcgggtgcgacgcgaggatgaacggcctcgccgcggagttcaacgcggctctcggggcactcctcgccggcctccggtccgagaagcgtcgccttcgctactccctcgctgatttctacgccttctccaacgccaccttcgccaacccatcggctgccggtaaatcctgatctctcttctaacgcgcacaaattaatgacaccattttgtcctcgcaaaaaagaaaaaatgacaccattttggatatcaacacacgtatgctattcaatatatttgtaactttgactgttttatttctattgtaaaatgagacctttttatgtgcttggaattaattaggatcgttgatctctaatgatctaacacttcaaagagagaaggtactaggagataggtattaaaagggtgggctggaagctggaaggttaaaatggtaattgagttttattaattgactagcaaaagtgcccgtgcgttgcaccgggtgattacggagtgtgtatattgaccaaaagtgttgtttggtctagcaaaagtgcctgtgtgttacaatgtgaagcgtacagattagaaaaatatgcaattaattaaaatacaaattcgctgaaatatttggtatttttaagtaggtatgtgtataattaaataaatttacaagtaaagcaagtgtgagaaataaaatgacatggttaaatttaattttttttaaattctccatgattagttacactctttgaaattatatttgaatttttcagagcttaattgttaattttattaatacaaacgtcatttaacaattatttacttggaaaaagaaagaaaatacttccttttaggtttgcttcgaaataaacacattcaataacttataattgtaatgcttctgaaaaaatgagcactaaaaatgaatttattctctttttttgggcctgagggacctaaaatagacttatttccggcccttgccggtcggtccacggccttttgtgcacgcacaagtgcacttcccctccccaggccacaacctgggcttgggccagaaaagtggcctcactctcgatccctcttgggctgatttcggcctggacgacaccgatcgtccgatctttagggttttgatcggacggccgagcgtcgatatcggggaaacaaaacccctccttctcctcagccgccgaaaccctagcccatttccctccctcccatctcacatcgccgccctcccctccgcgcccccgagcggcggcgacgacgcccctcttcccgcgagcggcggcggcggcgccctcccccacaaccaacggcgcggcgccctctccccgaacaacggcggcgtggaggcggttgcggcccggcgggagcgggaggggcggcgggccggacctcgcctccgccagatctggcggcatggaagcggctgtggtctggcgagggcaggagaggcggcggcgtcgtctctttctctctctctgtgcatggtggggaggtgcggcagtggtggtggtggcggacgtcatggaacgccggtcgggcctcgcctccgccagatccggcggtgtggaggcagctgcagcccggcgggggtgggaggggcggcgggccggacctcgcctccgccagattcggcggcatggaggcggctgcggtccgacgggggcgggagaggtggcggcgtcgtctctttctctctctctgtgaatggtgtcggttctcctggtgatgctaaccgaataggacttggtataacagatgggagtttgtttcctatttttgtggaatcggacatattctttttttttcccgatttttcttttaccgcgttgatgaatcggattcgttccggttttttttcacccggtttttttgacggacgatggaagcacctcttattttttaagtagtagtagagttgatgaatcggattcgttccggttttttttcacccggtttttttgacagacgatggaagcacctcttattttttaagtagtagtagatttgtacggctaaggacaaaatcgtcttatttttatatctgtatcctactcctatccgttacaagacaagctgcattcatgcagcacaggaggaagaacggtgtgcttcttttcgtagttaaacgtttatatcatacttttaccgatatgtacatatacatctgcacacctgctcaccgccgtacgcgcccgccgctcaccgaggccgcacgcgcccaccggtctcagccgcttcacacacgctgaggtcgctgctgttgtatgcgccctccggtcacagcaaactaatgcggcagtcggtcgtcgtctccgccaccgcacgcgcctgtctcggccgcccgtcgtagccgacgtttgcggtagccggtcgtcatcaccgccgccgcacgctggtcatagccattgctcgcgccagccggtcgctgccttgcacgtgcttgctggtcgccgccgtcacgcgcgcagcccctgctccttgcatccgagctcgttcaattgggattggagttgattagggttaagcactgaaatcgtggaaagggaatcgtgaacactaggcaacggatggagaattggtgattggtcaattactaatctatcctttgtagtaataatttttgttcctaaattaccctttgtgaattaacggtggataccaattgatttaggaggcaccataaaagaccgcttgtaaaatatatgaaaattatatacgatcatacggccataagtattagtcagttaaccttttttattatcaaacttccaaaagtgtggccatgcagatatttaccttaaaaaatactttcatatataacgcccataaacgtgggttttgtgaacttgtttaaataaaaaattatggtcaaattggcatattgaagactagaaaaaaagttcacacgacatatatttatgaatagaatgattagttttacgaaaaatatgttttccatatacgaattgcacccgtccaatcgaatttttttttaaaaaaatagtggcgtaaaattttttaaaaaagttttgtcagtctaaatttgtaacagtttaacttagcatttttctcatgatcgaagggctctaatatttcattttattccttacctctgatttctccaagctctgaatttctgatacggctcgttataattttgcagggtttgtgaacatcgacagctcgtgctgccccgggccttgcatgcccttcccctacttcaaccaaccaccctgcgacaaccgcgcgcagtactggttttgggacgggggttacaccacggagcaagctgccatggtggctgccgctgcgttctacaatggcaccgcaaagttcaccacgccggttaacttcaagcaactgatccgaaggaaaaagtgataactccacgctcgatctcatgtagcaaggcacggcgcccataaaaaaaatcttacgacattcgatcaataataagttaaatgttctcctttagaatggaagaattttaataagaattgatacaattactgacatttcaatggataagtggtttgtttatatggattttgctatcttcaaacaacattatatgtaaaggcgtggtcaagatccctagtcaaactgtttttttttaactcatacttcacacaccgacacattgtgagtggacttagtacacatttacactgtgtgggaaactcctagtctggttaaattcaacactactacaaagggagtcttttacccctatgctattaaaaaagttgctgcttacctgtgtgccacaaaaaagtttggagtcacctgtatgccatgagaaaaaactttcgttgacccgtgcgtccaccttctgttagaacttaacagttccatagctctgacatgtgggaccatgtataaaaatgactaatttgcccctaaggattttcagctctattctcctctcccgctatctcccgtgagtgcctgctctctccccgttgcgctgcaagccgccgcaccctaacctagccgcacgccgccgccgcctcgcctcgccggagccggagccgccgccgcctcgcctcgccggagccggagccggagccgtcaccgcctcgcctcgccgaagccgtcaccgtctcgcctcgccggagccgtcgtcgccgccaccgtcaccgtgcgcctaggccggcgcgccgctgcgccaggccgtcgtgcctcctcctctcctcctccagggcccacgcgttcccgcgtcctccctcgtcgcgcggcacgtgggcggcacgcgcggcgggtggtggttggttcgggagggcggcgtcgtcgtcggtcaccaggtggtgcggcgccgtcgggccctccgtcgatggccgccaccgcagatgagcgagtgagatatttgcggtggtcacgtgagattcgaatcacgatgtgctagctgcggctactgctctcgtgctatctctcgatctctcgctctcgctcttgctctctcgtgtggggtttcgagatgcatctgtatatggtttggagttctcgtcttttgcgagaaacggaatttggaattatgcgattgcttttggaaattggtgccctttggaagctatatgtgtatgcttgattcgaagcattaaataaaaaaaagggcatatgcttgttttcatgtattggacaataatacctgcccacatgaattcctgtcactcacaccaaactacaatatttgattacccgttattttttggtatgcaatggtcatacacctgtttttttcttttttacaaaatttatttctgatttttccttattttttccaccattttctaatttttcccacattttcctaatttttcccggatttttaaacatttttaaaatttattctcactttttctgatttttaccttttttaaatattatttttcatttttctggtttttaacgcttttcctaaattatttttcacttttctgattttttaaacccattattgtacacaagggcaaaactgtctttacacagcctctaacacctctgttatgtctccatccatccaaaatggcacacgggtcaacgaaagttaggctcatggcatacatgtaactccaaacttttttttgtgacatacaggtaaccaacactttcttaatagcatagtggtaaaagactcccacaaaagtgttaatcaccgtaagcttcccacctaagctaacatggactagttgatgcacgaaccgatagggttgtattaatatcggtttatgacataaactggtagtgatatgcttcaatcatatttcacgttcgtaccacaaattaactgaaaatgaactatatgctgtgacactaactagcaactgacattattcgagagcaacactattcactcttcactcccggttgggaaacccctttattactcccggttatacaaccggaaccacgaatccgggactaaaaatacccatatttagtcccgggtgaaataaccgggagtaaaaatgtatttttagtcccggtt

SEQ ID NO: 5694 - DNA, 21315 bp, Oryza sativa
  unsure (1)..(21315): unsure at all n locations
aattacatcacaagttctaaaaaatcaccacagaatacatcacgacacaaatacatcttagatctgaatcaaaatgcaccacaagtatcatctcacacacaaaatcaccacaagtacatctctgcacgccggctgccaccacgccggccgcccgccggcggatgggaggggaggagggggaggagaggggagaggagaaggaggaagtggagaggaggatagggggagtggaggaggaagagataagatcggatctaaggggaggagaagaggagatgatccgttcttatctaaatatttcatctgggacttaaccgatcagagataggagaaaatatttactcccggttagtaactccaaccgggggtaaagataaatctttacccccggttgttagtaccaaccgggactaaagatctaaatgatctttactcccggttgatagaccaaccaagactaaagtggtaccaaccgggactagagatcctcggccccctggcacgcatctgacaagggatgaaccgggactaaaaatcctctttagtcccggttggtactaccaaccgggactaaagatcaaaaatttttgaaccgggactaaaaacaatttttactgccggttcttattggaaccgggactattggggaaatcctccaacccagcaaagatcacttctctagtagtgattacgaaaaactcagcggtaaccagtattaggatatttcaaacaatcaaaacaaattctcaaaaaaatcataacattcatgcaatgtatatataccactccataaagttttatgaaaagttttatgaacaactttaactcacatattgagaaatagaagagacaaattcaacatataaacagtagtggtaatattgatatccaaactttttcatttatttagctcgaagatcgagtttggacttatttttttagtgagatttttctatactccattaatttgccatctaaaaaggagagatcaggcatcgccaagggaagatcaagccttcaagatcaccaaggcccctccaaggacgccccatgatcgcctcccaatcgcctctccgtgaaaattgcacgtttctgtttactgtcgatgtacactacgtctccatttaataaagggactatctacaaatcattcgccataaaacgaacccaaacacagtcggatttttctctactgctaatccatacctaacgactcagtggacctccaactacgtacacacttttacgattaattaggaactagtacgtattttattttttaaaccatatgattaataacacatagaaattacaatgtaattattctataactagtaatataagtggtatgtaattatagtgtaagtgatatgtaattacattgtaactgtagtgtaagtggtatgtaattacgttgtaagtgtagtgtaagtggtatgtaagtatggcgtaagtactgtaagtacctcgtgaatgaattttaacttaattttggtattgaaatcattaatcctacctcgctcagtttgttagtcgctctgtctaagacctagaaggccagagttcgactcccccaccactgcgcctgaattattttcttttgcactgacatgaatatcgtatgggcaacaattcaaccgttttttcttagaaaatctggtgacacatttatagcaaatctgtttaataattttctctttttcttttattagcatgcaaatttactaatggtctattcatgtcagcgaaattgcgtgtgttgtgaagtgaccaattttttggcactcccaccatttggttcaaaccaaaattagctgtgcgccaactcccaccgtgaatccattatttccaccgacagccttgtccatgttagaataatcaaattattgtgacgggtggtgtatatatctacatcaaggaaattaattttctgaccttgagatatataagtgtgtcatggaaaattgaatttccccgataagagagtttgtgcacgttagtaaaaccaatgaccgtcagagctagtccggtttttggtagtgtctagttcgaacagtgatcagtgtgaagctaagacatgcattactccctcgatgccatgataaatgataacacattacaagcttgttgctatgatatatcccaattaaactagcttgtgggaaaccaaaaaacataaatctgctaatggtgcattttattagagcgcgcacgataggtgatgtgctgtgttgacttgataattaatcaagctgctggaattctcgcttgctggcttgcactggtagttgggaaaataggtccctagaatccgttgtaattgtgatcctacaacctagagaatgtgaataaggtttttgaaaaagcacggtgcgacattcgtccatcacggctcatcttcctctatgttgaatagctaaatgggtgaatatgttaaacatgcaatattaattattaaatatattagattttggagggatgcaacactttccagtactatgattctggataggcttatctctatattcatagattaggaaatatgacatccctctaaaatcccttaattatgggaaggagggagtacattattgtgttggaattaatagatgggctaaggcccattcgaagattaattctttgaaaaatcacaaaagcccacctcatcggatggcatgcatgtggagtttagtaccaccttgcttattctaggagagggggatctccttaaaagggaggataccctcctagccacttgaagcatgtgtggtggagagaagaagggaaatacacacgcgctcgctggcctggcaggcggcgcgcgtgcacgacatacgtgttgaattgtccacaaaattggcatcctcacccttgcgcagatgcagcctccttttgcagttttgttttgctgcgggaaattcggattccgaaaaatccggtgcgtgaaaacggcgtggagtccggataagttacgcgtgacttatccggttcggttacgcgggcgccctgatccgccttcacgcaacacacgcgaaatcaatctagggtttgcctcttactctgtactgcgccgtcgctcatagactactccatcccgctcgccggcgtgcaccggcgatcgggagagtaggtctccggaacctctgccttcgacgtcctgcaccgggagaaggcggtaataaggtttttgggaaacgcttcacgcgactgctccctgttcgtccgcgacggctcgccttcctctccgctcgtgtgctgcgcaccttcatcgacgcccgcaaccgtgagtagttcctgccgagcaaccggtctttccgccacctcggtacgtgttcgacatattgtgcatatttgatctgttcatgttttactgcttagtttacatgtgtagatctaatgatgcgttcaatctagtttacatctgcaatgtcatgatttatttatggaataaattaaatcattatgtgcttataatttcaacaatccaaaaaccttattataggcgctgtgattttactatggctggttttgccgatgcactgaggccagataaattctccggtgtgcactttaagagatggcaaatcagggtcactctgtggctgacagctatgaaatgcttctgggtgagtactggcaaacctgaaggaattcttattgctgatcagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatgactgacaaccgttctatagtcgaacaggctcatgagatacaaaccatggctaaggaactcgaactccttaagtgtgtcttacccgataaatttgtggctgggtgcattattgcgaaactacctccatcttggagaagtttcggtactgcactcaaacacaagagataggaatactccgttgaggggttgatagcgtctcttaatgttgaggggaaagctcgggaaaaagatgctgcgtctaagggtgatagtgggcagtccagtgccaatgttgtgcataaggctcagaacaagagcaaggggaaatacaaagctcaacagaccaccaactttaagaagaagaagaagaacaacaacaatcctaatcaggatgagaggacttgctttatgtgtggccaacctggtcatctggctaggaagtgtccacaacgcaaggggatgaaggcacctgcagggcagacttctaagtctgctaatgtgaccattggcaacactggagatggaggcgggtatagtaatttacctactgtttttttagttaatcagtctactaattggtgggttgatactagggccaatgtacatgtttgtgctgacatcttattgttttcttcttatcaggtcgcacggggttccatcgtcctaatggggaatgggtcacatgcttcttttcatggtgttggcacggtagatctgaagtttacttcgggaaagatcgtgcagctgaagaacgtgcagcatgtcccttctatcgataggaatcttgttagtggctcccgtcagactagagacgaatttaagttggtttttgagtgtaataaagtagtcgtgtctaaacatggatattttattggtaaaggttatgagtgcggaggactgttccgcttttccctttctgatttctgcaataagtctgtgaaccatatttgtggcagtgtggatgatgaggctaatgtttggcactcatgtttatgtcatattaattttgacttgatgtctcggctttccagcatgtgtttaattcctaagttcttcactgtcaaaggttctaagtgccatagttgtgtgcaatcgaagcaacctcgcaagcctcacaaggctgtcgaggagagaaacttggcaccactagaactcctacattcagatctttgtgaaatgaatggggtgttgacgaagtgtggaaaatgatatttcatgacgttgattgatgatgctactatattttgctatgtgtacttgttgaaaacgaaagacgaggctctagactatttgaaaatttataaggcagaagttgaaaatcaacttgacaaaaagataaaaaggcttaggtttgatcgtggtggagagtttttctcaaacgagtttgacttattctgtgaggaacatgacatcatacataagaggacgcctccctattctcccgagtctaatgggattgctgaaaggaataaccgcacactgactgacttggtgaatgacatgttggacaccacgggactacctaaggcatggtgggggaggcattgttgacctcgaatcatttgttaaatagagttcctaacagaaataaggacaaaacaccatatgagatatggattgggagaaaaccatcactttcaccaagcacatgagggtgcttggcgaaagtcaatataccaataacgaagaagcgcaaattgggacctaagactgtggactgtgtctttctgggatatgctcattacagcattacctatagatttttaatagttaaatctgaggtacctgacatgcatgttggtacaattatggagtctcgtgatgctaccttctttgagagctttttcccaatgaaggatacacatagtagttcgagccaaccctctgaagtaattccccgttcaatcacacaaccagaacaaactgaacatacacataaacatgtcattgaggaggatgtcagtgaagctcctcgaaggagtaagagacaaaggacggctaagtcctttggtgatgatttcactgtgtacctcgtggatgacactcctaagtcaatttcagaagcatatgcatctcctgatgcagactactggaaggagactgtccgtagtgaaatggattccattatcgctaacgggacttgggaggtgacaaatcgaccctatgggtgtaaacctgtggggtgcaagtgggtgttcaagaagaagcttaggcctgacggtactattgaaaagtacaaggctcggcttgttgctaagggctataatcagaaagaaggcgaagatttcattgacacttactcacctgttgctagattgaccacagttcatgtgctactttccctagcagccacacatggtcttctcgttcatcaaatggacgttaagacagcttttcttaatggagagctagatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatcttcaggctttgcagtcaatgaggcagataaatgtgtgtactatcgctatggtgggggtgagggagttattctgtgcttgtatgttgatgacatactgatatttgggacaaaccttgaggtgataaatgaggttaaatcattattgtctcaaaattttgatatgaaggatttgggagtagctgatgttatcttaaacattaagctaattagaggtgagaatgtgattacattcttgcagtcccattatgtggagaagatcttgaatcgctttggctacattgatagtaagccttctccaacaccttatgatcctactccctccgtcccaaaaaaagacaaaccctggtttccgtgcccaacgtttgaccgttcgtcttatttgaaaaaattatgaaaaaaattaaaaagacaagtcacgcacaaagtattaatcatgttttatcatctaacaacaataaaaatatgaattataaaaaaatttcatataagacggacagttaaagttagacacggaaacccagggtttgcctttttttggacggaaggagtagattgttgtaacaccctgaaaatttctgacaataaaaatcactaaaattttaaactttttagaacttttgcatcatgctagatgttatggttgctattgcttgccaaactattaattttcacgattgaagattaagctaaagctgtacaactaagtagtaattagaataagataattattattaatcctataaatatttgtgcacatgatagcaagccgaataaagtacaagtcaattattaatttctataatgcagactacaaattgaatgttaaatacttgaaccatgttgacaagtgtcaggacatctaagcaaccatgaaataatcgccactacgatgaccctatataaaggagcgttccactggaatatttatattaatatttataatgttcattgagtctctcatggaatagattcactcatataaaatatttggtcatgtaaataaattgagtaaatataccaccacccttataatgtattctatggaaatatattaattctatatcacagccagcaattatttaagttaattatagagtaacccaatataatgcaaattcatttggaaataagtaaatattcaaatacatatttgaattcccaaaaccaaaatatatatattacatctcaattcaaattccaatcccattcacttttgcagattagcccctccctttccttcctttcgcttttcttccttttctctcttttcctagccgccactgttcattgcccgacacctgttcgacataggcccagcccagcagatcaggaacgcatccatcccgttcccaacccttgcagcactgctcccgtgtgccgcgtgcatcgcatcgatctcgctaccacccgacgccgcgccgcgccatgcctccgcacctgcgccactcccgcgctcgcgttgtgccatgtgccgcatccacccctcccatgcaccgcgccgcacccgcgtcgcaccgtttccatgtgccgcaccacgccaaactcgagccacgccaagccgctcttccgccgtgaatcccggcctccaaccgctctcccgtttccctccaagaaacacggagcatcgccatcgtcaccatgccgctctgcgtccatcggttaaaactgcgcatccctaccgcgcccgctggacaaaacaatgcccttcctccagctagcgcctagacctgcagtacataggttatagatgcgatgattaagccacagaaccttaatggagaaggagataaacccttatccgcgtcgtccacctcatattccttatccgattgccattagagctctagctcatccaggccatgtgccggcgatcttatccccatggtttccttacatcctaagctaagcccccaacaaaaatccccattcctctcagctttcttcccgaatacatttcatcgagcaccttgcgatcactctctcaccaccgctagagatcagcattgcgaggctccccggccggagctggaggttggagggagtggaggaagagccgtgctgccgccgtcgccattgagggagctgaggaccgctggacaccgggaaccacgcgtcgaacactttcgggcatcgccgaccgctagccacctctgctttgtctgcaccgcaccacgcgtcgccgcccttcgccgtctctccatcctagcgtaatccctcgaccccatagcatcctctaactctctaatagctagcatcggctccaatttcgccaaatagcacccgtggccgtaccggcctggccgccattgcactgccggcgagctcgccgtggacaagccatccgggagctcccctctccatctagctgatgaaatcgaatccccatacgccgtagacgctcacgccctcaccagtttggtcggaaaccctccctatcgccctagcacctagctgcccgagctcagccatgctgcgccactcgccctcactccgccgcgcgtcgctgacggtggtgggaggtcgccggagcctctccgtactttccgcagccgccgccgtgccggcctcgcgccatcccggctgtgcccagcgcgcatggcacggctgcctctgcccggctggaggttgaagacgacctccattcgagccactgacaggccgggcccactcctatatttcccctagcaaaaattaatccggtggaaaaggaataaacccggggtcccacatgacagtcaatgtagttgtggataggatttcggattaagaacaaatctattaggaacagtaacttttcacaatttctcggattaattcgaaattgaatctttaaactagtataacttattcattttagctccgattcgagtgaaacttgaacctaaatttatctaaattcataagctttccaatggtatgtaactcactgtttagtaaaatatatttataattgttacataattaatatcaaatgattagattatgatcaacttaaaaatatgctaataaataaaattgattattgtacagtaaactaggtgtgaggataattctctttaccatgctttatcactgtaaaacccatgtaaactaattagaagcatatgtggtcatactcctaccataactcgatagatcaactctgatttaatgaaatgtgtatcccatttatattatgatgattagatcctaaacaagccgccatgacaataggaatgattaagagattatccgtttgcaaacacgaatcgaccccaacaactatattttgcttgtgcatatttgattgaatattggtttttctcgcgtattatagaatttgtatatcggttagtcgtgaggcaacgtatgcagcttccaggaggtgaaggttgatcaagattatatcaagaataagaactatcctgagcatgcaagtcatcaccccaccccttgagcatgttgatcccaattgcgaaattgttttgtttacaaataaaattgcatgcaatgatgaatatcctacttgttattatgccatgcctttgattattgcttatctcattattcccttgtacccataattacgtatgagtccatagtcacttgtgacaaatgctgagtaatgctaatttagattcatgcattctcatatttatcaaatgctttatgcttgggcaactaccttggggagggtagttgagatacggcatgtagagacatgagtgccacattgccatggcattgatgagatgatttgtgaaagaaaattaaaactaaacaaatgttttcgactggggcggctggatgatttgggtggtgtccggtaaaggctagtgccatccctggtcagttaaggacagagccatgaagctaagcatgaaacgaccccaatacaaccgtacttctcgaatgggtatagacctagcggagtagatagccgagcggaggcagtacccctgcatagtggtttcacttaggtgtgtggatgaacaagcagtctgttggcggatacccgatacggatggccagatggcggatacccgatacggatggccagagactgacttgtcaagactacaagactacaaggagatacccaaaagaggacagcatagattgggttcaactacaggatgcgatgttagacttgcgtgagttttcttcctcgggagcgccagaactcctctcactgctagaaacttatgacgcctagagtgcatgaggacttaagttcatggagcgggtactgccaatgtgaggttattgaaaggctttgccgtgacgcgtctcatgtgttgggacgaggctcatgtgttgggcagttgcggagtacgggtaaagtgtacatccactgcagtgtgagtaaaacaaatctattcgaatagccgtgctcgcggttattgagcaccgggacatgtattacacttggctagactctaatttcttaatctgattgggatgggatatgcatcatgattttgtactagtggatcaacttctcgagaggcgagaaggggtagaccccagaaaaccatgatggccagtggcgggaagctatccttgggaacacaatggatggtggatagaaccgtcgctgtttaatgaacaatggagttaaaacttgatcagtttatgctaggtcttaggtttgtgaaatgatatttgaaaactcagctttacgcaaagtaaccatagccactccttgtattatcctgtacattactacattttgtgtggtggcttgctgagtacttttgtactcattgttgctctatatatatcttttagcagagtgttgaagagaagcccttgttagtgcgcttgcgtacctaacaagatgatcggagtttaattccattctaggtctcgtttcccagtcgactgcttgtggtatgtcaaccgggcccctgtattattttgtcttccgctgttgtttctctgatagttgttggcctgccaggccctaatgtaagcatttaactcttttagcctgaattcattcatgatatgttgtgattcggctatgtatgtgtgtaccaactactgatccagggattggtactgataaacataggagatttccgatttccaaaatcggaggtcgacaattgttgcttcgcaagaacaagagaattgctaggaatcaactggaatactcccaaatcattggctcgctgatgtacctagctagtgcaactaggcctgatatctcctttgttgtgagcaagttgagccggtttacctctaatccaggagatgattactggcgtgcgcttgagcgagtaatgcgctatctgaaagatactatggaattggggcttcactattctaggtatcctgcggtactggagggatatagtgattctaagtggatctctgatgtggatgagataaaagccactagtggatatgtcttcacactgggtggtggtgctgtttcgtggaggtcttgcaaacagaccattttgacgaggtcaaccatggaagcagagctgacggtactggatactgctactgttgaggcagaatgactgcgtgatctattaatggatcttcctattgttgaaaaaccggtgccggctgtccttatgaactatgacaatcaaacggtaattgtcaaagtgaatagttctaaggataataagaaatcgtctagacatgtgaaaagacgattgaagtctgtcaggaaattgagaaactccggagttataacgttggattacatccaaacagctagaaacctggcagatcccttcacgaagggactatcacgaaatgtgatagacaatgcatcgtaggagataggtttgagacccatgtgagttatactatggtggtaacccagtctatgtgatcggagatcccgtgaattagaacctgggaagaacaaaccattagtaaactagaggagagtaccaatctataccctctctaagtgaagatgcatgtactctcgtgagctgcaaggcaggttggctatgccttaatgagttctgttggctttaattagcgaagatgatgtcctgcagagcattcttgaaagaactcacctttgtaagcttgactgttggtcgcagtctatagagattttgggtgaatcttctaggaatcttactaaagatctaggagtatgacttatacgctccacccgaggggtagtctacagacggtctagtaccagataagactctgagtgaaacttgcttgcacaagacttgcaattcaaggcgtagtccattgttcaagttgtgagtaagtgtagcttggagttctaggtggatgtttaaccttaatcggtctccatcgaaccgctggtatataaacagtacattggaaaaggcaaatctcagtgggattttgagatttggtgggggattgttggaattaatagatgggctaaggcccattcgaagattaattcttttgaaaatcacaaaagcccacctcatgggatggcatgcatgtgaagtttagtaccaccttgctttttctatgagagggggacctccttaaaagggaggatgccctcctagccacttgaagcatgtgtggtggagagaagaggggaaacacgcgcgctcgctcacctcgcctggcttggcaaggcaggcggcgcgcgtgcacgacgtacacgtcaaatggtccgcaaaattggctcctcacccttgcgcagatgtagtctccttttgcagttttgttttgctgcaggaaattcggatttgttttgttttgaaacattccgaaaaatccggtgcgtgaaaacggcgtggagtccggataagttacgcgcgacttatccggtttggttacgcgggcgccccgatcaagcgacctatttctatataaaccgagccgccgccttcacgcaacacacgcgaaatcaatctagggtttgcctcctactctgtactgcgccgtcactcgtagactactccatcccgctcgccggcatgcaccggtgatcgggagagcaggtctccggaacctctgccttcgacgtcctgcaccgggagaaggcggcaataaggtttttgggaaatgcttcgcgcgactgctccctgttcgtccgtgacggcttgccttcctctctgctcgtgtgctgcgcgccttcgttgacgtccgcaaccgcgagtagttcctgccgagcaaccggtctttccgccacctcggtacgtgttcgacatgttgcgcatatttgatctgctcatgttttactgcttagtttacatgtgtagatctaatgatgcgttcaatctagtttacatctgcaatgtcatgatttatttatggaataaattaaatcattatgcgcttataatttcaacatattgtagccgcacacgtagcatgcagtcctggattgcttgaatctatcggcatcggctgattgacaactaatcaaacataaccaattgaccttgaccatatcatcaatcgaacctttcactggatatataagcatgcatatacacactataggcatgagattttatatatagagagagagagatagagatctgagttgaccgccgtcgacttaattagcattcaagtttttaggagatattctttttatcttggaagcaatgtacatcgatctgccatgcaagcatgcatggatcatggatgcattatgcatatatgcgtgatgaggaagcattatatgcatctggcatctcaacacttgacttaattatctcttgaggccacaatatatagctaggataaagtagccgatcaagcatgcatgaagcacttgaaaccttgtgtgcttataagtagctagctagctataggggcagctccaacaccttgctactgcagaaaagtgtaaaaaatggctagtggatcggatgcaatgggcactttccttgcgatggcagcgttaaccttccaagtgatgcttcttggtggtgccgtcgtcgccggcggctgcaacgatacacggcggtcgtcggtcccggcgatcttcctgttcggcgacggcgcgctggacgtcggcaacaaccaatacttgccgtcgtccgaggccggagacccgatccgcgccgatcaccccttttacggcatcgacttccccggcggcaatgccaccggcagggtcagcaacggctacaccatggccgacttcattggtaattaaattcatttcctttttctctatatgcatgtggcctagctaactagctatacgtactaactaccagtggtattattcattataatcccttcgttccattttaagcacggtcaggagtttctaatgtttaactttgatcgtctgtcttatttgatttttttatgattaatatttttactattattagatgacaaaacatgaacagtaatctatgtatgacttatgttttttaatttttttttaaaaaactaaataagacagacgattaaagttagacacggaaactcatggttgtaattaaaatggaacggagggagtatcaaattgggaaagtctgttcatctctagatatgacatctcttcagggagcggacccaagggtgtagtgtgcactggcatacccaagaaatttgaaaaaaaaaatttggatcacctactccttagcactatggcctaagtccagtagataatggttctgtttagttctcttcaaacttttaaaaattccgtcacatcaaatatttagacacatgtatggagcattaaatgtgaaaaaaatgtatagtttacatgtaaattgcaagacgaatcttttgagcctaattacgccatgatttgacaatgtggtgctacagtaaatatttgctaatgatggattaattaggcttaataaattcgtctcgcaatttacaggcggaatctctaatttgtttcgttattagtttacgtttaatacttcaaatgtgcgtatgtatacgtcaaaaaaaatttagaggaggaactaaacacagccaatatagcagattaggcacatgccagaacagcatgtcaggcctgttgtaagtgttaagtgttaaacagagttgtactctctctatctcaaaatataagggattttgggtagatgtgtgacaaatcatagtaatatgaatctagacagcttctctgtctatattcacagtattaggatttatcatatctacccaaaatcttttatattttggaacggaagcctggagtagcaacaagtagcagtacatgtgtgagcgcgcgtgctgaactgttgagtgccgacacgggttttggggtagcgccgatgatggccagaaggatgatgtattcacaagcgggagaagctgattaattaattaattaagtattaactattataaatttaagaaataaatttatttgcttttataataacttttatatagatttttttttaaaaacacaccatttaacagtttgaaaaacgtgctatatatgaaaaatgagtaagttagagtttggagttgaagaatagaacagggccttgctcaacaagcacaaagcgcacaattgctatatatcatccacttattcatatttgcaatttcctctcggtcccagtttccctcaaactgaattactgaaaactaaaactattttgtgatttctgttcttaaattaagttgagtgagcaaacatatgtgaacaagagcagtgcctagtgtttatttttagtgatcaccaaagaattcagattctagctatactttgacaaattctttaatttatatctttcattacatagttgcagttatatcttctatctgacaatttttgttaattatgtataagcgtctgaggcttatttgtatttgtatgcataaagacttatatattttcttttaattgacatgtgcgggcacacccaacactagtttttcctgtgtccacaattgcgtctcttcatttttacttatagcctaaaaatcatcaaaaaaatattaacagaatagattcgtgataatcaccaaaataaatattaataaaatagatcggaggtgctcatagtggtaggattcgcatgtgtgttcatagacgtgagtgtgtgcacgttgtgagcgcctgtatttgtactgtgtttcttaaaaataaatagattgttgatatatcattgttcaaattcaatttatatatgtagaaacaaaatagcaaatttgactctgaacagaacataaaaattcactgctaaattgttgtctctaattatataggctgaattaaagttatatgtttatgatatatcgtaattgatcaagctacctatttttttaaaaaaatgacgttttaaccaacatcacaaaacgatgggggttccctcgacacaaacatcatctcctatcagactataaactaattgtgtcaagagatgcatggtaatatgatattgtnttgtgtgtggttggagcaaaggctatggggttagagatgagccctccagcttttctgtcgcttaataatagcctgatcgaagtggatgcgggtttcagcggcatcaactatgcttcagcatatgcggttatttggaaagatttgtaagtagtcaaacattccgtccttcgatccgtgttctactggctcagttctttttccaactttcctaactcaccttcctcgttttccgtgtgcacacttttttcaaattgctaaaggtatgtttttcttaaaaaaaaagttatatatgagagttgttttaaaaattcatatttatctatttttaaaaaataaattagttaatactaattaattatgtaataatatgtgctttattttgcgtgccaaagaggactcctcctcctcctgaacatagcctaagccatatatacattttcttacataaaccaaacattttcttacatatacgaccttttcttacataaacaatacagttgggaaatatttccatggaggtaaaacgagtcgaatctcatgttaatttcataaatatttaccattttactatttatcagtcgcctgattttcccaaacaccatacaggacgacgcagaatcagtatcactgccgagacaagtgcgatacttctccaacaccgtggaggagctgaacggcaccgtgaccgagcacgagctaaccgagcttctctccaagtccctcttcctcatctccgcgggcacctccgacctctaccgcatcgccaacatactcgactcgccgtcgccgtcgccgccgccgcccgacaacgagaccgacatcccgcacctcgtcgcctcctacggcgagctcgtcgtccggccactgcacgccctgggcgcgaggaggttcggcgtcgtcaacgccccgccgatcgggtgcgcgccggcggtgacggagcagccgcacagccacagccccgtcggcggttgcgacgaccggatgaacgccctcgcgagggagttcaacgacggattggggtctctcatggccgggctgagctcctccctccccggcctccgctactctgtcgccgatttctacggcttctccaatgccaccttcatgaacccgtcggctaatggtatttaattacttgacaaaatctgtcagattattcgtgaaccgtcacaatttacttcttgcatttctttttaatgatgatgcattcctaatgttagtttgtcatcgtatgtacacagggtttacgaacactgatgctgcgtgctgcaaagggccctgcaatgagcagttcggagcgccgtgtgggaaccggagggagtactggttctgggacgtggggcacaccacggagaaggccgctaagctggcagcagctgcattttacgacggagaacgccagttcaccacgccgcttaacttcaagcggttgatgggaatacactggagatgatcgagatctcctaatttttcacatatttaatagcaaatttgatgggaatacactgatcagagatgatcgagatcacattttagtttttcttttaaatttgctattaaataattctaccccgtttgatttttattataaataaaaaatcacattaacattgatgtttttaaaataagttgcacgtaagtataagagagggaaatatattcattttataaaaatctaacataatgggtaaagaggggataaaaagaaaaattcagtggtacaactgtacatgagatgatgcaaaatttaaaaatttaaaggtatagaagggattgaggaaaaacttgtgggcacatatggaattttctgaagatcaaaacacggcaaccaactaagcctagcgttggaagaaataaaagtaaaataagttgatttttaaaagttggtattttttttagttgttacaatacatgctacttagctcaaatagagcgctacatgctctgtattagttctactaagtcgtatatttcaagtaagaaattttattccaagaacctagcccattagtagtaattttttccctaaaatacttagctcattaatagcaacaacaacaataataatacttactacctttgtttttaatatatgactatgttaacttttttacatcatgtttgattattcgtcttactaaaaaatttaagtaaatactccctctgttttaggttataagacgttttaactttggtcaaaattaaactgctttaaatttaatcaagtttatagaaaaaaaatagtaacatttttaacccaagacaaatttattatgaaaatatatttaattattgatttgatgaaactaatttagtattataattatgagaggggaggggaagtagaggctgacatctaggatccacccttagtcagctgtcacgtcagacaaaactggagtgaaaaccacttaggaacctagtttgcactggttttgtaagttgggggatgtgttgtatccggttttgcagtttaaggatgattttgtaactcgatgacagttgagggaccttaggtgtactttttcctttttattttcttgtggacggccgtaagccgctaaataagccctttgtcgctgtgtttcggcccattctgctggaaagaaagttgccgccgtcgagcttcctcctctctctctccgccgtcttcagttcttcgccaccaccggggcggggggatgtcatggaccggccggcggccgccaccgccgggggagccaccaaccagcctggggagggccgcgcttccctcgctcttcttcttcctgcgccggccgcgtatgtagctctccgcctccacctcgtcccccaccatctccgtcggccgtcgcgtcgctctttttccaggcagcgcgcgtgagtgagattccggcaggcagcagccacgcacttgtcgaggaccctctccgcggccggcgcttctctccggaccgtacgtgaccactctccctggcaagcagctcgaggagatcgatgatgcatcatcagtatttctgcaaacaccctcggttgctggtggtaggttgaagcatcttgcgatttgtttttcttgtgtgctcaagtgtgattcatggacagctaagccgacgtgttacgttttattaaaatctagggatttcaagctttgttcatcagattgtctgcacaaattatcgagctcttgttgacatagttgccttatgtgcccattctgctcttgaattcttgtaaagaggctgctacttccacctcaattttctgtactctatattaatttgccatctgaaaaggagagatcagccatcgccaagggaaaagatcaagccttcaagatcaccagggcccctccaaggacgccccatgatcgcctctccgtgaaaattgcacatttctgtttaccatcgacgtacactacgtctccatttaataattttctctccatcttttattagcatgcaaatttactgatggtccattcatgtcagcgaaattgcgtgtgttgtgaagcgaccaattttttttggcactcccaccatttggttcaaacgaccgaaattagctgcaactgccaccgtgaatccattatttccaccgacagccttgtccatgtcagaataatcaaatataattattgtgacgagtggtgtatccacatcaaggaaattaattttctgaccttgagataagtgcgtcatggaaaattgaatttccccgtgcacgttagtaaaatcaatgacgaccgtcagagctagtccggtttttggtagtttagctcgaaaagtgatcagtgaagacatatgcattactccctcgatgctatgataaatgatactccctctgtcctataatataagggattttaggtggatgtgacgcatcctagtacaatgaatctatatagacagagacagaatgtgtcatatccacctaaaatctcttatattatgggacggagggagtaacacattacaaccctgttgctatgatatatcccaattaaactagcttgttggaaaccaaaaaaacataaatctgctaatggtgcattttattatagcgtgcacaatagctgatgtgctgtgttaacttgatcatcaggctgctggaattcttgcttgctggcttgcacaggtagttgggaaaataggtccctagaatccattgtaattgtgatcctacaacctagagaatgtgagggtttttgaaaaagtacggtgcgacattcgtccatcacggctcgtctttctctgtgttccgatgctacttgtcatcgtccagataatattgcatctcgtgtgtcatgaacgcaattaagctaacctatccagcacaaaagaacatcatcgacttagcttgatcaccgactgcaggcaacaaccacaggttcttttgtgctgaataactgaatgggtgaatatgttaaacatgcaatattatgatatatgccaatatgccatcgtatggccatacatccagtgatcgcacgtgtaacaatcttacagctacacaatattcactgccacagaaacgattttcctggacagggaccttcagattgcgtgcagacggtaactcgtcgcatctgggaaaatcggctc

SEQ ID NO: 5695 - DNA, 12022 bp, Oryza sativa
cctttctcctctcctcggcggcagcccatggcgacggcggcgggcggcgtggaggccgagagaagcggcgccgacgagaggctggtgggaggcggccgccgccgctgccgaggcgggtgtggaggtcggcggcgaaagcgacggcggtgcgcgacggcctcctccacgcggcggtggtggaggcgcgggatccggtgggcggcggccgtccccgcatggatccggcggccggccgcccctcacgtgggatccggctcccctctcctcccattccttccctccccagatccgacggaggggaggggcgtcggcggtgggaggcgtggaggccgggagtggcggcgctgacaggaggctggcgggaggtgggcgccgacaacgacgaggcgggcgccgccgccgacgaggaggaggcagcggccgggagcaacggcgccgctgccgattctagggttttttttgaaattttttttccgatttttattttaccgtgtgggcgatataagcacccacacgtgaaaatcgcgattcacgcagacccttggttgcatgcgggccgaccacccgcatgcgaaaatcagattcgaccgcatagaaaaatcgttctcctattagtgattgtagccgcacaggtagcatgcagtcctggattgcttgaatcgatcggcatcggctggttgataactaatcaaacatataaccaattgatcttgaccatatcatcaatcgatcctttcattggcagacatacacactataggcatgagattttgtatatagagagagagagggatcggatagagatctgagctgaccgccgtcgacttaattagcattcaagtttttaggagatattctttttatcttggaagcaatgtacatcgatcagccatgcaagcatggatcatggatgcattatgcatatatatatgcgtgatgaggaatcattatatgcatctggcgtcgatcaacacttgacttaattatctcttgagaccacaatagataggataaactagccggatcaacacgaatacttgatccatgaagcacttgaaaccttgtgcttataagtagctagctagctataggggcaggcagctccaacacttcgctactgcagaaattataaacaattgctagttgggcagtggatcggatgaaatgggcactttccttgcgatggcagcgttaaccttccaagtgatgcttcttggtggtgccgtcgtcgccggcggctgcaacgatacacggcggtcgtcggtcccggcgatcttcctgttcggcgacggcgcgctggacgtcggcaacaaccaatacttgccgtcgtccgaggccggagacccgatccgcgccgatcaccccttttacggcatcgacttccccggtggcaatgccaccggcagggtcagcaacggctacaccatggccgatttcattggtaattaagggctggtttgttttgtagcctaaattagatttaccaatttttttaaagctaaagtttggtaaattttagtatggttaattttgttaaggtaaagttgtgtttgcattgaagccaaaatagcctaagttaactattgaaatgccctattttctttggcatgccaaaattttgctccaaaccaaatagacactaaacactattgaaattaccaaatattggtaaaatcaaaccagccctaaattcacttattttcactatatgcatgtggcctagctagctatatgtactaactactcgaggtattcactcctacagaaatggttttttttttctggatgagacatacgttgcagacggtaatttcgcatctacaaaaatcaacctctattttccgtatagggctccttaggaggaccatataaaaaatcgatttttataggcggacctcttaagggtccgcacgtaaaaataagcctatttttgcaggcagacctcttaaggggctgcatgcgaaaatatatttttgtagacgggcttcttaaggatctgtctaaagtctgagttacatcctcatttccctctcgacacttcaaaatttttcatccttatccactcctctctctcaccttctctcctcattatttcctctccactctctcacctcatctcctctctcacctcactggacgagacaggcggtgagcggcacgaggcaggcagcaggcggagggagcgatcggcgatagtgggcggctcggtggctggcggatccacctccaccgagcctgcgatggcctgatccgccaccgtagggtccgcgatagcctgatccgccgctgtagggccctcaacggccggatccgcgggcggcgagcagatccgccttcgtcggcctcgcgacaggcatcgggcggcgggcgtgcgccgatagcgagtggcgggcggcagcgacagatcacgcagcgggcagatgagccccgctcaaatttggcagcgggggccacccagatctggcggtggctagggttattttttgcaattttttttaatttttgttttttgcgtggaaaccatataagtacccgcacgcaaaaatccgattttgcccgcacgcgtggaaaaatagtgaattatgcagacccttcaaagcagatgggccagagttccgtacgcgaaaatcacttttgggctgtatggaaaaaattgttgttgtactagtgattattcattgtatcaaattaggaaagtccattcatctttcgagatgacgtttcttcaggaggtgtgccaggtgtgcactggcgtacccaagaaatttgaaaaaaaaataggatcagctagctactccctagcactatggcctaagtccactatttcctctaacccataaaaaactaacctagtaccgaatgtgacacattctagctagcagtatatgaatctggatatacatgtctttagattcgtagtatctctagattcgtagtactccctccttccaaaagtctaagacttattttattttttaatttttccaaaaagccattttagtcctatttgtaatcattatgtgctaaattaaattattgataggtaccaagaagccattttaggtggtgtttggttgaggtcaggaaatgcaaacgtaaatgggatcagctacagcagtaagggaagaaaatgtatcactttacaggttttgtttggttggccgctgtaacgtctcatgtttgcattacattgtttggatggaacatggtaacgggtaacggctgcttccgaagcagggagcgcttagaacgtgacgtagctcaaagctaaggcacattacaagctacatagcagcagtgttctcaaacacgtgtagcacatcaaagctatgtaaaaatattcacaattttataacatgcaactgtttgatactatcacacattgggaagtgtatacagtcttgaaaatgtgaacatcagtttaataatctcaagtagaaattatggatagtggtagcactctagctagggcatgtacaggaataattcaagaaaaggtcatgtggctttagaattcaagtgatataattggacaacatgcatctagaaactactgaaagtgaataatcgggcaggtcctcgcttcattctaaaaagggcattgactccaaagttaagaagcacacatgcatgtaaatatgttctcatgctcaaacaaagatgcaaggaatccaatttataatgttacttctacattaaaagaaataaaagatgccactgtgagtttaaaggagagcacgaaacccaaaaatatgtgttccacttatgcaattggtaacaagtggaatagtttctatggtttccaatcatacacttttcatgaaatataagttagctcacctgcaaatttaccctccatttgcttctgcaaagtgaattttaaaagaaaatggaaagcagggccatctgaagtcaacttcctggacaagagaaaattaaatgctaatcagaaagtagagcaaatatttgttgaacaatgtcaacagcagctgcaaaaaaaatatttgctaacaaagtttttggaatataacaagtaaagaaataaattgcccatgggacagttatgcacataccagatatataggcagttaaccaacaagtaaatagctgcaccgcgagactaattttcgcagcagtcatgagataagcaataattggcacttgaatccttgtggaaggatcacgatgagagcagtggaactccaacagttcaatctcgatccaacgatctcaagctagggtggtgtttggttcggaatactcaagagtaaatatcggatccattttgacatgcaaatatttgaaagcagctagtttcttgaatttgtatctaatatcagcctagcatcatcctggaagatctctgaacaagatcttgtagatgtagcttccgaatactcaagagtaaatataagacccatgctgggagtgagaacttcagaagttcaatgaactaaacaacaagaggatacattgtgatctgtctaaataaagtactgaggaaatatatggatgaacaattgacatgagtgaaactactagattagtagactcagattcagcgagtagattggtttggaacagtccatgctgcgaaacataagtaaattgattatatatgtgcaagatgacaattctgtcgaaaaggcaatgcacgacaaacctttttttttccaatctcacactctgcaaaataatatatcacctggcagtaatgaaaatcaaaattctcaaaatctagagagtaaaatgagttggtccgacaaaatttcggaacttacctacactcgaaaacaaatatgaaagaaccatcaactactattccagatttttcctgcaatcgggaaaaacagattctacaaaactcatgtaaacttataaagcaaacagaactgaggcaggaatacatgcaaccaatcaagaatacaaatgattcactagtataaactacttcatgatttgttaatgaaaagaaaaagatcatcaatcatcagcatcacaagtatatcatcataaagagtggtggtatcagtgaggggagggttctcaccggcgacggcggaaacgacagaagaacctccttggtggctggtgccttcttcgtgtgcctcaagatctctgccatgccttcttgatgctcaacagcctcgtccttctcgcagatccagtcgtcagggatgtggaactcgagggagatggaggagggactgaaggtagcagagcagtgggttgtcggccttgtcgaggcgggcaatctccgggcggtcatggagcgtgcgaggggaggggcagcggcgtcggggcagggggcagcggtgtcgacgacgcacgccgggcagggggagcggcgccagcgacggtgcgctgcaaggtggcggcgctcaaggctaggtcacgttcgctccgctccgcctccgtatcggtaacgcgtaacgcccgatctggagcgtaatcaactttgtattgggctgggattcgtttgcgggctaaccgattacggtccatctaaaacaaacagatgtaagggaatcaattcacgctggtatctgatacgggccgaaaacagcccaaccaaacagctccttagtgtttatcggttacatgctcattggttttgtctcgggtgaatgaattaattgtttttggtcttggtgcaaaaagaaatgacttagacttttgtaaggagagagtaccatagtatgtcacatccggtattagattcgttttttataatatgtcacatccggtattagattcgtttttttatgacggagggagtatataatagcatattaggcacatgtcagaacagcaggtcagacctggttgtaagcgttaaacaaagttgcactttctccatcctaaaatatataagcggctgggtttagggagtatataatagcttattaggcacatgccagaacagcaggtcagacctggttgtaagcgttaaacaaagttgtactttctccatcctaaaatatataagcggctgtccagatttataatgctaggatttgccacatctctcttcaaattaccttatattttaaggattaaagccaggagtagcaacaagtaatagtgcctgtgcgagcgcgcgtggtgaactgctgagtgccgacagagttttaggggtagcgccggtgacgaccagaaggatgatgtattgccaagcgggagaagctgtgcaactgtctttactcaacaagcagaagcgcacaattgctatatatcctccacttattcatatttgcactttcatctcttagtcccagtttccctcaaactaaattactgaaaactgaaactattttgtgatttctgttcttaaattaagttgagtgggcaaaggtatgtgaacaagagcagtgcctagtgtttatttttagtgagcaccaaagaattcagattctagctatattttgacaaattctttaatttatatctttcattacataaatagttgcagttatatcttctatctgacaatttttgttatgtactccgtataagcgtctgaggcttatttgtgtttgtatgcataaagacatatattttcttttaattggcatatgtgggtacacccaacacttgttttttttctgtgtccgccatctgcatctcttcatttttaagtattgctttaaaaatcatcaaaaaaaatattaacagaatagattcatgaaaatcatcaaaagaaatattaacaaaatatatcggaggtacttataagggtagggtttgtgtgtgtatttatagaggtgagcgcgcacgttgtgatatatatcaaataaatcggtgatatatatcactattgtgatatatatcgcatgcgtttgtaccgtgttttaaaaaaataaatcggtgatatatatcactattcaaattcaatttatatatgtagaaaaaaataaatttgactctaaatagaacatacagttcactgctaaatttgttgttttctctaattatatatgctgaattatatgtttataaagtgatacattcccatattaatctatcttgtcaatttttttaagaaaaatatgacgttttaaacaacaggcacaaaacgacggatgttccctcgacacaaatatcatctcgtatcaaactatcagttaattgtgtcaagacatgcatggtaatatgatttttttttgtgtggttgcagcaaaggctatggggttggagatgagccctccagcttttctgtcgcttaataatagcctgatcgaagtagatgcgggtttcagcggcatcaactatgcttcagcatatgcggttatttggacaagatttgtaagtagtcaaacattccgtccttcgatccgtgctctaccgagccataaatatgtatgtaccttttctacataaaccaaaccatctgttgggagttatacacagaaatacaatatagttgggaagagtctcgttccggtgctttatacttgtagtaaaattaatctgaaccgttgatcgtatttaatcgtagtgttgagatatagttatactcccaccagatttaatgagagtagaaatgtggaggggtatatttgtccagagataataattcgcgtagggtattatgtaatttgtcattatctaactgttcaccctctccctatcctatcctaatcgacgccattcccctccatccctctcctccgtcgtccgttcccctccatccctgcctccgtcgccgtccatctccctcaccgcctctatcgccgatccttctccctcgccgtctccgtcccctccagcaccgccgcctcccttggcctcgccgccttctccgccctctccgtcgccgtcctatcctccgccagtgtcgccttctctgcccccctccgtcgccgtccgcctcccccgccctcgccgccttctccgctccctccgtcgctgtccgtctcccccgccctcaccgcctttcccgccccctacgtcgccgtccgtcggccccaccctctccacctccgacgccgttggcgtctcctcccccttcgatgcccttgcctcccccgccgtcttcctaccctaccctcgccgcctccttcgacgccattaatcgcctccatcgcccgaccatctccctcgccgcgtccatcgcctccagcgccctcacggccctctgccccatccgcctcctccgcctccagcgacctcgggtgtggctgtggcgattcgccggtggtatgcggctgtggcggagcagctatggagctgctcctcgtattttcgttgacgaccaatggtggccctccctgaagttttcatctcccgtgtgagcccctctaaaagcctactctttctcccgattattgcagaaaatggctgctcgttcttcaaaccattgtattgttttttgattattttggttgaattgttaggagcagggtcagtatgcaagacggtggcgtgcgtgaaggggatctgcatgccggcaaaggggttctcggtgtataggtgcgacgtagaagcagatgcacgtgagtgacgcggacagcttactgccatgagtcatcccgaagcgtaaggttttatatactgctccttctcattactattacgaccatgaatagaatgatcgttgttatttggctatcggatttgttgtggctttccatttcatgagccttatgtgtgtgcttcactgtctgtgaccccaacgtagcaaaatctgaactatgaaaattaactcaaaatgcaacaacgtttgggaccaatgaaatactcaaggagtatctaaaatctgtaataagtggaagagagcatagtaaggtaattatatcgtggtttgtagtagtggacagtctttaatcttgttcggttcggacttgatcaaaattcctgctaagtcctgtcgaaatattttcatatccttctgcataatgtaaaggtccaattccctacatgcccctgtaatttcacccaatcccttctacgcccctgaaatttgtttgatctcttatatacccctgaatttttatttggatcccttacgtacccattccattagttgaccattagtttgaccgttagttattgtagaaattactttattgtcattggtatattgttaaaagctagaaacgttttgtgtaaattatttgagttgtgaaaaccaataaggaataatttactaaatatttgttatgaatttttaaaaataaaacattatttcattaaaataaaaaagatttattgtaaaaaaagttctgcataaaatttgaaaattacttttcaacaaatatttagtgaaaaaagattcgttgtgaaaaaataaaggggatgtaattagtttgtcacaaattagaaaacaaatttaaaatttttaaataaatttcagatcaaatttgatgaatttcgtatatcttcccaaaaatttaaacctaaataaaatttagtttttgctcttaattttctggtgaaactaatgtatggatttaatcatattttttaaaaaataaaaaataataagttttattttttaagttgggcattaaatgattatattgcttgtattttgtataagttaatttttttcatatgaaaatttattgagtaggtaccacatatgtataggatgggtaatatagtcgttgtaaaatatttaacggtcaactaatggtcaactaatggagatgggtatagagaagattaaaatgaaaactcatgggtatataaggaatgaggtcaaattcaggggtattgaagggattgagtaaattttcaggagtatataggaattttctctaatgtaaagggagtgcattttaaatggttttcataatgggaagcattggtgcaaaatatgaatagagtttattgtagttgcctgtatttgattttctgggagataagatccactccaatgctccatgaacttaagggtgtataggccacacgagacgctacaagaattgagtcattaggttaacaagttaccataattgaaaaatgtgaatatcatgtggaagagtttacgggtcacccacttgtctccttgctttagcaattttttgactttgttgtattcccatttggtaataacaaaatcaagccaatcatgttttaactgtgggtgttcattctttgtcccgtgtaatcctctctcgatagctagcaggtaggaagttttgtgcaacatcagtatggttaaaacatggcaaaaccaatttgaattgtgcaagtggaagtgtatcacttaccacacgccctagttcgggtcgatgttcattgattggcttggcaagcgaatctagtatttgcacctcacgtcgcttggcattaagaatggctaggtaccagtgtgtttctgtaatattagttgggaggaaaatctgcagatgttcaacagtaagatacattcataaattgtaatagccattacatacatagcttaaataagtattaccatgtcaaatggtagttagtcgcatgccatatctctaatccatcgtttatcacgagggttgttagattcaacatgcgctccctctacattgagtagacctgtttttatggcctgctctaggaaggccttgcgatctcccctgattcctttctctttatctcggagacattggatgtatgcatccatgacctgaatttgaggttagttcagttacattaaaaatatagttataaaaggaaagtaggtttgttaaataggcgaacttacatcatcattcaagtattctggttcaattagtactttcattgatttccgattaaccttcacttcttcaatatgcaccatcactttgttatcctttgtcttattaatgtaggtaatgaaagggtcttcttttttagtcaactcttcaaatgtcgtacaaatttttaatatgtaaacatagaatctatataatagatttatagaaaagtacaatgtttagatattacctttagaattttttatcggtgtctggctgttcgtttttcttttcttttgacctcgtaaggcgttctttggtgggcttttgtgtttttttgataagatcctccttatcgatgtacactacaaaagggtaagtcaaatcagtaatacacaaacatagaaaagaagtaataaaatttaggatgatgtagagagttcatacattcagatattttcttcagtgtttggttgctttgttttctcttcttttcaccctgtaattcgtctgtgtctggcatgatagcttctttttccgttcgcgcttgaaaatgaggaaaattagtaccaatcatgagcatatgtaaggatgaaatagcatagtacctggtgttatttttgttggtgtttgggttctgattatgtcctttttaccccttgattcgtagatgaagtcagtccgatttgttggtttgtatattcttcctgtaggacctataagcctcttgctgctttgattgcactcgttactgtcctcctgttaggtcatgttcacgttagtattatgataagttgtagtaacattagcgagagaattttaatttgccttaccttcgtttcacaagtcgtgtcaacgtttggatttatataggcctcttcgtgatgatttgatacaggctctctgagatcactttgttcttgttcaacatcttgccatagtcaacttttttttatttatccaaaataaaccgttccgctatattttatgagcgattgaccggaaaaccatggttttttaaaatcgacccggtccggacggtcccggattccatatatggattttttttttctgaaattaacataaaaaagaaaaaaatgcatcactccttgtcggcttgcggctgataggagcacatgcggcggtggtcgcgtagcaccctaggtttgcggcagataggggcgtatgcggccgagctctcgtacctcccacggatctcggcaaataggagcggatgcggccgcggtcccatacctcccgtggatctcggtgaataggagtggatgcggcggccgtcccctaccaccagcggctttcggcgctcgcctgccatgggcggcttgcggggagttcattag

SEQ ID NO: 5696 - DNA, 9269 bp, Oryza sativa
agatcggggcacctggtccatcctttttatctgtcaaacctccgcacgatttaggcattgctaatgaactccccgcaagccgcccgtggcaggcaagcgccgcaagccgctggtggtaagggatggccgccgcatctgctcctattcaccgagatccgcaggaggtatgggaccgcggctacatccgctcctattcaccgagatccgcaggaggtacgagacatcggccgcatccgcccctatccgccgcaaacctagggtgctacgtgaccgccgccgcatccactcctatcagcctcaacccgaccaggagcgatgcatttttctcttttttatgttaatttcaggaaaaaaaaatctatatatggaatctgggaccgtccggagcgggtcgattttaaaaaaccatggtttttcggtcaatcgcttatagaatatagcggaacggtttattttagaaaaataaaaaaaagttgactattgtaggatgtggaacaagaacaaagtgatcccagagagcctgtatcaaatcatcacgaagaggcctatataaatccaaacattaacacgacttgtgaaacggaggtaaagtgaattaaaattctctcgctaacgttactacaacttatcataatactaacgtgaacatgacctaacataaggacagtaacgagtgcaatcaaagcaacaagaggcttataggttctacatgaagaacatacaaaccaacaaatcagactaacttcatctacgaatcaaggggtaaaaagaaggacaaaatcagaacccaaacaccaacaaaaataacacagtactatgctatttcatccttacatatgctcatgtgaatggtactaattttcctccttttcaagcgcgaatggaaaaagaagctatcatgccagacagactaattacagggtgaaaagaagaggaaacaaaacaaccaaacaccaaagaaaatatctgaatgtgtgaactctctacatcatcctaaattttattacttctattttatgtttgtgtgttactgatttgacttacccttttgtagtatacatcgataaggatgatcttactaaaaaaaatacacaaaagcccaccaaagaacgccttacgtggtcaaaagaaaagaaagcgaataggcagacaccgataaaaaattctaaaggtaataaacattgtacttttgtatagatctattatagattgtatgtttccatattaataatttgtacgacctttgaagagttgactaaaaaagaagaccatttcattacctacattaataaaacaaaggataacaaagtgatggtgcatattgaaggagtgaaggttaatcggaaatcaatgaaagtactaacagaaccagaatacttgaatgacgatataagttcgcctatttaacaaacctactttccttttataactatatttgtaatgtaactgaactaacctcaaattcatatgatggatgcatacatcagttgcctccgtgataaagagaaaggaatcaggggagatgacaaggccttcctagagtaggcagggctagtcctgacttttcagagccccggtgtgaaactagatataaaggcccttatcatacgatataataataatcaatagatatatatattgaattatggtcataaatatttaaattgcattcatcaataatatttatataggaaacattgaacatttacctcgaaaatttcttctgacatttctagctgcgaagtcattgataatggtaccaatatcaatttcatccaataatttcttctcaatgcataaagttatcaaaccatttaaccttttcttttttataatgtacatgtgtgcagcacaatagtgcagtcagggccttcgtcgattcgtccaactctaggagcaacatcaattgaattaattaaataatcgattttgctatatctcactcgaaagattttttcttatctctcactcgattttctcacttaaatttacagtacattttcttttcttgtaagttataatgtaatttatgaaacttacattgtaacttttgtaagttacagtgtaatttttgaatcttcgcatgtaagttttgaaatttgtattggatttggtctttttcttaaagatatggtaatttagtgtctactatggtgtttcttagttgctttttgccttttactgtgtctattggattttaatctaaagattaaaaatctgtctgatacgatcgtaaaaatcttttaaaagatgcataggtactcccttaaataattaacctaacattcaatcctagggaacaactgcaactgaatcaatttttcacatgtacttatggcaattgggaatttgagatttaggaaattgactcactcacctgaacacaaaacataccactccgagtcctgattcctgaatttactgatcgttctcctcggcagtactcgatggcagcaaagcaatctggaaagcggcaagctgcactgcaagaagcggcggctgcggctgcggctgcggcctgcgggcttgtgtcggcgggacggcgatggcgcgacatcgcgactcgcgtgaggaggagacgaggagggggttagggttttgggcggcgacgcggcaatgtcgctcctcgatcgcgtcttctgatctgatcttctctctctttatgttggctttctctgcgcgaggccgaggggccgaggctgcgccggcttactgttggattgggccgtaagccggtaaataagcccttttgtccctgtatttcggcccattctgccggaaagcaagtgtgccgccgtcgtcgagcttcctcctttctctctctctacaccgtcttcaccaccaccgcgccgccctccccttcggtctgcgccgccacgccaccaccgtggcggggggatgggatgtcatcggccggccgccaccgccggggggagggccgcgcttccctcgctctccttcttcctgcgccggcctctccgcctccacctctcgttccccacatctccggcggccgtcgcgtcgctttctttccaagcagctcgaggagatgatgcatcatcagtatttctgcaaacaccctcggttgctggtggtaggttgaagcatcttgcgatttgtttttcttgtgtgctcaagtgtgattcatggacagctaagccgacgtgttacgttttattaaaatctagggatttcaagctttgttcatcagattgtctgcacaaattatcgagctcttgttgacatagttgccttatgtgctcttgaattcttgtaaagaggctgctacttccacctcaatttgatattctattccgagattttgatgatcaatgctacgaatttataatcgatttatcaatttttgtagttccaaattgatgtttcaatctgaaattcaatgtctgatgcaatgctcaatacgacaatacccattttttggatcagtaatgcaccttactccactgatctagccgtggatgttcagtaatggggggctattatttcactggtatagttgggttacccaactcccaagcatgctcctactggcttaagaatcttaggcattcgttgaatgaaaattataaatctcaactactatatagatgttcagggacatatatagaacacatccaattgaaggtaggctacatatagaaacttcatagtctgctattgtgtatgcatttgctctcccagcactactctccagccataccttgctgacttcctccaaaactgtaaatgccttgcttctttcagctagaaagactcagctcacagtggatgtattgatcacctttaatttaattagcccatgcgcttaccctgaataaatcaactgcaactagacaagtactattagtcgtacagctaaaaattctatttaggcaagatcaaaaaaaaaatctacgtaggccaagagattgagagtagagctatatgacttagcttttaaaaggtttgaggttgccgacttttaactacgaagcatgagccatgtgataggaattactgaataagcgtcatatctcaatacttgactttgactttcataccatcagtttaattaagaccatggactttgataacatagttgacacttaatttgtgcatataaatagctagctagctaactgcacttttacttcctatcaatcgtcagttcaatcatatatatacattctacatgaatgctgtataaataacatatgcagtagtgttcctgagttttaattggcttgtttggtgatgatgatggggcacttcaggatcatagttctaagccttgtgataatagcatcctttcaagtgcttggctctgctgaaggccataagacggctgtaccggcgatcttcgtgttcggggacggcatgctggacgttggcaacaacaactacttgccgtctgacgccccccaggctgactacccctactatggcatcgacttccctggctctgagcccactggaaggttcagtaatggatacaacatggctgacttcattggtaattaagcgacttgatcgatcatattgcccttattatcttttacagttatgtcaccattaaattgtattttctgtgtcatagtttttcatatagttatttgtgaattagatggatgtttgatggttattatacagtcttttttttttgctttagccgaaagattttttaagtgttttcaagcagttagaataaatcgcccacaatatacccaacacgactacaaataattaatgaattaatgctaattggtagtgtggtcgttgctctatactactattgactttcagaagacattagcaaataaaggtagtaatgttattgtagtttgtaaaaaaaaaatgatgaatataaagaaatactaacgacgattcagcatttcataatgtttggtttgcaaatggtatttctttgttacattgatatatatgattctatatttgagaaaggtagtgcatattatcaagtattcttttatttgagaaaaatacccaagttaatttttggtatatgcatgcaactttaattggtgtgtgctatgcatgcagcaaaggatatgggattcaaaatgagccctccagcttatctatcgcttaacagttcgataaaaatggagaccaatttcaccggagtgaactatgcttcagcaggtgctggcattcagatcatcatggtaactccagaatatatgcttaaatgcaaattcaaccataatattaattgtgaatgctgccatggcaatggcatcaagaaatggtgattatatatccaagttggtcatataaacatatttgaattgttgcatatctatatcactaattatcagaagcatgatctttcatgatggttaattaatgattggaaattgcaaatgaaagaagagagtaacatgtgactagatatcttgtcggcattgtaattttcaaaaaatttctgacagtgacataaggaaaattttatatcaatataatatcatctctgactgtcaacttctgatagttcgctgggccatttcatgggcaatctacaattatacatgtcttcgttcaatttgttcgttactctttgctatcaggaaaattatacccaatattatttagtcggtagatcaagagcttattttgactttgtagtaactcaacattttatataggatattgaaatctatgatgaaaagtacctaccacaaactgacgaatttcttggttatactatatatacgcatgctaagaatatgagtgatcagatctgctagcaagatgaaagatcaaagtgttaataaacatttgatggttatttaacagataaaatactgggttttccctggaaataaccttaattgatgctatattgtgaatatgcagaacgatgaagcaacgattccattcgtgtaccaagtgaagaacttcaatgacacggtaagccagatggaggctaacctaggccaccagaagttgagcaagctgttggccaaatctttattcctgataagcattggtaccatggatctgtctgtaaatatatggagagtattaagatattccagaaagccatcaccattcaacattccatatacactttcctcctacaaggccataatcatgcagttgtatggcctgggtgcaaggaagtttgggatcatcaacatccagcccttagggtgtcagccatggatgaggaagaacttggaaaacaatgtcgactgcaatgactccatgaacagtctcgctagggaattcaacgatggcctcaagcccctcttttccaatctcagctctcagctgagtggtctctcctactccatcgccgacttctacgcattctcaaatgccaccttcatgaaccctcgggcttacggtaagtcaatcgaaattattgaacactttttttgtggttgggatagaggatcatgagatggactgtaacacaaaccatggaaatgctacttgtccttgtttatctaatgtatttattgtggttatatcttgtatgtgcagggtttgtgaacatcaacagcacatgctgtattcccccctgcacacctgaacatgaaccaccctgccaaaaccgcaagcagtactggttttgggatctttcttacacgactgagcgggctgctaagctagccgcctctgcattttacgatggccctgcccggttcactgcgccggttaacttcaagcgattgataaagatgaaatgattttataataaagatcttttcgtgttgcaagtccattgacgagtagttgatcaggttttcctgggtgtgtatgtgtgctttccttaattttcatcatcttttttgtatgcctctggattggtaatttggtatatatatgtatgaattccatgctaaggaatgtgtcacaataagttgatcgataagaagaataaacccaactatatataatcgacgtttttgtttcagtgagaagattttgtttttttttttccctagactcctggtttccacaagtttgttaccaacctcccatcatgtcatgtgtggcattcacactgtgatttgggtggatagaataatttgagacgcactcccggatgaatgaaccaacactgccacaatagtaacagactcttcaaacaaagaaaattaaaaagaagaagaattagatatagaaaagataaaaagaaaaaaaaatcttgcgaagcagttaatcagccaaccttacctacactcttctaaactaagtcagtttgactttttttcttagttgaactttttaagtttgattatgtttatagaaaaatatagtaatattttttaacacaaaaaaatattattaaaatatattgaatgttatatttaatgaaactaattcgatgttataaatgttactatcttttttaataaatttggttaaatctaaaaatattttactagagaaaaagtcaaagcaactaataaaatgaaacggaagtaggaaaatattatagcaaagatgaaataaaaggaaaatctttaatctttatctagctcataataataaataaataaatcattaattaataaattcttcggagtttggactcaccaaatcttgttaacgtgtaagacttactgtacttttaagggattgacaatcaaataggcttttctactactcataatggaacaatttactgatcattcattgcacctagaagctagggagatgcacaaagtcacaattacaaagaaccaagtacttcctccgtttcatattataagactttctatcattacccatattcatacgtatgtctaaattcattaaaatcaatatgaatatggacaatgctagaaagttttataacctgaaacggatgtagcagtaacaatcgccaaataaacaggctgcacgttagtgggggaagatagtagggatgggcgtagtcgcccattgggcttgttggccggcctgtctcataaattaatttgagcaggcccaaactgaaaagaccagctttagtgggaaacttaggccatgcccaacgctccaacgtggagcgtgatctcaccccttccaaggagtatatttgtgccagctcggacaggaccgtatcccggtagagcgccgcgacccctgcagagggccggataatttcgtcagcttttcggtgcttttgggcaagaaacaggagaggaaccgcgttggggagatgcttcacctcaagccgtcgccacgcgccgttgctgctcccgcgcggggaagaagatggagagggggtggactagagagaacggtcgcatcgatcccccccccccccacgccggcgcgtcgagaccggccgccactgcgtcgatgggtcagccgccgccgcttcgatcgctgccggggaggggagaggagaggagaggagagctatagaggcgtgaaatggggagggtgttggtggggactggggagaagagggaggaggagagattttatattaatttctagattttagggtgtttagtataaaatttaaacatctatataaattgaaaaattgtgagaactaaaatgaaaaacaccaaggactgaaataaaaatatgaggctaccacctggagaaactagcacagtaggaaattagctttttgagagtgttgccccatcccacgtggcatttgaggggtaccctgcgttggccatgcccttagggtgtgtttgctactggaggttcccaaccaggaacagtgtgcgtggaaaacggagcggtacattagcacgtgattaattaagtattagctatttttttcaaaaatgaattaatatgattttttaagcaactttcatatagaaacattttagaaaaaacgtaccgtttagcaatttgaaaagcatgcgcgcggcaaacgagaggggaaagtgccgaacacacctgcttcaccgaattattaaaagcatcgatccctgacatcatcacacatgacgctccattttctccatctccacttccacgccggcggggcggtgccgcttcctcccttctcccaacctcttcatgccggcgcgattgtggctcctcccctctactcccttcccccatcctccacgctaatgttggcgcctgccctagaatttttacaatttagtacttttgaaaaacttattttacaaataaactcctggaaaaacttatcccataaatggttcttttcagggcaccagagtagatggcgccaacctcctgccaccgtggtggggcggcgctgaggtggcagggggagcgcgccagagtggctgcccccccccccccccccggcc

SEQ ID NO: 5697 - DNA, 10163 bp, Oryza sativa
gaggccccccccccccccaaccccctcccccgcgctatccctgctcttcgttgttttggttttcctatagccccccacctctccccccaccaaaaaaagtagattagattttgaatactcttagccttttttaacctcttttacatcctataaaaaaaataagttagggttttttctgctatattcgagtgtcatttcttaaaacaggcgtaactttctcatacggacttagaatcaggcaaataatatatccacggacatctacagaaaaagttacatccaattctccctggctttgctgagttcagcgagattaaaacctccaaattcagctttcaagattgtgttttcaagacgagaagcttttcggtagagctttggaaaattttacaggtcacatatttcgtccatttgagttaaacttttctacggttggttcttgtgggttcctaagtatgaaaaaaatatcaataaaataaaaataaaaaagttgcacatctctctcatctacactagagaggaaaaattctacaagtcacgtatttcgtccatttgagttcattttttctatggttggttctggtatattcctaaccatgaaaaaatatcaaaataataaaagaaaaataaaaaaaatgcgggggccggggggggcagccacattggcacgctccccctgccacctcagcgccgacctgccacggtggtaggaggacggcgccagcgactctggcgctcaaaaaggaccatttttgggataagtattttcaggtatctatttgcgaaatgattttttgaaaggaccaaattgtgaaaaatccagagcgcttgccccctttgacctttgtatactgatgtcagccttcacgccggtagcatatctcctacgtcctccgagctccacccttggcttcagcacgaagatttgacaatgaagaagacagtggggctgatcatggttggtagcaactagctagcccagaactcctgttttattgattttgatcaagaaagcactttttcttcttaattttgatctactgttttcttgattagttgttgtaagttccttgctccatcaggtcttctagacgtgctggtgataaacatgccatatacatattatatatttaaaattatgagtgattttatagttattaagaagatattgggagacatcatatattttctagggaaaagtccattttacaccctcaaactcttatgcttatccaaaatacaccccaaactataaaaccgaatataatacaccctcaaactttcaataccggacgcttaatcccccgggctgtttttacggtggtttttgacacgtcggatgccacatcagcccttgccacgtcagtccacaacataatatgggccaagcccatattcactctctctccctccctgccctgttcgcgttggcggcggcggcgtggacctgcgagggcggcggctgcggcatcggcatggagctgcgagggcgggacgtggagctgcgaagggcggcggttgcggcgtcggcgtggagctatgagggcagaggctgcggcatcggcgtgcagctgcgagggcataggctgtggcgtcggcgtgtggttgtgagggcggggcgtggagctgcgagggcggtggctgcggcgtcagcgtggagctgcgagggcggcggcgctgccatggtcgcggaggcagtcgccagcgaaaggctctgcacgcagtcgccagcgaggagagtggcaacagcggtggaccttgctgccctgcgcggaagaggcggacctcgccggagccacacgcgtggggaggagtcctcctatggaacgccgccactgcttgatcgaggacgaggtcaagctcaaggccatatctgcatccgccggccgccgccgcctcatcgagcttgagttcctgatccccaagccccatcgcctccgccgaactctacgtccccaagcagctctagcaccaccagcgagttggatttcatggagaagatagctgctcctggaggctgcaggagaggtggaccttgagctcgggctcgccggcagtcggcgcggaaggaaaggctagggatgtgtttgagctccgtcgcctcaaagagtctccaccaccgatctcctactccacgagctcaagaatgccactgccatagctctgggaggaagaaggatagagagagaaagggaagaggagatgagggaagaagaagaagaggtggttgcctccgtggctatggactgacatttggtcctattttttttatttccaccctagacttccacgtcaatgccacataggcgaaaaccagctgaaaaaccactcgagggtgtaaagtgaacggtattgaaagttggagggtgtgaaatatccggttttagagtttgggagtgtattttagacaaaacaaagagttggagggtgtaaaatggacttttccctattttctaggggatgtttagattgtagccaaaataaaccttatgaaactttggcaatagcaaaatttaggcattaacaggatttcttatgtatttaccaaagtttggcaaaactaaacgtgaatattttttttttgatagttttgcaaaaaaaaatagtatggttaaaaatgacatcaatttgaacagcccccaatgtaaaattttgtacctctccctccggtactggaaggtaccaaatttgaccttccaaatttgtactaaattttggtacatcttaataattataaaattcctctaacattatataaataaagtgaacatatttgtcgttcaaccacatatcgagagaattatgcatctctatgttgataacaggtgcatctacttgtgtaaatagggagagagcgtgaaaacgacgaggataaacttatggggtcaagatgagcatcttttctgatctgtttatacctgtggattaggatatattaggtaaattacggtagaatgtgactcggttctgttctagttatctagtagtactttaattattgcacacctagattattattactatgctgcggttctttaattatttagtactccctcggtctaaaatgtctaaaatttaatagtttagaatcggataagacatttctgaacatgtagattattcaaatttgtagttttatgaagtgtcttgtctaatcgaagattcttatatttttctgggatggagagattacttatattttgatactcacaaattcgtaagatttgcttgcctgttacagcgatatatcgttgcatatgttgtttcttgcattttgctcatcctagggagggttatttcacaggactgattatgtgcagtgtctgtggatatacaagagaactttttattattttttgcggaaaattgagttggttatccatttcaaattactccctctgtttcagtttcaggttataatacgttttgactttggtcaaaatcaactactttaagtttaactaactctatagaaaaatgtagtaatatttacaacaccagcatacttttattaaatctataattaaataaattttcataatatgttagtcttgagttaaaaatactattatttttttctaaaaaattagtcaaacttaaactagtttgacttttgacttaacgtcttattacctgaaacggaggaagtacttttttttaaaaaaaaattatctacgtagcatcctaacacacataggctcagaccttcgcttctcctgatctctcatcactcccgcttccatcctgctcgtcgtggtcttggtgttcctcctcccagtcgtcgcaaacgtcgaggaagtagagcgcgcagaccatggcggcgcaggcggcgaacatggggatgggcccgaagagccagaggaagaccgggcaggagaagtagaaggcgcgcgcgccgagcgaccagaagtagctgccgcggttgagcgtcgcggtgacgtagtcgacggcgaggcccgggcggcggcggcgctggatcaggcgcaccggcacgttcacgagggtgctggtgtggctgtagtaccggatggactgcacgttcaggaggaacgccaccaggaagcacaccaggatggcgaagaatttcaccgacagcgccgtctcgcccgcggcgcccaccaccagcggcgcgcccgggaggagcccatcgccgccgccgccgccggcggaggacatgaggatggcgatgagggagctgagcgtgatggccgtggacgccagcagcgtcgacgccatgatgttgttccggatcgtctgcaccgccagcaccgcgtgcttccccgacgcctcctgtatccacccgaaccccgtcactccggcgatctcattctcatctcgctcgccaccaaaaccagatcaagtgtacggacgaacctccatgatgtggcggacccagatgcggcggttgatggcgttgacgccgatgacggtggtcgccgggcggcggcggatgcggaggagcagccatgcgtggtaccccaccatgagcgccatccccagcgggatcagcacgtagtccagctcctccttcctcatcgatctccgcacgcgcgtctcacagcgcacgggagatcgatctcacatccggttgcacgcacgcacgaacgaacagcagctgagattgtcgatcgagtcgatcggatcttgcgagaagcgtggatcgaggaagacgaggaaaatactttcggacgctctcagccaatcccactcatattctctctcttctttgccttttgaattgcatatgcatatgcatttaactttttaagcaagatgtagcctttttttttccaaaaatacttgtccaatcactacgggagaaaccatctttgattggttgcccaaaaacaacaatagtcccggttgcttaaaaaacccgggactaaaaagcatttttagtcccggtttaaaagtgcaatgatctaacactaaccgggactaaagataatcttttttggcacgacgtggcaagtcttctaatatttttaatcccggttggtataaacaactgggagtaaagatcagatctttagtcccggttgtttataccaaccgggactacaaatcagtttcccacatctcgctctctctctttcatcatttctccgtgcgcgcgcatcgatctgagtcctcgtcaccctcttatctcttcctcccctccactctttatctctcccttctcttcctcatctcttcctctttccctctcatctcttcctctccccttcctctcttctcttcctcagatctgcaggagaagcggccggtggtggccgggcccgtgacggggagagacggcggcggccgagcctatgctgggcgggggcggccacggcggcggccgggccatgccgggcgagggcggtggcggccggacctgtgccggggaggggcagcggccgggccgtgccgggcaagggcggcggcggctagggccgtgccagggaggggccgcggcggcggccggggccgagccgtgccgggcggcggcggcggcggccaggcgatggcgggctggggaggtttcggccaggcgtggcagggcgacggccgccaggcggtggctgagcgacggcggcccggcgcggaagaccgcgcggcggaaggattcatggatttctttttcttttttccttctcgttgtgtgaataatgtgaataattgtttgctgattttatctgtgatttgagaatgatgtatgatttgttgttgtggatgatttgggatgttgagatattggtttgttgctgtgaatgatttgggatgtgtgaacaaaatctgtgatttattattttatttgatttggagatatttgcggtagaaaaaaaagaaaaaaaataacttttgtatcggttggtaacttagtctcggttggtgttacaaaccggcactaaaaatctatttttagtcccggttatttcaaccgggactaaaatgaacatctttagtcactataggagggttcccaactgagactaaaaagcgattctccaatagtgaatctaaaatccaattacaccgttttattagttacaattaaatctttacaacaacatctcatatgattaaattacgatgatttttttaaattttatgctgcatatggcgttattaagatgtttcagtaagtattgtatgatgtttctgtacttcgtttgcaaatgttgtacatcatgttatttagatgtttcaataagtattttatcatggttcaataattacatcttggtgttttatatgtgataaaaaatgtttcaatagaattaattatttacatattgtataccacatatgtttttttatgatgtttcactcgttacgactcaatgtttcatgcattgattatgggtgttgcagttagtaattttataatgttgcacccctatgaaacatcttattaagtgggctgaaacatttatccaagtgatgaaaaaacatatataattttatcaaaatataatgatgttagatcttgttgtgaagatttaattgcaacaaacacaatagcataatcagattattgatcggataaatattttaggagaaaaatcctgtatgcatgtacatgagtgggaggtacttgctatactctgctaaagagagaataatagacccacactgacatgtatagaggcaggtgtaggtgcatgcataaagtaagacctccataactagcagacatcggatatttgcaaaatatcgaacgtccgatgcgtagcatccttcggaagacgacgatgacgaggcgcgaggagggatgacgtgagggatggaggctggtttgctttggagttcggaccaggccgggccgagtaggatactctagaaaaggaaaaggtccaatttaactccctcagataaaggttagatctgatttgtatccctcaaccctaaaatcgggtatatcaacccctccaactattaaaaccagtacaaagtcttagcagtattggcagatgtttttgttaatgtggcattttgtccacctctcctttctcgcagtggtcgggccgacggtgacaactggtgggaccaaggcagtgcccgacaaaaaaaagagctaaaggcggcagctacttcctcatagacaagagaggcgatggccccacgtgaggaaaatcagccgggggaggcagagaggatggtggcaaggagcttaggtccggcacaagcgtcaccagtctcaccctagccatggcactcccggcccacaccatcctatcatatctccccatggcgctcacttacctccaccacaacatgcccctccttgaagggacctacacgaggtcaaagctcaccagcgtgcctgagggaagagaggcggtggcggtcaacgatccctggagagccacgaggaggatgggatcccctgtggggaggtggaagatgatgacggtggggaggactagcctcttttctttgtcgtctcttgtcactggaggtgagagcggtggcggtctgctcagcaaggtgagtgctcggcggaggagagagagcaacagcagcgcccaacatccagctccacggcccatctcctccatgatgtcatactccgcggccaccggcagcttcgcgccgcaaccctgttgacttccttctcagctcgacaaccttcttccccgatgacaacaccgacatgcagaaaaagttcagcctgcacgctgctccaccccatgccattcataacccaggtgatgatggtggcctcctcagcttcctccgccattgccgccacttggcctccttgtggggagatggcgacaagcaagtctgcactatttttctggattcttgcgcttgtttctgcgaaagaaagatgaaagatagaggagaagaagagtcggttcgaacatgtgggcccataattttttatgttttccttagggacaattgctcatgccactctgtaccgaagcaatttaaccctagtttttcaattttgctcatttgacccccacttttcaagtaggacatcgaagcacaagttgatgaatttttgggtccgttgcaatgctcacccacaaaataaagggtccatcctaatttcataatagtgtccacctgcaaagtccaagtactccacttatatcattgtgtcctaatgatctcaaacctttgtgtacttcacttgtctcaaatctgtgaaagctatgccaaatttagtataaatatgtcaaaaaggtctgaataaacaaaagactttttatataacatggtcaaatgagcgaggaaaaaataacaatttgccccatagctagcacagttatcttgtcttcatggtatagggtcaaccttgatcttcaaacttgaaaaatggggtcaaacaagtaaagttgaaaaagtgagattatagatgggtagttagccttcagaatagggtaaaatgagcaattatcttttttttaatcacttacatgtaggccccacatctatttttagttcatgtgatgacagagctaccatctggacgccacgctagcaaaaaaccatcctcaaaacaattgagtgagtcatttttgcacggtttgaatagctatgttaaatttattataaatatgtcaaaaagatcttagagtaaattgcatccacgatgcatcaacttggcaggtgggtgcaatttcatacaagaacttgagaaatgagcgttctagtggaacaacttggcagataggtgcaatttagttcaagaactttataagtgatcgcataaatgcaacaacttgcaagatatgtacgattttgatacaataagttaagaagttatgcggtaacttaattatttagagcacttttttatacatattttatttttaagtacttattttgacaacatactagcgtggatttgtatataagcatatttatattatcctaataactaataactaaaagtcaattaaactggaggtagaaattaatatattttggttgagatttgggaaggtgaagaaaacaaaattcttaaaggtaattagatatgcagtataattcttaaagattgaattcaatattataaggtaatatccataggattgctatttaatggcatattgatatcatgagaaaaactcacctagcatatgcttatatgcttagctaagtttatgtatcaaaatattaaattattaagttcttgtactaaaacacacccatttgtcaaattattgcactcgaacgtttaattctcgagttcttacactatatcgcacccacccgccaagttgttgtactatgggtgtaatttataaaaaaaaagggcttttatataagaagaccaaatgagcaagggcaaaaataacaatttgccgcttagctagcacggttatcttccttcacaaaataaggttagccttaatcttcaatttttaaaaatgggatcaaataagtatagttgaaaaggtgagatcagattggtagagcctggtgaatagggtcaaatgagtacttgtttcttttccatatcatttaaatgttcgacccacatttatttttaattcatgtgatgactgagctaccacgtggacgccacatagcgaaaaccactctccaaacagccagtgagtcattttacatggtttaatagtaggatgggtcgatatacccggttttacggttagatatgcaaatattttgaaggagttgagttggacatttttgctttcccgaatgggagaagagttaatttgatattggcccggcccaagattttgtaagctcgtacggtagctctgatgatgatgttaattgacagatgcacaaggatgaagtatggactgtatggtttcagtgagatgtcaagcaagcgcattattggctgtaaattattttaattttttcttatgttattatgcctctttcatttaacgatgggttcatttggatatatagaccaggatacccaaatgcatagggaaatagacgttgtaatggtaaagcatgttacttttatggggcaattgctttgtttgaccatgttttgaagcacaactaccaatttgaccttttttttaaggtttgcttatttgacccagtttttcaaaattgaagccaccgtctaaacctgttttcactggtgcgctagggtttcggttagggaaataaagaaaataaatttgctatcgcgaactaaccaaaatacccttgattatacaaaacatatc

SEQ ID NO: 5698 - DNA, 18827 bp, Oryza sativa
  unsure (1)..(18827): unsure at all n locations
cgatggcggtgcaggcgcacggattgaggcgggagggagggtgttaacgactaaacctggttaatcatagactgtacttgggtttttttttgcatcaacagaggggtggcaccgacgcacggtgatgcgaggaggagtagcggtggctactgcgtggacagtggcggcggcgcaagcgcgcagagtgatgagggagggaggggcggcgccgacgcggagagagaggaagtagcggcgcgcggcggtggttgcttcatggacaacagcgatgacgcaagcacacggagtgaggagggagggtgggatggcgccggcggagagagagagaggaaggagcggtggtggctgcgcagacggcagaggggcgctgttgtcgtgcagaggaaggaggagcgatgttggtcgtggtgggagcagtggcagtggcacggcggtggttgctgctcatgtgtgccgcccctctccctccctcctcactccatgatttctatgatatgaattcgtggtttgttggagctgttgtagggacatgaatattagtggtttgtaggatatgaatttgctgttggagctctcaaatctatcaaagctatgtcaaatttgttataaatgttttaaaaagattcaaattaaaaaactttgatataaacatagtcaaatgagcaagggaaaaaggacatctggcccgtaagttaacaccgttagttggacttcacggaataaggtcaactctgatcttcatttttgaaaaaggatcaaataaacaaacctagaaaaatagggtcaaattgatagttacgtttcgagatagggtcaaataagcaattatccctacttttatagcaaagcaaatttcgatccgtatcaccaaaatgtataactgaccttaggctagcaagctgacactgatctagacgcgtatggttatttgtacataataaaaggttagttgtacacttgtacaaagtcaataggagtctatacgggacagcatcatatgggtccaaccaaattaacaacgcttaccagcaaattgtgggcattctattgtttcttctaattttcgaaattctgtaaatagcatgtgcataatcctgtcaaccattttttaaaaaaaaacaagacaaattactacataagttcatggttttaactatagtacaccgtaaaaagtaaagttacactctctaaatgtgataattacctagtggacaccactcccattatttcagtgtgttcgggctgatgacacatgagagggcccactttttgacacggcgcgatcaagttacccctattgtatatttagactaactggatccgtcaaccctttagagccctatgtcgccaccccaaccatatatatgctctattttgacattgccaccatgacccgttcatcatccctgacccactaggaatagggatgcaagggtgatctcgtgctaggagtggaattggcttgcagcaatggctacactgttgtcagagcagggcgtggaatctgttacgaagctggtgaatctaaaatgggtgtccaaagggtaggctcgatttttctttgttttgattcgattgggatgcatggtttgttgatttcgttgagttgagttcttttcttgatgtacttgcaatggggtagaaggctagatttgcctggccagcgtcagttgtcgagattggtttggcttaggacattgtcggagatatgggcccgagggtatgcaaagtgaggggaagttaccttcacatccagccgcgtggctctacagcctggccctacccccgcacctcgcgagtcacagaggcggccggggggcctcggggtgccacgtcatgcccctcaggccctcgcgctgcccctccccgaggccctcgcccaactaccatgtggtggggggagcaagcggggaggagacccaggctgaacggccatcaatgcgcggcgccccaactgtccctcaccgcgtttaatgcggtaagggcggacgtgcggtgccgcctgactgacccacgtcaatcgggtgtgaccagtctgtgaccggcctgttgtcggccacgtccgattggacgggtggccgtgcccccacgtcgcctctgtatccggcggagtggaggtaggtatgtcccgtcccattggggcgtcatccggggttccctccacgcgaggaggactgccacaagtcttcactcatttaagagggaatgatagggctgtcccccgtggcaggcggggggcggcgccgggtcccactaaaggacggactgccgcttagcttccgggcgaaggcacggatcgtggtccggtcaaggtaaagtgggtccctctcccgtaaaagagtaggtaggagcggcgcatgtggtatccccttgaactataaaaggaggaccttgcccgccgaaaaagggggacaactcccagcaggcctgagctttagagggagcagaccaagagcactctccagagttggggaacccttgtaacactcaatcataaatcccacacacaagagtagggtattacgctctatagcggcccgaacctgtataatcttggcacccatacgcgatctagaaaccctgagggcggatacacgatctcgagaggtgaaccctttcccccggctgaactcaaaaaggaggatctcacgatctcccgctagagaggatcattcctcgacagctggcgcgccaggtagggggaattcgcgtgcttcaaagagaagttattttcttctgccccaagttttcctccgccttcgacgatcatggtcgaggtcttggaggaggaagtggtggtgcacacccccactccctccgggagtgaggatgctagcgggagccgcggcccccgtcaccaccgccgcaactctcggactccgccccgccgcgacccctcgcggagggaggatcccacccggtcgggtggctcggccctctccccgcctccgggcggggggaagccatggcgcatcggagcgcgacgtcgcctgacatacggtgacggtggctcgccccgaggcgcgcttcaggcggcaggagcccttctacggcatcctcccgtgaactcggagccagagacccccgtccagcgatggttggacgacgtggccaacctggtcaccactgcctagcggcagctggccgcaggtggccggcccaccaccactagtacgtcgcgtacccccaccaccctctcctcgtcagcaaggaggagggcccgtcggtcggccacggcctcgaggcggtccacggccccaacgtcgtcaggggcctcaggaagtcggaggcatcacgatggcctctacggggagcaggatgcttaagcgacgccgggacgagcgccgtgctgcccgcatgggagaaggcgcctccttgttcggagtgccgcattcctcctcgcgaggcggtccgccccccacgttcacccctggagggactagttgtagggccttcgttgcgagtcttgggaatgtccggtggcccccgaagtttcgccccaacctcacggagaagtataatggcagcatcaatccctccgagttcctccatatctataccacaatcatcgtggcagcatcggggggggggggacgaccgggtcatggcgaattatttccccatggctcttaagggtcaagcgcgcggctagctgatgacccagccccctgactccatccactcctgggaggacctgtgccagcagttcattacaaacttccaggtcacgtacccccacccaggagaggaggcggacctgcatgctgtgcagcggaaggacgatgagtccctctgctcgtatatacagcgcttctgccaggtccgcaacactattacgtgcattccggcccacgcggtcgtttatgcgtttcggaacggcgtgcggcacaaccgcatgctggagaaaattgcctccaaggagcccaagaccatcaccgagctcttcgaactagcagacaaggtggctcggaaggaggaggtgtgggcctggaactcccccggcaccggcgcggcggctgcggctgcccccgagtccgctccccactctaagcggcgagataggagggggaaaaggaagccggtccgctctgatgacgagggccacgtccttgcggccgatgggccctcacgggccccgcgcaaggaaaaagccaccggcgacaggccgagctccaccgctacatccggcgagggtcggtcggcagacaagtggtgctcggtgcacaacaactaatcggacagcctttgccgattgcccgttggtcaagaccttggccgagggtttcggaaagccgataaggaaaaccggcagggtcaacgggagggcaaagcccccgcggagccctgccaatgaccggcgaggggaggccaagaagaaggcccccgccgatgacgatgatgacagcaaggatctggaattccagatacctaggggaccgtcgccaccctcgacgggggtgcttgcgctcacacctcccgccgtggcttcaaggccatgagacgtgagcttctggctgcagtcccgactcacgaggcaacacgaaaggcgcgctggttggaggtgaagctcaccttcgaccagagcgaccatccgacagtgctcgctcggggagggaagttggccctcgtggtctccccgaccatccacaacatcaagatgaagcgtgtcctggtcgacaggagggctagcctcagcatcatctccccggctgcctttgacacgctcaaggcccaagggatgaagctccagccgtcactgccgatcatcggcataacctcggggcacacgtggcctctgggtcacgttgagctcccggtaaccttcggcgactccactaacttccgcaccaagcggatcgacttcgatgtggcggacctcaatctgccctacaacgcggtcttgggcagacctgctttggtgaagttcatggccgccacccactacgcctaactccagatgaagatgccgggccccagcggccccatcaccgtcttcggcgatgtcagggtcgctctcgcctgcgcggagtagcgcgccgacaacctggcggcagccatggagccgcaggtcccggaggcctccgcgtcctgcgcctccaagaagcgcctcacctcggccgacgaggtgccagtcaaggagattccccttggcgatgatccgtccaagacagccaaaattggcggtaccttggacgccaaataggaaagcgcgctcgtctccttcctgcgggcaaactccgacgtcttcgcgtggaagccgtcggatatgcccggggtccccagggaggtgatcgagcaccacctcgccgtgcggctggacgcgcgacccatccggcagaaggtacggcgccaaaccccggagcggcaagccttcatccgagaggagctgacgcggctcatggaggccggcttcatccgagaggtcatccacctagagtggctggcaaacctggtggttgtcccgaaggccaacggcaagctccggatgtgcatcgactacacggaccttaacaaggcatgccctaaggatcccttccctttaccacgcatagatcaaatagtcgactccacttcagggtgcgaccttttgtcttttatggatgcctactctaggtatcaccagatccgtatggctagggaagatgaggaaaaaaaatgctttcattactcctgtaggcacattttgttatacaactatgccttttcatctcaagaacgcatgtcctacttttcagcgcatgactcgcattactttgagtaatcaaatagggcgcaatgtagaggcgtatgtcgatgacctggtggtaaagacgcgccaccaggagatgttattataggacttggctgagactttcgacagccttaggtcaacgcgcatgaaactgaaccccgaaaagtgtgtgttcggtgtgccgacgggcaaactcctcggttttctagtctcctcctgaggcatagaagctaatcccgagtaaatacgcacgatagagaggatgcgtccccccagcaaacttagggatgtgcagtgcgtcacgagatgcatggtcgccctaagtcgattcatatcaacgctgggagagagggcgttgcccctattcaagctcctcaaacgccctaggccatttgtgtggacggaggaggaggagcaagctctcaatcagttgaaagcttacctcacttccccccacctatcctggtggccctagggccagaggaaccgttgctactctacttggctgcgaccccccacgcggtgagtgccacccttgtagtggagcgtggcgaaggtgacccgcgtcacgagcccggctatggcaagggaccaggggcccccatgactggcgatggaccctcgtctcccgacggctcgttgcccgaagccccccaaaccccgggagggccccgaggcccccgggggaggaagggaggctctggcgggtggccccgacgcctataatcctgacatggcccgagatacccccgaggcccctaagcacgggcaccccggaccggctgctcctaacaacaaggaccggccccaccgaaaggtgcagcggcccgtctacttcgtcagcgaggcactccgaaacgcgaaaacacgatatccacaggcccagaagatgctttacgcagtcttaatggcctcaaggaaactgcgccactacttccaagcgcatcgggtttccgtcgtgatgtcttaccctctcagccaaatcttgcacaaccgagaaggtactggtcgggtcgaaaagtgggccatcgagctcgctgagttcgaccttcacttcgaaccacggcacgcgataaaaagccaggttctggctgatttcatcacggagtggaccccggtggacgaccctgttgcatccaatgccccccccctcctcggagatggaggagacccaaacgccaacattcgcgccgggcactgggttatgcacttcgacggctccctcaaccttcaaggtgcaggggccggagtcacgcttacctcgccaagcggggacgtcctccagtacgtcgttcggctcgatttccgagccacgaacaatatggcggaatacaaaggactcctagcgggattgagggcggcggccggaatgggcatccgccgcctcctggtcctaggcgattcccagctggtcataaatcaagtctccaaggagtaccagtgcaccgacccgcaaatggacgcttacgtccgcgaagtgcgacgtatggaatgccacttcgacgggctcaagctccggcacgtaacccgacgcgacaacgcagtcgctgacgagttgtcacacatcgcatcagcacgagccccactctccccggggaccttcgaggaaaggctcgcacaaccgtcgttgcggttggacccccccccccccccgagggacccggcgccacggtctctgccccaatccccgacgacccatgggcctcggggcccaagggggtcggtcccgaccctcctagtcaggttgtttggatgactgacatccaggcatatctcgacgataatactcttcctgaggatcgcgcagaagctgaaaagctcgcgcgtatctctaagcggtatgtgctcgtagaagggactctaccgacgcggcgccaacgggatactcttgaagtatatttctcgggagcaatgcgtcgagctcattgccgacgttcatcagggtgagtgcggggcccattcggcctcacgcacattggttggtaaagccttccgacaaggtttttactggccgatcgccttgcaagatgcccaagaatgggtcaagcgatgcaaggcgtgccagttccacgccaagcaaacccactagccggcccaggccttgcaggtcatcccgctctcttggcctttcacggtctaggggctagacatcctaggacccttcaaagcggcccgaggcgggtatcagcacctgtacgtcgccatcgacaagttcaccaagtttcccgaggcttacccagttgtcaagatcgacaagcattccgccctcaagttctcaggggcatcacatcccgattcggagtgcccaaccgtatcattacggataacggcacccagttcactagagagctgtttggcgactattgcgacgacatgggcatcaagctgtgcttcgcctcgcccacccaccccaagagcaacggccaagtcaagcgagccaacgccaaaatcctcaaaggcctcaagaccaagacatacaacgtcctaaagaagcacggggattcgtggctcgaggaactgcccgcggtactatgggcgaatcggacaactccgagtcgcgccacgggataaatgccctttttcctagtgtatggtgccgaggcggtcctaccttccgagctttccttgggttcgcatcgtgtcgcgctgtacgatgaggccaaccaggatgatcttcgccgcgacgatctcgactatttggaagagcggagaaggcgtgcagccctgcgagcggcgccctaccagcaaagcctgcggcgctaccatcagcgccatgtccaagcccgatcactgcaagtcgacgacctcgtcctgcaccgcttacagtcgcgcttggggctgagcaagctctcaccgatgtgggaatggccatacaaagtgatcggcgttccccggccgggctccgttcggctaaccacggaggacggcacggagttgcctaacccctggaatatcgaacacctccgccgtttctatccatagagttgcgcgtcttttgctttcctagagctcgggccaacccccgcgcatcctttggcttgtgctggcttggccgggggctaccactgttaaatatgttgtatcttttcccctccccatcaataaatttttccgcttaagcggaggccgttgcacgccttttcttactctttcctatggctcgtcctggttcaaaggacgatttgcgcttactccagaacctacgtggcgttgggtgacctgaaaaccgccgaaagggagcctaaacacgggccgcggcgaaccctgggggctcagaagggcctacacacggccatccccgacccccggtcgtcgtagcctcggtctggccagacccgctgggtagctccctcggggcgacggccttgcccctcgccacttaggtcccgcggatcgagcgcgaatttcccttttcaccggaacgagcccgagggggggtataaagtgggtaagagcggcaacttaatcactagaaagtcaattgaatacgttagctttggtttttcttctttccttgccgcagacattcaaaggagaaagcaagaacataaaggagcgaaggggaagctttatttacaaacaggatggcacgatggcctaaagtttgaagcgttcaccgcgagcacataacaaaataaaagaagaaaagcggagatagtcacggagtgctcgggcccccgagtccggcgccgctgaccacctcgtcccagtcctcgccgccgtcatcaccaccatcgacctttctcccgctctcctcgttcaaggcaagtacgaggttgaaccaaggggccgacccctcgaagttggagacgattgcgtcggccgcctcccggactcgctcctgagccctcgccttggtccccggggggcagtcctcgagcgcgtgccacgggaggaagtcggggtcgcgagcttggtgactcgtgaggaccagctccaccgtagcccgcgccaaagaagccgacgatgacttcacggcctcgccgacctcctcctccagcctctccaaatctgccgccatcccgtccagccggaacgcaagtgccggctgtgtaggcgggagcttcctgtcctggcgcacggagatgcctacccggcatcccgcgcgctccagctgttcgacggcgtcggagagttggccaggtctaatctcgttggtgaggcggagggccacgatctccccggcttggtcctgcaccaggcgccccaggtcggcgagagtgctttgagccgcggtgagttggcttaccaactccgcgccgctgggctgcccgcctgccaccagctctttctcgcggcctccagctcggaagccctcgccgccatcgccgcgcgctcagcgcgggcgctttccagatgccgagcttcgcgcccgcaacggcctcctcgcgcttcgcgagttgctcgcccagccggcgtgccgccacctcgcggcggttcacctcagcctcgcgtacggcaagcacggcgttccgttcccggcacgcctcctctcgaagccgcagctcctccgcgcaacgagccaccaaaagcctctgcggcgagggtggtccggttgcgctcggcagcggcctcctcacggaggtggagggaggactccgcctcggccgccgttctctcgtgggcggccaaagtggtctcgcgctggtctagcatgggcgcccactcctccagtgcccgggtacgctcctccagcacccgagcatgctcctccacccccgggctcgctgcgcctgttcctagctgcgcccgtcctgttcgcgctggttgcggtcgaggacctcgatccgtcgatggatcgtggcctcgaactcctgcgcggagcgggcacgctcgtccaaggccttacgctcggcctcgagcaccgccgaccgagcccgcaacaaggcatcgacctccgatgcccgcctctcttgggcggcagccgcgtcgaggactccacgggcgtcttcaaccctcttcaccagatcctcggcgtgggcctcgtactgcaggcggatgtcgcccagcacctcatccaggacgctcgaagcgatgagcgccgcctgccgctcctcctccatctcccgcatgactgagtccagcgtctcttcgcgcgcctggatctccgccagttgggcttgatgcattttgtgccccacctccaccatgtcgtccacagcgcggcgcccctcgtcaacccacgcgcggtccgccgcgagctgcgcccactccgcctccagggccgcccgctcgtccgccagggcttgaacttgggcattgagcccctcccggacggtggagtcggcggcagcgagcacctgcaggagtggctccatgctcgcaggagtcggagaagaaaaagtcgcggtccgcccccgggatgacggagtgctattgaaacccccgcgggactgggggctgctctcggcccccttctacgtggccagccccgagggtgccccagatgcagaggggaacggttgcccccgtcccccccgcctcgagccctcgggctgactcggcctcggcctcgggttcgggcccgcccccagcctcggcctctgggccacgacctgctttggcctccactcccgagtggcgctcctcgtgggtcgcgccctcgggatcgccccccgggggggcgccaccgccgctgccatcacctgtggctggctgcacctcggctgtggcggactcggagccagacccagcgtgtggcccgtgggccccgccagggtactgcgaaggccccatagcaccgagtcggccgggtcccggtcatccggtcgctcgaattttgacccctgcgagggatcagacgccgcgaccctctgggaaggaatcccgctaccggagaaccctgatcacgttaagaaagaaaagaagggggaaaagcaagaggccaaggtggatagagagcacctagtcgggtgctagcgatcgtacctgcgaggggggcatttgaaggtctacttcaagggcccgatgaaactcccccggcacggctccgtttgccctatctttcgaagccgcttcttcttccatccagcctcggacgtggcggggcgtttgtggcccgttggtggtcggtccgccgttcgctcggcgccccctctgcgcaggggagaaggcggccgagattcggacacctttcgcttcccgttcgggttgctggccaggcccccccccccgggtccacggctcggactgggcgccctggagccgccgcccccgccagagacctgcggtcgcgccgcagctacccgcgccatcgccgccaccaccggcgccgccccggcgggaccgacccctgccagcaccgatggccgacatcacaaccaggatactctcccggtcgcggtcgctgcagagggcgaggatcccgtccggaatcagcgtttgctcaccacccgccggatcaccgtcttcgcttcctccttgccccagtcccaacgctcacccacgtgggtgcgaatgggatcgttgtgcccaatgtactcccacgcgccgtgggaccgctcctggagaggcgcgatgcgacggcggaagtagtcgccgaacaccatcgcccccattaggccctggcttcgcaggcccctgaggcgataccgcacagcgtcgtactcctcgcctagttccgaaaccgctaaccacgcggcggatcgttcgggagggccggcgaggagccgaagtcgcggatgatccggcagcgcggtgtagaaccaatccttcttccaatcctcccacttgttgtggaggtggctctcaatgtactgccccgctgttcctggccagggctggaagtagcatcctcccaccaccgcgccttgcagcagctgtgggacgaagaaggactggaacagccgcatcgtcggccgcaccccgacgaacatctcgcacaagtgcgcgaagatggccagtgtcatcacggcgttgggtgtgagatgcaaggcatgaatttcgtagaaatccaaaaccttatggaagaacctggagaatggcaggatcaaccccaccatggcgaaggacaggaggtgcacggatcgctctgggtaccgcggccgcggccgtgactcccccaccatcatggcggcgtcctccggcatgatcttgcggatgaggctaaggtgcctctctgccgtgatgcgcgacaccgggagcacaacgtcactagcgtcttgggccatgatgaccggcggggaaacggcgaggagtttggtgtacggaatagcgtggagcgagagaagcgttagggcttgaggagcgagtgtgcgggcgagcagtcggcgagaggaaggggacgaaatctccgcctccctatccttttatccccgcctcgaccgcgctcgcctcctcgtttcacgccctcgcggttgcctcctcgattcctacacctgcggttgcctcatcgtttctcgcgtccactcatcacatcgcccattgaacccacgccccgcgtttagtgcgcctgtcagcggcacactcggcgcggggcgtgcgatgttcacgggcgcgattaggcgggcccgccgtcggtcccatcgcatgcctggcaggtaggggagtcgaggcggcatgggtgacgattctgggcatggccaggtcgaccccctgattttcgcgccctaggcgcccccatcatcagcgcggttaatggcggtcaaatcgccattatggctaatgcgccagcctggccgctcagcggcaaccatctgggttccccgccgggcccacaacctcggcacgggaagtcgtgaggcgccacgtcagactgccctcagggggccaatgtccgacgcggtgccgggggctactatcggagatatgggcccgggggtatgcaaagtgaggggaagttaccttcacatccagccgcgtggctctacagcctagccctacccctacacctcgcgagtcgcagaggcggccggggggcctcggggtgccacgtcatgcccctcgggccctcgcgctgccttgccccgaggccctcgcccaactgccatgtggcggggggagcaagcggggaggagacccaggctgaacgaccatcaatgcgcggcgccccaactgtccctcaccgcgtttaatgcggtaagggcgaacgtgcggtgccactagactgacccacgtcaatcgggtgtgaccagtctgtgaccggcctgttgccggccacgtccgattggacgggcggccgtgcccccacgtcgcctctgtattcggcggagtggaggtaggtatgtcccgtcccatcggggcgtcatctggggttccctccacgcgaggaccgccacaagtcttcactcatttaagaggaaattatagggctgtcccccgtggcaggcggggggcggcgccggatcccactaaaggacgaactgccgcttagcttccgggcgaaggcacggatcgtggtccggtcaaggtaaagtgggtccctctcccataaaagagtaggtaggagcggcgcatgtggtatccccttgaactataaaaggaggaccttgcccgctgaaaaagggggacgactcccagcaggcctgagctttagagggagcagaccaatagcactctccagagttggggaacccttgtaacactcaatcataaatcccacacacaggagtaggatattacgctctatagcggcccgaacctgtataatcttggcgcccatacgcgatctggaaaccctgagggtggatacacgatctcgagaggcgaacccttttccccggctgaactcaaaaagggggatctcacgatctcccgctagagaggatcactcctcgacagacatgtttgagccagaccatctcaatttgagccggatacgcttacacaatttttacaatttgaccctttgaaaaaactatttttacaaatgaacctccgccaaaacttatttcaaaaataacccttttttcagcgccaaatcatgtggcgctgaacttagacatctcagcgccaaatagtgtggcgctgaatgtgcgttggcacgctgacttagcctcccatccgcgatggcacggcattcagcgccagtagacgtggcgctaaggtgtcaagttcagcgccagatgatgtggcgctgaaaaaaatgttatttttaaaataagtttggcggcggttcatttgtaaaaatagtttttttaaagggtcaaattgtcaaaatgtgtgatacacttagggccaacttggtcaccctatgtcaaaaaataggccctctcacacgttgttagcacaaatacagtaaaataataggcacaatgttcattagctaattaccacattaatagtgttttcccctataatgttactcttgcgatgtcctaaaggtaaaactagaaagcctcaagattctaaatgaaacattgactatgtatataattaactagactccggtcctcaaaaagcgcataactccataaatatatattctagaggtacatatctcatccttgaaaacaagtagaacatcaataattacactactggtaccacacacgtctcacataagttcataatctggcaaaatatatattgcaaaccatatatatagtggaaacatgtaaactacatattgttgaatcaaaatgcaaaatttgctacatgacacttaaaaacttattatctttgctggtagacgtcgtaagaatgtgattttttcctaatgacacttcgaaagcgtggtaatttgccataggacaccgagcgcataaaaatacaatatccacccaattgatgagagaaaaactatgtaaaatgtttgttttgccctcatcttcttctcccttctcatcttcttctcccttctcctggtcttcttccgacaataggcatcggcggtggagctatcatggacctctgccttacttccctcgcaggacatgatggttattgccgagatctacatgagatgcgcggtgaggttcttggtgtcgatcagagcggccgcctccacgcgggtgctggcgaaccgtctgggccaatcgaggaatctctcaacgacgagcgacatgttggggaaaggcggtgaggtagaccggcgaggcggcactgcgggcaaagctacacaggtggaatccaccagtggcgcgacggaagtattggcgaagcaggcagggtccggcggcggtgagaacatgagcgtgcagtggtagctcaggaagtgcagcgcgacaagcagcaggagtataacgagcaggaggactatagcggtggccgctggggtgatgaggaaaaggtagtgggagtggttgttagcgggaggagagggggcggtgccgctactggtggtggcgggggcaaggaggagtccacaagggcaaacttgtttcttatgaattttctctttttgtttccatcaaatataataaaataatacgttgagtatacgactaattaccatatttctatggtatccacgaactaacatactttctttagataatgtcacgtagcaaagaccatgatattttatatcatgcagcaaattttaccgaatcaaactagatgcctactccctccgttttaaaaaaagacaaaccctggtttccgtgcccaacgtttgaccatccgtcttatttgaaaaaattatgaaaaaaattaaaaagacaagtcacgcataaaatattaatcatgttttattatctagcaacaatgaaaatatgaattataaaaaaaattcatataaaacggacagttaaaattggacacggaaatccatagtttgcctttttttagacggagggagtaatatttatccacttcaccttagcacacacatgagtagtcggtgccagggaaagagacgatgggagatgccttctgccgataacgatgcttttttttttccgaaaatgaggtgcgcctggtttgcgtgtcagccggtccgtcactgatgtgtacttaccttccgtttttgtgttaaacagacaagatggcagccatccttgctgcccatggactcagcctgcctgatacacactcagagtgcacagctccttttgccttggtgttgcgttggtcggcccacgttttccttttacaagaagcgaaaataaaagaaaaaaatgagcacctctcctgcagcaagcgaaaatagagaaagaagaaaacgagcaatttcccggaagctagagagagagaaatgaagcagaaagaataaaaacacaatcccctgattagaagtcacttcattaggccatgggcgtttctaggccttcaaatatatcagcgccatctcgtttcacttacgtttttttttaaaattacgcagtacaacgcagtcactcacaacacgcaaccctacccctatgagcatcttctaagactgggccggcatgtcacgcacaggcacctaactgttgacaggtacgtcatctaccactgaaagcataacgcgcaaaccctacccctatgagcatcttcgaagactgggccggcaagtcaccacaggcacctcgctgtcgacgggtacgtcgcctaccactgaaagcataacgccgttaaatcctggaaaattcgctcctatggggagtcgaacccaggacctcaggtgctactgaggctcttgtaaccactaggttacaggcactttccctcgtttcacttacgtttatatatacatgcatcaaattttgtattttaaaacttaagatttaagttgatttttttcttttttccatcgtagattttttttatagtatctgcttttacatcatatgcctatataaaatttctgaaatcttggaccaaattaatcacatagtccttgccaagaaagagtgcatgtcgtttgctgcttgaactgttcatctgttacttaacatgttatatgtccgcaagctggtgttaaagtgcctatatttgtggctctttgcatgtgcctatgtcctagtaatatggttgctaaaactaatgagaatatttctttttatgataaaagagttagttacatctatccattgttttgggaccacaactagagaggttttcatgcttttcaaaattattcgtaaacgaataattggttcatattcgatctatgtgtgcgtccatatgttacaaattaagcgatttttcttttcaatatggcttgacaggatttgattttttttttcttttcaatatgcaatgtgtcaatttttacgtggaaacaccggttcttttaggtaggaggttttttcttaactaagacatgtggcttttttacatgagagaaatacagtggttgagaaagaactggaatgaaggggttctatttttttttattagtagagaactctgagatacacaaccggatactagtattcatattcatgttcgcatatctgaaaaacgaaaacgtgaaccatttcaattctcactgccatgtttggctcgaatctctcgacttgatctgcacgttcatgctcattcaggatgcaggaggaggaagcaaagcatcctgtgcaacacggcaacgccggatccgtgcaaaaccaaacaaaaagcatccatccatccatccatccatggcagatttggcaggcctgcacagagcagagcagtaaaaaagaaaggagagtgcagtcaaaagctctcctctcctttcctgaacgggaaggcacagaaggcgtaggacagtcggaaggccaccacatctgcatgccattctcgtcattctcattctccctccaccgtggggcccacccatcacccctaacctaaccgccgtcgattcagggaggtggacggccaggatggaggcggcgcctcccacgacgcgcgtggtgcaggttcagagcagcagcagcagcaggtgtggcctccacattattaattcctcctctcctctcctctccttcctataagagagaggaggtggaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5699 - DNA, 1551 bp, Oryza sativa
gtgagagataaaataagtttcatcttgatgaaatcttatctacactgtttccaatacagtttctcttgcatgttctacctacgaaacaacaaaaacaaaaccacatgtatcgtatgagctattttaattctcaattaaatgctttgttgcttatgtggcactactggaaacatgcaaatgatacttcctcagtcccatattatatgggattaggggttaaaagcgtgtctcaaaatataagggatcaggtaggtagagtactaatacaaacagacatcgggcagggagagtactaatgcgaacagagagctgtcggtggaatttgtccctaccttatcctctcaccgagtcacccatcgaccaccgcttgttcccctcccgattttctttgccttttctctatcccctccatcagcgcctccctcccacccgcatcttcttccacctccccccatccatccgagctccttcccttccacctcccatccgtcgacgccaacgccggtggtgcggcagccaacggtggcggccaagggcggcggccaacctggcccatgcgccaccgccaccggtgcccaacctggcccgtgcggtgggggcaccgccggggaagcgaatcgaggtggtgagggagcgggagaacacacttctcttgttcggccgggccgccacgcacgccgccgtcgccttcgttgagttcaacgtccatgtatatatatacagcgtagccgagttcgatgtgtatgcttccatttccatgttgttggtagtacctgtgtttgttttggactttgcattggatgtcagtttacgctttggattgtttgattttgacaccgcagcaacgcaatgcaagatttggaagctagcgtgggtatgacttggatgtagccattgattggtgtggtactggacatgaaatttgcagcaacgttctagccagtgaactatatgggataagcctcacaagtaggagtatcaatttaattgactcttgtcaacatgtgcattaatgtcattgtatactgagaaatgcttactctgtctttgtgccaatcatttgctggcaagcttgtaaacccaaatattctctcactactaatgcccagtactaaggactggtttggtttgtggtctaaattggcattaccaatttttatcaatgtcacattttgtcaacttttggcatggctaattttggtaaaggtaaaattgtgtttggattgaagccaaaatagcctaaattaactgttgaaatggcatattttcttaggcatgccaaaatttagctccaaaccaaatagacaataaacactattgaagttgacaaatattggtaaggccaatttaggcctcaaaccaaaccagccataagtaaatgaggggtacatgtgtcttttgccagcctccttattttggatgaatagtgcccagtcccatataatgtgggatggagggagtacctcccactgagaatgacctaacaataacacctttgatttgatttggaagctatgtatcagcaaaaaccaaggtttgaattgaattaca

SEQ ID NO: 5700 - DNA, 789 bp, Oryza sativa
gccctacatcctgttggccgaagccggtgctgctctttattcatctggatcacacaaatacaataattgggataatctatctatccatcgtcgacttggcggctatataaccaactcgtagtcgatgacagggtaatcttcctcctcgaatctgtactcggcgagaacagagatggcgctagatacctcttgccggcccatgtaggtgccggatagggcatggctaggctaatctctgatgttgatatacaacggcgtattggcttgtattggcttgtggctttgtagattgtggtgggtgtgtcccctctcctcctagggggcttgtatttatacccacaggtgaccccttgtccaagtagaactagggagataaatatggatacgatctgagtagtgagtagtccttgtcgtttctatgtagaactcttcttctccttccttatccggaactccttctatatacgaggttttttttccgtataagacatggcatgtggtgggccttgccgagcttagtcgattactattgggtatccataaccctgacagtaaaaacttcttaacaatgcatgcaaaaatgtattcttgagtaattaaaggtctatatttaaagaatatgacaaaattaaatatatattaccataatattggttacaaatataataattctttttttaagtagatatgattaaggttcaaggggaaaatttctattgccccttaataaatgaggatgtttgtgagtgatggtggttaagagtaagatgaattgaatgaaaattgatt

SEQ ID NO: 5701 - DNA, 2903 bp, Oryza sativa
cacattcaacattagcaactactccctccgtaaaaaaaaaaagacaaaccctgggtttccgtgtccaacgtttaaccgtccgtcttatttaaaaaaatatgaaaaaaattaaaaagataagtcacgcatagagtattaattatgttttatcatctaacaacaataaaaatattaattataaaaaaatttcatataagacggacagtcaaacgttggacatggaaactcatgtttgtcttttttttttagacggaaggagtagtaatcgacaacagaggtggtagtatgaagtttctggatgtagtactcgtttgagaagttttctgacgtttgtttggtcgatttgagtggtgcaggcgtgagcctttgaaatttggaataaccacgagcaatttaattaatccggtcattccaccaggaagacttgaaatttaattgtacgatatcctaattaaaacgaggaaaaagaaataatctcagcgcacaaatttagaaaagatcaccccggccctgaactattataaaattatggaaatcaatgtcaacatcagacactattttactcaaaaccgtacgcttttcaatgttaacaccgaatttatagtggtttagatgatgtgaagatgacgtacttaaaaaacaaatctagaactagatgtgatacattattaataataatattattattatcatcaactactactactatttcctctataagagtatatatattatagaaaaaaaaattggtaggagaaacaaaatataataagagaaaaaatgtttaaaactaaataaatgtatcttcttaggttaacaaactttattttcaaaacatagtaaaaacatagatgcttgtatacacacactcatccctatggatataagtaagcacatcatattcgtatgagcacatttgagagacttgactgatattaataaagtcaccatggacatattgttgtttatatgtatgtcgcttatcactttataagaatagttagctgaaatattccaattttgcagcaggcaagatttttttaatgaatttatgaaattaaaaataccattgtagtgatatgattctttttggatttcataaatcaataagtgaacttaaaaaagtcacaaaacaattctgcattgagcagttgattatatattataaccaggataagttcagtttacaattgaatagtttgaatgcaattgtcttaaacaccattttctggttcaattgaatttatttttctcacacaaaatttatctaggtagttgtcagggttatggataccacatacctaatagtagttgactaaatctcggcaggacccaccacataccatgtcttatacgggaactgactccggatatggagggagtttcggataaggaaagacaaccagagttctacatggaaacgacaagaactactcggattgtatccatattggttttcctagttctacttggacaaggggacatctatggttataaatacaagccctcctaggaggagagggatgacaatcaacacacgaccacctcaatcaacatacacagaggatcaacacccaacacaattgacatagaagccacaacatagaagcctacatatgcaagacacgccgccggatatcgactttagggataagcacggctagtaccctacggtgtctccagatactgtcaggagagacgaaagcgctatctctgatctcgccgggcacggattcgaggagaaaggctaccctgttgtcgactacgagtcagatcgtcagaccgccatgtcgacaacagttagataggctaccccaaacattatactggtgtgattatcatgaataagagcaataccagctttggccaataggatgtagggttattacctgacaattcaggggcccgaacctgtataaaaatccctgtctccatctcttttacctcagtctcgcgtatatcctagcaccgatgatccccatactgtccaaataccgtagtcgagacatcaaatgtcgacagtagtaaatactcctccgtgcaaacaatacttttttgaagaaaaaaagttcattttactccctataaagaatattttaccagagcacttaaacctatatactaatcttcagctaagaactattgaaactgatccactttactccataactctatttctctgcttttttctctttatataacttatattttgcactgaaattcagtaggatgaataaatgcattacaacttacctatcaatatttttttacataggttgaaattacgtaaggctgatctaaacatagatattttaaaattcaagcaaatagccatgaaaaaaattgagaatataaaacttgagaatggtatcatctttttatggcttaaaatatttcatcttaaaataacttgtataaagaaaaaaaatataaatactattaagatgtaggcacctaagatgtaaggtggaccgatgtgatagtttagaagtaaaataaacaaaaagttacatgattaagtgaattggagggagtaaaaatgtaaaatggatttttttatgaacttgttgaagtttttgtctactattagaaataaaagaaaaactcaagattgaaatatgaatgattcagtgggttagagttaaacagtatcggatattaaagttcaaatcgacttattttcttggatttctatgaaagcgaatggttgtaattcaattcaaactttggtttttgcttgatacatagcttccaaatcaaatcaaaaggtgttattgttaggtcattctcagtgggaggtactccctccatcccacattatatgggactgggcactattcatccaaaataaggaggctggcaaaagacacatgtacccctcatttacttatggctggtttggt

SEQ ID NO: 5702 - DNA, 968 bp, Oryza sativa
tcagcccgcagtggcacgagcggctcgagttcgccgtgcacgacccggccgccatgcacgccgaggcgctcgacgtctcgctctaccacgaccgccgcttcaacccttccggcggcggcggcggcggtggcgggaagaaccacttcctcggccgcgtgcgcatctacgggtcgcagttctcgcggcgaggggaggaggggatcgtgtacttcccgctcgagaagcggagcttgctcagctggatccgcggcgaggttggcctcaagatttactactacgacgaggcgccgccgccgccggaggataggccgccggagggtggtggtggtgacaacgcgccgccgcctgaggtcccgcctgaggcgcccagggacctcccggacatccccgcgccgaccgaggccgccgtcgaggtgcagcagccgccggtgcatccccctgtcatcatcgtggaagaggcgccgccgccgatgcatcacccgatgatgccgccgatgcacggcccgcacggcccgatgatgccgccggcggtgcacgggccgcacgggccaatggcgccgccgatgcatcagcatcagcatccgcagccgcagccggagccggagcctgaaccggagccggacggcggcgaggcggggtacccgcccgaggtgcgcaagacgcggatggccacggagcgcgtccgcatcgcgcgccacctgagcggcgggttggggccggagtactacgccacctcgccgcgcgtcatctccgggcggttcgtgtccaccggcgacgccgtcgagccggtgcagtcgtcgtacgacctggtggagccgatgcgctacctgttcgtccgcgtcgtgaaggtgcgcggcatccgcgcctgcgaggggccgtacgtgaagatccaggccggcccgcacacgctccggtcgcgccccggccgcgacgtttccggcaccggcaacccggagtggaaccaggtg

SEQ ID NO: 5703 - DNA, 3254 bp, Oryza sativa
gttatgttcttttaaaaaaataaagaagaagtctgatactaattgctatcatgataatgacgggatggtaaaggtccactttgccttgggtgcctcagccatgagtcatctgatattctttccctcaaacaccatccaaaaacactgaacaggtagtactgatgccctgctactgaagagcctctctgaagtatttctagaatcctaaatagtactactctttggtgaaaaatactttcttttttgggggcaaaactctacaaaattgaaggcacaaaattggtttatatttgtaaatgagcaattttacggtccttgagaagataccatgaggtactaaaaatttagtataaaatttggtacctcataaaatctagatattaagaggtataaaatttacaataaaaaaagtggtaccttatagtatcttatcaagaactgtaaaattgttcatttgtgaatatacccaaaaaaatgtgaattcattcactccaatgcccccggtatgattaatgccatgaataatctagcaacacaattacaccaaggtatacctgtgtgatacatgcaaaccacaccttttattttgcaagattatgcgaaattacataggtaaatgcaaaccatatttctgacctgtgtaatttattactactatatgtaacttccttatagaatgaaattgtgtgttagaagtagattgttcatttcaagtatgcttatggtatccgttattctgacttgtcaaaatggcatcatctccttagagaaaagcttatttcctttgttaaaggttaacatcaaagcggttctatcatatggtccatggcttattcctcatgcatttatgcatcaacgaaatcaccaaagttttcatgatatcataaaggtcaagtgaagtccatgcactcaagtgaccagaaatttttggacctgcctaagatcagcaaatctagtgaagccatgctgttgacatgtgagattaaggtcactctccaaagtccattctactccttttcttcctttcttgacacaaccattaatctcgtgctctgcttttgtccatggcttgttgtgttcctaacttattgttcttggccacttggttccattcagagaggagtagtttgcactcacaaagtgaagtgacaatcttctttgaagggttaggacatgatcacctgttaagtgagattctgtcttgacttgtgagcagagcaaagcagcaggagcagagcttcacttgatttgcctcctctctggtgaagcagagatgaactccccaaattatcatttcaaaagtggcaaatcaccacttcaactatatatataataatgttcaaattgtggtgtatacatgcttatgaataaagtcgaattttcttctttatttttcttctatccaccgattttctccctatatcgcacgctcgttattacaccagaacgaaaaccgattgagctcagagcatcctgtcggagaggctgggcagccgccggaagaagttgacggccgccggcggcatggggtcccggaacatcgggtggcggaggtagtagaacccgccggcgacggccaccatcttggacggcatggcgtacagcgcgacggcgacggcgaggcagacgccgacgaagatccggctggcgcgcgggtccctccagctcaccagcgcctgcaccctctccccctgcgccgcgacgtcgcccatgacgcgctgcacccgccccgccagcgtccgcagcctctcgtagcgcgcccggagcacctccggcggcggcacggcgtcgaactcctcctccaggtcgtcggcctccaccgtgtcggcctgcgacagccgcgcgtccatgccggcggggccgcgcggccggaaccggtagtaccagacgccgatgaggaagacgtagagcgacgccgtgggcacggccagctccgggtaccagacgaggacgaggtagaggacgtgaacgagcacggtggtgggcgggctgcgccaccgctgcacgctgtcgagccaccgcgcgagcccgacggcccaggcgagcacccccatgatgcggaaccagttcgccttggcgcgccgcacgctccacgtgtgcgcgtccacgtcgagcatgtggcgcaccacctcccgccccagcggcggctcggaccgctccagccacgcggcgacgacgcgcacggcggcggcgcgcagcgcctcatgctgcgcgacgccgatcgggcggaggtagtgcatccgcggcagcagcggcgaggtgtaggtggcccaggtgtccggcaggtgcgccggcgacgtgaaccgcacggcgagctgcacctcccccatcttcttagccccgaccggagcagcacgagcagcgggtacgacgccgtgtacgcccggttgctctccagcgtggacacgcgcacccgcaccttcccgatccggtagtcctgccgctgctcgtccccggcgccggcgaaggcgaacatccgccagttgtcgaacaccgccaccgtgagcaccgtgcacgggtcgtacacctgccacgtgtactgctcgttccaccgcgggttgaggctgtccgtgacggtgcgcgtccgcacccacttcttgccgtacttggccacgcagtaggcgtccgtcgaccccttggcgccgcccttcgtcttcatcggcagcagcccgcacgccccgatgatgcccagctccagcacgcccaccggcggcctccacagctgcttcgccgtcggccggtagtcgctgcacacgtgcgccgcctcgtcgagcacgtggtaccctccttccaggcacagacggaggtgaagccggccggagtagaaccccggcgggccgccgccgggaccaatgccgatgtcggaggtgccaccctcgaggctgaaccacctcgacgcgacgagttgccgctcgtggagacgctgctcgacggagttgacggggatggtggcgtgtccgagcagcgccggctccttgatcatggagcggtcctcgacgaggacgacgaggctctcgtcgagcggctcggacacgacgaacatgaggtcctcctcccacgcgaacgccgagccgctgctcctgctcgccaccgaccgccgcgtcctcgccgactggaacccgacctggatcttgacgcgcacgtcgaacggcagccccggcggcggcgccggcacgcgcaggtcctgcgcctcgatcaccgacgcgcgcaggtaccagagcttgggcgactggtacaccttggagcgcgtgtac

SEQ ID NO: 5704 - DNA, 2827 bp, Oryza sativa
ctcatggattggatgctttttttgcttttggacgctgcggcggcagctgctactatcatactatggtagctagagtgcgtgcttttggagggagaatctgggcaaagagtgagaggaggaggaagatggatggcggctttcttggcctggaagctcacgatcgctttggtgctcgatcgatggcgcagaatctgatctgcttgcttgctttttttctttcgagtatgtgtgcaggtgatgccggtgtgatctgaattgtcgccgactcgtcgtcttgctgctgctgccgctgcttcttcttcccgccttttttcacctgcgttcccaacagaggcggttaaataacttccaccaaccgcgcgcggcgccggaaaggaaaaaaagaagagattttacacgtgtcatctctcatctgtcctgtgttgtatccttctcggaggattttgatagtattttccttagaagttctaacttttctgttaaatcaaatgtttgaacgtatacataaaacataaaatatgaaaaaaaaaaccaattatacagtttacatgtaaagtgcgtgacgaatcttttgagactaattacatcatgatttgataatgtggtaataacggattaattagtcttaatatatttgtctcgcagtttacaggtagaatttataatttattttgctattagtttacatttaatacttgaaatatgtgttcgtatactttaattttttttaaatggaactaacacggcccttgtgctttgctgcacgctgcacggggaatgcccgaccttttcaggttctcgcctctttggggtaaacgtatctgtttcttccaagagagttaagagtatatatatatatgagtatatatatatatatactactatgccccgttccctaattttttttccaaaaacatcacatcgaatctttggacacatgtataaagcattaaatatagataaatgaaaaaactaattgcacagttagggaaaaataacgagacgaatcttttgagcctaattagtctatgattagccataagtgctacagtaacctagtgctaatgccagattaattaggctcaaaagattcatctcgtggtttctatgcgagttatgaaattatttttttcattcgtgtccgaaaagtccttccgacatccgatcaaacatccgatgtgatatctaaaaattttctttccgcgaactaaacagaccctgtgtacacagtacacgttgcaggggtgcagagttctctgcttttcttgtagattcagtgagatctatgcgtcgtctttgggcaggattaccgattacacatttacacccaatcgtcaaatggccacgtgcaccaaactagaagaagtagaagaagaactctgtttcttttgctcaaaattgcgcaacatcctcaagatgttgttcgacgagacgacggcgagcttaaatcacgagatagctgagtatctccagttctccacgtcgcagagcaaaattagacccatccccaacaaaacacgtgcgtatcatccaggtatacacggtgtatacttagcgtggcactcaggctatctatgtggaatgtggtgccctgttcggtactccacgtggcttgcttatactggtgccacgtaagcactgaatgagaaaggcgttattttttttcctgattcctacttatgcattttctttctttcaaaataaaatcactttgcttatttcatttcccgcatataattccctaatattttagccttttttaagtcgttggttaaattttactcttatcccgattgttcacatttgttccgtcttaatgaatatcttcctacattcgccccgagatctagacaagaaattattgagcacatgagccactggcccaccgcccaagatctttctacgggtagtctaaccaccacctcacatgtgttcctctaccctctattctccagtggtttcgcccttaaccattctatcatagtcatagttatttttttcttctcaaatatttccatgtgggcacaccgtgtgcttctgctcctcggttgcttgtcgtctcctgatacatttatactttgtttctttttcctctttccctctgtcacttttgtctcgaatgcctcatgatcatttagaccttacaacccttattgtcactaacgtgcatagaggttttaatagccttaccattattgtcttgccacctttgtcactcatgcctaggctacctttatcccaacctccttaaggatactaatgatgtcaactatgttgactaatttctctttttattacttaaaagtgtagtcattcatcttccccttccctccctcacttcgtgtgcagtgcatactgcatactctcgcataaaaaatagaaaattccccagataaatagttgttagttaaaaaaattcccattctttaggctagatccattcccagtgatatagccaaaagtatcagaatttaggtattgctaaaactatagaagacaaaagatgaagcatagtcaaccctacatacaacgaatcaaaatgttaagggttcgacccattttctcgaagaaaccttggaatgaaccgcaatgtcgattgcttagctcattttctctagaaaatcttttttttttgaaaaagaaaagttgcctatccatttctactcattgaaacgggggaaaatatgtagtgcaaaccatatatacagtggaaactaccgttgaatcgaaaaatagacgtccgagattcgtccacgtcaccatgagttaaaatttaactcgcagattcactcatgagttaaaattttactaggaggggctgcaggaa

SEQ ID NO: 5705 - DNA, 1507 bp, Oryza sativa
tcggacgtccatttctcgatccaacggtagtttccaagttttcactacatatgtggtttgcactacatatttttccttgaaacggcttacataaagttcttaaaacccagaaaatcacatgatgtacagtgatgatacacaatggttctcaactttttctttttctgttccaaactaggctagcccacgacggtcaacgtaatgcacaatacccggagatgctcgatcgtctaggaagggaggcatacgtatcctggtgtcgatcttgagattgctacgaccgctggtggtgaaaggcagaatttattctatctgcgtcacaaaagtcacaggccagctatgccgacggcgtcctcctcctcatgctcctgtagagtcatagaatgattagattggatagattgtgggcgagtaaggcctgtttaagtttccaaaaacttttttcaaaaacatcacattaaatctttgacacatatataaagcattaaatatagataaaaaaaattaattgcatagtttgcatgtaaatcgcgaaacgaatcttttgagcctaattaggccatgattagccattagtactacagtaacatatgtgctaatgctggattaattaggctcaaaagattcatctcgcggtttccaggtgagttatgaaattagttttttcattcgtgtccgaaaaccccttccaacatccggtcaaacgtccgatgtgatacccaaaaattttcatttcaccaactaaacaggccctaaaacagtactctagaacggagatgatgatatctactactccctccgtcccataatataagagattttaacattttgcttttattgtttgatcactcgtcttattaaaaaaatttgtgtaaatataaaaaaataaaaaattgtgcttaaagtactttagataataaagaaagtcacaaataaaattaataataattccaaatattttttggaataagatgaatggtcaaatagtgtgtcggagaatgaactcctccaccagggaaccgtgaggcccccctttgtgagttcggccggggcagcgggtgagattcgaggatttggtgagcgaaactgtgtggtcttgagggggttagccccctccaagacgatcagatcaaagaggtttatacaagttcgggccgctatgaagcgtaataccctactcctgtacatgattgattgaatgtagaacacaagtgcttgaggttgtgagacccaagcgccagttcgccccctcgtcccccctccaccactaggcctggacctccttttatacctcaaggggttaccacatgggcccaacaacctaacctagctctggtggagaagtattataatctttgcattaaatgcatgtcttgtctcttgacttgggaagccaagcacgcgtcgtcttgatgatggggcctgtcaaatcttgccgcctgacacggggggtgcccctgtcagtcaccatttaatggataaagacttctgggctcctattaaccgg

SEQ ID NO: 5706 - DNA, 6444 bp, Oryza sativa
ctacctcggacccgacccctctcggggaagggccacgtagcattggagggcagcctcctccatccagtctctgggaaggagtggccgccgtcctacctcgggcctgactcccctcggggaagggccacatggcatcgggggacagcctcctccgactagtctttggggaaggagtggccgccaccccacctcgggcctgactcccctcgggggagggccacgtggcatcggggggcagcctcctccctctaaacctgatacccccggatccatatcaccgacatagtgcaagaaaaaaatcaaaatccttatattttatatcatgagacggagggagtagtagcttgcaacgaactaaagcagtgacgtggccacgctcctgtaccgctgactatgctcaaccttggcaacgccgtcgacaaacagctgggtttatgtgacgacgcagacgtcacgccaagataattgtgcgatattgagccaccgtgccgccactacttgaaaaaagttatttgcaggcaagccaaatccatctttacgtacgggtattctgtctgtaaggaaacgcctatgaagatagataaataattttttagacggtagattcacccgactacgaaaatattttcagtgaaaaaaaaatgccgctgccggcgtgtgacaccctgaaaatttcaaatctagattacgggaacaaaattcaggattatcaaaaaacttttctaaaatccgtcacgctggattttatctcccattttctgttgcacttggaccacaaggacaaaaatctacggacaaaatctattttagattcaaatattatttattaaaagaaccatgattatgaaatgtattaattaagaaaatatttgtaaatacaattatctttctgaaatcccttttctatgaattagaacctatttgatgtatttgttttataaataaaaacaaatactagatattagaaaacatcattgtaagggataattccctggaaaactatttttacaatgaaggctaatgttaactaacctctgaaaatctagaagttaactattttggagttgttttacaaataaaaactagaggaaatttactagtgaaaccctatttgcgaactaaaatttttaaagaattcatttcaaaagattcacggaaaagtctagtttttcctccttgaaaggcctagcccaacacgcataatgagatttgtgttaattgtgtgcatttatatgtttgtgccaaagatctccgttaatccattcttgtgaatcccaatccttgttgggattcctccagattcgaattccacagttcgatcctcctcctaagttaataccctcctcgagcaaattattcgggcatctgcaaatactcgaacccagtgattttctggaaacgcctctcagtgtaatatccgttctctgttcctcctcaactccactagacggttacagtaccccgtcttttccttgaaccgtcagaataacacagataaatcgatccacctaaagagtgttcccccaaaccgacatccttccttaccctctctttcccccgtttgtcttgtcaagcacttcgatgttaaactgatcgaagtcccaaaattctttcatttgccacaataccatttctttccccgaacccttggaaccttgcgatcgaatcaaaacccgcttcatcttttcgactcagcctccctcagattcccttctttcctattttccctctactcgaaatccccgagttcggtctttcgcttgaaaccactaaagttgctcggcagatctaattgtcgtgcgtcgacccgtatattctcaattctatttctacctttgaaccccaccatgacgaatggatttgtatgccataaaccgctcctaaacccatagtcgatattgtccctacctttgaaacactaccgcgtccgatggatttgcatgcccaagcgtcgcttctaaaaatcccatcatatcgtcgtcaatttattcaagtggtcgcaaagaaaccctaagtcaaatacttgggcgactaaatggccgaatcacttccaatccaaaccccagttacaatttcagctcaaagtcaaaagtccagttatacagtccatttataaggcgcccagttatacatacaaaagtccagttatagagtcccgccttatatatgtttgtggagtgatgcaccgcattgatatatcttgttatttttttagtgaattttaaaaacatgaaaaaacgagatatgtgccctcaagagacaaatagactttctgtatttaacttgtttaaaacctaacaacctgaaattaaacgtttcatttatttccctttaattcgaagtttccaacattctctaagccttagatatacaccctccatcctaaaaagattagcttctgatccttagaagttgattttttcctttttacggaacattacacatcaatgcctcatcaaatttagccttacatatttataaagtaatctatcccatattaatggacgtgactacacagctagtggtagctggtttgtctaaatcatctaccacttcatctataagagatactatccacctatacttcaaatacaattttctcttaaactactcatccaatctacgatccgattacaccgttgtgttcgtaataattaaatctttacaacaagatctcacatgattatattttgatgaaaaatcacaaattacttttatgatatgtctaaattatttttagatttcactaagttacttcttagaaatacaaaagtaaattcagtaaagcttaaaagtaatttacatatgaagtaacttataaaaaaagtaactttaattaatacattttttcattgaacaaattatcatatatatataagttacttttagatttgattaaaatacttcctatacatttataatgctctgaggtgattacttttattattgtttttagttaattccataatttgtgctgattaatttaatttctagatagagtcatgtttttatctctacaacggatttacttcaaatggcatgccaaagttaccttcgttttgttctaagttacttctataatatatgtaaattacttttaagctttactgaatttacttttatatgtctaagaagtaacttagtgaaatataaaagtaatgtagacatatcataaaagtaatttgtgatttttcatcaaatataatcatgtgagatcttgttgtaaagatttaattgttgcgaacacaatggtgtaatcggatcgtagatcggatgaatagtttaagagaaaatttcataagaagaaaaaaatgcacaacctaatagaaaaactacttgcatgcatgtctgtaacgctactggtacttctcacgtaattgtctgcgtcgctcgttaagtctaaatcaagatgcctctcgaaatagattttgcgtatattaatatattttatttttaaatttgtcataagctactccaactccaagtagcttatgtgtgagaagagcccgttgacagccctaccatgaacaacctcggcatcgggggaaagttgacgtcgacgagcccctccagggccttcaccaccatccccatggtcggcctcgcgctctccgcgtcctgcacgcaccagcacgccaccttgcacgccctctccacctctcccatgtcgacctccccgcccagattgccgtccaccgcgtccctgaggtcgccgtcgccgtcgaacagcatcctcaccgccgtcaacgggaagaagtccgcctccaccgtgccgccggcgccgctgtcgtactcgtcgtcgtcggccgcctccgcctgccgccgccgctgctccacgttcctcctcccggatacgatctcgaacagcatcatcccgtagctgtacacgtccgccttcgccgtgaccgccgtgccggcgatccactccggcgccaggtaccccacggtcccgcgcgtcgtcgtcagcacgcggctggagtcgtcgcggcccatgagcttggcgagccccaagtcggcgaccttggcggcgaacgcgccgtcgaggaggatgttctccggcttgacgtcgcagtggatgatgcggtccctgcacttgtcgtgcaggtagtgcagccctctcgcgacgcccagggcgatctggtacctcgtcttccagctcaggacgccgccgccatggccggagccggagccgaagaggtgcctgtccagcgagccgttgggcatgtgctcgtacacgagcagcctccgtgttcggtcggtgcagaagccgagcagcctgatcaggttgacgtgctggatcatgccgatggtgctcacctccgcgcggaactgcttctcgccctgaccaacgccctcgagcttcttcaccgccaccggcgtcgcgtcccccggcagcgcgcccttgaacaccgacccgaaggcgccgccgccgatcttgtcggagaagttgttggtcacgagctgcaggtcacggtacgtgaacaccgtcaagaaggaggaggagtcctccagtctccgcaacgccttcgcccttttgcttctcatgacgagcaccgcgaccagaacggcgagggtcactgcggcggcgacaactccggcgacgacgagtccgatggtcattttcttggtgttcccggtgccggacaagtcggacgccacgccgaggcggatcgaaattctgtagccgtcggtgccggagccgttcgcgccccgaggttgatgaggtcgccgtaccagagcgtgcagctgccgttgtaggagtaggcggtgcaggagcagttgccgaggcacgcgagctcgcagtcgtcgtgagcgctcgcggtcgcggacggcgcggccacgccgccggtgggcagactgttcgccttgggcatcgtgaagaacgtgtcgtcgcgcttcgtcgtcttgcccgacgcctggccgccgccgccgcacggcatctgcaggccggtgatccgggcgcagccagcggttggtcgccgtacagccactgccgcggctgccgctccacgaatccctggaggcagccgcactccggcacagagccgtcggtgcagacgctgaaggagccgcagagcgagtagacgtcgcacagcgtgggctctgaccagaagagcacccaggtggcggcggactccacccacccccacagcatgatctgccccgccactcccacgacgatccgcgacaacagggcctcgtccttgacttcgaagacgacgtagctctcgttctcggcgtcgacgtagaggaaggtgtacggcgactgaccttcaggtcccgattcctccggcgcggtcgtccagttgccgccgccgcctctccagtactggtggctccgttccaggcgagccgcaggtgctggctcgcgccgccgccgccggcgtcgagctcgagggagaacatgcccggggtcgggtcgttggaacctttccaccgaccaggcgtgtcgcctcgccggtgagcttgttccggcggagcttgctgccggggagccacgtgttgtccaggtggtcgaagctctgccacagcacggcggaggtgttggacgcgtcggcaaggacaaggttgccggtgttgaggatgacaccgaccgtggagttggcggcggcggcgatgccggtgatgttggtggaccagaccggtgacctggtggcgcggtcgaggaggaccatgttgccgtcgctcgagatggagagctgcgacgattccgggtcggtgagtggggcctgcctgttggcaacccacagcttggtgtgttctcgggttttgtggtaccagatgcccatgtaccaacgctgcaaggcgttatctgttacgattacgaacaaggaaatggttaggtgatacttctacctaataaattaagggttaattagatttatgccacataaaattcatgtgttgtaattatgcctatgatcttttgcaaattactgtccattgattttttttatatatatatagatttggagcttcaaatcttacatatagttttcaactaatggatacagtccgttttgaagaaaataaccgaaaaagagacaaattaaacatgtcaaaatcataaatctaaagaaaaaaacagttgcaaaatttaattttggtgctctataaccaagtgtaagtacaaactgaatctacatgaatacaaatttttatgcaaaatcctactaacgaaaaattgaaagataggagtaaaaaatctctcacaagtgaaatagcaaactgcttgtaaaaaatgatatttatgcttctatgaccattaattttgaccaaattaccccctttttttcatctcctctactacccattctttcctgaggtttgctccggttcaacaaaaagtaccttgaggtaccggtacctcgcaataccaaaacattttcgatcgttggatctagctgtgcaggatgggcattgctagatccaacaatcggaaat

SEQ ID NO: 5707 - DNA, 14871 bp, Oryza sativa
ggagcaaaccacttttttcagcctcgtctccatgagtagccgcctgtagcggtgtctcatcaccccttccctgatacgcttgtccacgggaagccgccaccacagacaaccccaacagcaataaggtaggcatttctggttatgtacatggatattcctctctctaggctcatattattttttatgaaataaaattgaatcaattatattcgtattcaaaagtagttatgattatgcttttataacataagacataagtgatatcctaatagaataattgtcggtcaaactcttaccctgacaaaacaaaatatgccatctatttttctatagtggaatttattttggcctttacttcaacaagctatagccaattagtaaagagattgaataacgaacgactacgagttgcaaaatcatagtttgattaaaaacaagaaaactactttaaaataccatctcaaaggcagggattttttttatctatggttggtgagaatatgcataaccattatttcttcacaatggtttacatgtagcatgtagttgtctttctcaaattcaaaaacaaaatctctgaaatcagcaaccggtcattgtgttgatcgaattgtgcacacatcactgccggcagctgacgtcgaaccaaagtaaaagataacatcggagaatacttagctataaacaatgattcacccaatcttctcatcaccatatccatcaaagccaatccgacgaaaacttagccacctagaatgccaaaccacatagagtctctaatatgacgtatctaagaaggtcatgacatgtaggatgtcgtcatcactatttcgtccatctggaactaggtttttaccggtggcgaatctaggaatttttttaagcccaggcaaacctaatgatgagtaaaaagtacacttaaatccatataactatgtagactatttagtatacgcatatgtaaaattttcaattgtcgagttctaaattaaggagaagaaaaccaatgtacgaaattatattgatgaaatgatggtcatgcattgttgatggattagattatagtcttgtattatcttaaaatgaaaaatatgatgatgaatgttacagttaagctgatccacttatctgacttatatttgaactagtaaataaattaagaacgtaattacctactacgcaactgcatgcaggtgaatgtctgaaccctgtgactaagcaagataactatgtactgcttagggcattttcaatggtagagacgagtatggtctcttaaacaatacaagattactaagagaccatgtctttacaatagttgagacgacaaaggctctaatcattaactcaaaaaatattccttttattaatattctttctatttttttaccctcatgcaaccatatttccatattatagtgattaagagtcgttgttaagccgttgtcatgcataacaacgatgttttgtctctcccctttctctttcttccatgtcaacaagtattcctaattagcaacgctaagagaccactattgacaaccattatacatgcccttattgcactatatatagtgcactgaatgcagcaaaatgatggtaacaagtactactgatcacttgattcatgcagcgaagcccaggcaactgcccatgctagcctggcattggctctgccgctagtttttacagagagcttatccgacacgaagtgaggaaatggaagtcaacaacatcatcttctttaggaaggagtgtggcacccacaggtgtcacagatgtcgatactcctagcgttgatgacccggtcctaggtctacggtaatctaattaagctcgaccttctatgtcgtggctggtgacaggaggaaaggggcgaggcacatgcgccaacaacatcttgtcctaccatcttcattgattcgaagaggctaacaatagcgatggtatatagggtggaggcctccttcagcccagatggttactctagtagtgtctcaagaagacgtacttgttgtggaggccaaatctggctagaccttgccactgccttcctcgagagccatcgtcgcattctcgtctagggcaaaaaaataggtaggaagtatattatatataaaaagtttaatgcttgtgtcggtgggacacatgcatgcacgacaactagataccccataaattaaatgccgctcgaatttatcaattttatggctggactattattttgcaaaaaaaaaaaaggattttgggaccatataattgtcaatatccaaatccacatgagaaagtgtagtttaaacttgaataaaatctgaaatccagatgtctaccttgttacttttgtgaccgacggtaattttcaaacttgaattaataacctgaaatgcaacaggtcaaagtgtgtaatattacaaaataatgcaagtcaaactaatcggtccacatgattaagaattgaacatcgtgaaattaatgaacacgcagatgcagctacgagtgactgcaaaagcgaaaaatttgacttccgttgtgaactctgaactcttcttccgttgtgaacaaattttgagtatttgtttgtaattgtacgtctttgtctttgaatttttcaatacaatggaacaagacaaacttttatgggtgaaacagttcgagtgaccaacatttcattgtagtcggtggaaaaaaaaggctcggtgactcgttttttttaaaaaaaaaaagttctgaatgatcttttttaaagtggaaattatttaattttgaatgaaaattgttttcactgcggctcgttaataagaaaaatctcaaatgacagagaagaatataataaactatataaaagttcgaaaaaagctcaataaaaatatggccaaacttttttttcccaatccagtgcactgtacaatgtgtacatacgtatatttcattgtataattaattagtccaatcaattgatgcagcttcgccgattaagctttaatttgtatcattcggaaaaataaaactgtagatgtggtggtgaagtagtggtgcgtgatttcatccatcagggtttaaattctaattcttacgaatattacgcatatatatgtgcaagtaattttttaacagaaatttagtaagattaaaaatgtacagctactaataaacttttacctctttgagtatgtgttaggacattttcgtaggtgtgtgagcatggggttgcgtatgtagtgatggtgtgtgcgtacatctaccatgtaaatagttcgaataaaaaaagtaggttaaactgttaactgacactccgcccgattggcaacaaccaatcaggcaaaagaaacaagtaaacaacacacgaacataagggagctagcaaagcgtcgctgaccgcgatcgagacacgatcgatcagggggtaaccgaactgatgaagtgatgatcaggaggcgaggaagaggtagcttagctgctataggtacctggctggaagaagcctaccgcgaacctgccacccttggacaccagcctccgcccgcctgaaagcggccggccgacggccaaggtatcggtggcggcggcgcgcgacggagccagagccaccccttggtgcggccacagcagcaggcagctgctgatgatcagcgccagctgaaggagcggagagcagcggcaggaggacgaccaccaccacggtcgtcgtcgtcgtccaccccgagccgccattgctccaccaaacacaaacctccactagctagctagctacgacagatattagctttgcgaggaggagcgacagatattaattaatataaaaaggaatcgaatcgatcgatgggtatgggtaagttgacgtttgccagcgtcggccggctatccggggtgtgaattttctacacgttaggtgcaagcttattggtacccattattttcgtcttatctaaatattcgtcgtaaaaattacaccctttcttttggtcagtcagccttttgatatctgtctttttaggctcgtccacccaatcccctctgcccttccactccagggttcaatcccatttgccatttgaagttgaatcccatccccttcatcttgtggagtttttaaaaaggagtgcaaataaaatccaaaatttgaaaatgagtaaaattctaaaaactacctaggaacatcccgaaaattctgaaaaaaaataaaggactgaaaattactgtaaaattcagttggtaataagtaaaatagttacaatgatcataaaacatgacaaactaatgatctactagaaaacatgataaacttttaaacgagcaattagtgcatgctgtccacaacatttgactactcaatttaacttcacaacctttgatccatcatcatgacaatcagggttgacatcaaacactaagtacatacacattgttctataaaaaaagccaaaggatcacagaaatttgattcgtccaaaagttaagaaattcctctcatttcatctccacatgattactccatgaatgcctgaggaaaaaagtaataacgattgaagtgcgatgatgcaagaatgatcttataaagtcatgttcatgcgtagttgaatgtatgactatgctacacttcattgtttccgatatgaatttttgacttccgaccaatatcggtagattcctttccgacggtcccgtttccaatataccgatattatctatatggttaccgtttatggtataccgttctgattccgttttcgagaaaaaaatgaaaatgaaaatggtagagggtttttcctaccgttttcatcctaatcctcctggtatcttggtagttgtacaaggagcggaactccagggttttcgattactctctcttcggtttcagttgctttggactccatcctacagaaaggtcgtccgtggtcgttggcggtgccgctgtttttcgaggcctgttgggaattgtttttcgagtcctgttgggaatatagtgtggttcctccgtcaccgatctccttcaatattggagcagcatttctttttcgctattttaaccatagcagtcttttttttcttctaatatattaacgtgtgatccttttgcgcgttcacgaaaaaaaacccataaatccataatagaatagctaacgaccagcccaaacgagtctgaattctgaattatgaacagatcatcaaagatcacacgccgagtaatctcatatttcgagtgtttcacttgccgaattttcatttcttgggttcttcctgggtctcatatattgaatcatattatcatattggagtatattttaaacatgcgaatatgtgatgtcgtttacttccattagttccaacaatctccgagctcatcacatattccacaatatgcatatatatcaagctgagccattcctggtggcgaagatcctgtgcgagacgacgacgccgagcgcgaacgcggcgacggcggcggcgatcgcgctcccccgatcccacctggcccgctccttctccatctccatctgcatctccgcctctaccctcgcgtcctccatcgtcgccatcaccacctccgccgcgccgcccgcggggcgcttcggcacggtgaggcacagcgtggcgccgtcgaagcgggcggcgatccggtccacatcggccgccggcggcagctggaactcgcggtggaggcggacgtgccccgcgggccgctgcccgcgcaccgtgacgcgccccgcgccgtccacctgcacgcggaactcctccttcctgaacccggcgaggtcgaggcgggcgacgtagcccgcggcgccgtcgtgccacttcacctccggctgcaggtcgacgtcgcggggctccacctccgccgccgccgctcccttcgccgatctcgatcccttgggcacgcacgtcgacatggtggatcgatatgctaagctatagcctcgcgggcgatctggaccaaggaggagctatggatggtgagatggagctccaaggagggagccatatatacttacgtgattgtgtgttgaattggttattcgaagcgttttcttcaaggtgacacaactctcgatcgatcgatcgcaccaagaaaattggtgtttattggcgtcgagggttgggtttgggtagggatcttggttttgtctcgttttccaagcctacaagctacgcacagtactcttctacttacatttacttgctttcggcatggatgcatatacatggcatcaggcatctgctggttacctaggactacgattgccacctacgagaaatgtccaattcctctcatctgaagaaaacgtgagcgggattccttttataaatacatgattttagtaatacaggaaccgatatatgaaaaatataggaatagaattgacgtagtatatatgaatcccacgaaaatcaaagtcacatatgtttaaaagataatgtgtataggtggctcacaagaaaataacatatgaattttgatggattttatgttgcttttgactactcaaaggaaaaaaaataaaaagttgtttgagctcaaatcctatatatattccccaatggaatggattctaaaagaattggcatatgctctaatattttgttccaaacaaaacatgtgtataggaaaatctctaaaattcttatgaatttcctccaatccaaaagagcgggttggagctacagtacttccatcggcagatcaattgatcaagtcatcaagcatgtggcaccatcttgatgttcaattatggttggtcattaaattcttcctccatatttaaatataagatactgatggctttatatggacaaattcaaaacttgaacaaccgatagctctcaaagatttattttgaaaacataaaaaacaattatggatagatttttctttataaatactattataattttgttagttagtagtcaaagttgaaaagaaactggaatgtcaaataatgttatatatttaaatatggaggtagtataagctattagttgctagggaaacccaactgcgtacatagcaattataagctagttccattggcagaatgttattgagaaacacgagacgatgtgcattttatataaactagcaatgtgctcataagtgcaatgggataaactaattaatatttttttttaggaatatgcaaaagaattgtgcatctttatacaaagacaccatggccgcgaaagggtatacttagtaaaataagaaaaacacaccacgctgcgtgccaacaccactaccatagcctgaggaagagacctatgtgccaagacggctgccccaacataactgattgtcgttgggcctacaatgcagctatgggtgaaagaacctctaaaatgatgcctccaaggaggttatgacactgaaaacaccgtcatcgcttgtcaaaggatacttggatgtggttttcacttaaaggatcccaataaaaaagatgagggaggcacctcgagaaatgcctttaagagggttgtggcacccaaaggcattaccgtcgccggcctaggaataccatgctagatttcccatagaatctgcctacacccctgttgttgagacctcatcgaccaccaatcttgccaacacatcatcaccaccacaacgtcgctctctacttgacttctgtcctactgccagcacaaccacaaccatccatgcctacacactggcacgaccatgaccatgaccatgacaatgaccaccgaccgttgcacgatggcgaccatattggccttcctcctatgccatcacctcaccaagaaggagcgaggtgactgccaacacccaccacttcacgtcggcaatctcggatttcctctcctgtcatcgcatataccgtctcaccatagagttccccacgatcagatctaaaccggccataaaagggaggagctacaaggagatgaaaacgcactagcaacagaggacgacccgtcgttgccacccgtgatggtgatgttctgcggctcgatccaagtttgaggccccgaatccggcggctgctccaccaaccagtgcttgcatcactgccttctgcatggtcaacctcacgagtgcatgcgctctatccgtcggctgcttgctgcatgggccaacatgctgctaccagcctccgccttcatcaatgcgtactagacctctgcccggtaggccccacactccttgccaactacagaccctcgccgttgcaaccccgcctctagccagtaacacgaatagcctctgaccacacccactacatcctcagcaccaagtagatttagagtttgttgtcataggaggcaatctttaggttccaggggcacactgtgcaaccatggagaaggcctcgctgtcaccggtgacctaccgagcggccgtcggcgacgatgacgaggggaagatagggtttctggagggttgggaaagatgcagcgtgattcacttagtgagtcgctggagcggctcatgagacctttttagaagaaaagtttcataatctcaaacctaattaatatttatgactaatattaaataattgattcagtttcgacatatctttgtatgattgcatatcagggagcaatttcaacatctatgactcgtaaacatgaccatcttcgcaccagagagtttctttttaaatgtttgtgttagggagcttaattcgatgcgcatgcatgtggagccatggagccgagcagagtaaagataaatcaccaattaacaaaagagcatggaggtgaagatagacccgagcatatctttcttttctcaatgaaagcctcaagaatatctcaaatcaatcttaagaaaaaaaaataattcaattatctgcttatgcacaacccactgaattttgcgtaggaatcttttgcacatgtgcagatgcgtatcacaataataatcatgataggaaagcgatcttgtgcagaataagaactcgatctgatgaaaagcacacatggacatgaatcggacatcatatcaagaaatttgcgaaaatgcttagtgacgtaagtccgggcgactccaaaatattggacacactcgtccttatccagaacacttagctacctcctccaccacacgttcccacatctcttcattttatttttaccctccctcttgctctatctctcctgaaagacttcatcccaatggccatacggtggcagaggaggcactgggcctcgcttcgttaaaaacacgatgatgacgacaacggcggtgcagggtacatgacaacagcagaggcagtgtgtcagggggcatagggcgacacaggatatgatgaagacgttggaccttgccgccattggcggccgccgggggagggggcagggggcagggcacgacgacacgggatggggaaaaggtgttggatctagctactgacaaggaccgaatgctgatgcagctggccttagtcggaggacgcccgtcttgcgccactgctcgcctgcgtcttccctgtgtcgtcgcctcccccgccgcatcggtggttctggtggctgaagtagaagaagacggaggtgggttcattttcttagagcttttagagattttgcaccccgattgtttttcttgttgcactttattttatcaaggtgtttcattatattttgatttggtgttgcatatattgattctttgtgttgtgattggtatgtttcatgttgtattttgtcacaccccgatccggcaccgccgtacaatggctcctgacaggagcgtgtcgtaggaaaacggcgcgaaccacttcctacgaaaccgcgatcacagtaccagtcccaggacatagtgctggtacccacggtgacaaatatgattcattgcaatccttaaaataaatagaggacttatttaccttaacttaggttgcagctcagacagcccgagaatacaaccgacgacgcggacgaggaaacaccaacaacagcagcagtgaaaccaacggactaacacccaacaccacaggcgacggctgggaaccaagacaaaaccctaatcttcacttcacttcatcttcaacttcagggcagaggaactatatatatttatatagagcaagggtgagtactttcgtactcagcaagtcacgggaataggtgtttaatacaagcttggaagagaggcaaggttgttttgcaaatcttttgtttgaaatcattttgaaatcactaagtgatttatttcttttcaagtttaggccaaaaagagacttgcgtctcgattcgacttaagagatgcttttcaacaactcaaatggtaatgtaccgacctcccaggtcagatcattacttcttggctcccagagtcatttcacttgattaagcggctcccggagcctttttcattttctcggactcccagagtccagctgcccagcagcaaagcaatccgtttctactcgagaagcctagtctatgatgcccacagacatcccgaatcacacagattcgtttctgaccactcaggtcatccatctgccacatagactgattctggttacgattcccattccacaacaacttttcacaaagcacaggcaaacaaatctacgcaacgggaaccacctcacatccgcccatgaccgtgggcacggctgttcgaacagatagttaacctctacagaggggtacactttacccacaagatacgaacttattccgaacacccgtcggtgtcggagtttcgcaacaaagcctttcctaagccggcccagggttacctcatgccacatagaaggatcaaatcctcacataaatataggctattttagttttcacaaatcaaactccaaccacctcgatcggtaattcagcaagcttctcttccttgcttaccaggaacccggtttggctccaaccgaccccgccccggcgttccccaactattggcatgcaaggtttccctaaaccgactaattacttagccagggtggcccataccaccttgtggttgcactttgttatgcttgatgagtttcccacaggaatcggtcctcatatgcaaatacgggacaacgccacgtaggcacggcacccgcatcgcgagttttcacaaactattttattttcaaacacaccgacaccacatgtcgggttttcaaggcttctcaaacccatttcccaaattttcgacaatcaacgatgtatgtgggatatttagtatacgcgctcagagagcacgaataccgaagtaccacaaggatggagcaacaggaaatcagggtagtacagcctacaggaattagtgcgactactgggtaggtccgtcgatttggcacgcaaaccgaggcctagcaaattaagtgtgtgattctaataatgcaagttacaaacaaaataataatgattttccaattataggagcaattgatcaaagggtgacttgccttgcttaaggtcttcacgaagcttcacgaatcttcgagaaaacccgcgatcgacgaaaatccggtaaccgcaactatacgcaaacaattaaaaacctacacaaaacccaaaataaagatcatatttagactaaataatagtgccattaaatagatctcaattttacggaattattgaaagttgaacggagtcaatcggatgaacggatctagagatatgaatttttgaagcttaattggaatttctggaatatgagaaatgatttgttggaatttttggaacaaagaaatgatctattgaatttatggaaaagaatatacccaagaataccctttaattactcattgacatgtggggccaactggcggggaagatggacttttgtgtatgtgagttgatttggtggagggagaaaatacagactttttaggccgagcgtgaggcgcggcccaaaggagattggcccattagggctcgggtggggagagagaggcggaggctgactgggcggctgacggggcaggcgcggacttggtcaagcccacgtggactgccacgcaagcgcgagagagagggaggccaggctcgcccggatcggacggctcacggcggccgaggggcgccggcgaacggcggcgaaccggagtgaggcgcggacactggaagcaagagggagtcgaggcgattccatccaccggctcggatgagggagaggcggcgcgacggcggccggcgacggcggccgtgcggcggcgggatgggtggcacggcgcgggcgcggccggcgaggcgggcggccgcggaggcgcaccggggagtttcgccggggctcaaggagggtggcagcgcgaggggttgaggagagaagggccgacggcggaactgcggttgcgcacggcggcggcggaaacacggccgcggcgggctaccgcgagcgtgggtgcggcgagaaggaaaagtggggagcggccaatgggaagggggcgcgaggaactccgggagtgtgacggcgagctggttagagagagagagagaggccaacgacggcgcgtggcgcgcgcggcatcgagggtggcaggatgatagcgagaagagagataaagagggtggtgacagcattgcgcgcggtaaggggaaggggcgggggctcaccggcggccacgaatcgaccttggcggcggcggtccgctgatgggaaggaggcggcggcgcacgactgggttccagggaacggcgttcgcgccggtggtctcggttcggggacaccgcgtcggccgagcggcggagtctagcggcgaatttgacaccgaggcggcacggtgccgaggcgagcgcgccggggaagggagtgcgggagtgcgggggtggtaggatttggggacggcggtggagcggcaagaaccgaacgagaagggcgctcgaactgggttttataggcggtggtaaagtcggtttggggggaaggggggggggaaccgacctagacggtcaaggagcgggagatggcggtcgagcgtggtcgcgggcccggcaaaggaggcgatggtggatggaagggaaaaagccaaaagcggaagggggaaaggagctttgctcccttccggtttttgggccaccttagggaggagacagcgcgtgggagagagaggcgctgcctccgcattttggacgcacgcgagctgtggcgcagaggtgggtgcggcggcagagtgggcgcgggcggctgcgcggcgcaggcgggccagggcgaacggcgaccgagggcggtcggccaccacgcgggagcgcgcgcgcggagcaagggcgcggcggaattcaaaggcggaggcaggaatcggtgccggtgagtgaaacggggagaggaagagcgagagagagagagctcggctcggggatggctcacgcgcacgcgcgtgcggcgaacgtgcggagcgagggaggggaaggctgagagagagaacgggccgggccgagagagagagatgggccgagggaagaaaaccggtccacaaaaaggaagagggaggagataggcagagtggaggggatccggcccatccaaaattagaaggaggcaaaatagacttctacagagaaattgaattggagagaattggagtttaggtttgaattcaaatttgatatttggacttaggaacatagggtggagtcaaggaactggttcaaggaagactcggatattttggaatcgagacaagtatttggcgaggattcaaaggaggcgattgaatttcggagacttgaattggaattggaatcttgaggtggacgattttgatagcgacgagagggaacaacgatggagattgaattgagatccacggcacgacttagactctcactcaaagaacgaaattttcgcatataggattttctagaattagttttttttaacgtctcacgaaaagcggagcgttacatatttggttgagacactttcattcacgggataaaacatttttccccgtctgatgaaacattttaaacttttttttattgaatagtgaaacattttataataatacattgcaacattatccgatatgatgttttgtaaaacatcggacgtatgattgtggcactctctagaaattggatgacgatttaatcagtgcgaagtcgtttttatccaagactttttcatggttgctgtttgatcggaatcgggcggacgcaggacacaatacctcaccgtgcgacacactgatcagtggacgacggaccaaaacccctgacagaaaacactattgcgaagaaacaaataagagcacaagcctactgtcccgcacctaagaaacacacacacacacactcatgtggattacaggagttatttttcatgcatgtactcagtactcccactaatcccagcaaatcaatctctgagctcacatacacaacatcattcatcaagcccatcaattaaccattcctggtgtagagtaagatcccgtgcgacacgacgacgccgagcgcgaacgccgccgcggcggcggcggcggcggcgaccacgctcccgctgtcccacctggccgcccgctccttcttcttctccgtctccgtctccgtctccgccacctccatcgtcgtcgccatcaccacccccgtcgccgccgcggccgccgcggggcgcttcttgggcacggtgaggaacagcgtggtgccgacgaagcgggcggcgacgcggtccgagtcggccgtcgggggaagctggatcacgcggcggaggcggacgtgcggccccgccgccgcgggccgctgcccgagcaccgtcacgcggccggtggcgccgttcacccgcacgtcgacctcatccttggtgaacccggcgatgtcgaggcggacgacgtagccggcggcggcgccgtcgagccacacctgctctcgcaggtcgccgccgatctggatcccttgggcacgcacgccaacatgatcgagctatggttggatgggttgagaacttggatggtgaga

SEQ ID NO: 5708 - DNA, 11907 bp, Oryza sativa
agatttaacgtggaaaaccctcccaaaacagagagaaaaaaccacgggctccagccagcaaaatatcttcgctatatctggggtgaggttacaacgctacacggcggcttacaagaagtatatatatggtggaaccctaaaggggatgacgatccgtttcgtgggggctccgccccgcacccccgagcgtccccaggtgcacggcccttcgctctactacggtagaagctgtcctttattaagtgtaaatgaatttgaatcacaactcaacatgtttgtgtgttgaatttgtttattcgaagtgttttcttttaaggtgacacaactctcgatcgatggtaagaagaaaaataggtgtttaattgacgtcgaggtttgggttagggtagggatcttggtttcgtctcgtcttccaagcctacaagctgcgtagagtagtaattacccgcgactatacgaggttagcagaggtacgttgccacctatgagaaatgtgcaagtcctctcatccgaagaaaactaagtgagtgagagtgtgagaccaacaaaatattctaagactcgatgtgtggtcatgtcgtttgggccatttactccctctgttttatattataagtcgttttgatacgttgtgcaagtcctctcatccgaagaaaaaaaccaagcgagtttaaccaactaaatattctaagactcggtgtgtggtcatgtcgtttggaccatcaatattttgtactccctttgtttccctttgcttcgtattataattcgttttgactttttccctaatcaaactttattgagtttgaccaagtttgtataaaaaaaatataaacattaattaaaacaacagattagttttattaaatctacatttagtatattttgataataagtttattttgtgttaaaaaatctattatgtttttttataaacttggtcaaacttatttaagtttgactaggaaaaaatcaaaatgactttcaatatttcgtacttttttttttacaagaagggctaagccgtagagatgtggtaaaagagttatgggtttatgaccattgaccccagtagtacactcactgaaatttacatcctagtgcccacaataatacacaagtgggtacgttttaaatagaatttcactgaatttactaaagaactttcatcacttgattcgaatttatgtgtggtgaactcactcctttctaatgttccactgtagatttgacagaatggaatgtagaaattgtacatatattgggttcttttaaattttcattgcctataataaaattggttgatatggcaagggtttgtttgaatttacatttgttgggtttcatttttcatcatctataagggaaagagtttcatatacctcccttcagtggcaaacacaggactaaattttaggaggtgccgatgaaataaagcatactaatataactagattaaatatgaggacttttacggtacattctacttaaagtatatactatcagtatatttgatctaacggtgtaaattcatctgatcttccttccaattattttacggtataaattgaatagaatatatttgtcttttaatctatttgcgtgagggttaattttgtaaattcgcgtttctaacttaatcaaatccgggcttttgcgcccagtcaaagcgaattttttttgaagcggcgcgcatgggcgaccgccgtcgctggctgcctttgcgagcacgccgcgccgcgcggccgtcgacaaccacaatcggggccgccgccatcgggaatcgattcgatttccctccccctttcttcacccaaaacctattagtttttccaaaaatccccaaatcgtcaggttgcgggaagcaagcgccgacgggctgcggaggtttgcgggaggcggaaggcgacgagcagtttgtcctcaacgggttcaccgccgcgaatctcagcttcgatgacatggcgacggtgaccccgaacgggctgctcatgttgaccaacggcacgaaccagctcaagggccacgccttcttcccggtgccgcttcagttccacagggcgcccaacagcacggcgatgcagtccttctccacggccttcgtcatcggcatcatcggcgcgttcgaggaccagggcagcggcaacctggcggcggcaggtggcagcagcagggcggcataattagcataactaatgtaattagcatggttacataccaatataactaatgtatgaacaattctgtgactactatccattcaactcccacgtttcaatcttccagagaaggccttgaaagaagaatgttcagactccaaaaccattaacatcgtttccaactttagacgatatattagagaatccaatttaatagcacaattttttggagcaatgcagtatagagttgggctgaaataaacagctgttacaagctcaaattacaaagcaaaaaaaaaaacaaccgaaggaattaatattcatccaatggaaataaatctctattttaaatgactagacaacccttttcagatttttaacaaataccaaatctaccctatcatatactggtagtatatatttacagtacaatgtatcgtaaaagttctcttaaatataagataaatctaaaaatcatacataaatatattgtaagttcctattaaaaaccttgaaaaactatctatcttttgatcatctagtttttttcctctatctagcaacaagtagtaacatgtgtgaactattggatctacatctgctttggccagctgatgggggcttgagcccacattgcctccctgctaggatcttccctttgaaaccgaaatctaatcctctaaaatttgtaataccatttatattatcccctaaagtgtttcggacatttgtatcgatgcttgtttgtaagctcaatagtacaaaagaaagataagtggaaattttaactcatgcatattatgtagtacaagtatacatgcatttcgatcgatacacacgtgagaatgatactgggtgaattgattaattaattagttgttccgggagaatagtttggtggagacgaagacgccgagtgcgaacgcggcgacggccgtggcgaccacctccttgttcttcccgatggcctccgccagcttcatcccttcctccgccgcgcgctccttccaccacgcggccgtcttctccggctccggcgccggcgccggcgcgggcctcgaggcggcctgctgcgccgccagcctcgccctcgccgcctcgatcctcctgtccgcctcccgggacagcctcgccttgtgttcggccctggccttctcctcctcatcatgacgctctcgcgccgccggctgcggcggcgccgccgcgggggctgtagccttgggcggctcctctttcttctctctagccgacagctgggtcctccgctcggactgatcactgtcagtcttcggcggcggcggcggcggcttgccggcgacgtcgtgttcgtcagccttcttggtctccttctcctcctcctgattggccttgggcggcagggcggcggcggcggcggttgtcgccggcttcttgggcacggtgaggacgagcacgctggcctccagcctgccggtgatcgcgtcgaggttgcacgtcggcggcagctggaacaccttgttcagccggaggccgccgtgctggccgcggacggtcagccggccggcggggtccacgtgcacctgtaactcctccttcttgaactcttcaaaaacaaaaaataatcaaccgagaaatcaagaaattaacagtaaaaaccaaccaagccaacgtatagatcaccatttcacctcaccattacacatgcatgttggaagaactaattaaaacagttagtaattacctgggacgttgacgcggaggagatagtgggcgccggcgtcgagccactcgtagaccggctcgaagtcgccgtcgcgctgctgctgctgctgctccgccatggcgcctagcttagcaagtgctagctagctacctttccttgcaattccaatcgaaatctcctacccggtgagatgcagctagctctgggtaattaatctgagacagatcttgagatgagatgaacaagcgatgctcgatgctgctcagctgctgccggtgatcgatcgatcgaggcagggcacgcataaatatttgcgatcacgacgcaccctggcttgtggtgcgaggtcaggtttaagattattccaagctttttcttgaggatcacatataaatttcggtcaggtttaagatgattccaagcttttcttgaggatcacagataaatttatcatcaagaattggggaaaggatagatttcgcgcggcgacgtgtccggggcgccggtgcctttcggctcgcggcacggtaccgaggttacgtcttcttcgtcgtcgtcgtctctccaaagctagctatagttaattttctttcgcgagaagctttagctagctaattaattagctatcttccagttttggatcgatcgaatgtactgtagcgatcaggtagtttatatgccacatgttcatggctagctacttcgccggttgatggatcgcgtgtgccttcgcgtgatcactctatacttgatagtgtaatggcgatggatatatggtttcaactctaatgtctcgtgtttaattctctaacatgctcacaactttttgtaattatttgataaccaagttcctctttgattgtctttttttatgactgatcactgtttatttctgaagtaaactgaaactttcagtccatatgcccgtgtttttttttcttaatcaaactggataggctgaaaagcggatatgtaggcttgatccaagcccagttgcccactgaatacatagtccggctgtgtttagttcacattgaagtttgtaagtttggttgaaatttgtacgatatgatagaaaaattgtgtgtgtatgaaaggtttgatgtaatggaaagttggaagtttgaaaaagaactttggaactaaacagggcctccatcctgtccagagtccagcagactcatccttggcccaatccaggtccagcctagctgcgatcacttcgagtaaccaaacttgtgatgaaatgctgaaagtcacgtttggaacgtcgcccacgttagccttgccaaaatattaacaagacaaagttttgggacaaaattccttatacgtccctccactttgcgttctaaatcatgctctatatgtctctgatttttttcatttttatatcccatctatgctcgtccctttagttgaccgatcggcttcttctaaaacaactatgttacctttctcatacatacttatgtgctacctacttaaaaaaacatggatctcagtgttaaaaaatatagtaaaatcaaacgggacaaaaaaatatatatatttgtcacaattttaaaaaaaaattaaaaaatttcatgaaattcatacaaaattttcaccaaaatttgaaaccccaagttttatttggatttgattttcaataagaatgttatggatttcatcaaatttgatttaaatttcatttaaaaaaatgtaagttctagttttcaaatttgtagtcaaataattctaccatcttttttatatgaatacttttcacattgagaattatatttcttagagtgcataagtacgaaagaggcaacatagtcattttggaaatatgtaatggtaagtcatctaatgaaatgggtgtataagggatcaaaatcaaaactcaatggcgtataagggatcgggcaaaattcaaggacataaaagggacggatagaaaactgaggcacataagaaattttcttggtttggtgttgccaaatttgtggttagaacttagaagttttgcaattaatcaaatagatctattgggaatatttttgtgttgtttgttagggcaacaacccaaatatgcccaaagtgtcctattgttttgcattcttttttctccaatttgtttatcaagtggtttgctacgaattacaatgttgtaaatgcgtatgatccttcatctgctgttcttcgctcacagtttgtcatatttgaacttggaaggtttgcatgtcttctttttttatggtcaaaaaagaacagatgaaaaactatgcatggccgtcaatggcttgggattggatgaggactaacaacaggcaatagtccagggcttcttggcttcatgatttctctaataagctattgcatattgtgagccttgtctctgttcatgatgtctctaatgttatccatggttgagacttattaaccattaacaaatgtatgtagctgcctggctgcttgtggcagtaaagtcatttcttcaccttattaactgtcactgcttcctcagttgctatcagttatgagttatacttcatctgaattacgtgggaactaatcaacttgtaattggaatcttggcaaattgttctccttgtcattgacattaatgtttcatactttcatataggggattttcccgtgcaatttttacacggactagttaaattggatttgcatttggaatacaactcttaggtcctatttccatagataaattctctaaattctcatatgtgcaattatattttgcatacagtaaaatatttaaaatagggttggatttaatatacaactctttcttatatttatattatatatatatcataaatataatttattttgtatacaactatttatattaatctacatcgttataatttgatccaaccacattctaatggttagattttgtctcttcacttaatgataatttctaggtctctataacgagaacatggtgtgtccttttcgagctatctttataatatactaattgatagatagatttatttctttcagataaaaatcagaggcgacatgtcagaaatttgtcgttctagtagtacaaagaacaagtacatggaggacctagcagcttgcatgcacagggtcttggcatctcgtcagcccgaaatgatcgtccatgtctggttgtgtgcatggatgaatttcttagagccgaccataggtccatagtcgcaattggctcatgtttttatatcccactacattctggtgttttgcaatccttaatggcatcaaggacacactaggtttgtaagttagttcgtcaggaaacaaaataattagtgcctcctgatgacatagttagtctgtttctggataatcatggagaaggatatagtagtatacagatcaagttgtctttactccttagggaaaaatatcttggcatctatttaagcagatgtgtgctcaattcttctgcacagccttaagccattccagttccagtgttagtactattccgatagaggttagctctggattcattcatgtcacatagcctactttgcctttcttcttcttcttgtgcttgtgtcaccataatctagctcacttagtcacttgagcatgctaccatcatgttatttgccctgtacaattgatcacatttttttcttcaggggattgtgttttaaatcatcttgtagcttgaaattgagaactaaatgttttatagtctagcaggtaatgagttgttcagtcagcgaatcaatgtctactactctatttggttggtggattgccaaaaaaaaagtgaggttagaatgatatgcaggtaaaattagccaaaaagtaagtctatgacatgtgggccacaagaataaaaaagagaggggagaccggtttgtgatagtgaactaaacatttttctgtagaaatttgccaggatttaggttggcactgttagtcacgtgatgatgtgccatctctggctaatagtatcttgattttttttctgaaatgtttggttctagtaattcaagcctgttattaaacactaaccgatgcagttctaggcaaaattaaaactgcacaacagaacaagttgttcttcacgcagaatgtcacaaacctcatttttcagtagtttttttttaattggtggttctagaggttttgaggttcgtataggagtaccccatccttttaaatttgatgaaaattttgatgaaataaatgtaaatttaatattatgaaatttcaaagtatgaggtaggaccatctaacgaaaatttcttccgccactggttttttttcaaagtcttttatatcagtctccctgccctgaaccacgattacagaagagaaaaataaggaaaggaaagagaaggcatgggcaacctgttgtgctgcgtggaggtggaggagtcgacggtggcgatgcgggagcggtttggtaagttcgacggcgtcatggagcctggctgccacttcgtgccctggtttcttggcctccaggcccgcggccccctctccctccgcctccgtcagctcgagatccgctgcccgaccaagaccaaggtcacttcacctcaaatcactaaaaaaattacactttcctacgcaccagagtttaaatcctgatgtctacaagacgacacatataactgtgtgtattattagttgagttagagaccgtaagttattacttttattgtgaaaaatgaagtcacctactcatctcgtgttttttccctctttctgcaggacaatgtgtatgtaactattgttacgtgtgttcagtaccgtgctctagccgacaaagcgagccatgcgttctacacgctcatcaacaccaggtcacagatccaggctcacgtcttcgatggtaattactttcttaattgttactatggtgattttcgtttatagtaaagatgaaaataaaataaaattatggtggataaagacaaagttaagacacgaaaaataaaaaaattaacatatgattaattaagttttaattattacaaactaaaaaatgaagttatctaatattttaaagcaacgtgtgtatatataaagttttcacatcagttataccgttttaccgtttagcagtgttaaaattgagaaaaaaatctatatcttactcggaaaagacagttaagcatgtactaaaaagataataactgtgaggcatgcagtgctgaggacgagcataccgaagctggcgctggaggaggtgttcgacaagaagaaggagatcgcggaggcgctggaggaggaggtggcggaggccatggcgccgtacggctacgaggtgatgcgcgcgctcgtcgtggacgtggagcccgaggaggccgtgaggcgcgccatgggcgagagccgcgccgcggccgacagggcggtggcggagcgggcggcgcgcgccgggcgcgccgaggccgacgccgaggccgcgcgcctcgccggcgtcggcgccgcgcgccaccgccaggccgtcgtcgacgggctcagggcctgcgtcgtcgcgttctgcgccgccgtcccgggcgccacgcccagggaggtcatggacatggtgctcgtcgcgcagtacttggacaccgtgagggagatcgccgccgcgtccgcgtccgggtgctcggcggcggcggcggtgccgttcctcccgcacggccccgccgcggcgcgcgacgccgtggcgcagatacgcgacgggctgctccaggccgtgcagcctcctgccgccgccgccgccgcaagcgtcgccgccgttggccttccattgccattgccagtcgccagcgtttgcgaaggtatcacagaagagcagtagttgagttgagttgggttgccttactgtgtcagtgtgtaataatgccaatggttactgcaaatctagctactatatatgctgtgtcttggatgtgttgtgtacaagtgatctggatcaagaaaagtgtcatgcagtgcttctcttgttctttttgcaattgaattgcttctgcaaggatgccagaacttaatgatacacattgagcatgtgtggagcacacgaactaagcagaaacatccctatttccctttggagagactaagcaaaatccatgttccaggttttactgaatcttcctttcatttccatcaactccccaagcatgggaacaagatttatatcatgcataacagtatataccacattaagctctccaagatgtcaattacgacactacgtaagcatacaacgaaaggatttacataccagaattcagatggaaatccaaccgtatgatggaaaaccagatcaacgaattcaacaaagatgtggaacacagagatatctccatcatatttgacagtattcagcaataggtctcaaatcacccaaaattattaacaacaggcgccgaggataaaaatatatagccaatgctaatgtttgcctagggtaatggtggggaaagaactcaagatcaaaatgaagccacaatggtagctgtggccatgttttttccatgttattccaatccacaagaactgaagaaaaattcctaggatgcaaaacatactcaatgcttgagcaccaaggacaagccaactttcgtgctcttctcaattgccttggtgtcaacctcaccagagatggtgattagcgatttgggacgccattcatgctggacgagcgcgctggccatgccatagttgttgaagcgagccttcactgtcgtgtgagggtccaatgagtgctgggacccaaagatcagtgtgctctcattccttgagaagctgtgggacagctcagctcctacggcagtgttcgaatggtgctttaccaggtggtagtaggatgcaatcaaggtatcaccatgattgttcctggacaggaattgtaaggtcagttaccaaactaaataaactgatacaggagtaatgaccacaacaaccagtaaacaagaaatgttattctggaattggcttctcagtcagacttggaagtaacatgcagtgctaatatatgataaccatgcatagaatcaatacttacagatgcagagaagcaataaggtctgaattggttagactcaatgcagcattgtacttggtgaaattgctagtcgcagtgtcgaatgcaacatcaacaccaactgagagctctttgcttccaaagacaccagaaaggttaaccataggattggaattcaggccaacacttgcattgatgccagcatattcatgaaggtactggagttcaagctgttaaggcagccaaaaaataatattaattgcaatgcctgtcatattggatgttttaaaaaaaaagaaatggagggctgcccaaaaataccttccctgacctctggtctggaactaccaaactaagaattgatttcaaccctggagttccaaactcatcaaccgtgactgttgttaaaagctgaaagatacaaaaaatcatcaactcatgattatgcaggaaaaactacagtattaccatgaacattatgcgtgtgcaggaaaaagagaactgaatgcttacatcggactctgagtttgctttgacatcaacagtcaatttcttgttcttaagctgggtttggagctcaccaaagacagactcatttttccttgttcctgcagctgtgatagtctgcagtacaaacaaaaatcattaacatagaaagcacaaatcaaatgcgcagacatgctgaaccgcaattgtactgaattgctgataacatatcaatctcctcggtaaacaattcataaccacagaccatatgtgctattgttgcatggaaggtgccaattgcacttaataatagatttcacagtcgcaatgtgacggcaataaatctatgatcttatcccccaagagacattttacagtgcttggaaggttttgaaggtacctccacttttaaaagaaatatcaggtgttgttcacttaaaagtggaggtgcccctatgtattatagactagtagtgcgcaagcatctataaagtggacatctcatcccatcaacatacatcatctgatcttaaatatgcacgtatgtagatcctaaa

SEQ ID NO: 5709 - DNA, 2436 bp, Oryza sativa
ggggtgcaggtggtgagggtgaacttgtggtgcgtcccgtagtccctgtaaagcagatctgcggcgtcggcagcggcgggggccatcaacaacaaacgtcacgtcagcgaggtcgagcacgagaggtgaacaacaaccatggcgagaagaaacgagagtgaagggagaggtgaggcctgggggcgcagggggcgccgtacctctggtcttcttgccgatgtcggtgtagagccctggcgccatggatgccgacggcgtcgacggcgagagggaggggatcgatatcgcggcggcggcggcgaaggcggttaaaacggagtcgcgcttcgctggctctctctcgctgcagatctcgtggcgtcctcctcttcgccctggacctggactcgctttttcttttcttttctctctaaaaataaagaaatgagctttttcttttttttctttcttttttttctttggctgggcgtgggcgcgggtgaggtgagagggagaggggatgatccgtgtcgtcgcgtcgtgcttcgtgcggactgcggagcaaacggcgggtcaggctgtcagtggggcccgcatcattcgacgccgccgtggtgggcatctgcgtctttattctaagcacgtgcgtcgggaagggtggttgcgggcgaccgtgggcttggttgggcctggcgaaccgtacagcgatctgatccctaggcgggctgcagggataagttcattttgactcccttaaaagtgacccgaatctaatccgtagccctgaacgacaaaccagatatcttgactcttaaacgttaatatcagtgtaatttgattctctcggtggttttggagagccgttccgctgacgtggcatccatatggcagtgttgacttagtatgccgttgacatggcgcacaggtggcattaaaattgaaaacatacacgtgagacccgttcgtcattcacacaaaagaaaaatatatgggaccactgacatgtggggcccacatatcaatctatcccttcttcctcctccctctctctcccccttcggcaagcgggggccgccagcgacggcggcaggtgggggccggagtggcggcagcgacatgggacctacccgtttgcccgcctgacgcatgcgaagccggcaccttcgcctccgccgaccaaatccaccgacaagcccacctgctacgtacgttgccgccttatcatcttcctccggttggctcatcccctcctgtgagccaccggcgacagagacagcagtgtggtgttggcctagatgtgagccgccgatgacgccattgtcgattggggtggggtaggattggggatctgtggggagaaatggaggggtggtgagagagagagagggagggcagcggcgggacagagcttggcgagggagctctataggcgtcgaggccggctgtgatgggaacggcggtgacatcctgacgcgggcaggctggcgcacctactgctcgccaaggcggcgtcgacccctccgccaacgttgccgcctccggctcctcttccatcgaccatgcaaaagtggaacgaaacggcgggcgaggaggatgttgcgccctactccaggctctccttcctcctcctcctcccaactcaccagccacgaagcttgccgcccatggcctcctcagcgccgcttcctatcatcattatgctggcgccgtagcaggatggtgcagctccgcctcgattgccccctcgcatgagcgccagcgccgagtccgtggctgccttcaccgcccgcggctacggtggcacgcccctgccgaggagagagggagagagggaggaagaaggagtcaaagagagaggctgacatgtgggtcccacatgttagttgggcccttttttttaatgacaaatgggtccccataaatttttgcacttctaatgacatataagagttatgtcaacaccacgtcggatgaagatcaagttaacaccgccacgtagtcgccacgtcaacgaaaccacctaggaaatcaaattgcaccggttttaacagtttaggggtcaaaattttggttttgcggttgagggtcaggtcactttgaagggacctaagtgaacttattcctgggctgtatctgtgtggaaggatgctatatcctatggcccatttagttatattgggccttgtttttcggtcgcgcagaaatgcagaaagaatcactcggtggacttaggccggcctttgccacaccacacaaacatataaaaaattcgaaatttttcatttttaattttttttaaatatttacagaaataatctatcgtcgcaaaaatttaaaaaatagaccctgccgccctagtggagggcggcaagctgacgtggctagacgacggctcgacggcgccgtgtgcgtattttgcgctttggtcctgggcggcaaggggcgtaatgcaatttg

SEQ ID NO: 5710 - DNA, 19383 bp, Oryza sativa
  unsure (1)..(19383): unsure at all n locations
tctttcacgctctggtgatatggcccttccgcgggctggctttttttgcatggaggccccttgccgccctggcagtgggtggcaagggtgttaatacaaaaaaatcaactttttcaatcggccatcaccacccgtcgagctgtcgtctgccacgtcagcttgccgtcctccactagggcggcagggtctattcttgtaaatttttccaacgatagattatttctgtaaaaattttaaaagaaaattttaaaaatgaaaaaaaatctaaaaaattcatcccctcgttcaaaacttttttggagggattttggatgcttttctaaagagaactactacaccacgggattccgttttaacaggagatcaattatgacgcggacatcacctcccttgcttctagcgcttcgtcattccaatctctcatttccaaccatgtcattaaacaatatactcgtacagggctactagacgtgtgatgcatatatgcctcgtaagtattaggtaccatatatgattcatctatgtacttcacacgatacttaggtaatagacatacatggtacctaaattctaggcatggtacatatgagtaccaggtctgatatctatcggatttggtactcaggtaactggtctggtatctatatgtattaggtatgatatttagatactgggtctgatactcaagtatcggatttgacacatataggtatcgggtttgatatctttatgtatcgggtctgatacttagataccggatctgatactcatgtatcggatttgacacatataggtattgggtttgatatctatttgtattgggtctgatacttagataccggatctgatactcaggtactggatctggtacatataggtatcaaacctgatatctatatgtatcgggtctaatatttacatatcgggtctgatactcaggtactggatctgggtacatataggtaccatgtctaatatctatatgtatcggatttaatatttagatatcgggtctgatactcccatatcggatctgatatttataggtatcgaataaaaagaaaaaaatagtgtgtattacacgattattataattatgctaatgcaattttttctgttccatatcaaatcttaaaagcatcacaaccaaaaaataaaattaaaaacaaagcaagataaaaaaagggaaaacaaaaaattaaaaaaaaggtcacatgaacggtccaggtatagatgaattgtagttaggccaacatattcacatgcccaaacggtccacatgggccggagacctgtttgtcaaaaatcctcgtgcaggaaaggaaaaacacatgcatagtgcgcgtgaaaatcatgtgcgcattgtctttctgatggaaataacgtttaccattagtgacttaagtcatcccgtttccacggaatagtgttctctagattttctcttttctaaaggatatttaacccttttttttgtgaaattccagtataaatttctgtgttcaagaagaacccttaatcgactaaacaaaaggtcctttgtaaatcaccatatagcttccccccctcgttcaaaaatttcttggatgatttttggacgttttataaacgaaatttaacttttttttctgaaattcccgcctaaatttctccatttcaaaataacccttaattaaacaataggtcctttgtaaatcatcctttagcttttcctaagggacaaagaaaaagaaaaaacgaagtgtcgggagaacacaaatgatacacgaactagaacgtccaatacatacccacagaaatcagagagtattaataggattgcaacaagcaaagcacacacaaaaattgcaggtacaaaagaacatggcggcggcgcgcgctgccggttttaggaacctactataatgccttgagggtggctgctcctcctccggcggcggcggtggcctggaggaggccgtcgcggacctgcgcggccatgtcgcggacggcgctggggccgtgggggatgaagacggtggaggacctggaggtggcgccgatgtcgcggatggtgtcgaagtactgggtgacgagcaccatgtccatgacgtccttctcgttggggacgaagcgcttgaggccctcgacgatggcctggcgctgccgggccacgccgacgccggcgaggtacttggcctcggcctccccctcggcgcgcttcacctgctggatcttgtcggcctcggcgcgctccgccgccgccacgcgcagccgcgccgccgcgttgatgtcgttcatggcgcgccgcaccacctcgtcggggacgatgtccacgatcagcgtctgcacgatctcgtacccgtacatggtcatcgccctcgccagctcctcctccaccgcccgcgccacctccttcttctgcccgaacacctcgtccaggttcatgttcggcacgctcgccctgatcactgcgtcaaagaattccacaccttcacgctccgaaacatttctactaccagcagaaagcaccgtacaaaatattattttaaaaaataataatctattattaatatagaccatagtattataagttttatcagtattatctctacttgatagtcgtaaaaaaaacatgtcgaaatttcttttctcgaaggaatccaacacttagacagtatgaagttccattgaatatagcagggaaaaattgtaaaattataacctcgaaaacactagtcaccgacccacacatctgaggaaaggctagcaccgaatcgatcaccggccaccgctaaaccaacgaggaactatagatgtaccccggcctgtcgaaattattatggttgtgggggtgtgattacgtaccgtcgaagacgtaggactggatctgggcgtgggcgttggtgaggcagtagaaggcgtcgtaggccctgtcggcgagggcgcggtactggacggaggcgacgacggtgacgaagacgttgtccctggtcttggtctcgcagcggacgtcgagctgctggacgcggagggagaggtagccggcgacgcggcggccgacgcaccacggcacgaagtggcacccgggccccagcaccgcgtcgtacctcccccacgcctcctccaccgccaccgttgactgccccacgcacgcgcagcacagcgcctgcgccgcctccgccgagtagctgctgccccccgccgccgtcgccggagacgacgacgacgtcgacgacgtcaccccgcccatcttaatttggtccccttgttcctgatcttgcaaagctagcttagattatgtactttcggagtgtgtttatgggcatgcaagaagagaagagcagagtttgactgcgaagaagtgacatcgctgccacgctttagtgacaaaacaaaaaagcaaagcaaagggagtattagtgccaatgatgtacaccagaccaagtaacctcctgattaagtcttgctccaattggcaaagactagcatcgggtgtgaactctgaacagatgaaacgtaatcacaataattaattgacgagctggttagaataacaaacacattgacacacaacatatgaggtatccattgaccggatagggcaataggcacctcggtttcaactgtcaaagttggactagtactaatgggacaaaatacaagggggttggaaggcgcagcacacaagcgagcgcacggcagcatggcagtggcagcgtagtcaaaaatcttcggccatatcagctccaatccgggcccgaaccaaacggggacggggacgcaccagctgggtcgccatcgattcggaggtctctgcatcggcgaccgcggctcacagatcgagtagtgagtgactggtgcaatcgccgtccggccttgaccgcgtttagtttctctgctgtgtgacggtcatttatattgatcgcactatcgcagtgtttatgtacacgtctgcaaagttttctaccatgcgaagtgatttgatgtcaaactaccatgcgaagtgtttgagggggttgtcactatgatctgatgtcaaaccagagggataagatgagcgcgaaagggatatctctttttggccgaggatacaccgattactcactccgcctcaaaaataaatttatttttcgctcatctcacatatatcaatacaaaaataaaaatactaaaatactcaaactttatcaaatcccaatgcaactattgttcactttaactactctcaatttcattgttgctttaattttacaaacttctatgcaataattattctaaaaataaacatattttgagacaaaagggacttaaaaataaacttattatacgagacgatgggagtagtttattattgagtgactatcagcggcagagtatctactgttaggctgactctggccttgactactatacttcctttgtttcccagagactccatttgtcggtatttggttataacgtttgactcttcgtcttatttaaaaaatttcaatgatcagtgtttttattgttattatacgataaagcatgaataatattttatacgtgactaaattttttggattttttcataagtttttcaaataagatggacgatcaaacgtgggatacataaagcgaaaaataagtttttttaggacggagggaatactagcaaaaacatttgtgatgtattgccggagatcgggaaacacttcttcctcacccaggctcaatggcactgctggctccgtcactgaatatcgacccgaaaacttgcatgtacaaagggaaaaaaaaagcaaagttttcggattgcgatggtgattcagggttgctgctctatggattttggtagacccaatgggctgcattttccatgacagtgcttgggttttcagtccaggcttcaggcggtccgatgacatttttctttgtttcttccttctctcccctacctattgaaaaccgcagcgtctcatcactgagctgcatttgcggtccaagatttgtggtagctggttaccgctctggcgaactccagattgtcgtatcaactgatctttagtgccatgccacgaacaaaaaccttccaccacaaaatcggacagcgtgcaaatgatcctagaacggatcgctgtactataccgtaccactaccatatgcatgtccccctcggccaaaaaaattaccctacaaatctaaacgcatgtgttcaggttcatatttgctacatattaggacggagggagtagttaggaattttttttttggacaaagtagtactacctccataaaaaaaaactcaacctcgtactacgaatctaaggttaggttgtgtttagttcagcgcaaaatttggattttggttgaaattggagatgatgtgactgaaaagttgtgggtgtacgacagattgatgtgatggaaaaggactgaagtttggatccaaactttagaactaaacacagcctaaacatactctatatccagattcgttgtattaggatgtatcacatcctaatactaggttgccttttttttttttgacagagagtatgtacgtagtggtgtaccgtacgtccgtaccagaagccatacggcaccagtctacggcacgcacaaagctgcagcctgcaggcaccagcttgtaactcacttacaacgacgcagtacaacaagaagcagtaacaatcaatccatcacagacaagagagtgagtagagagttaccagccggtaaaaaggatgggtaaaatgatcaggggagtaatggcacgtgcgagcatcttagattaccaaactcgcatcgtcgcatgcatgcatatgatcatgatctatctgtcaaaggaaggaggggtgcgtcgcgtaccacggcctacctgaaagcggagcttagctctgtcaccccatcaatggcacatgcgccttaactgacctgcctgcccttcctcccttcctcaccatctccataatccagcaagcatcatggaatgatgatggcgacgacgaagacgacggtctttgatgacgaccaatttgcctcccctttttttttgccattctccacatggcgattaattacaaggcgaaggcgaccgacaggtgatgacagtgcgagtaagagcccaaacccagcattctccgggaaggggcaaacctaaccacctcagtctgagcatttgttcagaagaaaagcaaaagaaaaacccggtttgatccaccccctctcccaagtcaagggtaagctagaattggaaatgtagaagcttaagcgacaagatgaaagtttgcacattgtacacgtttgcgcgcagttctagtcgttctggaaacccggtttcctccacgacacagggtgctcccaggtgccatggtaggttggttgggtgcaccaccaatgcacccaggttggataggaagtccagtcttgcactgatcattgttgaatggatggcagaatgagcaccaaggactctctcattgcagtttgccgttgttgggccttggggactgccggtacggggaggcgtgcgggccataggagaggctcctcattggctgctgcccgttgcgcgcgaaggtgccctgtgccttcatgctttggctgccaattgggttgccgaggcttgcggcacgctcctgctgcatggattggaagaagtatgaggagctggccatgtctttgaggttcaggaggggcttgaggacttcgaccacttgactcatgagaggcctggccttgggatcccggttaaggcaggcacaggccagctgagctgtcttctgagcgcctcttatggagaagttcccctccagacgggggtctacaagcctatagaatcgccgtctttctccaagataaggacgcgcccattcaaccaggttgtgttcaccgtttggcctattcttgtccattgaccttctgcctgacatcatctccagtagcaccactccaaagctgtacacgtcactctttgatgtcaagtgacctgagaaagaaatgaactgatgaagtggtggaacactgcaatataccaagtgaatgtggtgcagtttaattctcaaacaagtgaataaatagcaaattatgtacagtactgtgatatatgagtacattcattcagcttagatcagtcaatggaagttcaaagctcatcaaatcaaaatgggcaacataattttgagccagtgcaattatgattcttttggactgcctcagagagagagattcagataaacagctattgcaccaccacagcagcacatggagtgccttaaatatcagtaatcacagaaaattaagatggtgtgccatgatagcacccagatcattgtgaatgtgaccaaaaaaggtgcaggctataataaaacactccatgcacacatccttgtacacagatttcatctatgtcaagtcactgaaagtttctactgaagggctatctaggaaatttgtcaaaggaaatataatgtgccatgaaagattttactacatgtgcaagtttggatagaggttcagcagcatgatgcaatatttcaaaattactcaagcaagccaactaacaaagtaatgatcaactcacctgtcatgacatactccggagctgcatatccataagttcccatgactcgagtagatacatgtgttttatcaccctcagggccatctttagctagtccaaaatcagagagttttgcattgtagtcctgaaaatgaatatttaagaaatatgagaatgttacaatctaaatgaacatttctaatatgttttgattctcaaacatggttgcataccgcgtctaaaagaatatttgaagttttgaaatcccgatagataactggcctttcagcttcttcatgaagaaaagcaaggcccttagcagcaccaagtgctattctcattctgatggcccatgggagaggtaaagaccctgtttaatacaattatccaagacaaatatcagataaatacaagacacttcagaatagagttatactgaaatgaaacagttgggccaaatttaacgcaacacagcaataacagtgcataaactacattgtctaaaggaggagaacaaagagttgcacccaaggtatttagtcggtaataataaaacaccaaaaatacatcatttggaattggaaacatgtaacatagcaccacctaacacccttattgactgccagaaatcgtaatgaacagttagtaaggtgtcagccatttcttaatgaactcttaaatgccaaactgtcagacattcaagtatacagtacaacagaattgctacaaaatatgaataaaataaataatcaactacatcactagagcagagtacaatatagaaaagtgcatataaaaatgcaggtactacaagaaaaactgctaccgtgaacaatgaaagaactccaaactgttggcaacaaatgggaagaaaaaaatgactgacagtaggacgcaaagattcttactcctaaaaagatggttctccaagcttccacgaggcataaattcatacactagcaacctttggtcatcttcgatgcagtaaccaaccaatttcactaggtgtggatgttgaaggtttccaagaaaatcaacttctgcctgaaaatgaaataacgctagtttaattgatgatgcattagaagacagttgaataatattttgtggtctgtatgctgaagcaattcaaaacataccacccactctttatggccctgcagcccatcatggttaagtgtcttgacagcaaccgttaatcctgtgccaggttttacgggagcagttccgttctcctcaatccaacctttaaagacacagccaaaacctccttcaccaaggagactctcaggccggaagtttcttgtggcacacttaagttcattaaatgtaaacctacggagttggaaagctagtttaagttcctctccgactatggacgaaggtgagatgcttccagtgttactggatgttgtggaaccagaggccattggttgaactgaatggtctcgacaaccatcattcgctgatttgctttctgcacatgaaacataatccttgttaggggaataactaaaaagcttatatcattaacataatatcctaaaataactcaacaggaaaaggacttggttcttagcagaagatgacaacctgagacggttgcagcagaaatatttagcaagttctagagggtttgttgggatgtattttatgctatgtcccacactgtatgatttgttcagagtttttttttccctttctacgtttcaaacggttgggtcgaagattatctatatgaagattaaagattaaaaagaaagaaaaggcttctttcccaacaaaagcaggtaagtcagcattacatcaagaatagaccagttttttttcttccaaattttggttcccaaacaatgtaatgtaagaaaaggcactaccagaacaaattaatacattcgtggacagaggagtagaaaatgaccactccttttactccaacagagctggacatgaatgccatattcagccaaagctccaactatccatgtggcctgctagagtgttaagtgcaaactggagcgaccaagtatattaagtcaagttagcatttccctattgagcgtttcacttcactcatacacacacgtttgtcggtattcagcgcatgcattatctaattatagccaaatatgcaaacctccatgcaacccacacaccaataaaatataagcatctacaaacacaaactgaaaagaattgaaagtactgaatctaatctgctcgcctcccgccaaccacaggtgttctactcatctcacagcaaccaaaccgtcactacatatcttccccatactacaacggcttcatccagaggacatccactacagaatcccctggcactagcaagccacaaagccctacaaccaggagcacaaagcacgagcaactcgaacaccaatggcagcactccaaagccacagaccctgcagactcgtacacaacagcacagcaggacagcacacagctcccatcatcaatctcattaatctaatacccgtacgtgaatgaagcggaggccatcccgtcccgtcccattcccatcctatgccagtatgccacacacaccccacacacacacaccaaccactctatccaactcacgctcttgaattcgtaccacccaccaaagccctctcctctcctctctcggatcacaccaacacacatccatttttttcatcatagaatgctcccatcacaatcaaacattacttctaaaagtaaaaaaggataaaaacagaaaatactactagaaaacaaagcttccgccagcagccatggcgccatctcatctcatgcggcgctagcgtacaattctctcgcgcccgtgcacgcgtggcgccgccaccccgagcgaccgacgcaaaagcatgcgccgaaaacgaagagcggaacacgagggaagcaagcaagtagtacaagcgagtgcgggagaggatggaagagattaccgccgccgacgcgagcgctgccgccgccgccgccgccgctggtggtggtggaggagtcgaccttggagcgcgacgacatgcagccgccgccgagccggcgcgggatgcggatccagcaccccatcgcgggcgccgcgtcctcctcctcctgctgcagcaccatctcccccgcccccttccccttccccttcctcctccgcctcccctcctcctcccgccgcttcccctccttccccatcacccccacccgcgcgcacacacgcaccttcaccgccgccgcccacccgcgcaacccccgaggtcccccgctcgtcagcgccgcggaggaagccgccgccgcgcgctccccccggcggcgagcgcgcagggtggcatcggcgacgccgcgcggcgggtggtggtggaagggaagtcgaggaggagagtgaagaggaggggtggtggtggtgtcggggcagcgcgggcaggggaaaggcgaaggctgagggcgaggatgcgggcagagcgggcagggcggccagaaagccaagcggagtgggaatttggcaaagaccgagggagaggagaggagagccccctgcccctgcaccttcttatggccgccgtccgcatccgtccgtctatagaacccccgtttttgcattttactccctacaagatttctaatatatccttcaagattgtagcattatcctttctctcatagaggcttcaacctgctgcctcttcttcgcatcaacgtggtcgctttcggcatggtaaagagtacaggaactagggtttagagtttagtgctgaggatccttaaattcacgatattgtaatatgtccagaaaaatgcatgagaggtgatacgtactaattaaacgcgggaagatgtaataagggatgacgtaataacgtatcccaaatacgcgcgggaggttgtagcaattaaaagcggaaaaataaaagttaacggtattggatgatggagttttaagtcgggtttaatgtttgatgtgttctaaatacacgatactataatatgtccaaaatagtcttgagagtcaatatcgattaaatgcggggagagataataagggacgaagtgatgacgtgttccaaatactctcaaaagattgtactagttaaaggcggaaaataaattataacggtatcactactatgttgtttacaaatgccttttttttggggtgcgggtggaggggtgcttatagctatccaatggatctatgtgtaaatactagaaaattttgtctccaaccgatattcctcgcaaagcatgtttatccatagaaagaaggtgatgaaactctgcagggtttaaactgataatcttggcaagcattaacttttataaatactcattattcacataaaagacaataataaatacagtatcaatatgtggtgtatccaagcaaatcatttatcaataaatccaatcaattattactcaaaatgtgtgcgcatatgtgctttaattttgagttttagataaagtaactcgttatttcactgaaccgtcgcttgattgcaaacccgctaagtatatgcaattcgagtttatgacttcgagtctggttggtgtacatcgtttctgacgaagatatcataacttataatccttatgtatattggtacgtggatctttacaagcataatatacaaccaaacacgtttatgtgatgatattattttcaaaaccacggaatcaaaagtgtaaatgaatagagtttgaggcagtacaaaacagggggtggaagtctgattaacgaatgcgtaaaatatacattcaaatatttgaaaaccaaacatgccaaaaactagcacggttagattccaagttttataccaagaacagaaaataaaaatgggataaaacatactattagaagcgactacaatccttatttttttcaaaagacaaacctgtaactatgctatatgcatttgaaacggattaaccaaaaccagctcgaaatttttcttttggtaacgtaggcagaactatgttcatattgagaacggataagctacagcctttcaagataagcatgtctgaaggctcgttgctcggttgtccacagtagttttgacttttgtcttttgatgttaaccgtgacatgcacagtttcagttcaaaggaacaaataaactaaaaaaaattacaaggttctatctgcaaatcgacaccaacacacgcacattttgacgatattcacgaatccaccatccatttcaaatccaacagccccctctactcggacgccgtccgttgaggcgttgatgcctatctcccgcaaacaaaaagaaaaaaaatactccaaaaaaaaaagaagaagagaacacgagagaaagagagcgcccattattctggaaacatagcgataacgaacccctgcgactgccatcaatgacaagtgggcccacccaaaggtggtcccggtgtgccagttacggcgctcgcgtgcccctctccccaccgggcccagtggcagctggggggtggtgcagatattagtaacaaaagaattttggtaggatgataaaagaataataaaatattaaaataccttgcatgtattggtcctttttgtgaaaagaagcacttggactttagagcagagagcagcaggggttggctggcttgctatgctggcaacgttggcaggatctcgatccgtattctattatgctatgatactatcttactatgaaacaatatcaatcattttattctaattttcatagtatcccgatcttactatttatttacacatgatcttacgaaatcttagctagtatcatgattctacgatcctacaaaatattatttaaaataaggtggattgaaaataatgtgaataaatattcttaagttttacataaaaaccaattaaatttatcaaaatcaatttatatgcgttaatttatacaacatattatatattttatattaaaaatatataccttctaaaatatgatagtatcgtgatcttataatattataaatcagaaaacgttcctagtatctcaagactgattacctttgttggctttgggtgtgggtttggtttgagttagacacgggtagttaaggcacaaatcatttcttcatgcattcacccaaaaagaaggctacttagtacttaccggttcttgaaacagccttaaaaagaggttagtaatgattcgaacccaggaaaataaggctcattttggtatgagaaatagtaccggtactcgagacttaatgcgtgacgatgatttaatttgaccagtgcataaataagtatgtgaattgaagtgccgttatattgtcattgtctataaataccaagacaaactgactttttagaaggttttagaagggagaagacagggatacgacaccataacacaaaagtagacacaaaagtatatgatgttttgggatctaggagtagaatttagatgaaacgttgacctattacaccctctagctactataaccaccatacgtgcacagaaacattgtgagcttaccctctcccatgtgtagaggtggatatcgaccaccatgactctcctttacagctttgatatgatcttgtcaactcttccaagtttcaaagggcttatttgcatttagaggtactccacaagaaaaaaaaattaactcatcttgcatgtaacaaaaaccaagaaatctagcgctgcaaatctcttcatttaagttttgatctatgaaaattataaattaatatgtccatctcatttaaaaaatatagaaaataaaaaatacataatttttagatggagggagtatatgacaaagacaagctagcagtaggattggggaaaatggacggttaggattagctcaaacacatccccatcctcaccaagcctcgtccatcacctaaatcctgaagattccataatagtaaaaagattgttaactaactgaaatcccgtgtgttatttcggacatgcgtagttgtaggtaataattaggaagaaacgctttttaaaacaaataagcatgaataataataataataataataataataataataataataataataataataataataataataataataataataataataataataatagcatacagtataaatggttgagattaagcatgtaagagatctaacggctcaccttattgcttcacgtacgttaagggcatctgacagagtatttgcatatggtttgctaactacatgagtttgacgctatgaaattttacaaagaggaggaggaagaagaagaagctactcagaaagaaccaaaccggccttacctagaataactgtcctgcccactaaattaattaaccaacatgtctgaacacggtcaagaatgtctaaactgccagtgaagttgttcttaaacaaacatgagctagcgactgtgattaactaatcatatatagtacacgttttgcccctaaacaactgctagttgcagagtgttagaccggtcaacgaatagttttctcctattagccagtataattattttttccccaataatctgtgtgccgtagggtaggactaggaaggcctcgattgtcaatggccggtaagaaagttaggtatccaccgaataataatgcactgggatggagtggagtggacttcatcacacagggaatctcttgctccggaaattatatgcatgcagggttatgaacatggcagcgacagtagcttcatcttcatgggacccaagtttgacaaattagtgaagcttcgaggataaaaaaaagtagtaatgtgcggaagaatttgtaagttttagaatcggtcgtgacggtggtggtggcggcggtggtaatgacggttgtcagcagctacaaaatctctaccattaggcttccagcagggaacttattttctctagtttttggtaagaatgattacacttaccctttgttaccgaagttttactttataccatatgtactctatctaatgttttcatattggactaaatatttttaccatttttcactttggactcacctaacacttttgtataaccacatccaacatctcctccgcaaacatgtgagctacacataagtagaaaagatcattggcatgaggacgctgatgtactcgtaaagatggtgatccaaagagtataaagggtgaaaattcctagttcaaggtgaaatgattggatagaaggcgattcaaaatgaaactttgataataaaatgtgataaactgcaattcaccctattaggaattattcccaacgttttagaatgttgttttggttttgtccaaagttaaaccactttaaattaactagatttatttataggaaaacataacaacatcaaattaatttcgttaaatccacaactgaatattaattatatttatttagtattaaaaatgctaatatgtttcccgtaaacttgacaaaaggtgatgaaatttgacttaggaaaaaaaacaccttacgttcttaagcagacagagagagtagggagatgtttgggattctggaaatggaggatgatttgctgtgaggatatagttgttcctaatgtgctgtttcttgaaaaaaagttgccgttccaaatcaagacacactttacgctgggcttgggctgtttttaccatcccgacctgtgcaagcttgggccgagcccgtttccagcccaactcagacaggcccagctttgctttgcgattcgcgctctgacgtgcgcgggatcggtcggtcaaccgcgaccgacctactccgaaaggcacacgtgacacgcctttgccgcctttgcgatctcaaagccaaagccgagggcacacgccgcctttgcgatcgactcgcgcgtctcctctcctccttccagggctcaggcgaggggggtacggtggtggtgggctcgccggagagatggccgagcgcaaggtgatcaacaagcactacccggacgacttcgacccgtccaagatcccgcggcggcggcagcacaagaagcagatggtggtgcggatgatgctgccgatgaccgtgcgctgcgccgcctgcggcgagtacatcgggagggggaccaagttcaactcccgcaaggaggacgtcgccggcgagaggtacctcggcgccgtccaggtgttccgcttctacatccgctgctcccgctgctccgccgagatcgtgttccggaccgaccccgcgagcgccggctacgcgctcgagtccggcgccacccgcccctcctacgagccgtggcccgcggcggcggcggaggcggggcgggaggaacgcggcggcggcgacgccatgacggcgctcgagggccggtgccgcgacgccaggcgcgagatgggcgtggacgccgcgctggaggagatgcggtcgctcaagtcgaggcgcgccggggtcacgccggagcagctgctggagtcgctgcgccgtcgcggggaggcgctggccgagctggaggaggacgacgagaagctcatcagctccatcgcgttcggcaacgcgaaagagcgcagcctcagacggatcgacgacggcgacgacgaagacgacgaggaggatttcttcgattcgtgcctggccagagcagccatggccaccaccagccaccaagcaaagaagaggccgccgccaccgccgcgagatgcggttaaatcgttggtcgtttcgaagaagagaaggccagagagcatggatcaagctgcatggccgccgtcgtcggggaagaccaccgcgagcaacggtgctcttcaggtgctttgctgtaactatgacgacgaggagtagtaggagagctaagctaatgtgtggtgatggaatttgacaatgattctttcccttatggcttgtttagttggcaaaaaaaaaaattgtccctacatatcacatcgaatatatggacacatatttaaagtattaaacgtagtccaataacaaaagaaattatagattccgccatttactgtagcaccacattgtcaaatcatggcacaattaggcttaaaagatttgtctcacaatttcctgacgaactgtttaattggttttttcatgtctatatttaatactccatgcatatgtccaaacattcgatgtaacaacgtgaaaaattttgtttgggaactaaacaaacccttaattaagccattttagttagacgctgatatgatgtagtacgttttaattaattatcgcctgaaagtagtgcgctcagtatacgtactttgtaattgtcacgtataaagatattgattgtggatttcagtagttgagagatgaaagaactattcatagagaggcattaattgatttcactgttttaattgaacatatactgattttgttactcctgcttgaatgtcctaaagaaggagagtatactcctggatccttttcaaggcttcagctatgtaaaatggcaaacaagccgcagtaccttttttttggcagaaatttatcataaataagcaaagaattaaaaaaaaaggtctatataaagtttgggactattaccgtggcgcatttcttcccaagcgacacaaattttcaacctttgattagaacgggtgtggcaactagaaaacttatatgacagcatgttttctccactactataaaaacactcacgtcttctacctttcccagtccccaccatcgtacttacttcctcctccaagtaaaaaatccaccattccttgaaaaaactatcccttctaaaaacgagaaaaacaaaatccaccaacaattaataaaaaaaaatcagatacggggtatataagactagcataaaaccattcatatgtattcccccaatacaatttgtaagcacgggcgtagcactacatagaaaaagggtcaaaaatttaaaaatatgtgttctggcagtgtaaattatatgtcgtccatattgtaactttttaatcatagtacatctcaaattacaaaacttaaattgcaattttacaagctcacacgaaaaaggcaaaatcacaatacaagccgtgcatgcctctacttttttttttcgtttttgtgaacaacgtgttcttgtggataaatgaaggatcaaaatctaatcgatccattcaggataaaacgtatcaaaagcaaccgataaaaaaataaatatttggaaaaaaacaataaataaaaccgtaaaatctacggctcaacaacaaacctccgatatgtgccgtttatgtggtgacagttgtaggagccttccagtctgtcaagcggtgtgcatatcaatggaggccaaaggattcagtcgtcgtggttttgccgcaaaactctatcgatctgattccctactgttgttttatctcatcagaaagtttgcttccttagagtggttactctctaccttgttagagatggtttattggcttaagttgtatccttgtacgatgtactagggtatatccctaaattctgtctcgttgaataaagttgttcatgttatcttaaaaaaaaaatcagtctggtcgttcggtcggagtcggactcgagtcctcggcccggtccaaatacaaaaagagcgcacgccccactcgacacgttgccccacctcaacgtgaccgactcgacccccacccaagacacgccggcggctacgcccccgaactccccatcgcctcgcccgcggattctcctcctcctcctcctnctnctctttcctcgccgccggggacgcgccgncggctaccttttgacgctccgacggtggtgccctttttctgtgggacccgggatcctagctcccctcctcccccgatgattcccggtcgcctgggcggctctcctcccgtcctagggttccggcgaggtcccccgcggctgcgccggcgagatgggtgagcgcaaggtgctgaacaagtactaccctcc

SEQ ID NO: 5711 - DNA, 7407 bp, Oryza sativa
acacgcttccgttaaccgtttacttacggtaatttactgcgatgtttgcttgttttgtttggcatttgtactgatcaatgtcttagggcctttaggcatagcttgttatctatcttttttgcttctgagaatcagggttgcgcaacatagcttaaatctctctgtggtctttgtattatatttaccatgataaaatgctctagtagtatagtgtttgccatcgatatgcggtgttaatgctgaatgaagcattgagcactccatgttcgctgttgcctgcctaagccatgtagcccctgatgtttatgtgatcagagctgaaatggttgccaagtaagtgtggacttaatcgtgcaattgaagacaaaaggttaaccatttaactgtggacttaatcatgcgattcagaactgtggaattaaaaccatttttacactgttacttggcaaccatttcagctactgtggacttaatcatgcaattcagtatttcagaagatgcttataaattttggttggcctttctggtcaaaatatgtgcttgctattcgggattgtgcactttctttctatagtagcttctgtactactctgcatcttgtgctcctctttattgctttactggagagagttggcatttacctttcttttacattgaatactgactatatcctcataatgttttatattttctcaacatatagttaaaacacaacagccttttttgccatctttctgctgtcgttaaacttttaaccatgattggtaattcattgttgtacggcaaagcgtgagcttttatctggttattctgttcttttgtaattgtagaatttcataccaatggtgtatctgggctgctagttttaatgctaatttatgctaatgtgatttcatttcttgtgtgcagaaatacctggggatacaaatatttaggttttacttcaagtgtacgaaatgttcagctgagataactttcaaaacggaccctcagaattctgattacacggtggaatctggggctagtcgcaattttgaaccttggcgtgaagaagatgaggtgggtgatccagggcatatcttaggcacatcttatttgtttcgactaatattatattgaaagtgacaatgacgatgtatattccttttttcaggtagcagacagagaaaagaggaaacgagatgaagaggagatgggtgatgcaatgagagcattggagaatagagcaatggattcaaagcaggacatggatatacttgctgctttagaagagatgcgatccatgaaggtagaatatggtctatgggcatctgttcttttttctgtaaataaaaattgaaataagtcggacttagtgtgctgacattgttttcttgtgccttttgcagtctagacatgctggagtcacagttgaccagatgcttgaaattttgaagcgctctgctcatgataaggtaagatctcaaaataattcttttgcttttgtttaatgaatgaacaagtcattgtagcccctaaactatctcaagaatcaatcctcaactatgaaactgtccagcattcaccctctaactcctaaaactagactaaataaccccataactctggttttagtggtggcttttgccatgaggtactagatgcttgctgttggtgccattatgaacctccacctcagcattactcttcatgtacatgaaaacatgatataacccagcaaaatcttctcaactttcttcgctatacctgcttcttgtggtcgtttctggaagcagtagcaaacttgatgttactactcagtaggaaaccttgggttttaggtgttgggagtcgaggatctggccttgtggccttgttgctgctaggatgtagagcgatggtgaaggatcaggggcagcggtgacagctagacctgtggattaggaggccatatcaacgggtgaggtgttggtgttggttggctacctcttctgtcatagatgtttatgatctgcatgacccagcaaaagggagcaatgtagctttgatctgaaccgctaaaataaaaatcatgaattgtcttgttattaattggatggtggatttaatctgcacttggtgaaaagagtcaggaatctccatgcgaataaattgaattggaactagccagatttggaaaacagtacatagatgatagaattgaccttgacgattgagctgatatgcttgccctgcaaccgtatgatattcatggtaatttacctgctgggatgcttgtgctcccacaaccatgtacaccttgtactttaccttctgcccagcagcttgcactctgctcaccggggtttcaacatgctgtgttagcagcattgggactagtaggtttgtcatgtcagtgtgatgtaaaggtgatggttgcttgaagctgttttgttagacaggcaaaggacagcgtgaagataagagagtagaaagaagcagcacagggtgactttttttcctgttattatttaattatttaacttagatatgttttccaccacatagatgccatgtcagcatgataccaggtactccctccgtttcacaatgtaagtcattctagcatatcccacattcatattgatgttaataaatctaggcatatatatttatctagattcattaacatcaatatgaatataggaaatgctagaatgacttacatcgtgaaacggaggaagtagtatggagtggtgggctatcactcccgttctgttttgaagggtgaactttaaacaattctgttgttgagggtgaaaacagaccttttcctttaaaaaatgtttgacataggatagttcaagagggagaaaacataacttttcctttaaaaaatgtttgacataggacttttcatctttttggtaatatttatgatagcttccttacaagcatgggtggccatggtgtgtaatctgcctgcttaaatctcgcattgtttttctaacggtgataattttgggcaatgacaggaggagaaaacagtagctgagctagatgaagaagatgaaaaacttatcaaatcaatcacttttcgagtaatcctctacctcaacttacatacatccctgcatgtgcaaaactgtgtagagagagaagttacttcgtacaaattataaggcatttttttaacttgtgatcctattatttaatgcagaactcccaagattatgtaaaacggatagaggatgatgatgacgatgatgaagatttggtgataccgggccagtcgagtagcacatcaaaggtacttagcactcctgtttgatcttgtaggctccatattcttaacctccagttacagtaaaaatcattggacattagctggcattcacatattaccaaactagccctggcagatccattaggtactaaagcttgctaagcttttatttccatccccctttgtcatttaaactgtaaagtattcagctttttcttaatagacgtattggatttcttaaatagataatacctgcactttgagcactgaagctttgttctggttggaaaattttttagcatatatttttagttattagatttaatgaacagttggagctagggtagaaggccatttgaacataagtccaatgataatggtaaattttggtcaccaagcagcagtattatgcaaattggtagcaaacattggcatagtcatttaaaactattattttttaaaacttaatttaaaactattgttttggagtagacattgttgtagcattttcagaattgcttgtgtcagtctcaagagtttactggtcaattttctatgctaatgtagagttattttcttatgcttccatttgatgtctcttgaatttatttgctttgttgactaacagttctattgttctgtagatgaatggatcctcccagtcagtatcaaatgcaacagatgtcctgaccaagactagtggatctgataatgccaataaagaaggtaaaaactaagcagcatatttgtttttatcatgattatcgttatcctgaattcaaagtgttacattttttccccgcaatttggcagggatcgtgtgttattcccttttcttgattaagcagcgttctattttggaaacaaatgggctgcccgtgttctttatctagttattaccgcgtgttacttaccattaaatatgcactgcaggaaataagatctggccatctaagatgccaaaatttatagtcaagccaaagtctacccctacagatcctatcaagaaacagaagacggaaaccacggctggcccggatactggcaaagcgccagtcgcagaagaaaatagtgagcctgcgcagaacaatgtcctccaatccctctgccaaaactacgatagcgatgaaagtgagtgatgactgcgtggctgcttcgtgccgtaagcccgtaacaaccgtaaccgcgaatcgccaccaactgctgtggcattggttgcagcggatgacaattccactcacagaagaagaatattacgttgtgctaacattggataaccagatccctgaggatctattgttgccacaaatctgaatcccgggaattcattggttaagtatatacagtacttcaaaatctgtggctgctaacattgtccaggcgagatttatacgtgtgtggtttgttgctgaatgcctgaagagatcaaaagtcttgtaaaattgacagggaagatgtttgttgacgttgggttcttgcaccaatccttcatttctacgcctagcttatacacaacacaaatttgaccatgtttagtaattctctcccaaatggattctccttaaatccccttcaaaatctaagctgtacatgaaatgcaattccattcttattttatctcggtttccgttagcactttttcaaactactaaaggctatctgtgtaaaaacatttcatataaaagttgctttaaaatatcaaataaatcacgtgttaatagtttttcgtttttcgtgtgtcaatttaatcctcatcctcatgaaactcaattatcatctctactgctctcatctcagaacaataaactggaagtacaactgaactcccatgaccccctcaatggaagatcttaactaactactcttaactatagtgaaaatcgccgtgcgtacaaacgaggaaaggaaggaaatccagttgggtctccaatctcacgcacgcggccaccaccagaagactacgcacagccgccgccgccgggacgccaccacgctccccgaggctgatccatccatggaggaaaggcccgtctcccaccggagtagttgcacggtcaccgacgccgacgaggatgacctcccgacgcagtggaacaagtggcgccgcgcagccgccctgtctcggaggacccggcgcgcgccccgcgtcgccgtgccggccagcccgacctgcgcctgcggcggccgcatgcgcagggtccccaagcccaggcccatgcccaccgccgtggacgagcgcgccgacggtgcctgcggcggtctcgcccccgtgctgcctccggcggcggcggcggcgtggtatccgtatgatctcatgtgcacggagtgcgacggcgagaccggctggcgccggcggaagccggcgtgctgggcggcggattggaaagccgcgcggccgcggcagcgatggcggccatatccttccttcgccgacgtggccgctgccctcggcgatctgcggctcggcgccggcgacgacgatgatcattccggtgacgttgatatgatctcttgttcgtttcaaaaatagtgtgatcatctcttagggccgaaatttcagtgtcacttgtaccgtagtactactattctatatgtgatcatataatttcatagtagaaaaaaagctactaatttagttgtcctaaactatgaaatatcaattcttctcccctgtctaattctttagtcgtctatcgacaattgttcgtttcactccagttattaggcaaaataaatacatataggttcaaattattgtgccaatcttcctaactaaaatcggttctatattgatacgttatacgatccaccattccccaaaaagagagaaaaaaggaacatagatactgaaaagaaaaagaagatatcaagaacatcttaatttcctttcagatgatctgttgcacgctttccttccacctggcttcctggcttgaatcttgtacaaatactaggtaagtacttatttgcatatttcatgacttgacagcatctaatcagtctctgctaagctcattgctgtgttgatgctgaaaactcattacagcgaaattgaaaacatattatgattcttcaagaatggaaaaaaagggatcaaggatgaatctaagctacagtctgattagaaggtaggaatgataagagtagtgctgacctgcagagaatgtcacccgttcgtgtggttttcccatagatccaatctgggatgagttcttgtcgcaacctcaactgttcttttatctcacctggaaccttatcgatttaggatcagattgcagtatccggatatgtataaaatgatgagcatgtgttataaaatgggcaccggtaaacagtgtctcatgctctgttaagtatgggcttgaaagaattgcagttgaaagaatcattttagggccttttttttttgcctactctattttcttgatcgctaggaatgaattcagaggatatcattcgaggtacatacatctatccactattttagggttacttgtaattatcttgtaaatgagctcttgttttgtcattacagtttgttcccttgagcccttgactgaaagatcagaaagatagtgtcaaaagtgccaggcaagcacgcgatcagcttttgtcttctaaaggtatctgcaaaacctgtttccttttcctccaaacctctcttctccttctgctttatctgcaaagagagagaatatcaggttcggatgccatatgtagagaagcgaaacggaatttcagtaacaagcgagcccgaatctgaaagaaaatgataaacacagtatctttgtgagttaccctgctctatttcaacaaaaaaaaaaaaaactgtccattttattttgtaatcaagtaaccaactacatcttcatagagggtagtataaatagagatatatatatatatagcagaaaccatgatcaatacatgttgtaggataggatccatcaaacagatgctcataattctgttcgtaaattatgcaaagcatagtgtactgatataactttgcttacccacacattgaagtttgaacatcgatcctcttgttctactattcaataaaaaaaagcgtgaatattagggaagtatctaatactccctccatcccaaaatgtttgacgccgttgacttttttaaaaatgtttgaccgttcgtcttat

SEQ ID NO: 5712 - DNA, 14244 bp, Oryza sativa
gtcaacggtgtcaaacatttagggaaggagggagtatcaaataattagaagggtgaggcttcgaacccatgtcgtctagcccactaccttgtggagctagccggaagacgcctgggcgtttctcgttctgctattcaataaaactacacgatcagaacagaagcattttgtcttatgtcacgaagatttggagaatcaagggattaacattgttatgcttgaagcatgttcctcacataaatgacagttcttctactggacttatgctagattagtaagtctctgcccgtatgactatgacgtgtgactaatagaacaaaggttggagatgctacggcatgaatgtgacatgggagtgtgcgtaggaagaggtcaaagatcacacttttctggcttggtcgccggcgttggtcgtcgccatggttgagcccccatcttgctcctgcgaggctaccccgctgctgcggcttctccggtgtcgagatccgctaaaaccaccttcgtcgaggactacacatcccctggcttcctctccgtcgctgtggtccgctcggcctactagggttgtggcacagtccacgcttctaagatggatgacggatagtttggcgggaagagccggcttggcgcgaggcaacagttaaggctgcattgtttcagtgccaatcatgtgaccatgtacagaaacgtattggaatttcagcccaatccaaaagaagctgaatttgggaataagaaaaataaataaacatgatacttttgcgacctaaatttgtttgataacaaactgtggttgtgaaaatagaagtagtataaggccgaccagtggccaatatcataacagcctcaatcgagtaattgatatggtagaacatgatcaataagcaataattgagatattggtggacaccaactagttcagcagatatgaaaaccaaaggtgcatcaaattaatatatttacccaacgatccatatataggagagaggtctagtatgcgatgttcttaagcaacttttatggctctttttttaaacattttgtataatatatgattacccataaatccatacgagaaatgcctacattatgatgttcttgttctttttagatacattttgaatagaatatgtttactcacgtaatatccacaagggagatgtctatatgttgagatgttcttcacgtgatcttttagatgcattttatatcgagatgttcttcacttgatcttttagatacgtttcaaatagaatatgctcacataatatccataggccagggagatgcctatacatcaagagatgttcttaagggcatgttgttcatcttgtaagaggatcaaactaactaaagaaagaaagtataaaggagcaaactaactaaagaaagtataaagtggtaataatgtttttgttatattattttgccaagtgggttccatttaatcaccgacaacaattgacttgataaaacaacttcgatttttcgaataatcaatcgaagcagctcctacactgctatcaaagtaatactacctctatcccaaaataagtgtagttttgcactgttcatgtccaatgtttgaccgtccgtcttatttgaaaattttttttatgattagtatttttgttattattagatgataaaacatgaatagtattttgtgtgactaattttttcttaaacttttcaaataagacagacggtcaaacgttggacacagaaacccacggttatacttattttgggacaatggtagtataaatcaagagcatttgttctaatttaatttgcatcctccctagaacaaggtaacttctcgaaaacaactgacaacaatgatacaacatgcattcgtcccaataaatctcatgtggagtaatacaagctttttagtaatttggacatgacattcatacaacaagttgttggaaccaccaccttgtcgtgatggtgacggggacaattgatatccagtgataaaaactgtgaaggcagaagggagccgtcagttgaaccttgtgaaagatatatgatggatggatagcatgttgtttaagggcacatttatactgtgattactctcctcaatactgagatggcccaatgagatgttggagaaaactctttatctcggcgctgtcttgcggacatttttaggctgagagtcattttttttctaattatggcatcttgaaaaccactgttgatttcatctgttatataagggaagatcttactgtaattgcttcgtttatcattagacatagttgttgtttttaatggaaaaaccgggccgaacttctaaaactaaaaagcagcccacccgcttccatagaacaatatcgcggcaacgtattgactaagatgagccaattagatgttggagaaaactatttatctcggcgctatcttgcggacattttaaggctgagagtcattttttttctaattatggcattttgaagaaccactgttgatttcatctgttatgtaagagaagatcttactgtaattgcttcgtttatcattagacatagttgttgtttttattgactaagatgagccaatgagatgttggagaaaactatttatctcggcgctgtcttgcgcacatttcaagactgagagtcatttttttttctaattatggcatctcgaagaaccaatcttgatttcatctgtgtgttatataagggaagagcttactgtaattgcttcgtttatcattagacttgtttttattatctcactagtcatttagcatctaaattttggtaataacaaaaataaacaatcataaaaatattcctgtttaaattatgctcaagcaggacctatcaaactaattccacgtagaagggattatttaaagatacaaccaattgaagattgatgcccgaatcaaccaaacaaaagatagatcttgccataattttatttgctactaaaattttagcgttgcatgaattttggcaatgtcaactcatgcaatgctaaaattttggctatgcgtttttgttgggacaccttggggtttacttggccccaaaccaaatgaagccccttaacaatgctatcaaaaatttagcagctgactaagtgctccaacttttatcaaaattttgaaaatatctaatattcgacgcacccatatttcaataaggttcatattgtttgtaaacccaaactaatgtctcagaattttggtagagtatgtccattttatctattgcaaatgttttagaggtgtgtgggtttagttgggtactttcgacaaaaaaaaaggctatcatgtgcttcaatcttgcttcaaatacaaattcaattaagcatgaaattaattggtactatgcatgtcgttcgtactactgtggaggttttcttcattctggaccaaatcagtgaatccagatgaaacaaatatgctgctcggcaaccatactgaagctgacattttctccgatcttaaaattgttttgttatcataggaagaactgacactttttttttttgcttcgcagatatcagcgaccccataggtttaatgtattccatcttctataggagcttctcctgtctcatttcctttgcttcaaacctagctagtccccacccttaaatctttcacatcacagtagtgggcaaaagttctgataattcactggtttgttgtgcatgatccgacttattctcattttccattaggcaagataaggatttcaccctctccagctatcctctaacggctcgtttggttggagggagtttttagaagggattgggagtttagagggatgatgctattaagtgttttgtttggttgggagagacatgagaattttgataggatgaggatggagaattgaggaaggaactccctccttttcaatacctgagtaggggcaggtaattgggagggaattcctcctttactttgtctaagcacatcttagttatccgtttttattaatgacctaatctccaactaaactccctatcaatttccatcaccccaactaaataagatattgggattaaaaatcaaattctcatcttaatctcatcataaattcccttgtgtaaactcccaatctccttccctcaagttaccaaacaagccgtaaggatgaaatggcgctagacatcaaacatgaggacactcccaagtttaccacttaatcaatcacagtgtacaatattattgataattctcatatagttatgtttaaatttaaaaattacgtacataattctcatcatatactgtgtaaaaagttctcatcatataaacaaaccaaattggatgctagggcggctaatcacatgattagtagaacattacaggacaaaccttcacatattcttctagaaggtcctcaaagtcaaacacccataaaccactaaattcagacattcattagggaggaaatcaagagcatatcttcttaattgttctgcaccctttccggaacaagctgacttgttcaaacggtcattaagtttcctaaaaacaaatgatagcaatgatacaatatatatcatgtaatacaaagcttgttccagaaattttgaacatgagattcacacagccggctgtttgaaccaccacattgctgtgatgatgatgatgatgggataattgatatataaggcagagggaaaccatcagttgaatgttgtgaaagatgatggctaccatgttgtttagggacacgtttatgctgtgattctgtgattactctcctcaacatgtataccacgatgtcaataaataaatagggacctgaagtggtaaagagtgataccgcttgctttcctttcatgggctgtatgtgtgggtatatagctgatagagtgagataaatgagaaaagtaaggtggtgagatgcaagagaatatttagaatcttttttttagataatggaagctttattaatctcagtaaaactctatcaagtgatacaattattctgagagcacctccggctttgcacccaaagagtgcacacagccaacaagaaagaaacaaaagataaactcatcatccaaatagcagggacaaaaagaacttcaggagccctctaaccgtagcctagaacgccacccatgcgccggggtagaaaactccatggccactagctccaattattgacaagccgcaatgatagtaccccgcaaattgaccttctgaaggatagcccatgaaagataacctacaaagaagaagatatgtttttcctttcaaaaaccacatcatttctgcaaagccaaatagaccaaatagtggtagttgcccctaataagaccaaagatctcaaattgcgtggttgtcttcttatccaatgcccaaacatatgagttgtactattaggcaaactaatattcgaagcaaactggattaaagaccaaactgcacgggcaaaacgacaatcaaagaacaaatgattaatagtttcatctttgtggcagaaagaacaagacttgtttcctctccaattccttttaataagattatcttttgttaagactactccacgatgtaagtaccataagatcttaatctttagggggactttgattttccagattcttttgtttatattgggaacatcggtctgtaccaacgcaagataaagagatttaaccgagaatctgccatcagttgttagattccatttaaactcatcttggtcgtgagataatataatattagcgatgcgtgagagaaggtgattccacaccactaacttagagccagtaaggtccctgcgccaagaaaagcttagaggactggtttggaaaatttctgaaatagttgcatgtttatgcctagcaacgttatagagacaaggatattgttctcttaaacaggcattccccaaccatttatcttcccaaaaccgtacttgagagccatctttgatgttgaaggagccaaacccgagaaaatcaggcttggccttcattagactagcccaaaagtgtgagtcttctgctttccactgagcttgagacaaaggctgtgaccccaaatatttgttccttagcatttgttgccacacaccatctgtagtgagtagtttatgcaaccacttgctaaggagagccttgttcttaatttcaagatcttgaattcccaacccctccttggtctttaggacgacatatgatgtcccaccttgctagtctatatttccttttgtgtccatccccttgccaaaagaaccttgatcggaaataatcaatcttcttgatcgctcctttaggtatttccaaaaaggacattatatacattggtaggctggtaagcactgaattgattagtgttagtcgccctccaagtgataaaagtttgcctttccaacttgccaaccgtttttcaagccgctcaatcacttccttccactccgaattacgaggtctcctatgatgtataggaatgccaaggtaacagaatggaaaagaaccaacctcacattgaaaaaggttagtatattgatcctgagctgtttgggcttcaccaaagcagtaaagctcgctcttatgaaaattaatctttaagccagataattcttcgaaaacgttcaacaacattttcagattacaagctttctctagatcatgttccataaagagtacaatatcatcagcgtattggaggatggacaatccaccatcaatgagatgaggcaccactccaacaagctgtcttgcattatttgctctctggatcataaccgctagcatgttcgctataatattgaataaaatgggagatagcgggtcaccttgttgaaggcctttctttgtttgaaagaaccgtccaacgtcatcattaactttgattgctacacttcctcccgaaatgaaggactcaatccaagaaatccatcttggcgagaaacctttcatacgaagagtttgtagtaggaaaggccattttactttgtcataagccttctcaaagtcaatcttaaggatgaccccactcaatttcgatgcaacttatgaacagtttcatgtatgacgacaaccccatctaggatgttgcgacctctcatgaaagctgtttgagttaagactcactatacggtcagccaccgagtttattctattagtgaccaccttagtgaaaattttgaagctagcatttaggaggcaaattggtctgtattgttggatacggttagcttccttgactttgggtatcaaagtgatcaccccaaagtgtatttagaatcttttaaaaaatggtaggatcaatatgttgacacactactcttgtgtatgtattatggagaacctatgttttgattagtcgtactatctttctaacgtgtgagaatcatacctatttcattatgcaatttctttctcttctaactagggaagagaagggattgttgtaacttaatcggtatggggagagtgttcttattgtttcatttactattaagtattattgttggttttctcatctcatctacttcattgtgtgaaattattgtaattgtagaataagagaatcacacaacaataaacttttctaaacattgtgcacattccacccaaattttgaaattaaaacacaagtgtatgggtttattcgaattggtgcccaaaccaaccacaaaaactttgttaacaccgataaatttggccattttcttcactaccaaaattttgattgttccaacttatacaaagctacaattttggctatggattttggttgggagtccatttggtttcaaaccgtatgatagcccttaaccccccttaacaacagcactaagaaaaattggcagaaaaacaattgttccaaccctcatcaaaattttgaaaatgtcccagatttggaatgcagatattttgcggcctcagttaggtatgtttgcccacgccccacccaaaaaaaaatggtaatgacatattttaataaaccaaatttatcgctggtgagattagtgctacttgaattttcttttcccaggttaggagtgctgggattttattcacaatggtaagtttggtaacatcttccatcaagattttagaactttttagggggttttaatgtttttctgtcttaatttggagagaaacaagtctaatgggccagaaagcccaatgccctagcaaggcccacacgtggcgcctcctcctcctcgtctccttccggcgaaagcccaaacccttctctctcctccccgcgccgccgtcgagatgtttcggagcccggccgccgccgccgcctccgccctcctccgccgcctaggcccccgcgtatccggcggtggaggcggcgcttccactcaccggcgattcgcgcctccggtatccacctccatcctctcccgctactcctccgcgccgacgtcctccccttcgccgccgccaccgccacccccaccgccctccgacgccgcggcggatggggataaccgagcggaatcgggggaacccggctccagtctcagcatcaccatcgaccgctccggcctgtacaatcccccaggtccaaacccttcctctctcgcgcgcgcgctcgcacggacgcaacggcggtgtctggatttagggttttctcatggtttgcgtcgggtttatgccgcagagcactcgcacgagccgtcgtcggattccgagctagtgaagcacctcaagagcatcataaaggtgtccgctgtttataatgagcctcttcgtgataatctctactgtttgccaatgcggaaaatgtgatttggtgttgtgaaaattgtgattcggaggttagttccgcagcgggcctatcagcgtagccgagtacatggaggaggtgctgacgaacccgcagtcagggttctacatcaaccgcgacgtgttcgggacatccggggatttcatcacctcgccggaggtcagccaaatgtttggagaggtaaatttgtattgttgaagtaataattaccatgcctctgcatatcatttttctttcgccctgtagggttattagaatagggaatgaccgaatgatggcactcaggttcaaagcaattcttcttgtgaagattataggacaattaattcatgtgttcgtgctatggggtgctagatgagagcaattaatgatgtttcttttcctcagatgactggtgtgtgggcaatgtgcctctgggagcaaatggggcagccagagaaagtcaatctgattgagcttggtccagggcgcggaactctcttggcagatttacttcgtgtaatgcatttctgcttgcatctatcctattttgaactttcccgatttgtgtctttgactgatgcatccattggaacaggggtcatcaaaatttgttaatttcaccaaagcactcaacattaacttggtagaatgtagccccacgttacaaaaggtgcaatacaatactctgaaatgtgaagatgagcccattggcgataaaacaaggacagttagcaagctttgtggagcccctgtacactggcatgcttcccttgaacaggttccttcaggatgtatggagttctttcattgataactttgcttctaatgaacattaactattgttgaaggctcataagcacttgtattatcaactttcacacttggtaaaatttgtttttgtactgaaaataagtgcaatttcagttttgatacccaaagaatggcattttgttttgtcctttctattcaaaggtccattttgtttttgccgctgcagttaccattcatcagtttggcagcactgatttggcatgcattgttaagtacagtagggaaagctttaaggacattagctatataagataaggggaaacattatgttttttattttattatggtaccgaatgtgccatcgtgtataattgagtactacctccgtttcagtttataagactttctagcattgctcacattcatatagatgttaatgaatctaagcacacatatatgtctagattcattaacatatatatgaatatggacaatgctagaaagtcttataatatgaaacggaggaagtaacagattgggtttagttaatctgcggttcaactcttgtggcgaggagccaaaagaattgaatgtgccaatggactgtaatttttctaattagttgtatcatctccttgcacatatgttaccatttcatatttggtaatttagttgtttttgcatgtgtaaagtgtatagtgttctcgtgatatatgctcatttttagtattagattgtaaatattttctcgtaagtgtcatggttgactttgaaactggttgccgcctttatctagttctctttttcgtcaagctattttctttttgacatcttgatcagatttcttatgcttgttctgtttgtatatgtattctctgcagtgccaactataattattgcacatgaattctatgatgccttgccaattcatcaatttcaggtctggttacaccagcaattccacctcttaatgttttgtgacacaaacagattgaatattgttcatgcattccactgaaccgtcctttttcttctcttcagaaagcatcacgtggctggtgcgagaagatggtggatcttgcagaagactcatcgtaggatttacaaattttatttttaagtggttaaccttatggagatgtgtaattctaactttgtagcaggtttcgctttgttctatctccacagcctacagcctctttacttttcctttccaagcggtgcggttgggctagttctgaggaacttgagaaagttgagcatattgaagtctgcccgaaagcaatggagatcactgaacagattgcagatagaattagctcggatggagggggtgcacttatcattgactacggaaaagatggaatagtctctgatagtcttcaggtttggatattaaatttgttttactgcacaatatgaacccatggctctgtccaatcctggtctaatgcctctataacattaaatttatgtcctagatccatatgcttctgtagtctgtaacaatggctagtgtttgaacctaaattcatgtcctgcatttctgcattatttggattttgatttttgtgctcacactgagcttttgctgtatatttttatgtaagaaataatttaattaatttctttggcactaacaatactataatttatgcaggcaatccgcaagcacaagtttgtacacatattggataaccctggttcagccgatctgagtgcttatgttgattttgcatcaatcagacactccgctaaggaagcttcaggtttgcacagatatcttaaatcctttctgcttgtttttctcatgtccagacaaacatttcttactaggtctgtcttgaactttctgcagatgatatttctgttcatgggccaatgactcaatcccagttcttgggctctcttggtataaacttccgtgtggaagccctgctccaaaactgtgctactgatgagcaggccgagtctctgaggacaggctactggcgtcttgtcggagatggtgaagccccattctgggaaggtcctgacgaccaaaccccaattggcatgggtactaggtacttggccatggccattgtcaacaagaagcaaggcacacccgttccattcgagtaaaagaaatactggaaccgtttctcctctcctcaggtaaaataacatcactgccgtgtaactcttatgctgctgatgaattctgccggcgggcagtccagatagataaggacgattcttgtcaaccttttctaatgcacaccatacatggactcgttcagatgcgtgctgttttttttataagaagtgtgtactgctttgtacttgctgcacggaaagaattggtcggtttgacattcctgttactacataggtttcttcgtgcaagatgggatagtggttgtatcaaagtttctggtacaattcctgaatttctactagtgttcaaccttgagatacaagttatgcacattgtttagctgcggagtcagctgtttagaccttgagatgtcatgcattacgcatttgtgcctctgtttggtatatgtgttccagttcactgcttctaaagtctaaagaggctatagattagtatttaaaaccggtttacccgtttcaaaagcatgcttatcttatgtcattcgtgcaaagccttgtatgattgtatccttgtatgccaccaatcagttgaagtcaaatatgtatttgttcggtacaattattccaagtcactgcatttttcccccagtcaagttactactataatactctttagtaccttcttccacgccaacaaagcatgcaatttgacatcctaacaccaaagccccggcaaaataatagggtaattaacagtctccattagactttgacaagcctcttgtttgttctaccaaatcaatcactgccaacatcttcagacatattgatcccttcaaaagctcagagttggaaccaacagcagtccaccgtcagaatccatcgaagaggtcggtaaaagaagttttagagatggacacggttattaaaaaagtaggtagaagtgaatgatgaaaggttgtgattggatgagtagtggagataggtggaaaaggtggatggcgcagggttgtaattggttgggaagagattgttggttaagaaattattatattttgggacaaatcctgaaggctaaaagtagttatattttgggacggatggagtaattagtaaaaaagaaaaaaaaaggttggcagaaaagcgactctccaattattggcttggcatgaaacgatatggcagatggaagaaaagaaagaagaagaagaagaataggcagaaaaacaaaacggaaaagttgcaaactgaaaacggccttaatcgtgtttactagtattatatggtggacgtgatgactttggatggacacgagagtcgccgtctccatcaccggtgcgatgagtgtcgccggaaaactacattgtttccattcacatgctatgacgggtagtagggtaggatcgacgaaaattggtgccgcaaaacaaccgtgagtaatccaaccagtgtggcaggcaatcccccctcttgctgtggatatcgtatcattatcccggaatttaagtatctgtataaattgaaagggtatgtagtggcttgatccttgtcgacgtgatctgatcctattatccctaaaatagagcctcaccggttagcctaataatacaaagaaaaagctaaaatttaaattttcaaacttgattttgatcttgattttgagatgttttcaatgtgatatttttttttaccttttaatatattttcaatgtaatttttttagccttggcttttaagtcactataacggatatataaaagttttacttataaattaatttttattctctaataagacgttctaacttaatagggaatatgatcaaccgatgagacactattgttttataggagcgtaagactagttgccctgatcatatatgcatacgacttgattttgatcgtgcgatccctcgagtaccctgatgggagcatgggaccattcaacacaatcctatatgaatatctgatcgaaacatattcagtagtacttaacacctacaatttcaaaaataataaatatacaaacagcgctagactaaactacagccttgtaaggctataattataaaagaacacatacacacggtcacgtgccgataatgccttcgcataccactgagagagaaattagcaatgggccgatcacatgaccttcagccaccaaacctacaaattgttccaataaggatatagaatatcgagtcaccaagattctacgcatagtaccaatgaggatacagaggatcaagtcatcaagattctacatatacactacgcgtcctcctgtaaatccttaaaaatagatcaataagaacatatgatgaatcgatatgtacgcggttcaactatatccactacttaacactagtaataaagtagtagtaaactagtgctgaaatttacacactagttaactattagagcataatggtgagttatatgtcaactataaacttacgtgaaaaagagagagagagagaaaaacgagacgtgttactcttgcaagagttcgctctacgcatgctccaaaatatttatattaaatttaggagagaaaaaaaaataaagccaaccgtaccctatagttaagatattatactccctccatttcaaaatatttgactacgttgactgtttagc

SEQ ID NO: 5713 - DNA, 10341 bp, Oryza sativa
  unsure (1)..(10341): unsure at all n locations
gtcaaacattttgaaacggagggagtatatgttagctctaacactctcccaattcagtactagaatcaaacatcaaccaaagaccaaaaagttggattttcagaagaagaaaaataaaaggtcccacaagtgaaaacctatcacaaagtcatcaccatctcctttttctttatatataaatcacaagtcatcaccatctttgccctgcatttcctcaggccagggaacaccagaattccaatgtcaacctcccccctttggaattggaatcaaacgcaggaaccaaaccaaccaacaaaccaaccaacctaaccaaccgaaagggcaggagcaacggcacgtccaaatccggtgacccaattcgtcgccccggcgagccccaccggctgcctccctgtcccttgccgacaaccggcgacggcacgtcccatcgctgccgacggcgacgccggccggccagccggaaagcccggacccggaccaccttttccatcagcaatagatgagacacatttcttcagttagtcaaacatggttcagactttcagagattcttttcttttagagacgaatcatcaaatcatttccaggaatcagttctgaatccgaatccatccatccacacgtgcatgatcaatttcagtgcagaatcggatcaaacaaggggacacagattgcacaggcatatggagaagatcaagatagacagatgctactaatattacttgcatatacatatattccttcttctagctagtgaggagggaggggggccaaaagaacagcattgaggaggcactgctaatgctaaatactgtcccaattgacatattttgccaaaacaacaaatcggcagacccgagctaggggccgcctttggctaaatcttttcggttagtggatgttactttcccctggctgagaaaaacaaacttcctccaggatcatattcggcttcggcacgagaagaaggtatcgtcgtccgccggttagaagcttgggtaagaatagggccagagccgagagatcaggatgaggtgatcctggtctcgaggtcaggcgcgaagctgtgcggcatctgatcgtcccaaaccaagccgacctcgtactcgggaacatactcctgaaatttccaaaagggtacatacaaacttggtgttatgagaaggaaattgccatgtagggcaatgtgtcgaaaatggaacagtgcaagctgtgagttttttttacctcaagcttcagaactagctccctggcagttggagccgagatgataatgcgccgcgcatcctccgctatgaatccttcgctgacagccatgtcaatgaaggatagaaaaggatcataaaacccgtcgacattcagaaggccaacctggtaaatattgaggagctgttagagctaggagtagagaatgtgcatttgagagcaataagggaaatcccgcgcgattaaaagacgagcattcctctaaaaacatggatccaagaaggatcactatcctagttaatacagttacacgacaccatatgaattttgtgggggccatcagcaaagctgattgctaggcatgatgaatgaggtttaatgcactgctcagatccattgggtcattaatttagcatagatgcaaacgataagttcctttttgaattaaaaaaaatgacaggtacaagatcctgcgaacatcattctattagatgagttggaacattcataaaagtataaagcatatatcatattaacaggaagcataaacaatagagggtgcagatctcgtgatccccaagctatcgcctaatgtactgtaagatctgcagatcatagagggcttaaactattggtcaataattcggtttctagatggcaaaaccttcagccaaccacatgggagcaccacgaagccataatcaagggcaagatgttagcacaagatctcaatggatccaacgactttgcgattattaatttgcctcaattgcaaccagagacaagaaaggaattcgggatcatgcacgcacaaccacatggcctccaaattatcgcgcaataatgccattcgttttcttcgtgaatcttactagtacaagatatacagaggaatcagaaccagttggttacttaccggcttcttgtggattcctagttgggcccaggtgatgacctcaagcaactcctcaagagtcccgtagccgcctgtcgcgcaaattaagagtgtcaaattttgcatccttaggatgcagcatcaaaaaaaattcactgcaaacgacgtcgtagtagcaactaaattatcataccaggcagtgcaatgaacgcatcagcaaaccgggccatttcagccttcctctcgtgcatgccagagaccgctctaacttcaccaacaggctcaccagtgacctgcaaacgaaaaaccagtatatattgaggatccggcacacatcacacttgtttctctttcagaatcatgttaataagctcatcatcctagtagaaaaatatttaaaaaccttttttagtgaaactagcaatgcaaaagtccatagaaatacatggctgacaacattcggatgcaaactacggcacacagagttgttcagcgtgagatcatcatcgacattagaatacacaggaaatacaagttctacgtacgtaatgcagtggtcaaagaccacgacaatcaagaaagtcccatttttaagacattgtactaccgaatgagtactagtacaagtagagatacgtacaagaagagtaaataatcccagttactgcacttactactacgtgcaagccccagtaaattatccgaaggcaaggcaaatgcgatggcacatcctagacagctactatagctcaaaatccatttaagagcagcacgcaatgctgttggataggcgcattagattcatgtgatgagcataaatgcatcatgtccccccaataagcactagcagcatgccaacttggttctttattgcaactcctatttttcagctgcgcacagcagcagcagcagcagcagaagccagcagggagaggaattgaaagcattcatcaatttcgccccgaacaaaatggagcagcacggccacattaaaaacagcaatcaagattatatctatctctatcgatcgagcttgtgtaatagcagtagtactactcctactagcttccaggagtagacagctcacctctctgggcatcaaggatttcgggatgaccctgccaagaacacaaagagagaggaaacagaaaagcacatcagtttttagcacaaaagcggtcaaacaggtgtagtaagaacaagcaggcttgctttctctcccttggtaaagagactggcaaagccaaggcccaggctattgcacaggcagcacagctacaccacactagcaatacagatagatagagagagagagggagctggaccaaataaacactgcacaataatgagagcaaagaagagaagagcactagtactagcaagctagcagcagcagcagcagcagcagattgcaggagctgagctatgcaggagcaggccaagtgaagttggagtgtgctgctgcacaaacaacaattcaagcatgcaggcgagtagcctttcggaaacggaggcgaaaaggccccagatgcattcaaaatgccccccccccccccacactgagacccaagaaagagagacgaaaatgggcagggactcagcacctactactcctcctacccccaatctggcgatcaaaagctgccgtttttatcatcccagcgacgcatgcattctcacacatctcacctggcaagcaaccagagaaagatagagagagagagagatggacaaatggatcactcacccaatgacatggcgaccaccgtcgtgaacagcgtgggagacgaggcccatgaggccgatggagccaccgccgtagaccaggtctatgcccctctcgacctgcaccaacacgaaccaaaaacaaaaggggaaatgtaaaaaaacaagaaaccaatcaacctctctctactctcttgagtcgacaagaaaaatccaaaaggtgggggagagagggaggagatggtggtggcgttttgatgcatgcaaaaattgtaagattgttgttccgttcgggacgcaactgaggtcaccgcgctcgccagcaatcatgattggttttgtttgctcatctagaaaacctactactatagctgcctaggatactagggacgcgcaccaagagagaaacggccacggcgagccggagagtcggtcgccgccgccgccgccggcgagccggccggcgaagcccggagggggaagaaagaaagaaaagtagaaaatgaaaagattggatttttatgacggatttgggagggagggagggagaaaggacaatcaatcaaatcaaaaaagaagaagaagaagaagaagaagaagaagaagaagaagaagaagaatcctgaccagttccttgccgagctcgacggcggcgtcctggtagctggccttcctccccttggcgctgccgcagtacacgcagatccgcctgaaccgcgaccgcctttcccctgcaccaccgccaccgctctccggcgccgccgtcgccgccgcccctgctccggcgctcctctccgccgcagcctccattgccatcggcaccagcctcgccctcaggtaggtagagcgcgcgtgcgtgagcgaggcagcgattggaggagagagatggagagagaggaaattgaattggagggggaggcttttgcttgagttgaggcggatgaggtggggggaagcggggggtatttataggagatggacaaggagaggagtgggtccagcattgttgggggagggatgtgtgttgtgtgtgtaggggtagtattggtaccacgggacgggagtccggaggggaaaagattgagtttttttttctttttgtgtttgtgtgtgttagtagcatttttgttttcttttcctctcgcgcttgtgcgaaaattgcttgccacccgtcgacctccctctcactcacccaaacgttatctgaaaacgatcaggtttttccatcacacatcacacgtttgggaataggggtgaaaacggatattttttaaaaaaacgggtgcggatgcggagcgtgtttcgaatatcggaaatgggtgcggagcggtgcggacttggttcggaaaaggattaaaattattggatgttatgtatatatacaagggacgatattgatttagcaatacaggggacaacaataacgactcataagaataatccattgctaataacatgaataaataatatccattatatgaaaacgcaactacgtaagtatgagataagacgataaaatcctcgaacaaaggagtttacagcttgtttggtaacttgaggaaggggattagaagtttagatgagggaattgatagtgagattaagatgggaatttgatttttaatcccaatatcttgtttagtacacatggtacaaattgatagggagtttagttggagattaggtcattaatgaaaacagatggttgagaattgtttaggcaaagtaaaggaggaattcattctcaattaccacccagtacccaggtattcctcaattccccatccacatcccaccaaaattcacatgtcttccaaccaaataaaacagttaacagcttcatccctctaaattcccaatgcctcctaaacactcccccaaccaaacagaccattaggttaattgataatataggtcattaaaatgggtcgactcatgttatatgcaatagatagagtgattatatgggttgataatttcagattatctagataatccaatagaaatatcatataatccatatccgccagattttatagataccacatccaaatctgaatccacaccataccattcgcattcgcattcgcattcatatcagccggatttctaaaaacccataccttatcctcgttttgaacggattcagagcaaattggatcgatataatctaatccgttttcacccttatttgggaaaaacctaattctccgaaaaggatggacccagactttgagcaccctagactgtggcacgaggcataataaggttaaaagtccatatgctgaaatttattttcactatgatgtgtcgagatgatagcaaggttcacgttatcgtgcggttattgcgcttactgccggggagggggtcggttaccggtggttagggtttgagaaattttgagcaaattcaaatttttggaaaaaaataaaaaaaatcatggatgtagttcttgatttttaatggtagatggtgaagaaaatttttgaaaaagagtaagataatatcaaatatgagggcaaaaccgataattgtttaggaaatagaaaaaagaaaaaatgtattgggcttcatttttgtattttacatccacaagctagatttgaagtgtcctatatatccttccccaatttctacacacatttaagtgatttttcttttttttagcttcttttcatttttttttcatgctttctgcaaatatcgcgtttagcgtgcaaatatcgcgttaccgcgtcaaaccatgcgatgaccgcgacaaaccgcatggtaaccgtgaaaccgccaaaatttttaattcaaattttttaagacgaaattcacatggttttcggcggttaccaattaccgcagggagacgataacctcctgtaaaacggtaaggtaaaccctggatataaaaaaacatagaaacaagaaatcgaagcaattcccttattacaaaggaaaaccgaaggatttgattgccatgtcaactacaaccctacagaaaatatatgaatttgtcaactaggtattttggaactttggatactccacgggaaatcgacaggaattttatagaaaaaataagaataggtttgaggagagattaaaaaagagttgcattagacttttcaaagaaaataaaaaccaatatgtttgagatcatgttttaaatcttccaaaaagtgaagggaatatagtatttctatggaaattttccctccagatctttctatttcacaaaattacaagtttaagaacttgtttcacaaaactatagatttattgtcttcgtttatcacaaaaatgcaggtactttgcacaatatatcacaaaactacatattcaagaaccttgtttcataaaactacagatttaatatcttcatttatcataaaactacatgcttagtgtctttattatcacaaaactatatgctttagcatttgttaaaacctgtagttttgtggtaaatgaaaacactaaatgtgtagttatgtgataaccgaatacactacatgtgtagttctgtgataaatgaatacactaaatttgtagttctgtgataaacgaatacgctaaatctatagttttatggaataagttcttaaatatgtagttttgtgatagattgtactaagtacctatggttttgggataaacagaggcactaaatttgtagttttatgaaacaagctcttaaatctgtagttttgtgataaattatgcaaaatacctgtagttatgtgaaatttgctcaaaaaaaattattagagggtttcagtcttacaggttttctaagaaaatttccttgttccaaataatccctaagtgagtttcttcttgtttatggcacaagtgtcgtgcttttccttgatctcacgagcgtatcgtggctctagctcctttggaacgtctagtaattttacaatacttttcgcataactagttttgttttgtagaaaatcttatggaattatcattgtagaatctataatctactaacatgagtgcttagcctaaacatgatcaccctagtacggaaattttagggttactggccgttgtttgaagccgttgatgcgattctcattgttccttctgcaataccatcaaccggagtggaagtagaggatgaagtccctcgaactgctccggtaatcgtcggcatatgggaaataatcgtagcagtgagaacaccggcttgatcccgaaggggttgtcgtcgatcacttgcggggtagcggcggccttccggtcgccacctacactggcccggaaccgccacacgttttccctccatcgcctatgttgatcgggtttagggtttggctgtcagggagattgagaccaagagagatcgccatccgctcttgggccggcctccccttttatatttaacactgcagggaatcgggggcgactcaaaaggaaataaattgggcgccaccgatcataacgcgtagttaatcgggaattaaaacaaattagatcgctgtgatttcgcgtagacaacgggtggaaaaacggtgtagcacgatctcctcccggtttttcaaaccgagatatcaattttttcaacactcattcgatcgtcttcctggatacccttcgacaagggtaaggctgttgatgtcaacaataaggctgaccaagacattcacatcgtacaccttgccaccatggccacatgtttctgagcttgtaagtcatagtaggataatggcaaatcgcttatcgtgttacacgcatgggatgatggcaaaattttcgattatttatgaactatttagagttcaatattggaagtacgtttcctcaattgatatactccatatagtaatttccaaccagttactcccacgcttagggcatctaaaatagatgcaaaagtagtccatatgtaatataatattctattcagtcaccttgtattgttgtgcaagtagtcctcataaataaattatcaaaaggtacccatatacatatggattacttatatgggataaattatactattatctatctctatttatgtctcttttcctaatgttatcatgtatatatacattgtgaagattgctatagttaaaatctatttatgtagatcctatttatatggaccacttttgtcatgtatattggtgaatggtgatgcccttatattcagagcaataaacaacttgaattcaatatgctttctttttttaataaaaaatgaaatcatttttggtccgtcttaatttcatccttgggcttatactcagacccagtttcccttccatcaattcatttcatatcaaaattgaaaaaacacatactcttactggagtttagtacatttacgcacgtaaaaacttcatcaatcttaagatattacttatgagtttttaaagtgcccataagagtacacatttatagaagtgagtgtgtccgcgtgtttccgagtggttgcatccataccgtgttccaagaaaataatttgatgcacgtgtacagtgatgtgtatgtgcgtctgtgtcccgctatgtaataaaaataaaggactacacatttaacatttgatataaaatcccttctaaaatctgttaaatgtaattctttctcatttcctcctaatcgattccggagtatgctaagctcctccttgatagtccaaaccaaatctgtcatttggagaaaaattaactggaaaaaaaaaagagatggaacagggggaatgaagaccacacacggttcgttcgccctccctcctcgggcaaatcatcttatcccagtcaaacgggtgatcgaaatttattgccgtcgtgagtgcgaatcgcatttgcattgcatctacatcgcgttctcttctcagccacgtcgtgttgctgttgctgggtgacgacgccggaatgccgaattaatggcgagatattagtagggctgtggctggggatttgcagcacgcggcagccatggacaatgtgctgctgctttgcttcgctttgcttttttttgtggttgttgccaacaatttaattcatcgcgacgacaacgacgcattatgcatatcaccatctgcactgtccatggatggatggactgggctgggcggtcaaatcgtattcgtatctatcggtctcgtgctggaatcagatatggtatcggaggagggagcggtcaaatcgtatcatcatgggccattaatcaaaacgatcaattgctagtagtattgcccgcgagcaaagggcatatggatggatgtgtgtaggagtatgctctcctcgcattgcatgtgcattaattttgggcaagcgctgcctagttgggccctggattaattgctggtgtggttggaaaatggagtaacacctgaaatgattttttagttactttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5714 - DNA, 42277 bp, Oryza sativa
  unsure (1)..(42277): unsure at all n locations
tctataaatgacaccactaagcaactagtagtggtaaataattaattaggttctgcaaaggaaaataagtcatctcagcaatacgcgaagaatcttacatgctccaacctgaggcatccacaaatggatgccacagcccatgttgataaagcagtcgattcctcctcggcaaatagcgcattgcgcatctgaaaaggagtggacaaagcttagacatagtattcatgtatatacatagcaaatagcttatgacaccagagtggacaatgataaatgcataatattgcaacacatcagtatatctcacctcagccacctctaaacttgtatcacatgaccgcagatcaatagtagaaccagcaatatgaagaactgtttcacctggccggtgaaaccttagaggatgaaggtgatccaacgggtgaaaagtaagggatgaacccctggcaggacactgcagctgatagtactgagaaacaacttgcagagatccatatttttttgcctgaagaaaacaataagttaccaaatataccaacaaaaaagagagagacagatgagcaaaaatttgtgtcattttatgcaaatagcaccttagcccattgcgatatattgttgtggccaactaagtctccatgaccaattgatgatggctcctccaaatccgattcatggctatcgcttctgaaatttatgccttcagaaggagagtcctgggaactgcagtaaatagtgctaactactttattattttattcagctagtgatgcacaaaattaagaagtaacaagacgatttcaagtgagaatatcagaattcaagaaacataggaataggttatgtaaaataacatactagtgccttaattatgtggaggataacataccctggagataattcagaaccttcacaaaggcgagagcgcatgagaggtagaatagtatcattaacaaagatgtcaagctgttcatcgttcacatcatcctgtaaagaatagccacaattttctgtggtatcagattccttcaggataactggtacagaatccagttcatgaagctcaatcccagattgatcggcagttgtatcttctgataaacaattgtcaggcctttcaagagtatcacactgaggagctgttcctgttacaagatcatcctgtactacacattcctgttgaacttctttgcagtttaagtccaattggttatctctacattcagaactgctgtcagtgtcagacaggtcctttgaacaaactcccacacttgattcaaggattttccagattttatgcatgacatcgaaatattgtttttctgttgcaagttcagttcctgcgcagacaacatcatcctcacaggtttcctcaggtgataatgatgtaagcaagctaaccccatcagtgagccattcgagacgctcttccataagaatactgtttgtgaaagtcatatgcaaaagaagtggcatcaaggagaatatcaatattgcgtatagatctggatagcatgaaagacactcatacaacaatgtttaacaaagagcaaattgagcagagacaatcgcaggaactttggatgcaatctaaaatattatttatgccataaatagaaatcctgaacttacatccccatcctgagatcttgaagcattttgtgttcaagctcacaaggaaacaaattaaccattggatacacataataaagcagataattgactccaatgttaagttaaaagcattactagaaaactagaacactgtgccaattgtggaaaatataagggagcaagtgattgaattcatggttttaaaccccaaaccttcttagttgcttattctagtattcttgtctaagatatcgatgcttattctagttgctgtgatgtaaaaatgttacttgcagaagcaaaagaagcaacaaacttgtatatgttttccgaaactagcagcgcaattgaaaatgtaaaagctctttatggctaataaggaccaaaagcagccgatgaatattttttacgcaagaactagtgatcaaaattagaacatacaaatggtacacaaggatgaggcttccacttctgctgagtgcagaccggaaaggtggcaaagcaaaagactgccaaaaataatgaatatttacaattcagcaagataacaagcgataattgcgatcactataccgtacctctgtagcaccccaaagtgcagttcaaagaatgggagcctggaaaagatgcaatagcatcgcggtgtagttattacataacgactccggcgtggaaagacaggtttttcacttgtgagcatagaaaccagcttcgaaggtctctgtacaatctcttcaactaacacgcagcatccatatagtgtagagtcatcagcaacctgcagtctttcgataatcagcaacctattgaagtagagtgatatattggagaaagaaatacatttacctgtaaacggaacacgaaagactggttgctttctttaagttgctcctgaaatgggcaacttactatataagattatggataaaaaaaatcatgacacaggactatattacacaggctgtaaatccttagagagcatcaccattatatggtgttgaaaaagacaaaattagcacggagaaacagtcacctgtcctaggaggatttcattcagctcactgaatgagggggtccgttcaaccgcatggacctaatacaaacataaacataggtaaattgttttgagggtatacagtgcatgatctgacaaaactacagatggaggattggatgttaagcaatcaatgcatatgtgttttcattcagaagaaacaaagaatatcagctgtggttgcagcctgcagcaaaaacaagaaggtaaacactattagcagtatgtagcccaaatgtaacagacctgtacacctccaggaagacagaacgagaggatatccttgtacttgagtggtagaggcctctctggagggtatgcaaaaagaacctaaggagtaagcaggcaaaagtaatcagcaaaagtttcaagtgcatgaaagaagacacaaagcggatgaaggtgagctataacctgaggttccaaatttgacaatgcatgaacttggtggtgattgttaccgaatatatttctcggtttctttacatcttcctcattgctccctagtgcaatgttttctagctcatggatatctgcctgaggagggagtccaacaatcacaatgctctcgaaaagatgtgatggttctctgatgcacctattaccctggtccagaaaagaattttgacagttttgagcaagaccagaacgggtacaaccacagaagaacagaaatgagaaatacaacgtcacactcttcaaagtactttccagaaacaactctacagcggcttgcatgctgaagcaaagtgactcgcaataatcatctatgaaaaacaaagtgtatataattctaaagtgtttgccacaatttaccagtcttattaacttaaaaaagctaggttacaacacagtggtatttaaattcatctgttgcactcaaataattactcggaaacatggtgaacacacataaaagtgtgcaagtaaatgagttgctctggtgcttatgaggtgttaggtatgaccgtatgaagtttgccacaatttaccgatcttaccagtttaaaaacgctaggcctttcaatggtgtggtatccaaatattattgggttctttttttttttttgaagtggagagagagcctctcccgtttccattaatagaaacgatagtagttcattacaagatataaactgaaagcagaacagcagaaaagataaagctgaactgactgctcacaaatggcgccatcccaccattttgatgcatcagcagcaacaacttttgcactttggccctacaaagtctaagaaagctgtaccaacaaagacaaaggtagacgagaaacaaagctaccctattgagttcttactgtacatggctattgcactggaataagtactcagaattcagaggcacttgtgaacaagtacataagaatataacaaaatggatatttttgttatgatgctcaggttatttcaaccattacagaacaaaggtaactgctatttataatctatagagtgtgaaactgtccagagatgactagtataaatgtaatcataactgttgagtaaaccttcctaaatagtttcaaataattcagcaaaatgctgataagtcaccactcactacacaagtacacatgatagatacatgagcaaggtgaaagaaccaaagtaaaactttcatgcaaatcaaactcaatgtgtgatagatcattgagcctgacaagcgatattaaatgagttctggtattttctataagtaaaactccaagacaaaaaatgttgatcaaaaaatacacatagttcgtgtaaatggaacaacatagacgttgaagcgactgttatcttgtcttgtgaccatgctatgacctgtataggttgtaatgggaaagaattaagactaacatccctaagatgaactgcaagtttgaatattatgcttgaaaaacaactgccaatgaagacacactattgaacaactagtgaaaaaaatagcatatttagctctgttttgtgcactactgtactctgtcatagcagttaaaggatacaggtcactcataaattaaagctctgaattaaagaccgaagttaatctgcaaaagtatgtccaccaacatatagattgaaaatgcgatacataccagcgactttagttggaacctggaccactggcgcttttgtgttgtgagaacctccgggttgtaagatccagacacttcaggtgacgttgaaaaccctttcaggatcttcgaaaattgttgttgcagcttctgcattgggctgccactctcttctctggaagagtacaccacagatggtcgtgttgactgtacagtggctgcagaagctgcagcaataaatgctctcgctacctcttcagttgtttgcatcaggtgtgatgtgttgaatttgagcccttcagatccatcgttcttgtccaccattctaaatgcttcctattcatgcaagcaaggagattgtcactccagtagtgtgattgagcatgcgcatatccgtcagacaacatcaggacacaggacacatatcatggaaatacgtagggtaacaaacaaaacttgagcattacaccatgatcatgatccagtggtagcatctatcgtacaagtaaatcatcttctcggctttgaaccacttaaattaaattcgacagaacctatggcctacacaacctacagtcctgggaacgtaaatttgtgaaatctacctcatacagaacaataaatcagcttgtacctcactctgatatccaaccagaagccacctaacagcaaaccgtgtgcactttacctacctaaaaagcggtccacttgaataatcatcgaacttttccaaaattaatcactgagtgcatggttgaatccaaaagggcaaaaggtgacaacaaatcgaacaataccacataatccgatactactatgatcgatttatatacttcgaaagtaagaaaatgcattatcagcgaccgaagcattctatattaaaaaaaaaactagcaaaatcgtacagagcaaccactcgatcttagtgttatgacctaaaattcgcgaaaataccacatccaacagactgtttgactactccaaatccatcatacaggcgacagtaacctcaaagtgccaaatcgatagggaaatcgcaccctccaaccagagtcagatgctctcagaatttaacagtagaaaacccatacccccactacggtcgacgaaacatccccgaaaagaatctcaaaacacacacacacacagagaaaaaaaataatagggaaaagcgctccgaatcggctcacctcacctgacgcggcggcggaggggagggctttgaagcttcaccccgcgaagatctcctcgcctcggctctcctctccccgctgcgcgcgcgcgcgccgccgccgccgtcgaaatggacccgccgaactagcaacgaatgggatggcggcctcctccccttcccctctcctcctcctcctcctcctctcctttttttttccccttcggatttgtggtttaatgcgtcgatccgttcgattaaaaccagaggcgattcgtcgcggaaaaaaaattaagtggcgtgatttggttcggcgcttgggctggactggacgaggggggaggagagattttgagaaggcgagtttttcgtggacgagtgggagtctgctggaactggggggcgatctgtctctctgctcgtggggcccgtgcaaaggagggtgcctgagttgacccgagccgtgtggccctccgtgtggccgggtgcctcgcttgccgctacgccatccgacgcgtggctgcttctggctggagccaacagggagtacgtttttttttcctttccgagggaaaaaatgcagtagaagtacacgacagcaggcatgcagaacaggcctttgtatgctcgcgctattaaatagctctatgaaatcttgctatttaggattattaaatatagattattgataaaaccgattctataatctctaggttattttgcgagacgaatctaataatatatattaatccatagttagcggttgattactgtagcatcactgtagcaaatcatggattaatatacctcgttaaatttgtctcgcaaaatagcttaggagttatggaatgggttttgtcggtaatctacatttaatactcttaaatagcaagattccggagggctatttaatagccctccggattcaaacagggcgtagtagaaagggagtgtttagaactttagatcaggctataaaggtttgacgtgtcatatcgcatattatatagagtttctcactgagtgttcgggcactaataaaagactaattacagactccgtcagtaaactgcgagatgaattattaagcctaattaattcatcattagcaaatatttactgtagtactacattaatggagcagttaggtttaaaagaattgtcttgcaaattagtcgtaatctgtacaattagttttttagattatatttaatacttcatgtagatatttaaacgttcgatgtgtcagtgtgtaaaaattttggcaaagatctaaaggcctaaatcaaacgttttcttttaagatgaataaatcaaacgttttgcaacaataattgtacggtttttaagctgtttagggataaatgatactaggacgacttaaaaaccagtggtactagtactcaggaagagtccaacaagtttagtctcggcaatcaactttttctttctctcaattaagttgttttgaatattgattcagtcgttttctgcttggttgctaccgagcattacaccctgtgttgtttttgtattttttggacaactagttgtggatatgctcgataagaatataagatactccaagctcatatcttcgggactttgtttattcttcagaccctttttactttgattggaaaatctctgctcctaaaaaattgcaagtaacaggagtgtgaccaatgaaactggtagagagatgagtatataggaatggtatcctcagatttatacgtgagtcacttaactgcatttgtgattacttcctccgttttaagttataaaactttatagtattacacatttgtatagatattaatgaatcttaatacattaatatatatatgaatattggtaatgttataaagttttataattaaaacggaggtagtaagtcggagtgtgtaaaaggcaagaagctgaggctcaaactccagaatccagatgtcaaagcctctagtagaacaattctgaaggtacgagcagtacgacacatgtacagtgatgacgttttaaagccggtatccatagccatcaatgaagtggttccaccgtttggcagcagttgaaaaaaaattatgtggacacattgtacctacctaagtactcttagggagcgttgcgttcgttctggtgagttagggtgagaaagcacatcgtagtccgcgcacacgctttctaaactattaaacgatgtgtttttggcaaaaaaaatttctataggaaagttgcttttaaaaattatattaatccatttttgaaatttaaaatggtttatactcaattaatcatgcgttaatggctcacctcgttttacgtatctttccaatcttctcaatcccctatccctcaaactcacccttaggctctgttcgttctggggagataggggagaatgagtctcgttttccgcgtgcacgcttttcaaactactaaacggtgtgttttttgcaaaaaaaatctatagaaaagttgcttttaaaaatcatattaattcatttttaaaatttaaaatagttaatactcaattaatcatgagctaatgactcacttcgttttgcgtatctttccaatcccctcctcaaacaaacccttagctatgcaaagtacagtaccattctttcgctcttccatttgtagctgtactctcgtgtttgcagaagttaaactcgctaccaagatttaaaaaaccacgtggttattacgtgtgatatccttttaaattttcgaaaccacgatataactcatgataactatgtggtttcgtggtaaccacacggtttccgtgataaccattaaaccttgagccgtgaggtgatggtaatctcgtccaaaatagtttggtaaaccctgcatgctacccttgttgattttaacgctttgctcctgcgagcaacgatttttgacgttaatgagtactatcaagctgaatactagctgatcatcccattgccgcataagatcagtgagtgctacagcgacacgaactcgcccgctgatctccatctttttctctgtctgggccacgctcaagcgtggcgagaaagccgcctgggcccattgctcggaaatcaatcaatcatttcatttcattgtgaactactccctccgtaaaaaaaaaacaaaccctaaatttctatgtccaactttaactgtccgtcttatatgaaaattttttataattcgtattttcattgatgtttgatgataaaacatgattaatattttatgtgtgacttgtctttttaatttttttttcataatttttttaaataagacggacggtcaaatgttgaacatggaaactatggcttgtctttttatttggacggagggagtaaggcatgatctagttcccaactttttcttcaaacttctaactttttcatcacatcaaaactttcctacacacaaatttttaacttttccgtcacatcgtttcaattttaatcaaacttacaattttggcgtgaactaaacgcacctgaacccatgccatgccacccctttcagctttaaccatggtttccaatgcagcattcagctctgccgtttacttttatacagcagaattttcgcagaaatttctctacctgaatacggctgtgttcagtgcagtgtaaagtttagattttggttgaaattagagatgatgtcactgaaaagttgtgtgtgtatgatagattgatgtgatgaaaaaggactgaagtttagatccaaactttaaatctaaacatagcctacctgaactttcgtagagtcttgagatcgggtcattgcgaaagtccatttgttgcattttggtctggaaattgttcggcgaaaaatctcggaatgcattggtggatatgtcaattgcatcagcccatgcctgcatggtggggagctggacatgggaattgtagcacgcaagaaaacgacgggtgattgagcagataggctgtgtgcactattctgaatttctgattccaattcctggtctggtagcatgccagcccagctctctgcattgctagcctttctcaggctcagaatctgaacttcgtttgatggaggatttgggtttactctgacggaacatcctgcagcttcaccaaagtaattaaggccgagtttagttccaaattttttcttcaaacttttaacttttttattacatcaaaactttcctacacacataagctttcaacttttccgtcacatcgtttcaatttcaaccaaacttctaattttgatacgaactaaacacaccataaataaaaaagttagaagtttgaaaaaaaaatttagaactaaacacagtctaaaacatgagatgaacaaaaccaaaggtgagggatgtatactctactagcattggcaagtgtgacgatgcataaagaaagaatgttcttccattacgtggtgcccatacacgtcgatgcaattaattccgtgatagatgaagaggatggagagatgacacgacctcgcgagcctaatccgaattggatagatttagtgatccggctttacgattgctatccaaatgagagagaaaaaaaatatttttagggggctttctttcctcttgaaaaggaccacatttctttatccacgagctgttagcatcagtgcatcacgccgtcgccaatgaaagaaagaaagagaaagggaggaaaggttagcatcatgattattgagaacctgtcatagctgtcaagcagagttgctgatcgatttgtagactcagataattatatgtcattttgggccctgccaatcagccgttgcctcatcaacagatcactagactgatgaagagtgccgcgtcatccttcgtctgatggcatcattagcccatatgctgctagatgcaagaactcgatcgaggacatgaacatttcgggcttgtttggtttgaatcaaatttttgccataccaaaatcttaatagtgccaaaaccttggtaagttttggtactattaaattaggtggtattgaatttgaactattatgacaaaaaattggtagcaaaccaaacatgtatttgctactattgaagtagccaaaaaattagtagggcaataagttggttgcaaaccaaacaggcccttccttgcatatatctaacacaattactatggatgtgtttagttcacaccaaactccaaacttttccatcacattatatcacatccaaaacttttctacttacattaactcctaactttttttccaaattaccaattttccccaaacttctccttaaacttcggaactaaacacagcctatatggcaaaggccacttgctgacagatctagcaaacgccacctgctctgctgcagaaccccttgctggtaggtaaacagagtgcaggttgtgcatagaaaaaactactagttccctctgtatgcaaaaatgtttgcacttaggccttgtttagttcctaacttcttttcttcaacaagtttttccgtcacattaaacttttctacacataaattttcaaattttccatcacatcgttttaattttttcaaacttacaattttaacgtggaactaaacacagtaaacacaatacacaactgactggcctggtgttggcctggtattaccttgcccgacttctatgtcagagacattgacattgatgctctaccaaaccagccaaattatcaaaagtatcaaacccttcctctttataagaagttgttgaatagctgacgcattcttcaccactagttgccggttgaacactggcgttgcttttatctgaacaatactagcacttccacttgcattgcataagaccccctgaccttgtgttgtctcttgtggcttcaggccttgaacgtccaacaacttcaggagggtaggagagccaaaaaaaacggtctgttgagtatcattggtgtctgactgaaataatgcgtaaatgcagtaggtgagatcatagtggatatggccggaccgccggacagttcgatggatacagaagagataggctccgtgagactttctgtttcgctagcagacaggagctgagcgactaaaccggggagtactgccaacaaaacgtaaggcagatagccagatatggaacttctggactaatctgatgcaaattttccattttttagtccacgactccacatatcatctgatagcaagggcttgttcagtttgctaccattttaaaccttaccaagttttgatattgccaaattttagtaaagttgtcaaaattttggcaaggttaacaaattttgacaagatttcatatgtactttctaaaatttagtaacaaactaaacgtagctaaaattttaactactttaataaaaaaaatatggttgaaaatgacatcaagttaaacaggccccaagtttgtgaatatgaagctaacagttgtactgagccactaaacacttctcgaggaagaaaagaaaaaaaagacagatgtgcaagaccagtttaatgcagtgttggcccatgagtcatgctgaccacaagggctcgtttcgatgggcctaaatgaggcccacttacatgtatgggctagacacgatgcctactcatactgaaccgatacatcatattatcgtggaataagtccattttacgttcatcatttcatcaaatttaaattgcacccgaaaccataatacctgaaatcttcgcaccctcaaattgtaaaaccaggttaaattacgtcctttagtattatagatggttggtttcactgacgtggtaagttgactcagtcccgtcctgactagatgtttacgtggcaaaaacaagagtggaccacatgtcatgcttactctcctcccctcttcactccccctcctctcttccctacaaaaaatggcctcggagacaactaggaaccgggtagcgaacgtcaacaagcatgaccacctcaatcccatacgtccacgtcggcctgaacacgccgcaatagcttcctcctccactctcgccaccttctcttcctatcgacgccagcaccctcctcctccgcgcacctcaatgatttgtgcaccgaacaccaacattgtgtgcccctcgtacgcaaccggcccacctcccccttctccacccactccgcggtggagaccgcttcatcttactcatttggctccatcctagccaccccctagtcattctcaatcttagctcgagagccataggggatgggaggtcaagcaggaactcctagtcatgacgatgccgaattgggagatatgtgcagtgagctcagagatgatgtagaaggtcgaggatggggcggtagagggtgcgggaatctatgccaacgatgaagctcagcctccccctccaacgacggacgggaaatgggatcaccagccgcctccctcgctgccaatcgctgaatggtgtgcgtggttgggaaaaagagaagaaaaaagtggacattgatatgtgggttcatatatattttttattttcttcttcccactcaccccatccgtcccaaaaaaaaatccaattatagctatgaatctggatatatgcgtgtccaggttcgtagctaggatttaccttttttctgagacagtagtacatgcagggctcatatgttttttaattactttttgctgactaggataccatgttagtgaaatcagccatccatattaccattagatctaatttaactcggtttgcaatttagagttaagattttgggtatgacgatttagagacgtgatttaaactcgatggaaaaatgagggacctgaagtggaccttttctattctcgtcgtaaaaagatgcccaaattcactcgattccgtcggccattggcaactaatcacctccaggctccagcccagcccaaatcgttctcctcctccagaataagcccatccgccgcgcggcatgcaactcgcgcaaaagaacaccggagagcgagagcaccgtgcacgacgccgatggccaacgttgcagaagatgccgctgggcgctggcctactagtacgcgctcagccgcacacgcacacgcccgaatgctcgatcggatcagtctcctgcctgcgggttgccatgtgcgcgcgtgtgcaatgcgctgcgctcccacggcgaagcccccacggagacgcgcaccggcgcaacaagcgaaaagatgggcaaacgcttggagcccatcttgctgccgcccagtgcccccacgaaccccatgcctcgttactgctcgtcgcgtcgccctgcttgcttgctactagtccgctgccgcttggccgtttcttgcttgcctcatggctcgtcggctcgtgatcgtacctgtgccgcgagacggcgagaccgcgtgtcacactgcctcgtggcttgccgtatgcgtaacgcaggtatgggcaggccaaagaaggaacagtcccattgtttaacatattcgaggaaaaggtaaaacgctacttgaaaaataatgtcaataaaatttttatatactttgtttttaataatttagaagtaaagactgaaaaataaactataatgaaaataatataaaatttaactttaaatttaaatttaaggttgattttattttctgataagtataaacgtaaacgaaaagataaggctgtaagtagttcatcagcccatcatcccatcgaaaagccgctgcagagtttagcagctcagcatgctttgaacctcttgctacttctctttcatcgcatcctctctgggctgtttggacggcgtagaagttttgtctgtggagcgaggcagctataattaacagtggatcatcggattcagattagtcaatactcggctactcgcaggtactgtacgcaccaggcgacgttgttaatggggttgttacttgttagtgtacttctttctgtgaattaaaggagatctgaccggaatcttgaccacgtacatgctgatgagttcattcgtaatccgtttaattctacgaggacatttgactgtacaacaagtattttgtgcgtctgtactggacagtttgtagaccgggatctagttgctgtacttgatgggacaagaggtcgctcacgtagatactgcagatcgtgtagaacatctgtagtctgtagtcttcagttgaactgcgtgcatgcatgttgcacgatattgtagtatgtacctattcatctataacatctataacgcatcaaatcatctgtttctataggacttctttactgtacacagcaagtagaaacgatgaagttcttcagcctggggccggaaaaaacaagaggccaagagggcaacgcgcgacctcgtggtttctctttcaaagttgagcttttcaattcaaatggagttgataggagtgcgtgttagaggacacggtttaggccatcatcgagggtgaattgacaaacaatatttaaccagcaaaacacagctcgaaagcttatatatcacgccccctgtccaggatgcagcctttcgagcttcagctttgaggatcatacggctcaagaatcgccatcattaacccgtggaagatttgcacggcgagtcttttaaagatcgtggagctgttaagcagtgcaagcgttttcgcaatcaaacctgctgatcaaaaggctgcctcattcgttggccaaagaagcatgacggctcgttagtgccttcacatcccgtcctttttgtgtttttgttgttgttcacttacgtagtactccctccgtattttaatgtatgatgtcattaactttttaatcaacgtttgaccattcgttttatttaatttttttgtgtaaatataaaaatatttatatcatgcttaaagaatatttgatgatgaatcaagtcacaataaaataaatgataattacataaattttttaaataagacgaatggtcagacgttgaataaaaagtcaacggcgtcatatatattaaaatatagaggtaatactatttatacatgtgtctctgattgctggtagaatactactacttgatactcaaagagcaagattaatctttggctagtatcacctttgcagttgcaggctacatcagccgtggtgttaaaacagcaaaataatgtagtactatatttatcctaaaatatatctatcttagatgagacttgttctagactgctacttttgaaacggatatagtagcattttattttacatagcgggtacattggcctttatttcaacagaaactataacaacgtaacataactatatatgtttgcatcacacaagtccacagaatcgatgcccagtttcagaatgccaatgtaccaactgcttgtgcatagggaaacaaatgaatctgtttgttcgtagtcgtagacgcatcggcggcaaatggtgcagacctgcgagagtttcttcttttctgttttcatttccggccacacggtgtgccacaggagttgtgccgcggagaatcaccgattcgctttcggcccaggccgaagggatctgctgcgcttgtgctcaagatggatgggattttgtcagagaggtggacgtggaatgggccctgcgctgcagctgggccttgttaccattggcctgtataattaatgccacctttcggaagcatttgagggctggcccacaatgcatgatatactagattttttttgcacgtagtactgaactttattttatgcacacaaatcgctctagattttgagatttttggcagccgaaatcccattggaagaatattcttgtaatgaaaaaaacataattgagctaacttaaaagagtaattatttttataaaaaattatcaatttactatatattaaaaaaatacggcaattgtatatatactccctccttccctaaatgtttgacgctattgactttttttaaatatgtttgaccattcgtattattcaaaaacttttgtgaaatatgtaaaactatatgtatacataaaagtatatctaacaataaatcaaatgataggaaaagaattaataattacttaaattttttgaataaaacgaacggtcaaacatatttaaaaaagtcaacggcgtcaaatattttgggatgcagggagtactttttatcagaaaactatagctttattttgacaggttctagactctctcatcatatacacatgaaatacttatatcggtgtaagtttaccccacatattgtgcacccgtagtagataaaattataattttgtaaaaaatcaattgttattgttgttgttatgtgaaaatacccatctaaagttgtgacaaatgatttggaaaaataaagttttaacataataattgcacgaaatggttgatgcattgaccattatatcactaagcaagtcatcctcaaaattcaaaacgattgcaatacagcaaagcgagcatagctcaactgatttgattcattacggtgcgtagaacccatacatttgggttgaagtgctaaacttggcacgtgtactcacatttacgattaattactcttttagcaatatgcgatgtactgcttgacataagaacgcttgtggtgactttatcaatcctatgatatatcagcccaatatacaaaggtgtctatatgggtaatatggcaacccaatctatcatagggtacaaggccctgatgtgtgcgcgggtgtatttagagaggcactatatggtgactttataaatcttaagatacgccaacaaaatatatagaggtgtgttcattgtggtgaatgtggtgagtttatcaatatctcatgggatagggtatataggtgtgtacggtgactttatcaatctcaagatgtgcaacccaatatatagatgtactcatagagttagattacgtgtcatctgtttataggagagtgtgtgacttcggtaatactaagatatgcagatatggtctttataggtgctcatagaggtaaaatgcgcatgcatattcatagagctgagtatgtgcatttgtttatatatgtgagtgtgacttcgataatatcaagatgcgtcaatccattcgttgtagttgatcataaagataaagcgtgcgcgtttgtatgtctactcaggagcggagctagagtatatgaggggaacccgataagaatttttttaagctatatatcacctattttcactatgtgtgcactcttctcaatacaaacttagatatctaaatcatcttaaactctatctaaaatagagtaaaataagcaaatgatatattctccatttcgttatagctctaccctgtacctactctgtataccatgttgagaaagaaaaagagatgccaatgtaagcggattaaaactccacattttcagcgaagtggatgtaaaacccagaagatccaaacatgccagaaagggggaacaagtacagtcgtaccataacaaccacgagagcgaaagttgcagtcatccacatggacgtgccccctgttcgtcacccacaagacacaccaccaccaccatcaccttcacgccaaagcctccctctcccatctctccctctctctccctcccctgcgcccatagctcgcagctttgcagcagccaagccaagaagccaactcaacccatcagaacggcagaaaccccagccgcggcgttggttaaaccacagcaaagcgtcgttgatgcccccgcgcggacgcctcgcctcggcgccatgacgacgaccaccaccactcgcctcctcctcgctgccattctcctcgcggtggccgccgccgacgatgacggtgggtggccgcgtgccgttcccttttgctctgctcgcctgcgtgcgttggcgagggagggagggagagggaaggatgatggattatagtggggagggagggggttgggtttgggtggcttcgtgttttggtgtttttttagtgctgcgagtgcgcgccttttggtctttgtttatgtcttgctccctattggccggcgccgcctaagaatggcctaatactagattaatcccagcctcctgttcgtagcatctcttcttctgttcttcttccctatccaggggacagttgctgtactttttttttgttttgttttttaaatgcggctttatttttgaactatttttttttctgttttgtttcgttcatggataaggtttctatattgttcttggagatcaaatgctcatttctgaaatgccgccgctgtttgtggaagtttagggagtgttttttttttgtgtggggtttttggttatcgagttttggatccggaaatggttttaaattattttggaagttattctccgattcctcctccgaaaccagattcctgtttcctcgcgatgtttggtacttcgattctgctgtttatcaatctggtttgctcttgcgtgttttccaggacaaacgctactggagatcaagaagtccttccgcaatgtggacaacgtgctgtacgattgggccggcgatggcgcgccgcggcgctactgctcgtggcgcggcgtgctctgcgacaacgtcaccttcgccgtcgcggcgctgtgagtttcctgccaacctattgcttggcttgcctggctgcagtgcccgtggttactgacgtgttttcttgcggtggaatgcagcaacctctcggggctcaatcttgggggcgaaatctccccggccatcgggaatctgaaaagcgtcgagtcgatgtacggtggcacgttgtctcctggaatgaaatgtttctttcattcagctgcttaattagtgtgctcaactcgttctccctgtttgtttgattacatatatgcagcgacttgaagtcgaatgaactttctgggcagatccctgatgagattggcgattgcacgtcgcttaaaactctgtaagtgagattcagttttggttcgcagtgttgttttgaggatgtagaacagtagaagtaatgcgtgccgcaaccctcccctgttcttttattcaagggacctgtcctctaacaatctaggaggagatataccattttccatatctaagctgaagcaccttgagaacttgtaagatttaccctgctgaaacttggtggaggagaagtattttgcagcatttctttcatcgtaagcactgctgttacttgaatatataggatcttgaagaacaaccagctggtggggatgatcccgtcgacactctctcagctaccaaatttgaagattttgtaagttgcggctgaactgttctgagggcttaatttggatcaattctaatgtgatatatgccccagggacttggctcaaaacaagctaaatggtgagattccgaggttaatctactggaatgaggttcttcagtacttgtgagtactaagtagtcgatgattctgttccctactttaaaaaacttcttttttttgtttcagtacttaaactgcagacaatatgtaggagctattagtgctaatcagatttagtttgtgtaaattataggcggttgaacatatgtaatgtagggcaaatagttcggtaagatcatattgtcatatccaattgtgctaatctgattttcatatgacaggggattacggagcaataatttagaaggaagcctctctcctgagatgtgccagttgactggcctgtggtacttgtgagtgtattgcttccttttgtttattattagctctacatgtttgttttctttgttcctttcacaaacttgattttgtttgacttagtgatgtgaagaacaatagcttaacgggtataataccagatactattgggaactgtacgagctttcaggtcttgtatgtacataccttctactccttctgaattatgtgtccccctttctttgacatgtcaatcattcctgaccttatggtatttttagggatctgtcttacaaccggctcacgggagaaatcccattcaacattggcttcctacaagtggctacattgtatgtggtagtcattttactaacaaaaagagtatccaacctgtcgtaattaatgaaaccaactacttgaactgctatgcactattttgtaccaggtctttgcaagggaacaatttctctggccctattccatcagtaattggccttatgcaggcgctcgcagtgctgtaagtccaatgataattgatgtgcttgtcttaatttatgggctgagagtgagaggtattaccatagcccttgaatgcaagttttcacctgtaccttctatttgttgatacagtgatctgagtttcaaccaattgtctgggccaataccatcaatacttggcaacttaacatacactgagaaactgtaagcctgcccttgtgtgtgtgttttcctagcctttgagaaatataatattcttaattatgtcaagaagttaacatcatagtatcttgttttcttaggtacctccaaggcaataggctaactggatcaataccacccgagcttggtaatatgtcgacacttcattacttgtaagcctctacctttaaaattttgttgcttcttgattgttaattgattagcgcactaccctcttttgagacaatatctggtttcagagaactgaatgacaatcagctgaccgggttcattccgcctgagcttggaaagttgacgggcttatttgatctgtataactctactcatcctttatcaattgatgcttacctggaatgctaaatcagtcagtggaccatatcatttgtttttcacaggaacctggcaaacaacaaccttgaaggaccaatccctgataatataagctcatgcatgaatctcattagcttgtaagtttcatttgttctcctgaagttctatatcctctccgatggcagggcacttaactttagctttgtaacagcaatgcttatggcaataaattaaatgggaccgttccacgttcattgcacaaacttgagagtataacttatttgtaagtgttattggttttaggtgatttttcttcaagcctgctataaatttagttctgttcatagtgtctaatgatttttgttttcatcctaacttctaggaatctatcatcaaactatcttagtggagccattcccattgaactagcaaaaatgaaaaacttggacacattgtaagtaccagaagttaatctgcaattgcttttgaataagtgattctcatgatatgacgtgtttgctggatatatttgaagggacttatcctgtaacatggttgctggtccaattccctcggcaattgggagcttagagcatcttttgagactgtaagttctataatattactccttgttataaaaaaataaaataaaatacttgtatcatgtcatgacagcattctcttattcctaaagaaattttagcaataataatttggttggatacatccctgctgagtttggaaacttgaggagtatcatggagatgtaagtaccttctcacctaaatgcgttgtctgctctgtacctttgggagtaatgcagattcctcttcctctgttttagtgatttgtctagtaatcaccttggtggtttgattccacaagaggttggcatgctgcaaaacctgatattgctgtaagtctatgttttaccctctatcctataaagtagtattgcatggtttcaaaaggctgtttgcattggactgcatattaatttgagtattctgtttctcattactgcatattgatttacgtgaatttttttttgtcttttttcagaaaactggaaagtaataatataactggggatgtttcttcacttattaactgcttcagtctcaatgtcttgtaagttatacacttgaaaagcaatatgaaatgatttcacacaattttttttggccatgaacctgtaagcttcatactgatagtgtgttactgcagaaacgtatcatacaacaacctggctggcattgtaccaacagacaataatttttcacgattttcaccggacaggtattttccttggggattaatcgatcgcttgaaaaagaactcgtaatacttaggcatctcaggcctcatcaataatctgatctttaattcagcttcttgggtaatcctggactctgtggctattggcttggttcttcgtgctactccaccagtcatgtgcagagatgtcagtaaaatgttacagctgttgcgttgctccgaagtgtaacttcacactgataaactttctaattttatatcctggatttttatgcagcctctgtctcaaggtctgcaattcttgggattgctgtagctgggcttgttatcctgctgatgatcctagctgctgcttgctggccacactgggcacaagttcccaaagatgtgtctttatgtaaaccaggtgatgcatctgcagaggtcccagtccattgattttacccatcaatttcggtagctgtttggcaagtgtcctctcgtcacactcaaccttgcaaatgatctattacatgtctcagactattgcatatgttcgccctctacttgatagatgcatttggttgttaacagagtgatattattattttcctgtgatagatatccatgcactaccatcaagtaatgttcctccaaagcttgtaatccttcacatgaacatggcattccttgtgtacgaagatataatgaggatgactgaaaatttgagcgagaagtacattatcgggtatggggcatcaagcacagtgtacaaatgtgtactgaagaactgcaagccggttgcaataaaaaaattgtatgctcactacccacagagcctgaaggaattcgagactgagcttgagactgttggaagtatcaagcaccggaatcttgtcagccttcaagggtattccctatcacctgctgggaatcttctcttctacgactacttggaaaatggcagtctctgggatgttttacatggtaagtgaattttacatggcaaacaaatacataggaactgtaagcagaatagttggtatttagaacgattgttcttctggtttgtatagccgttgcctgttcatctgtcaacaagcaccacctgatcactttcatatcaacttgtttgatggtttaatattatttggattaggatattttcatggaacataaacagctgataagatttctgcaactatagcctaattagcaatttctttattattttagcaggctcatccaagaagcaaaaactagattgggaggctaggctccggattgctcttggtgcggcacaaggtctggcttatcttcatcatgactgcaacccacggataattcatagggatgtgaagtcgaagaatatccttctagacaaggactatgaagcacatcttgccgactttggtattgccaagagcttgtgcacctcaaagacacacacatcaacctatgtgatgggtactataggctacattgaccctgagtacgcatgcacatcccgcctcaacgagaaatcggatgtctacagctatggcattgtcctcctggagctacttacaggcaaaaagccagtcgataatgagtgcaatctccatcacttggtaactatttttccattcgcttgctactgtttatttgaaaacttgttcctttccttcaccatatactcttgcatttgaggttcaataagtgcacaatcatgggcattatcaggtctgtgttccttcaaggggaccacgcatgaatcctaccatgtgagtagatctatatacactgtggcggacctggtagtgtgtgattcattgtatggctggtgaaagctctatcataacttgccagtgtcccataaagcctgccatatttgtcccccgccttcaatcatgtgggtgaacatttacaggcaacacacacctgtcaaaaactgtagctaactatgactgtactagttattttgatcactgacatgctggtaacttatcggaagaatttaccctgtcaatcctgaacatctctttttgaaagaaaacggcaaaaggtgaattaaaatttgtatttctaccagcccacaggtccagtacggaatagtgcaactgtaaacagtcgattttagcgatgaacttcctggtttgcatgaatgctgtttatgctcattggttgcttctctgcagatcctatccaaagccgcagacaacacggtcatggagatggtcgacccagacatcgccgatacgtgcaaagatcttggcgaggtcaagaaggtgttccagttggcgctcctttgcagcaagaggcagccttctgatcgaccgacgatgcacgaggtcgtgcgtgtcctggactgcctcgtctaccccgacccgccctcaaagccggcactgccaccggcattgccacagtcgtccacggttccgagctatgtcaacgagtacgtgagcctacgaggcggcagcacgctctcctgtgaaaattcgtcgagcgcgtcagatgcggagctcttcctgaagttcggcgaggtgatatcacagaacacagagtagagtgactatctgaatatcctgatggctttgtgctttgtggcgttggcgttctagctaagttaccagcttttgtgtccttcctggaataagaagggacaccgacgaagggctggctattcgctgctgtaaatatgctgtcttctggtttgttaggccttcggaaagctatttggccttcctgttttgatcagtttttcttcttatcattattagttagtggggtttggatgaggtgaactgtattaaggcctcctgggagtatgaattttgtaagcacgggtcagttaaaaatatcgcagtgatcgggaaaaatccgcctcttataaaattggttttgttggataatcgcggatttttcagtacagtaaacgatgttaagaaccgctggcttgtaaagctgggagcctgggacatcccagaggcaaaaatgggtgctggtaatgatcatccgtgtggatgcatagtctgctcgatcagaatgctgtttataggtctcaggaatcattctcggtgataggctgtgttgcagagctttgtccagcgctgtcgatgtatggcacagtttatgtcactgtgattcgctggtgactagtactagtaacagtaacagtactagtaagggcctgtttggcacagctccagctccaactctacccctcctggagctggagctcagccaaaaagtttcagctccaccaaaaactgagagtagagttgggtggagctctctcacaaaatatactagagttgtagagctgggtttaggcagctccacaactccactccagactcaactcctggagttatatttaggagttggagctgtaccaaacaggccctaagagtagttagttaatggtcagtgaccccactttttttttttgctgtgttcaatactctccctctcatcctgccattggtttcagtattgaagtgtgtttgagtagaaggagactgaggagattgaaaagatacgcanaacgaggtgagccattagctcatgattaattaagtattaactattttaaattttaaaatggattaatatgattttaaagcaactttcttatagatttttttttacaaaaaacacatcgtttagtagtttaaaaagcgtgcgcaccgaaaaggagactcaatctcccctatcactctgaatgaacgaggccgatatggctacccggccatgtctatcacaattcacaagtagtagggggcatggagtacaaatttactgccctttgtagtacaaatttactgccctttgtagggcccctctccccctgacggatgattgatggtatagcaagcgatgtcattcaagcacggctccatgccatggggccaaaaaaaagccagccaggcgcggcgagctcctcgtgatatgcggggctcgtggagtaatggcgctgcgcgcgcggcgcgaacgcaaatgggatgccctttccgttcccgtccggtttagtacatgctgccgcggccgcgaccgcgacgcaacacgccctgcggtgcggggtcggcgccgcgacgcgctcggatgggatgcggcttttgacagggcccgtggcccttcttcttcgtccgtccccttctcctgggccggaagaaggcccatcacaggacatcagtgtgcctctgctggttgggctgatgcggaacttttgttgggccaggaccgcaggacaccggtaagggtctgttcggcgtccctggttcccgaccgacgcacagaaaacgcagtcttaattaagtattagctaatttttttaaaaaaatagattagtttgtttttttaagcaactttcgtacagaaattttttcacaaaaaacactgtttagccgtttgaaaaatgtgagcatggaaaacaagtgagaggagttgggaaaaaggggtgccaaacaggcaaacacagcctgttgtgttcttaccctatttctcaaacccacctcttttgttttccgcgcgcacgcttttcaaactactaaatgatatgatttatgaaaataaaaagaaaactttatatatgaaagttattttaaaaaatcatactaatctatttttaaaaatataataattaatatttaattaatcatgcaataatatcagctttgttttttcgtccggggaacccatcctcacgaaaacactcaaaacagcctagtagtaacgtggtgtgccgtgtaccattgattggaccggagagtatcggacacgacccatgttacgtactagtatgttcggtgtagaggacgagagatcacctcagcaatttttcctaagccttctggacctctgtgcaaatagtaactcattacgacatcatccttgttcggtgttgaaggccatcatccggctgacggttcgtcggcggcggcggcagtatgtggaggcggggaaggggtctggcggcagggaaggaggagtccggttgcgggcgcgccgtcgacggcgagaacaactgtgggcggtggccttggccgaatcgctgaagggacaatgctgttgaccgacgacgatccttcttgtgcggattggtggtgtgggtttggacaaagaatcgcgggcgaaagctttgccgagccatttggctggctgacaacggcaacgccgtttggcgtcgttcccatccttataggcgttgttttagcatacccctttcctttccctatcatattctccgggtgaaaaccttgcttcggttacgaacgagcggtggcggcgatccacgtcgcatcctccttgggagcaccgctttggagaaacctctttgtgcaaagatattgtcattggtctatgcattggcttcgaacttcagtcttaggccttgacgaggccttctagctccacattttgttttgcttttctcagtttggatcatctcttctcttgtttggtgtgttcaacttgtcttgaagaactatattctcttctggagtggatctttataataattagttatagttctttttatcaaatgtcgggatattatatttcattatctaaaaaattacgacatcatcaatccattcgtccacgcttcacacggtagtatggtactcgtagtcgtaggctcgtagtacgcacatggtttcagaggggaaaaaaataaaggaacaattgctgaaaagaacagtttttgttaccgtggagaggacggttcccagaactccacggaaaatacagggagttacccgcaagtgaagaaaacgaaaggcgtagccagaaaagaaaaggaaggaaaaaaaaaggttttccttggcgtgcacagcttctccaaaaaaaaactgtccctcccctgcacggctgcacattgaacgcaaagctcgcgacaccaatcgcacgtgccacgtggcgggcatcttgaacggtgggacccgatgtcagtggcaggatggcagtctcctcgtcctacgtggcctcgcccgctcgtgggacgaccaaccgtctttaagaaattggtctcaagggcaagacggtaaacttcgtgactggtactggtagtagagaaattaattaactgtcgtatttcgaaaacctcaagagcacactgggcatcgtgacttggagcgaaacccggcgggtttggtgggtccggttcttcctttgaacgcacttgggccgtcggatcaaagtggtcgtgttaggaccgacggttagggacaggggcgtgctgttttcgtgcagaaaaagggtaatcctaggttttataattctggagttttgcagggtttatttgcctggtccatagtttgtgatcttttcatctaggagtatataggatttaattggttttttccgtgtttaattttcatccaaatctattcacgttccatcggactaatttttagcaaagtgtttgtttatgagttgcactattggacttcacctctagctcgagttgaatttacatcctagctacgctgggacgagcccaacctagttgatataacctatagcgaatccacgttaaaagatactactacatccgtttcaaattataagactttctaacattgcacatattcgtatagatgttaatgaatctaggcacacactacaacaaaaacctcgtatagaggcacttttgtagaggcgttttgcaaattgcttccaaaattagaagttttatagcgtagagacactttatagaggcactttaaaaattgcctagaaaacttttactctagagacatttttagatcagtttgttagattttatctcgtagaggcattctttcggcactataaaatacgtctaatatgtaaaggcattttgttgatacattttaaactatgtagagacactttttagaatgataatgtgtactaaaggactaaatataagtaactaaaggaacaagcatataagtaatgacatggagttgagttggttagtgtattgaagattaaaatgatttaacgaagagattatgagttcaagacttgtcaaaagcaaggaaactattttattctcttttttggactggttttatatttttgcggtacaatttaatgtctctagaaaatgcatctaccatcttatagacattttataaaatgtctattcgtttgtagagacaattcaccataagacacttattagacattttttaaaatgcctctacattgttgtaaaggcatttaataagtgactctacagtactagaaaaatgtctctacaaagcatttttcttgtagtgacatatatgtctatattcattaacatatatataaatgtgggcaatactagaaaatcttataatatgaaacggaggaagtacgagctaaattagctactcaagtgtccaaaatagacaattttgatctgacaatattatttgggtaggcttttgaaacaaggtgaaacaatggaaaatttggagttatttatgcaaatttgctttgatacattgtagtgcatgaagctcgttcaaccaggttttcctgttctcgtgtatctaggccatgagggaagcacattttggtagaattatgagaattttgttgtacatatatagctcttgatacgatgctcaattcaacaatatgttttcagttattgtactgatttcgtgaggatttcttatgctatattaagttgttcaagtttagtaatataaaagtgccatttcgttgtataaataaactgggttacaacaataattcatgatgatgtccaactattcctgattctccaataggcggtccctctggcatcctcaaatattagttcaataaaactcaaaatctctctgagggtgcaaagatggtggacttttacaaggagatggagaatgcgataatccgtggttgtttgaatgagccagaggaggccgtaatggtgaggttggtgagatatctcaaaggtttggattattgtatttgaatgcatcgttgaatttaagtctcacaacactgttattagttgctataagaaaatcaccaatggatatagtcgtgccattaaaaaaatggacccttagctactggtactacatgatctggtccaagaagctaaagatattttggttgcgttaaaaacatatttcaagaccaatttaagcacaacaagttatatatttaatagcgaggcaaaactggtagctcgctaagtttgcatggggaatgtcttagttctctgttatttttctgcatgtgattttcgtgccgagcgttctgcatactaagcttcttaatttgaagttcgtgttgatgataaaactcctccgggattagatggaaattgagttgtagggaaattctttgtggtactctgaatgccaaaaactaataagaagaccttatgttacaaactagctctagcttatactcatataaaagggaaaccaccatgtgtccatgttactctaaacatatcaaagtcccttgttgtaaacgatttcttgatgcctctgacctcaactagtgaatatagaacagatcagggacctaagtcagagaaagcagcccatgtggccatgcattcaaagtttcaagttggccagatcggcaaaatttcaacggacccgccaccctcgtccgcgcctgcagcgccccgccgtccccggccaccatagccgtcgccgtctcgtacgcccatcccaccccttctcccgcgcccatcccaccccttcctccgcagccgccgccttcgtccgcgttctccgtggctgccgtcgtcgccgccgccgtctccctcgcccccggccgcagccgtgcgttggctgggacactgccggactgccccgtcctcacatggaagaaaaaaaagctgaaagggaaggatgggagcaagaaagggaatagagggatggtgggcggacaaaataaaaaaatatttatgttgcagtaattataatatgtctattatatcagttggctataatgtttatagagggatggtgggcgcacaaattaaaaaaaatatttatgttgcagtaagtataatatgtctattgtatcagttgactataatgcttactacagatgatgtgtccatctattgtagccgatagctggctatgttattgttattgatctcgctcttaccgatcaaccgatgggtccacgtgatttctcccccacacccagaaaaagacgcctctgccctcctggccccacgcgccccacgccaccttgatactcgcgggcccaccactgccacgcgggcggaaatgacgccttcacccctcgaccgttcaaattccgttgccacgtcggcgtgaggattttgatttttgcaatcaccaccccgcgcggcgcaaacatttcgcccctcgcggccacgttttactttccttttttttttggccattagaaaaagtgcacgtgagaagaagcgccaagccacagccaaaatttcggccatgagtcgacaactccaagcagcggccgccgcctcgctctaaccggagtcccccactctctcggtctgccaccgccgcgcgggccaccggcggcgcgccaacccgccgcgcgcgcgcgtctctcgtgctcggctccgccgccgggggggaacccggcgggggctagggtttcggcgagatgagctaccggaaggggttgaaggtgtgggtggaggagaaaggggaggggtgggtggaggcggaggtggtggaggtgaaggaccgggccgtcttcgtgctcacaagccagcggaagaaggtgcggcaatccccctcattccgtgcggtttaagtttgtgttgtactgtttgggatttttcgtgggggcggggtgtgagcagagacagggcgttccatatgagtttgcttcgagtattattcgagacgattgggacagaggcttgttttgttattagtttgatcatgggttgacatcagtgaactgaggcagttcaaaattctactaatacagtatatattttttgagttgctctggtgtaaactttgcgcgtcagagtacagggagaaacaactgattcgaaatggtggaagttgttgttacagatgtttaatttgaatctatcgctaatttacacaacaaattcgacctggttctggtggggcaccagttcgctaaaggggagtatttgaagtgtaaatggtagcattcctggggtactttaatttggattaaaattttgaaatcctttgccagttggttttagattttgtcagcttgtttgtaattttgcagaaccagtttgaagcttcagtcagagtacttctatatagttgtatgaacctgtaacttcacttgtgctctgcaatttacctggattgtatgagccgtgaaacataaatgcattgacatcaataactgaggacgattatcaacattttttttgtttacttggaaatcgctgtgctattagttaaaatttaactagttttagatgtatctgtattatgctatcctttttggtttgcaatgcactgctttaccaggattagtctcccttcggctgttgattttgtagttgtcctggcattctttataattttgtatggcaggtggaaatttgttttatcaatgaattctgatccactctgtttacacccaatggtctatttgggttctgcacttgatttctggatttcacgccgtcctcggtgaaaacattgaagtaatttcatgttgcaaccaaattatctatacttaataaaagagagtagtgttggtggttctgccaccacccctaccaccaactcccaacttttctttacaaaaatggacgtgtggtgctagagggcccagatgtcaaccactcccaccaagtcctttaccttgtgtgagaaagaaaaaagtacagtgtgggaccaaaaggtccacatgcgagtaacaaatatatacagcaatcaagagatgataataataggttaatgataattttttaattaattaatacaacagtaaaacacatgtcaatattctgcttgctctttgtactttgttaggctgtaggccgtaatctataggaggagaggacattgggatttgggtgagtctgtatgtactttgtgggctggaactcttgaattttccaagcatgtcattttttttctttttgttctttataagacgatagatcctgtttcaaccaattaaaaacaattcttttcaacaaggactttattttgctattttcaatatccgttgcaacacacgggcatttgtctagtgttgatataaccagtatttatttctgtacagaaaaaaatgaatttatagtttttttaaacataattattaacaatttatttgtttttactattaaaatttaatgtagttagtttattcttcctcttctggttttcagattacagttttggcagagaagttgctgcctagggacacagatgaagatctaggtggggggcatgtcgatgacatgaccaaactaacttatcttaatgaaccaggtgttctatacaatttgaagagaagatatgcattgaatgagatatatgtaagttgttcactggctctgttgtttttatttgtcgagtgacttgtctacaatgaaaacatattttgttctgtgaatcatcgactcgttgtcggaatttctttgtaaagatacacttcacttgcaattctctatttatcataatttgtgaccatcaacatactatatgtgccagtgttactttctcataagacaagttcactttggctgtccctatgattagacttattaatgatgattttctttcaacatgtgttgtcttagtaaatacatcttcttttgttttgctgctagcttctctttgtgacagccttttcatttttcttcttgagatagacatacactggaagcatcttgattgctgttaatccattcacgaggcttcctcacctgtacaatgagtacatgatggagcaatacaagggtgtccggctaggggagttgagtccacatgtttttgcagtggctgatgcatcatacaggtttggattacattttgattcagtttaagtgcccttagcctctgtttgcatgtacaatctgttttcatgacatttattgagttaatgtagggctatggtgaatgattcccggagccagtcaatcctggttagtggtgaaagtggtgctggcaagactgagacaacgaagcttatcatgcagtatcttacgtacgttggtggtagagctgccattgacgatcgaactgttgaacagcaggttcttgaagtaagttttacctcctgttttcttccactataataaatggatactaagagttgtgcatattttagtcgtcgaaaatatttctggttggtacttttcaaggcattttctcataactcataagtcttttgtttcttcttactagtctaaccctcttctggaggcatttggcaatgcaaaaacagttagaaatgacaactcaaggtgagtatcactcataaggtgacttgggaaatgttgttacaattatatgcaatagttagggatatattcctcaacagtacacatggttctccctctggcccaaaatatggcaacttctagcgttcaaaacttgtcccagaatatattaacttctacacctactctctcatctcaaccaatcacaaccatttctcattgagtttttccacctatttcctcaattaatcacaaccatcccccatttaattccacctcctttgggacggagggagtataaacgatatttcccagaatatactatggctttaccaattcataggactcaacctttctcaatgttttctttgcatagtcttaatttacaacactttttggttgcagccggtttggcaaatttgttgagatacaatttgatgcaaatggtagaatatctggagctgctattaggacctatcttttggaaaggtcccgtgttgtgcagattaatgatcctgaaagaaattttcattgcttttatcagttatgtgcgtctggaaaggtacctctaccaaccattgctattccatatttggctcactattatgtgcataattgtgtgagttccattactgcacggtttgattatgggctatctgtgaagtcagcattgaatgttgaagaatatgcttagagttaaattatactgataccctgttggcccgttccaatgtagacctcattcatttcgcccatttgagcagttattggttcagctgggatgtgattacgatgacacccatttctgttatataacttataagaatttgggcctgcaatttattactgaaattagttttattgtcaaaatattttgcatatcagagaagaaattgtgaaagatgtattcattgctgcaagacaataatatatccatttgaacttagttttaaagacaagcactaattgtttttaattgctgttaatgagattatcgtaatccacctcattatcaaagccttagttaagcatggagaacatagtattctagaggttgtataatctgtttcaattcagtctattctatctaattgtacagttgattccatgcagttctgagttttttttttttggttttggttttgaattttgcatatgtttgttcatgtaggatgcagaactgtacaagcttggtcacccaaggagtttccattacttgaataaaagtaagacatatgaattggaaggaacaaataatgaagacgagtactggaagacgaaaagggcaatggatattgtcggaattagcagaaatgatcaggtttctacagaatgtgaacatacttagatgttacatggaaaaagaatacctaaagaaaaccagtgcatattatgcatacttttccttttcttatcccagaaatgaatgtgtatattgtactttgttcaggatgctatatttcggatactggcagccattcttcatcttggcaacattgagttttctcctggaaaggaaattgattcttcaaaaattaaggatccaacatcaaattttcaccttcgaatggcagccaaactattcatgtatgaattttatttacatatatgattgtgacccctttttccgctcatcgtcctcatttatccataacaatgactcaaaaattgtatcaagttccaaactcttgattcttgaagcgtttagtttttaatgctccagggcattgaggttatggacgtagatgatttgacctttgatttcttacagacgtgtcacaagaaaagaatacactttccaccctatgttaatgacttactgtaaatgtggattacaacctatggttgataataataaaaaatgacatgtttacgctcctatacatgctatatgcatatgtggatattataattgaatctttttagatattttatttgagtttgtcttgatgaattttgattgcctgattagcaaagtttacaattttgaactgtccgcatttactgttttgacatgcatttctggaaacgggtcatggaataaccaccaaattaagtgagcatgttgataatgtactttaaggataatgcatgcatggataatatcttgttatgcctaaaatgtccttggtcactatgaatcatatattttccatgtagcagaaattatttaatgctctgggaacggaagtagctttccacagctttatttgttccttatcgcttcattttttctatttgaattaggtgtgatccagatctgttgatctcaactctatgtacccgctccattaacactctcgaaggagcaattataaaagcattggactgttctgcagcagcagctaatcgtgatgctctagcaaagactgtatatgcaagactatttgactggtattttcacatgccttcttttttcaaggatactgtgcatttttgtaagttaacattctttaattgtttccaggcttgtcgagaatattaacaaatctattggtcaagatgttgattccaaagtacaaattggtgtcttggatatttatggttttgagagctttaaaaacaacaggtaattaagtattctgtcatttagtttaactcactcactgcaattttatagcattccataatttagtttaactcactcactgcaattttattatatttgatttgtgaatatactattatcaaataaaaggtgtcatgttttatgtcagcatttctgttcacaatgcaccaatttacagtaattttgtgcctttttttcttgcttggttaggctggccttttaaatgtccacaagccgacaagctatttagtatgttgaaattactgtttgtgctgccaactaggcaaaattgtgggaaaagtatgggatgtttaactgctgcattttcgtctgtttcccttttcctgatgaatcatcctttatttattgctgcagttttgagcagttctgcatcaacttcgccaatgaaaagcttcagcaacatttcaatgaggtatagtgcatcatttgctctttaatggaaacacaatattaatttgtacttaaatatttatgtaacttttgtttcttatcattaaatactgcaaatctgtttcttcagcatgtattcaagatggagcaggaggagtacaaaagcgaaaaaatcgattggagctacattgaatttattgataatcaagatgttttggatttgatcgaaaaggttgtcttggcgaacttatttaccaagttcaatatggacaaatcactttatgcttagtaatttgttttaatattgtaatagctaccttcttttttttttctctgtatcaacttgtttcttcgtatgccattttatattggtcagattgccaacttgcatttgcatataatgacacctttacaatttagttacttatgtcttagagctggtattatgtttccctttgtgctagtgttggtggaattagttactgatgacattagctgtagttgttgagtgtttgacacgttcgtccattactagcaccaacctgaccacagtactagcatgccacatcccgctaaagcgttatcacatattgtcatcttttatagtattataccgggttctaagcacacaacaatgatgttaaagcttttgcgatgtattagaagaaacttcagctaggcttgacagatcttatttattcatgccattactcctaacagttcaaacttccataattgaataactagaaacacatagacttgaatgaccagaacaaacattcaagatggcttggattgtagaatgcattaatgcatacaactgttgcacttgcaaaatgtccgcaagcccaaagagccaaaacagcacgttggtgatttcaatataattatgcgatgatactattttgtaaaaatcttgacaaaatatgcttatcgtggcaaacataatttgcttctgcaagctttaatatctactgcatcgaaagtgtccggtgcggtaactataaaatttatggttattagtgttcagattatatctatgttatgtttgggactggtgcatgcttgtgtgagacagtttgctgtgcagtaatttttgattggtgtcgcttttgaaatgctattttgctgttggaccagcacttataacatatttttggcagcccaatgctaattcaattgtatgtacttgcagaaaccgattggaattattgcactgctggatgaagcttggtaaatcgcaatttttatttttgctggaaaacagctgtttttattaacaaatagataaccattctaatatatgttttttattttccagtatgttcccaaaatctactcatgagaccttcgcaacaaagatgttcagaaatttctcttctcatcataggcttgagaagacaaaattctcagagacagattttgttatctcccattatgctgggaaggtatgttaagtaattttaattattttttcctgtatcaggtatcaacaataacaaagtcgaccttttgcaggtgacgtatcaaacagaatcgtttctggagaagaatcgagattatattgttgcagagcactgcaatcttttatcttcatcaagatgccctttagtttctggactttttggttcattaccagaagaatctttgagatcgtcatacaagttctcatcagttgcttccagatttaaggtatcagcaaaaatttctttgcttcttggtctttgaaatttgtctgcttacatggtttatttggtcacatgtgccataagatattatttactctagaaaataatgtggttaaatgcatctacttccaaattatgatctaggtagtgatgaatagtgtggcagatgtaaggaaaggaacaaaaagaaaaatctctctccactatcccacctttgcaagggattttcatgtaaaggggattgaacttgttagaagctatttttgttgtatcatagcaatattttgcatgtgtttttcctccaaatattgctgtttccttaaaaataaaaaaaattacagtacatatgctcattgttgatttatataggctgatcttcacttttggaaattatatgtttccttgaattccatttgcagttgcagcacatgcagaagtttgaaccgtaattgtactagctttgattgttttattcatttcctttcattcctgtataatggttgtaattaaggcactgacttgctatattttcatttctcattgattgccttggattgtattgaaaccataacatataaccttcctaactgcggtattatattcattctctctgaagcaacaacttcaagccctcatggaaaccctcaactcgacagagcctcactacgtacgctgcgtgaagcctaactctgttaatcggcctcagatgtttgaaaatcagagtgtcctgcatcaactgcgctgtggagtaagaacatacgccttaaacattaaacacaaaagcaatagtatctgtttcttctgcataaatctcttgaaaagcacatctgcccatacatcacgtcatcacctcttgagcagcacatctgccttaaacattaaacctcagtttgctgttggcagtatggcactatgaatgtcgaaatgctaatgttcattgtgggtgcttcaagttatacctttgtgcaatagatgagtaaagctttttttggtcctatgccaactttcccaattcattgtgcaacagatgagcaattcctttgttaattgttggcactagcggatgatttgttggccatatgccaacttacccaattcattgtcttggttcatgctgtactgtttggacaggaagctatcatgtgacttgagtaggctatagtcacatgcaatccacgcttttgtgatcatgtatatggagccacattcataaaatcacttaataagatgtttactctttcgtaactgtatattggtattatacatcgtggtatgcttttgctttattgaactatctctagcaatacaccagaaaactccttaaattgtgtgactatttatctcaagctattcatcacttttgaagttttaattccatttgttgcttcatgcatgaactggtcaatgttccttgaagattgtaacttggtcatttgtcagggtgttttagaggctgttcgcatcagtcttgctggctatcctaccagaagaacttacgctgaatttgttgaccggtttggcgttctagttcccgagttgatgcttggaaggtatgcaatttatacttcattaagttaattttgagtttgtgcttcacattgtaagttgcaatggcaactttcttcttttctttttacggttttggcgatcttaattacagctgcaaatcattccatttgttgttggtgcagtctatagctgattcatgttccatctgttttggcctaaacagttagtaggtttgttagatctgatataaatgttctccaacaaacaacacttttttgctcaacatcgtggagctgatatctcttgtttgtacagcaacttgtatgtgtgttaccgataatgatattttagccattcatggtgctactttgatccagcattcccctcatcaattagagtaggccaaaccaaccaatggatttttatggcattttatgtaatcccgttattagttaatgggttcagcgctagcctagcagtttgaattaacatacacaattctggagcaactcaaacacacaatatcttttcaaatggttgccaactttttgcctattcgatgctaaattcctacatttactaccctctttcctatcctggaatggcaatctgactataagctttaaattgttaggttttgcgtgaaagtttggagggaatttatcaagggccattgggaaaaaggagctgcttatttgtttgtttttgattgcattaccttatgtgatgttatgtttaactgtgcagttatgatgagagggcattgacaaagggaattcttgaaaagatgaagcttgaaaattttcaagtaatctactcaacagattttatattactgtcattccctaatatttcttgtttatataaagagtaaatttcacaaaactacatgttttatggttcaagttgtagaaaaccacacacattttgatacttagcacttaagtacatatattttggtagtttag

SEQ ID NO: 5715 - DNA, 22508 bp, Oryza sativa
gtacagtagttcatcagtgaaacagccacgtcatctcgcgggtgaatctattcatcgaagtgtggttttgtgaaactacacaaccaaaatgtatgtacttaagttccaagtgtcaaagtgtgtgtggttttctgcaacttggaccacaaaacgtgtagttttgtgaaatttactctataaagagtaatgcctgattccagtagtgatttttgtacacacatttttgttctgtttccaattgaagtgattgatagttgctgtcttgtacttttttatgtttatactgttcagtgtagaaaaactgactataatttattgatggtttaacactttgctttacttaatagcttggtagcactaaggttttccttagagctggtcaaatcgcaatattagatatgcgtcgtgctgaagttttggagaatgctgcacgccacattcaaggtcgtttcagaacattcattacacgcaaagagtttgttaaaacaagggaggcttcaatttctatacaagcatattgcagaggtaaaatttctgttgctttgtcaccttatttcctccatgaattctgatatattgctgctttcagtgctaaattgctgctacattctggttgctaattttaatgactttgcaggctgtttggcaaggaagatgtatatggtgaaaagagaaacggcggctgctataattgttcagaagtatgtccggagatggcggcttcatcggacttaccagcaagctcattcagcagctcttcttattcagtcctgtattcgaggatttatcgctcgccgttatttctcagttatcagagagcagaaagctgctttggtgatacaggtgtgtccctcctcttaagtttcaacttggttatctggaaacagtgctaggatagtaaataaataatttttaagctctcttttgaagtcataagcatgttccttaatttgttgttgagctgttggctaaggtaagtctagactaattagaatattagcttcatagcttggcatggaaggttatattgtattgtgatgccatcaattgtttatacgagaaaaaaactgactcatatggttgagttttcaacactgatttctgttggcaattgcagtcattgtggagaaaacggaaggttataattcttttccaacaatacaggcaagccactgtgaaaattcagtgtgcttggagacagaaacttgcaagaagagaactaaggagactcaaaatggtaaattctttgtgctattcgatatattatcttttggcgattttcaagccgtactgcaaaactaaaatggaccattgcctgttttagttttttttggtttttctacctcaaacactaccgtattactattacttgttattctttcttcctccacatgctcatgagggatacatgtttctgtgtacttgaaatgatctggtccaattttccttccaagttactctgatctgctccctttgtgtcatctggcaggttttattatcctgtttacagactagttttgtttctagcctgttattttcatgcattgtgaatactcttaggcttagttcatttctatgtatagaggttagctactacctcgttatttgtgagcacgcttcccaaactgctaaacgttgtggtttttgtaaaaactttctatatgcatttcttttataaaatcaaataaacccaattttcaagtttttaagagttaatactcaattaaccatctgctaatggcccgcctcgttttacttgcaagtgaaaagctgtcccaaaccgttcattcgaacatagccttatacttggtttatgttataggctgcaaacgaagcaggtgcactgcgtgaggcgaagaataaacttgagaaaaagttggatgaccttactctgagactaactctagaaaggcgactgcgtgtaagtgttgtctatcattttttacctttgtgttctatttgttaattagtacttaataagatttgctgttgaggggagaccacacatgtatatattttactaatatgcttgttcctaacagtattatgacacttatatctgtcatttggtatttaatgcttccataccattgtcacatcatgagattaacctaaatgtttcagaaactgattctgtgaaaaaaaatttcatgtttaataataatcataataatgtatttcgcctcatggggcatgaactttaaaatgtaggctgctggtgaggaagcaaagtcagtagaaatattaaagcgcgacaaaatgatagaatcattaagtgccgaatgtgctgcagccaagtcagatgctcaaagtgaacatgacaaaaatcggctactccagaggcaattggatgattcgttgagagagataactatgttgcagggtagcaagattatgacagcagaagcagaaaaggagaactccaatctgaaggttcaaaggctttccttgtcattttaatcgcaatgatgcttggttaactacattttcagttattctctgctgttttttttacacctttaattgcatctctcttatttaatgatttttccattgtctaattgctgtacttctaatgtgataaagttaccacaatcatttttttatttagttttaccattagttttcattgctgctgtaatttgctgttagcaatatgcttctgtgtttctcttaattgtactttggctgaaattattctatattactctgtacagaacttagttgagtcattatcaaagaggaattcgtcactggaatatgaactcacctcagctcgtaaaggtagtgatgatacgatgaagaaattgaaagatgttgagggaaaatgcaaccatctccagcaaaatttggacaagtatgttttccctttcatttattaaaccatagagtgctagaaaaatatgtatagtattctaaggtttattgctgctcgtttgtattgggatgcaaagcatctaacagctactggtttgctaattttagattgcaggagaaacttacaaacttggaaaatgaaaatcatgttcttaggcaaaaggcattaaacatgtctccgttgaacaatatgtccatggctacaaaggcttttcctcaggttcttttctttgctctttattaattgcttcagctatctgtttgttgctgttaatatttgatctagcatttaagttcttttattgatactcatatttgggacactgggtactgctctagtttgcatctcttcttaaatagtttactgacatgctgcttgaatgcagaaattcgctacaccgattgggcttccaaacggcgagcagaagcacggatatgtaagcctattcttttgatcgacgtacagaactgctatagattcgtctgacatattggatctcaatttttgaattgtaggaaacaccaccagcagcaaaatatctcgcttcacttccacagagtttaactggatcaaggagaaccaggatgcctgttgaaggcaggaggtaaattccacatcatatttttcatttgttaatttttgcttgttctagctctgttgataccaccttagataagatggcaaataatttgttctggacgatgtgacattattcaacaaaatttcttatgcatcttggtgatgattttgtgtcatgcaggaaaatcatgaaatcttattacgatgcataaaggaaaatctaggattcaaggatggtaaaccagtcgccgcatgcatcatctacagttgccttttacactggcgtgcttttgaatctgagaggactgctatttttgatcatgtcattgaagccataaataatgttctcaaggtaaacttacttcagactcatctattttgctgtttgtgctaaatgtttatttgcggatgtcaaataatcatggaagttctcctgttcttactccagggggaagaggctgacggtagattaccttattggttgtccaatacctctgcattgctatgccttctgcagaagaatttacggtcaaatggattatttgctacaccatccggccggtctggtggacctctagggataggtgacaagatagtgcaagtaaggaaccctgaaaattatggatcattttcttaccagtactattgaattatgctcagtgtgctgatatccatatgaagtaatattttgaaagcaatgtcctagtttaactctacattattttatcatgtctgtatattttttggacatgacctggctattgacccagtcaacaactcaacgtattgggtcactggttgaagctgttggtcactgatggggcccctggtttcattttagcggcaaaaacaatagcatgacggtgcttagtaaggtcttaaatagcttattcggttcaactggaataagtagtagctaccttagttggttaccaggcagatgcagcacacatttttggaatctttaagctggtggagctagccagcagttgtattagtctatgccgtcagttacgccaaaactacctggttttaacataggtctttggatttgccacttcaaagtggccatcaatcagatttggtctggttggactgtcatggtgaaagtgctggttctcctcctccctcctttctgacaggccactctgctgttctggggcagatctggtaaatcatgtgtacctgtagaggatctatacgcttcccataatgggggaaatggaaacatcatggcatcatgctcttcaagtattcttaatttgcacaactgtataagcccagtaacatgttttgctggtatagaaatttgttgtgcaatttttattttccttttttttcgaaaattcgggtacgataaaattattgtttccctctgttactgaaatggctcctgttttgtttcttgcagacactcagatctccttcgaagcttatgggacgcattgatactcttggacaagtggatgctcggtatccagccatattattcaaacagcaactaactgcatgtgttgaaaagatttttgggcaactcagggataatctgaaaaaggaaatatcaccacttcttagtgtctgcattcaggtacttatccactttaaaatctggacgacaaatagatacattggaaacctagatatgtcagtacaccggctcccatctgaatattttcatgcaggctccaaaatcatcacgtgcacagcctggaaaagcatccaaaccacctggggttggtgcccaaccaccatcaaactcccattgggacaatattgtcaattttctggacttgcttatgtccacgttgcatgcaaattatgtgagcattttcttaagctttttttcttcatcagtggatttaaaggctcttggggtgaatcattcttttttattattatttttttttgctgcaggtgccatcattctttatacgtaaacttatcactcagctattctcttttataaatatacagctttttaacaggtaatttcctcaatttttaaatttatccttgttacatttacatacaagcaaacaaaacagtttgcacatggtaaccaatcgatgttattgaatgggtagttattccttggatgatataattatgtcttcattagttttgcaaatagcgtgatcattgcaccttttatttatgatataagcaaagggcctttttgacagtgaactgatggaattctgttggttaaaagttataataggagatggtggtagaattactttgggaaaaatcggagatggtggtagaattactttgggaaaaatcattactgtattatgtttgagataaagttataggtaaaaataaaatgatgaaatcatatggtttgtaatgatattaacagtcctgttcccattgttccatcagccttcttcttcggcgcgaatgctgtactttctccaatggggaatatgtcaaagccgggctgtcattgctggagaaatggatttctgatgccacggatgaggtaggtgtttgcattctgcttgtgaagttgttttgcactctgagaatggactatgagaaggcctgataaaattgttagcttatcccactatatttgttcccagtttgcttatataccttgtgttttaggaacttaggagcaagcaacattattatacattttatcggtgctctgactttttcacattgctttactagtttattatccttgtactttcagtttgcaggaacatcttggcatgagctaaattatatcagacaagctgttggttttttggtaatttcttgtgcatgctgcatttgtttccatgtttctgtgcttcttttgtatgcctgccgaacatctcactaattgcataacacaggtcatacatcaaaaaaggaagaagacgcttgaggagattaggcaagatctttgcccggtaagacttgctgcatgtatgacctccgatttgtgcatatccattatttatgccatacctcaactagttattttctgctcttgttctttgtagaacttgagtgtacgccaaatatacaggatatgctcaatgtactgggacgacaaatacaatacccaaggaatatcgaatgaggtaatcacttttggattggaggctttccattttttggggattcactatgcttttttgttctgagaatttcgggatctggcaggttgtttctgcaatgagggaggaagtaaacaaatatactcagaatctcgtatcaaattcctttttattagatgatgatttaaggtatgcgtgatttcttggttaaaattttagacagcagaatcagcctttttgtgtatgtaaatcactactatccttattgcagaacatgatttactatctgttaatttgcccttgtatgtgatgctttctttcagtataccgttctctacagaggatttgtcaatggccatccctgctatagattatgcagatgtagaatttccagaatcgcttcatcactatccatcagtacagctcctagtcaagcatcatgatccacagcctgtctaatagtatggttggggttgccttgaagattcgtttatttttgttcccagtttttagtggggtttcatcttttgaactgttgtatggttgttaggcttgtagtcttaagtttatccggggtgaaaaggttgtaacagaaatggtaggatgtcgtttcaaagcaacaattgttgctcggtgaaaattaaacaatcgtggaccctggttgtccaccagtcctatcttcagatgtacatagtgttgtagagacagttaagcatttgctatgaaaaatatccatgttctgtagcgttagttttctactcgtgatctgatgtttggtgcaatgtttggcaaaaacataactacctttgggctcgtcaaaacaaaaggagaataggaaaaaaaacgcaattagtatacctctgccattacccgattagtggtacctgcatcttaaaatttaagcttttctggctatggagtagtcaacactaacatattaggattatttgataactgttataacggttataaaaagacttgcaatgggttttaaggagcgagtgcgctgatgtatctgtggcaaaatctgtcgtaggtaatgtgaaatgtacgtgaaagtgttgggaaataacgggaattgtttgtattcagaaatatccagggaagacaatcccttaaattgtgcgtttttttctgactaatgtagaaatgttcatcgatggacatgtagtattatgcgggaaaactgatatgcatacgactcaattgtttaactcacgtacaactgaatttgatcagcggttgtaaacagttacagtgtatatgaacatgctctccttatataattgcatatctctagttatatatgagtagtggtgaaatcgggtcgggttcggtcggatctcactcttcccatatccgaacccacattttataatcggaatcgggttggatacggatagtatcgaatacggatacaagcacggataatatcgggcacaaatatgagacgaatacgtaccaagacggatacgaccactatcggttacgaatatcttttcggatatcaagtcaaagcaacgatcatctatactatatagataatagctatatattcaaccaaccccatataaccataatgcgactatattattagggcttaagatgtacgggcaatacgacaatgaacaattgatttttaactggaaaaattgaaagtttggttgaaattggaacgatgtgatggaaaatttgaaagtttgtgtgtagccgtgtaagaaagttttgatgtgatggaaaaattgaaagtttgaagaaaaaatttggaactaaactcggcctgacatgtgatgagctgctaacttcctgttcctgaagagatgaggatcggctctggcagcaaaggcatgtagcggcggtggccgcggctcagcggacgcagcaggtggcgcaccggtggcgctcgtagtctcggcatcattgctcaatgggattagtgaacagtaattagtatttttggttattgggttgttaggcatggtttactggttgatggtggtcattgtactagtgggccttttggccactagtgctttattgggctagacatgttatctaggtattatccggatatttaaccgggtaaaacccatatttttgctggataactcgtatccgtcggataccgtcctcccaaacccgatctcatatccgatagaaaatacccgtattcaaacccgctacccgtaaaaacttccgggtacccgaatttttgacccgaaattgtctcgaaataatacggtcaggcgggcaggcgggaaatacccgccccgttttcacccctatatatgagttgtataactggatcgtacttatagcagtagaactgaagtttagttcttttcaattgaatggctgcttttgactgaaccctcttttcatttttcacatttattattttccgggattcagcggtacaagctgaaaacaaagggaaaaaaagaacaccattttcctcaagaaaacaaaaggcaatattacattttttgctcttgggatcgaaaatagcatcaccaagaaaaagaatcaacgaacatgttactgcacctcctgcactttgcatccaccgtagaaatatgttaccactattatgtacacttgaaacgatctcgaacaatacacgctcacacgcgcgcacacacgcagtaacaggcaaattcacgccctgccgcggtcgcactttgcatccaccgttgaaatcttgagctagccgcccctgtccctgctctgcctcggcgagccggacacggagctcgcgtaccggtgctcccccttccgcatcgcgccctccgcgtgcaccgccgacgccacgtacctcctcttcgccttggccgccgccgccacctcctcctcgccgtcctcacccgcggccgcggccgccttcttcccgtcgtccttggcagcaacaacaacggcggcagcggacgggacggtgtagacgaagggcccggcgagcacgtcgccgcaggacgtctgcagcagcggctcgagcgcggcgacgacgtcgcgcatgtgcgggcgggacttgggcacgctgtggaggcagtggtacgccaccatggcggccttccccgccgccttgtccgagtagccgccctccaggctggggtccatcacccggtgcagccgctccggccgccggaggtacggccgcgcccagtccacgaggttctgctcccgcccgcgccgccgcttgtccacgctccgccgccccgtcagcagctccagcagcaccaccccgaagctgtacacgtcgctcttcgccgtcaggtgccccgtcaggatgtactccggcgccgcgtacccgtgggtccccatgacgcgggtcgtgacgtgtgtcgcgtccccctgcgggccctccttggccagcccgaagtccgagagcttcgccgtgtaatcctgcatcgcccaacataatataaatctctccgtcagccacaacatcataattaactatagctaagagcaagtttaatagtatagccaactactaactttaaatcatttataactaatctaatagtctattcatacaatagttaactataaaaatatactcacaattaataaccggtcccacctctcatacacacataatattttggagtatgtgttgcagctgtttttctctctcttctcttttcttctcgatatgtgattatagctggcttatagcatgcgtaactgctctaatgtagcattgttgatttgaacttttgtttgtatatggtgtcagcttagtctatgtttctgtgtaacataaactgtaccagactcgataatgttcacgtgtgattttgctactacaagacgatttcgtgtcaaaattcgatgctacctgccatgggccggcatgtgtgttttactcgtagaatgttctctttactgtttaggtgggtaattaactagtcaaagagagtggttagctttgcaattaattgctcggacaaacgcttgacctgtacaattttactgttctagaggctttgtagccacagtgctcatgaacagcctttgcaacaaccaattgtgtaatctggccggcgatcgatcgacaccaaaccgtacgtttccctaatttacatatctgcttagaataacacggacgtttttgtccgattaggtaggaggcataaataaacaaccaacccggaggagagtagtcctacataatttgttcatttctttaagttttggatgcactagtacttaattaattctccatttcttaagttggccgccacaactaataaagtttgccacaaagaatcgacagagattggccaaaaactatagttcaaatcgtgtactctctactctatatacgtgcgtgctgcccctgcagctaaggtatagcttatggccttattagattcagaaaattcagaattgactagtggcgatctggcgattaggcgaacgggtcgtagtcaccaacgcagattaagaaatcttaattattggagccgatcgtacgtacgtgtgcaagatagacctggtaaaactaattaagcataattaataatcagaggagtactcaccgagtcgagcaggatgttggatgccttgaagtctcggtagatcaccggagtgtcggcgtcgtgcaggaacgcgagccccttggccgcgcccaccgcgatcttcagccgcgtcgcccacggcaagctcgacagcaaatctgcaagattaatcaattaaccgcgctcagttaatgatagcaattactggttaataatgatagtgcaattgattagtgagggtgattaagcttactcttgaagaggtggtgctcgaggctgcccctggccatgtactcgtagacgagcatccggtggtcgtcttggcagcagtagccgatgagcttcaccagatgcggatggctcaacatccccaggtacaccacctccgcctgtgcgtgacaaaaccacgcaattaattagctacgaactcgactaattatcgtcaaagagtaccacggaattactctgtacgtaccagccattcgcggtggccctggtcgccttcgccgtcgaggtacttgacggcgacgtgctggggttggaggaggccggggcggagcttggcgtcgatgaagcccttgtagacggggccgaatccgccctcgccgatgaagttgctgccggagaagctgcgcgtggcggccttgagctccgccagcgtgaaggcctgcagcccggactgcgccagcgtccgcgacaggtcctccagcgacagcgaccggagccgccccgtcgcgctccgcatccgcctcaccgccttcttgttcttcaccaccgccgccgccgacgccttcttctcctcgtcacctcccgtctcgtcgccaccgccgccgaagaagcaacgcaacatcctcctcatctctggcaccgcgccgccgcgcgcgagtgcaacaacaacgacaacaacaacgacgagagaagaagtcttttcgcgggagagagtgcgggtgaggtgaggagggaggacttggtggtggaatggatggtttgacacggagtggggtatataaagaggaggcgggagggagggaggcgtgtggggggttggttgggttgggttgggtttgttcgttgggttggctctcggagtctcgtgcgcgctcgcggagtcgcgcgtatgaaacggccggattgacctgatcacctaggcgatgcccacacgccggccggacggctgggttaacttggtggtttccgcggggggtgatgtgatgctgagctctatagcctctatgtccccctatgaggccgaggccgtccaggtagcttgacataatggattgtttctctcctgttttttttgtctatattttataatagacaaacattatataattagaattatataattagagcttggctgtatcggtgaattgaaaataaaacccgagctaggttagacaaatataataggtgattggctcggtagatggactaaagataaaatactagatctactatggttccgcacacgtgaagagggctactacatatagtggaaaggagatggaagaaaaacgattgcacttttaatgtagcagagaaaattacactttaattccgatgaatattgtggaggagctataaaagtttcagagccaagacaaaactaaccagtacattgagtattttcttaaaaaaatatatatgcctaatttatgcaaaagaaaaatgtgttcaccaacgagcccagctcgtcacccaaaagttgttgagaggtggcttcgctattggatgaattaatataatagtaatgattctagattaatcctttcacgatcctcgaggtggtataattgagtgccacagtaacactaaatgtgtactccctccgtcccaaaaaaaaaggcaaaccctgggtttccgtgtccaactttgactgtccgtcttatatgaatttttttataattcgtatttttattgttgttagatgataaaacatgattaatattttatgcgtgacctgtctttttaatttttttttcataatttttttaaataagacgggcagtcaaacgttgggcacggaaaacagtgtttgtctttttttttacggagggagtactatattttcaaaacttatttaaggatcttaagtattctcttttcatagtaacgttacttcgtacatacgttacatgcgtataagaaattaattaatattttaatgcagcattcttggataactatgacaatatttgtgctggaccacactgatgttgtttaaactaagaagttgtaataagcgttggaatttcacacatttgaaaaatataaagtagtcaatctctagcatttgatggatgtaaaatggtttaaagatgatgtgactgggaggggctatgtatgttgcttgtggaaagaattaaagcatggatatggtcggcttgttgcttactacctccgtcctaaaatataactatttctagcacagtactttatcccaaaatgaagctatttttctacctacctttttctctcaaccaatcacaaccattctttttcacctactttctctttttaaccaatcacacaccttcttcaatcattctcacctactttcttaatacccgtgccaatctaaaaaatatttatattttgggatggaggaagtatgttttgcatccgagtcatggtaagacagagacatcttaccttcccttcaagtttctattagaagatcacttcatttatgttgttttctactagatggtttattttatttttaaaggggaaagcgaccatgcaaaaactaatgatgtgtttatggatcttatcatctggacttgtagagtttaaacagacctaatgatcagggtgtagaacatctgatttgaatatctatctatctatctatttcatctgtagctaactgaagccaaaaacaattcgactagggcttatgatcaaccgattgatgttgaaggattatagcaatgaacgtaacgacaatagaagtagagaactgccttatttttacctacatcaagctcgtcagttcaccctaaaacatatggatgcacaatatatagtctatctcatattataagtcgttttaattttttttatagtcaaacttttttaagtttgatcaagtttataaaaaaattagcaacatataaaacattaaattagtttcattaaatctaatatttaatataatttgataatatttttgatttgtgtttaaaatggttctatatttttccctacattttgataaaattttaaaaaaattgactggaaaaaatcaaaatgacttatgatagggggagcgcagttaattggacatctagaaagaaagcctcaaaatagagaacatggataactagctatggcgatagctaattaattaatcaaatgcttttatgctaaagataaacacgactaaactttagtaaaaaaatgcaggatcaatatcgatgttgaaatacaaatgtaggggggagttactccttaactagtggaagagcagcattctatatatattatgcatttggtgaaatagtgtcaagtgcatgggtttgcttcgaactaaactatttggtgctcgtgctcaccatgcgatcaggtagaagaatctcatgcacatgcacacatagttccaatcaaaggaacggggaatccaggaaggctggaggaaagcaaggcgctgatacgaggaacagtaaaataatcagccaaccaaaccaacccttgcactgtactagactgttcatctatctgttgttagatttgcctatggctggacgattggcctagagtaagtttaatagtatagcccactactagctccaatttatctataactaatttaatagttaattcatacaataattgcttactatactattaatatatggtctcactgtcatacacacagtgtgtactggagtccgcgctgcagctgactacagatctatagcccgctgctcttctctcttattttttatctcattaaaatatatttacagctggctaatagactgttattgtacctgcccaaagaaaatatgtttagatcaacagatagatggacacctgtaagaccatatcataatacttctggtgagaatacatgatggagaccaggatgaatgattagccgtatctgcactcgatttgtacgatgtgtaatctctcaacgattgaggtgcacatgtgtgtgtggatgggtgtttgtcgaggaatcttggaatggttgatgaaataatggccattgattggctctcgtttctcctgagtcaagtagataatcactttgtttacaggcgttgttcactcttcgccatcagcataaccttttaggttgaacgaattatttcgccatcagcataatcttccgtaaaattcttgctttttgaacgggaaaagagcctgtctattcgtgatgcggaaacaagtggatggtgttaaagtgaaaagaatgaattatttgtagtcctacagataacgagatcataggtgaaaagatagcgtgaaagccatcctgtcttcctgattttgtaaaaaactctcactctgtgtccctataagaacagagcataaagatggctactcatactgatttttcaacctcgattttcagtgatatatgtacgattggttgatgaactaactgcacgattcaccgtcacaattactcagtacattcgcattcttatccactaattaatccatcccatttttcaaaataaaaaatatcagccttgaatatatcttgacttcaatcatcgttcgctcatagtataattcaatcccagctctcaggaaaaacctgtgcagtattttttttctcataaccggaaattactactgctgctgtactatgtacttgcatcagcactaaaccattttaattttaattcgccactaattgtaaattcgggcgtgtgccctcgcggacacggtgtctggtttgatttaattttcttccaaccaaactgggccatgagacgctccccgacaaaattggaggattattacagagattctttgcagaaaaaacacaaatctttgtggattaataactaactaataatgcaaacacgttctccaaccaaccctgctcgagatgagtacgagatgaaacatggttttggatttttggagctgtaccatgtttctagaaatggagcggctagctaagacattgaccatttctgcttaacctaactactccctccgggttgataatacttatcatttcggaaaagggtgaggtcaaactttagaatctttgattatcaatcattttcaaaatatttctctttcaaatatggtgactatatgtatagattggtcttaaaaaaatactttaataagatcatatatttgttaacacttttatatatattataatagaaaataatggttaaagttgtttttttgacaccgtgccattgtccaaaacgataaatattatcaacctggagggagtacccgtatgagctagccatgattaggggaccagcactgtactactgttgcattagcacttagccgcagctacttatctgtgagatgatacttcagtactttgtttgtttcttaaaaaatggatttgggttgtcatgtagtatgagttggtaggattagtcttaaatggtattcagtagttggggatgagaaaaaacaatatcactcgacgcggaacagttcatcaagttgtaagtaaaataaaattacgattggcaattttgtaagtatatacttgtgggcaaatgtatcttgttaggtcaatggctgctttgcaaggatttccttgagctgcacaatacaagcactgatcatttgagaggatatcatatcatgtcacaagattgtaagacctcccttgtgggcctgtggcagtgtcgtaattctgacggtttatacgggttgtttaagtatagtcatgttttgaaatataaatatttctaggttttgtaattatagattatgtacatgttttaaatgtaaactttgtaaatttgtagaaaattaaaatttgagatgaaacagagattgtctggctagaatagtacaacatactccctccatcctaaattatagggtgctatcctttaagaaactaggtgataccccgcgttttgctgcgggacttatgtataagtatattttaaatattgttaaaaggataaaagttgaaatgttgagaaaataatatgaaaaagatgatttgacacatacttgttgatctctataatataatattgtagatgatgtatcatgtttgcatgaaatttaaaatatactataatagtaattgctagtgagtgaaaatatgacatgtttgcatgggattttaaatgggctagaaaagtaattgctagtgggtgatgatgtggcatgcttgcatgttgagctttagcttctaataattgttagtgggtaccaactatatagaaaatatagatattaaactcggtatttttttctattaattatattaactatatgtatatatgctaggtatatcactagatttatattttaaaataatttaatacgatgctaattttatattcattagcaatataatatgaaataaattaatgatctatcctatgcacacagaccctcacgtgtacacacgtgcacaccaactaaaaaatatcaccaaaaaatctaaaaaaaatcatacacatactttcaattgtattacatttagggttaaaatcttaacgtcaaattcattatgttttagccgtaacaaaaaaaaaacaaaaaatctgacagttttaaggttgtaattttgtcagaattttatcttttttgttattctctatgtagaatgaatttgaagatgcgattttgcacgtagatgtaatactattgaaagtacatgtatgaatttttctagaattttttgtgataatttttagttggtgtacacggtgtgtacacgcgagggcctgtgtgcataggatacgctcccctatatcttggaagatcgttcttataatttggaaggaatggatagagtaccgtacaagcagccttccaatggaagcgtagaagcaggattttagtactgtagtgcacatacatttcaacctccaccgtgtgcagatgtcaaagggctaaacgtttgacgagagctcccaacattcagaaaccggacagcttcctcccttgaagaattcagtcatgtgctcaatttgacctgtctcagtactcctacggagcactagtgcccacacggctctacagcctttggactcttcctcctcctccgtccagacaagggagagcttctgcttctacgcgttcgtgacgctggatgtttctgcatacgagagaagagaaaaaaaatgagagctctgcatggtttggtttctgtcattctgtgggcaaatgcaggccatgacggctgtaatctgtagaagtattgaatttgaccgagacctgcagtagttagttccggccgatttggtcaaattctaattttcgtctcaaagtgctgctttgcggctggcacctggctagcgagcagtatggtcctttcttcaggttcaggttttgatttttttgaaattttccccaacttgaaaatgcaaaggtttctggactttaaaagcggtatgattgtcatttgtcaacgtttgaattctctagagacctctttcgttagcggctgcggcaggtggtttaaacagagtttttgagtttcacatgcctttttaagttgctattgtttcgtatcctgaaacacttggtgagttctagctgtttcggaaattaggcaccaaaatctgctgttaggtccagtgaagattcgcctttttttatcgattgtgtgccggcttttcttctctgtgtccagttccaaattgatagcatatccaaatctcaactttgcaacgcacttttcagagagaaaaattctccggttgaccaaataggcttcgaattagtaatgttcagtccaaagttcaaatccttgccctattggtgttgctcatctccaaccaaacaagaggttttaatttacagcccacaggtataatacataggtaaccaagttgggtttcattgtttcacacgtcttctacctggtcaatgcaaagaactgttctttctcctggtttcaaaactctccaagtacgccacctaggcttattaagtatgtgacattatactttaaccattaatattatttataatatatatataaacgactacaaaattagtatcatataaaaatattttaaatacgaacataatggtgctgacattaaacacatgtattttttttactttaattattaaccaaaattcctgatatcttatattttagaatgtacagacactcataacgcacgcacactcacttctatgaacataacacacgcacgcacataaaccctatctctataagcatcttctcaacgtcgttactaccgaggctcttctaaactaggctacatgtactttcgctctaaactttaattttattctcgtttaatttcgtggcctttgcatgcatggagagctaggattgggaagctggcaacaaggagaatcagtatgcagcttcaatctgacgatttctctggacgtgtcatgtttaacaacggaagcaaaagcaaacgcttgctgatgacgtgccacgcgttgtgtggctttcagagcgtttaaagacggtttttctctgtgctctgaatatacgtacatgtgtagtacgagagatcggaggagaaagcgaaaacgacggcagctagttgtagcagtagccagtagcaagcgtacgtacgcgaaagcgaaatgacaactaaattaacctcgaatccgtgctgctcaagatgcccggagagcttcaacgcttttcgttttttttcttttggttaattttatcacgcttaagaagataactgaaactaaaacgtgtttgcctcttcataaacatatatcatcgattaatctgcttttccgagttgtttcacgcgacgacttacgcacttacatgagagtgcaaaacttatcaaataaataaactaatatatatttttattttctgtaaagttgcactctttttgtttcctctgttgcttataagccgtgcaaaaataacgaagtaactaaaaatagcctatgcgtgaaacctttatctatgcgcatttagcaatttaaaagctaatataaaaaaaccacaataaaaacccttaaaaataagtttcaaatttaaattttggctatggcaaataagccaaaagataaacgatgtaagactttggcattgggatttctgaactcctgaaactgtacttatcgtctgtcctttctttctgaagctacacagaaattcagttcattgcggcccagatgtaaacacgtcccttttctcagtcactgtggcagcctagtcatcacgtgaagaacactatcgagctagttgcactgatcgtatctcaactcaattggtcgtgatcagataagattggcaccacacgatcaatcaattctgcgacggccaaattgcagccaagccgttgattggtttaatttcagatgttagcgtgtcaccggcctcttcgccattgatggcagcaagaacgcaagaacctggagatcgaccggtctgacgacgacgaagacgacgcacacgcgcgtagtaatcctcaaggcaagcagaggatctagctaataagtttcttgcttaattaatccatggaggggcataagaaaaatgatcaaaaatgtcagcaacaatgataacaaaaagacgggtttagctcacataattaagagatgataatgacatggcataaacaacaaagggtcgggctaactcatgtcgaaaacgaaagtaaacgggaagcacgtgaaaagcaggaagacgatgcacaactaaaccttacaaaatttctttcagtaatcgcttagcattagtcaacagcaacataagaacattcttatcaatgtctgtccctatgttaattaatctgccgagtaaaccggatagtttcacactatggagactggagataatacttttttgcaggccgcgtagttgaaattaagagggcagggctagtccatcaacgagtgattgattgcatgacatcagtgtatattcagcgccgcggtcagagacttcagggttaaactaatggcgtttttgtttagcctgacgaaactatgtagtagtagaagctgaaacacgctttaaattgcacgaagtcaggatacgtacctactagttaacctgaactgcatatctgaagttctgaaacgtgctgacaatttgtgtatgatcgttcaatccattcacattgctaaaagtccgtggattagcactgtaaaggaaagttcatgcgttcgtccaggaattgaactcttttctgtcaaatgtcagcattccagatgaacatgaaaatctagcgtttttgaaagccctgcaacaaatggtgtgtttagttcctgaaaaaaaattggaagtttgaagaaagttgggagtttaaaaaaaagttggaagtttatgtgtgtaggaaagtttttgatgtgatatgatgtgatggaaaatttttgatgctttttggtttttgaaaaaaaacatcgacagcaattgggtcggagttttattctccgactcgcatcatctccgatcggtatttttttattttctccgatgggcttgcagaaaatccatatagatgcagaaactagcactgcaagtctgcaggagaaaaagttcatgcgtttccctatgaatatttgagcatgttttctgtcaaacgtcagcattccagatagatgagtctgaaaatctagcgtatatttctgaaatccctggaagaaaacatcgagggcaaagggggcagtttgttttttcaatttccgatagcctgaacacgttggtcagtattatcgggatcggagttttaatctccgaccctccttgagtcagtatttttccttttttggagccctcaaaaacaagacgaacagattgaaactccgaaccccttcggtcgatatttcctacgagacgagacaagacatgcaatccggcccattaatttgtgtccaaatcgtcattcataaacagtccatattacagccggcagaaaacgttacaaacacaagaacattcttatcagcgtccatatgttaatcaatccgtagaactcactcactcaggtatgctggacagtttcgcactacagatagacttttgcaggctgttgtgtcgaaattaagaggcggttctagacttctatacttagctgctgacgttagtcctccaacgagtggtatgagaaaattgacatcagtattccgtgggcagaaacttaaaggttaatctaagacgttctgttagcctgacgaaactgtaatagaagctgaaacacgcgctcttcaggaaaacctatcaatcaaaggacgtgactatcaaccgtgctgacatgctgtgtaactgtgtatgatcgctaactccgttcatattgctgaaacgtgtctaattgt

SEQ ID NO: 5716 - DNA, 19249 bp, Oryza sativa
gagttgtgtgggtgttaattctccaagagtaaattgcatcggcgatacacgaacttgtcagttatgtaaaatctagtgtatgaacttgcaaaatgctcattttggtgcatgaactaattatcttgtgcgtgcaaaataaagtcaaaaggacattacatgactaattttgttgatttatgtgctgattaggatactacgtaaacatatatacgagaatgttgctacttggacatacacctgttcaataaaaagatagaatgagatatagtgattgtagagaaatatataaaaaaccaagcaatgatataagggttagaaacatacgaaattcaagataaagtagaaaacaaatttataaatatagcatgtttttatgcgtaattactatacgtattcacgctacatcctaatcaatatcagctaggtggaattaaccttgccaagccattttggacctagtttgcacggattagataagttcgtgtaccaaaacgaatattttacaaattcatgtactaaattgcacccacctaacaagtttatgtatcaccaatacaatttactcattctccaacctcctttagactttttttcttttttttaaaaaaaaaggcaaaaggggcatatgcagcaaatcaaggccaaccctgccaccatgtcaatgtcatgggtcggtgtagccttgtcaaaaaggtaaaaaaatcgaggtataggggttcggagtttttatctctgaaccctcgagtcggtatttttcctttttaagtcccaaaataggtcagtaaatgttttgtttttactcgcggaagcagtatacttggtttttatataggcctgtaattttttttatggaggcctgtgaaaaattgaaagtgtaggtggtaggagttttcatctctgaccctccttatttggtgtttttttggtctaaggccgagtttagtttctaactttttcttcaaattttcaactgtttcatcacatcaaaatttttgtacatacataaactttcaacttttttcttcaaacttttaattttagttaaacttctatttttggcgtggaactaaacacagcctaaattgtccttccaaatacattggcttctgctgcgcaacaattcagcccacttttgcggaacggcccaagatggcacctgcagtaggtgcactggcccgtagccaagttttcccagcccagccatgactcccttgagggatttagggggttcggagtttcagtctctgaaccttattgagtaaatatttttccctttttggagcccaaaataggtcagtatatgagttgttttactcacaaaaacaatattagctttctttggcctgattttttttcctgatggagaggcctgtaaaaattgaaggggattgtcggagtttcaatttccgacccttttatcagtggaaaaagtacaccggaggtccctcaacttgtcaccgagttacaaaatcgtcccccaaccgcaaaaccagatatccggcgtccctcaacttccaaaaccgttcggtccttcggtgtttttggctccggttttagcctacgtggcgactgagtcagcgtgggccctacatgtcagtgtgtccacgtcatcactccctctttttcccatctctcatcctctcttatcccgtactactcagttactcttttgggcaggccgaacccgccggcgcaaggtggggagagggagggcggccggcggtggccgacgctggtgcggcgacgacggcggcggcggcggccgatgctggggcggtggcgactggcggtggccgacacgggagaagccgagacgatggcttctcctaccgcgggcgcgaggcgggtgggagggcggccgatggtggtcgacgttgggggcggcggcggccggcgatggccgacgcaggagaaggggacacgacggctcctcctaccgcgggcgtgaggcgggagaaagagggagggcggccggcggcggtggccgatgctagggcggcgatggcggtcgacgctagggcggcggcggctccggcttcgatttcctccgctctctcctccgccgcatcctcccgtcctccccgcccgcctccctccatccctccgtccgcctcctcacctccctttcctccgtccgccttcctgcgcgggccctccctcatccaaaacaagcccaggtgccgccgcccgatgacggccacagccccaccgtttcccaccattgccctcgttggctctggtcctcatcccaccttcggccacggcgacctcctccgcctcgccctcccagctgcgagcgggatggccagcgactcggcgagggagtggggagtccggcggcgagcgcgcacaaggaggaaagaggcggggaggcctctttatccgcacggccgccgcccgtcggccctatccctgccgcccccgctcctccgccgtcgcctacagcctctgcgccgccggcctcctccccaaccggcctgctcccgcgtcgtcgccgccgccgccgcgtcgcctgtcgccagccgtcgggccttctctcctctcccttcttgccccggcgacctcctcacgacccactggccggcctggtagaggagaaaagcgagagacagagagaaagaggaggaagtgaaaggagggaaggagagagagggtggtacgtggcatactgacaggtggggcccgcgtgggtcccgcactgactcagccgccacgtatttcaaaaccggaatcaaaaccaccgaaggacctaaagtaaacggttttggaagttgagggactccggatatctggttttgcggtttggggacgattttgtaactcgatgacaagttgagggacctccggtgtactttttcctatatcagttatactatatgtttgggcccaaatcgtccttccgaaacggcccataatacagcggcttctgctgcgcaacaaggaaaaagtacaccgaaggtccctcaacttttcatcaggttacaagaacgtcctcgaaccgcaaaaacagatatacggggtcccttaactatacaaaaccggtcacaataggtccctcggtggttttggtcccggttttatcctacgtgactgttgagtcagcgtgagacccacgtgggacccacatgtcagcctgtccaggtcagcttctctttctttcccctcttctctcccttcctcttccagtcttccctctctctcactcttctctctagggctctgggcaggccggcggaccgacgaggcgaggcgggagaggaggtccggcggccggtggcggcggcggagacgacgcgggagcaggggagcaagtcggcgacggcggcgagatgcccatggcgaggtactggaggcggagctccgtcgggacggggagcgggacgatggcggcggacggcgggcacggatcgcgtcgcccgcccgtggcgacgccagcgccggcatcgcccgcccgcacgcgatctcccccaccgccgatctaatgatcagcactatgcactacatggcaaccattggtggtagtgtggtactagtcgtggctaactaactggaggatttcctcatcattcctgtaagtaaacagcagcagtcaattcacaacaatggcatctcaccgtcaccttgaacacataacaggtgctgaagggtttggtagtgacgatggggtcatgcagtgttgttgccactgcccactggtgaaggctttcaccatcgattgctgcggcatttgcttcaagagattcctcaacgtccatagaatcgacttctgtctcatcagactccattggcacttcaaagaattctctcttttctgaatctgaagaagaccaattagatgccgtggcaatttgtggtggcgtccaaggaactaaagccaagaagttgctgcacccaggagatttgtcctccagcccgtgatagttcctttgcataaaaacctgatctgaaagatgagaaagaaaatggtgagaagcaatttcaaggtatggatgataatcctgtcctgacatacaggagatcttggtgggactcgatgaggaggagggccgagggcaccagcacgcattgcggcgagccgcatggcgccgggcggtaggaggcggaggcggtcaggttgaacggcgacgaggcggcgcgtctggccgctgacaggggagaagcgcaatggtggcgctctgcccctcgctgtcacctccccggtcccatctttggccgccgtggagccccactgcggccgccaccgccgccgccgtcgccggccatcgtcacggcgccgccctcctcctcttccgccttgccccaccgagctccgggccggccgccacccttcatcgccagagtcacgaccaccatcgcctcgccagttcgccgcgccgagcaacaggaagagaggcaagaaaagaggggaacagagaagatgacgtgtcatactgacatttggggcccacgtgggtcccacgctgactcagcagccacgtaggataaaaccgggattaaagccatcgagggacctattgtgaccgattttgtatagttaagggacctcgtatattggttttgcgatttgaggatgtttttttatcccgatgacaaattgaggtaccttcggtgcactttttccgcgcaacaatggggaccattaccgcggaccggcccaagttggcccaagtgcactagcccagccacgagtcaatcggtgtcactgaacagcgggccccagggagaacggcgcgttctgggccccaccctgcagcgactccggctcgctcgagcgagacagcagccaaaccctccactcctcgcttctccggtggttctcttctcttctcttatcccccggagacgccgctgcggcgccaccccctcctcgccgtggacctcggggtgggagcgtggcggcctgcacagccggagctcagctcgcccgccgcgtcggatggacgccgcctcctgctgccgcgtaagcgcgggcgcgctcccccgatttccgttctcgcttctcgaacgttctagagccttctacggtgggggatccgtgtggtgtgacccatcgtcgcttctctcgctctcgcaggtcttctcgacgcagagatgccgcttcccgctgcggaggctggcgccgccgatttcgcggcggccgttcggcacggagtcgacgagtgagctgttcgccgcgtcgacctcgaagcggcgctcccgggggcccgtcatggcggcgaagaaggccgccgagggtgagtcgacttgatcccattgctgtactgttcttatttttggttcaggttgagggtttggtgagggttttagtagggggattggtgtctatatgttggtatttcagtgatgtgagttttggctgtggagtaggtgcattaggcgtccgatttttcttgggattactctgtgtctgtggtcaatgtatatcgtacttgctctgtggattgtggggatgccagccatttttgtctggtgaggcgttggaggttgaagctggtctatggcctggagattttcgttcttgctgttcacgttttgatgggattgatcacagggtgaggcacatgattacagatattgaactcgtgtgacgtacagcttaaactggttggttaatttaggttcaaatatgtgattgtagtttccacttctgcaattgctataattattttcagcttaagcacgtagggcttattaaactcattaccaaacttgttttactgcagttttctgttacatttgtacttttatgattgatgtgtgttacttaggctcaatctgcttggtttagccttaagtatgctatgacctgggatttttgtaattggtgtacttttcagatttaagaatgtacacacctattggacttctcagttcgcaccaaaatgcacttattaggtctcaagcaccatggttggaagattattattgttttgcgtatcagattaagcttaattctcattttctccatttggagtagcatcaactagtgctcgaaagtcgaaacttgatgcttatgcttgttaggatgaaagctgtttaagcttaaatgtgttttgtatacccagaattcggtaatcagattgatttttgaaaataactttgttatctggtgttagttgaaactttgttatttcagtacattccattgagattcaaatgcagtgagaccctctgcttacttagtaggtgtcaatactgaagcttttactggcaaaagttatggtgtattttgtaatgaaaatctcgtagagacatgtaattaattttatctggctgttttataatgaatagtagttggtagtttgacaggttgagtcccagtttcaatttagtactgcttgcagagttaaattcattaagatataattatatatttagcttcttgattctggctaggtgctaaacaagaagaggggaaatacaaacacacggtggatctaccaaagacaacttttggcttgagagctaattctgttgtgcgggagccggagctccagaagttgtgggaggagaaccaggtgctcaagagggtatcagaaaggaacactggggtgagtatttcttcgagtaaagctaaaagtaaaattaaaatttacctgactttgttggttttcttgactgttggattaggctacatttgttctccatgatggtcctccttatgctaatggtgatcttcatatgggccatgcactgaataaaatcctcaaagatattataaaccgttacaaggtatcgtttactcttcaatctaatctgagtatttttctttaaaaaccattgatgtatttttcagggcaattactgatgcagtcatagtatgttgtcttattcagttcaatccataggatattctctgttctgagatcaatgttactgtacggatgattggtgcatagattttattgtcttttccaatgcagtgcaatttctgtcatttctttatcttaacatgtagagctctttagtgtagttgattgtgtacgagatttggatgattaatgaactttttgctaattctagtagttttttcctgataactctcttcgctgaaatgtctttaactttttttggctggatgactatgctttttatgttggtccaaaccaaaattgggaacataaatcaactgacaccaaaatttgcttttcttctgtgtgcagctgcttcagaatcacaaagtttcttttattcctggatgggattgccatggccttccaatcgaattaaaaggcaagttcatctttatatccaatggaaacaccctatgtttacaagaagttaggtaggggttggttttaacacaatgcttgcatgtgttagaccagccaagtaattattgaatatccttccaaatgtaaccattgactatttgctgcagttctaaagtcactggacaaggaaacattgaatgctctgacacctataaaattaaggcagaaggctgcaaaatttgctaaagcgacggttactacacaaatgaattctttcaaggtaaccatttctttattttaaagtactttagtggtgacatgatctaatagcaagttgcccttatctatgttttgtggtatttcctggtatgattgctgacttgcagtcatctaatatctggaattctgtctcatgttagcctttagtttcatatttctataattgtattaaccaatgacattgtgcctgcagcggtttggtgtatgggcagattgggacaacccttatctaactctgtcaccagagtatgaagctgctcaggtctgatcctattgtttatagtaattttgccattgcatcaaaacttatttatccatttcacatgaatgaaagcttggaggtttggaattaccttagttagatcattgatatcatcttggtcacattatagctgctagctctaataaaaaaaatagagctgtttactttcagttccttttagtccatttaccatcgttgatataaaatatataacgtgtatgcaaattttatgctgcgagaataaatactgatgttttctttttcatccttatcatatgtttttaatcaaggctaaccgtaacaactcttgttctccattttgatatgccagctagaagttttcggccaaatggttatgaaaggatatatctaccgcgggcgaaaacctgttcattggagtccgtcatcacgtacagctttagcagaagctgagttggaggtatgcttgaactttctacttgatgctattaatttgctgtcaaaggctttgttgtgcattaatttttaagtgactattaaatattcgaataaaaaattgacaattccgatttgtttcctgtttaatttcaataattttcttgtgcttcagtatgtcttctcagtgaaaagccactagatgtgtcacttatttcttcctgttaatattaggcctacactgctgcagaaaaactaccgagcttttttcatgaagtcctttcatgtttaagaacacttctcttactaaccaaccataagagcgctttatgtgtcttattacataaagcacattacttcgtacatgtagtctttcacttaattcatgattggtgatcttttattttttttctcccttttcatttatgttctttagatttcttttgaatttgattcctcatatcatcacatgcattccttctgttcttccagtattcagaaaatcatatttccaaaagcatgtatgctgcattcaagatcaccaatctgtctaagcctgggttgctggaggaatttctccctaatttatgcctagccatatggaccactactccatggacgattcctgctaatgctggtgaggtgatgccttgattgctttaatgtattcagtgagtgtcactcttataattggatttcatcagagccaacgtaattaatttcaaaatatgtggctaattttgaagctatatgcgtctgtacatggaaaatagcatattaagaaacagaaaacttcacatgttttgtagttcctagaacctgtaattcctagaaggctagaacttgattaagaaatactaagtaatatctacgttacagtgatataacatagtttgattgtaaatcatggcacacatcttgcttccaataaaaaaaagaaagctctttgccgatttatccctccatagcaagaagatgcttcatttcaagtatgggtaagatcgaataggtgatactggtatgctacacagcatttcatgtttttgtttcaccagcagaaacagtgtcttattgtctcagctattctggaattgtagtagatagcattatgtccctgtctattcttatgtgtctgctgcgcatactgtatggattcgcttcaactctttggtattctctacatattaacttgtctaagaagccctttcttctttaaccagctgttgctgtgaaccctgagctcacttatgtagtagttgagctgcaatctgtactagaaagtgaatcaacatctggtggaaatcaacgaaagcttgggagtattttgagccctgggagtcagaaaccatttatcatcgtggctgctgatcttgtctcagctctagagtccaagtggggtacaaagcttataatccagaaatcatttcctgggtcagccttggagcactgcaggtattttgtttagcacttctcacttcattatgattgtgcttgacctatttattgttttgtgtttatttacattatatttggtgttttcaggtatattcatcctgtgaatggcaatgaatgttctgttgttcttggaggagattacataacaactgaatctggcactggccttgttcatactgcccctggccatggtcaggaagactacataacaggtttgaaatatgggcttcctattgtgtctcctgtggatgatgaaggaaacttcactgctgaagctggacaattcagtggtttatctgttctgggagctggtaatgccgcggttgtgaattatctggatgaacagtgttctctcattttagaggagccttacagtgagtagattgacaataacctccacaatctggtttcacttgtgaatacgaaaaaccttattaagtttgtcttccaattgtatctcttggttcacagaacacaagtacccctatgactggcggtctaaagaaccaacaatattccgagcaactgaacaatggtttgcctcggtggatggtttccgtaatgctgcaatggatgcaattaggcgagtatcttggattccttctcaggtttgtaactgctatactttattttcctttactcttactgtttcactgaacttcccagtttgaacttttgttctctttagtggcgacaaagttcagtagaacacaaactgctatctgatagtgtttagcatttttgttcagtgctatttctcttctgcactggtacatgaaattctctatgctaatcttgcttttttttttgttgctttggatcctggaaacgtttgcttgatttcacatattatggtcaagcaattgcatatttgcatgtctggttcatgtaataatattgatagatatccttttagacccttgtaagttgtaagttatagtttcatgctgatatggaatgacctaattgtactgtctgctagtttcggtacatcatcttatgtaacttgataataactgagtttgtgttaatattcccaggctgaaaataggattgtggccatgacttcaagccgttctgactggtgtatttcgcggcagagaacttggggggttcctattccggtcttctatcatgtagactcgaatgaacctcttataactgaagaaactattgaacacatcaagggtatgtctacgcttgtgatttttactggttgaaaccatcgagtacttgaacattactgtggctcaccttctgccaaacaagcatgtagttctaacgtcggtagtatctagttcttgtcacattatgggtttgcagcatggttgtatccgagctatttaagcaatataaaattcttgtttctaataaaaagaataaaaagtgaattagaatgagatgccatcttttaaagttgtcgcatctaagtgtgttctctgatttgtatttccacaatgaggttttagaaaatttctgttctaggaaaaagcctgaagttattgtatccaataagtgatccttttagataatggaagctttattacgactcagtcaattacaccaagatggtacaatccaactgagcccacccccggcctctgcattgaatgcacacagccaaaaaagaaccataaaaaaccccatcccaagcacaggagtgtgaaggaaacataaaattagtggttatcaatccgtagactagactgccacccgtgctcctgggtaaaaaactcctgcgccacctggtccaaacgtcgtgataccatttgtcatgaagctgttaaccatttatgtttgcacttttctgaattagcataggataagccttatgcttgacaatgcttcccaggaatttaatttcattggcccagttatctctttattttgtgtgtgcataatagaatttctgggttattttcctctgcttggattttagaatcccaaaacatatgttaataaatatagtttgcttgttactcaggtatagtgtcaaagaaagggagtgatgcctggtggtatatgacaattgaggaacttcttcctgaaaaatatcgtgataaagcatctgagtatcgcaagggaactgatacaatggacgtttggtttgactctggtaggattatgttttcattcttcctctattaatggttttgttaacaaagctcaatgtttgatgctggtcacaatgcccaaaatcaatgttcttaggagaattccatcttgtcttgctctgctctccctctttgaaccttggcagttttcagatgtttgtagttttaactgctttaaccttcaaattgaaccaaactgcccaagccatgtgctataattctctcttttttatactgtggtagtgtaccgtttgctttgattttggccatacgtatgtcacagtgtggcgccgcttaggaaattaactatttttaaggtgtagcaatagacacttttagtagggataagattaaactctaaaacatcaaatgaaaaagactggaggtaattacttgttattgagtcgtcatgcattgtatagtttgccatatagtttttgtttacagacctcaacttttatttattgactctattaagggctcaaggcgtgcatattgtcatgattttctgggcgaagatagagctttgcatagtgtcacaatgttctaggaaaagatagagctttgctatagtgttttcttaattattttgccatcttttcttgtgtccttgactttttacttctgcatattttcctaatttaggctcctcatgggctgctgttttggcacaaagagatggccttaattttccagcggatatataccttgaaggttcagaccaacaccgtggatggtttcagagctcattgttaaccagcattgctactacaggtaattgtgggctagaaactcgaatgaaaatcccttttttgaaaaagcaagttgttttgcaacattaattgcccaaatcatggttcatccatgatgttatttattctagatatataagatgttttttgagccatattcggtttagtgtctgacatttcaaccactagttgtgcaaatggtgaaaatttttctgtaggcaaaggcaatagaacaatattgcttgatatagttgcataatctgaaaccacatgtgtgttttctcttgatatatttggaacattatattctgctggtggacacaataggttttctatttataatttttccattaaaaaacaggaaaggctccatattctagtgttataacccatggttttgtactggacgaaaagggtttcaagatgagcaaatctcttggtaatgtggttgatcctgagaaagtaattgttggtggtaaaaattcaaaggtacgttcctagaaaagcttccgttctttctggacttctagttttgcctaatgaaatatcaatcaaccttttgtagcaagaacctggctatggagcagacgttcttcggctatgggtttctagtgttgattacactggagatgtgttggttggtccacaaattttgcgccaaatgtctgacatgtaccgaaagctacgaggcacaatgcgattcctattgtcgaatctccatgattggaaagtatgttcagttcaacaactaaaatttatttaggttttggataaggaagattcagtaccaggcagcagaggccattttatatgttttcaatatttcaaacccatatcaaaatgccatcttttactagttttacattttgcttaactttctattggctttattctttcctttatcgatgcaaagcactgaagctatttctgtttagataacatattgcagtgaatttaatattttatacagcctagttgaatacttttgctgcacataattttaatctcttaattatctatctgttttcccttcttatgttttgtttgcacattcgtttcaatgatcatttattgctctttattcttatcatccttttctctctttcctgtcaatagccagaaaattctgtgcgctacagtgatctaccgaaaattgacaagtatgcacttttccaactggaaaatgttgtgacttccatgaaggatagctacgagaactaccaattctataaaatataccaggtgggttaagagtttgttgtgcttcattactttcattttacaatgtgtgtgatctcttctatactttttgagattgtgtgatcgtagttggtgtatgttggtcaatggtcatctttctgagaaatgggaagtgcgcttcatgattatgatttagtgaataagagtttgatggtcaaaagtgaaaacttttagcttgaaagtggaatgttcattttctaattactgtccttttctgttctccattctggatcttgaatgatatgtttattggattctcaaatcacatgcacattgaatgattatatcatgccatttatatgctcagaatggtatgatatgcatacattattaaaagcaaatcctattgctaaatctctatccatgattggcaaagagctgcattatcatcatctctagataacggcatgcctgctgcatcatttgtttgtcctcttcacacttttgtaacaagagattattgacttgtgtttctatttcagatcctccaaagatttgctattgttgatctctccaatttctatttggatgttgcaaaggatcgactctatgttgggtatggctttgatatcttgttcattggccatctgattacgtttcgttacactgaaagctcagtcaatgtcatttattaatttagcttgccagcttcacaactttgtttttatcttcttatcagtggccgagttagctttacaaggaaaagctgtcagacagtcctcagtgcgcatctgctctatcttgttagagccattgcccccattatgccacatctagctgaggatgtatggcagaacctaccgtttcaacacacactggatgatggatctgttgctgagtttgtttttaatctaaaatggccagttaagaatgaagaatggctctcggttccaaaggatgatgttgattttctgagtgttatcctcgaggtatgcactgtttctgcataactttgaagcgttcacttatgacaacctcataggttatatagctttgcagtttttttcctataggtcgaatatcaaacttacgttaaaaaataaaactctgccttcaacttggagacgtgcaactcagacaagatttcttgtatacacgagtaactactacttatgatctgaaatagcatcatttctgctaaattacctgatcctatagtttataggacattgcggctattcttgatttcatggtgatgagcgaacttgcatttatgatttcgtattaagattaatttcatgattaaaaaattccattacttggcaacagttgagatcagaggtgaacaaaattttggagagtgctcgaacaggaaagctgataggctctagcttagaggcaaaagtttatctccacgcggaaaatgctaacacagtgtccaaactaaaggagctggtttcggcaaccaatgacgctgatgctctgcaccgcctgtttatcacatctgaggtaaattcaaaactagaggctgcccttctgcattcaagttttttttttacaccatctttctttgtttctgcaggtggagatccttccttccgtaagctccgaaactacatctggtgtatcctacactggaacttttagcagtgagcgcaccggcaacatctggattggtgtgactcgcgccgatggcgaaaaatgtgagaggtgctggaattatacccgagacgttggatctttccttgaccatcctactctttgtgcccggtgccacggtgtcattgatctgccaccagttcctgctgccgcggctgtcagctgaggctgctcgagagtgacaaggaccactatcagcttcatttgaagattataggtggaattaattgtttttgttctacaattttgttcccctctgaccgatgatgctagaggaaggggaaacttgaagagggtttcggaaacttagtttctaacttcatttgttgcgtacaataagttgtaccttgatttttgaccattgcttggcttcctggagctgtaattgtatatttgtattgcagaactcacacggattaaagatggaaacagttttgcacacgaactcgcatctccttacttgacgtaatgtcagagcgctagcaaacgaaggggcatttttatacaaaaatcaggaaccaaacgaacgagacggtccgaaattccgaatcacgttaccaaatactactcctagcgacccaaacgagagttttgtttctctacagaacgtatcggctcctgtattgggcttagctacaaagttataatgaagatgacgagtttatgaaggctgtatacgataggcttgagacaataattatgtaactttttatcaattatggttggagattcacaaatagatttcaataatgtgttcttcttatcttagatgagttattttttattttaaatgcttgttctcaatgatttattgaactacactcttttttgagtgtaactttgtaataaattggaaaggctgggatattctattcctctataaaaaacgagttttgtttggtaaaagtcaatcggaggggataacgcagggtgcgagaattatggccgttggatctttagatctccaagtctaggccattccccctctcgtggccggtcgccggagatccatcacccgccgtcgcccgctctccccggcgatcctccccgagccgcgcgctcgcttcccccgttgtcaccaacctccacgcaggatccgcaccgccgcttcttctctgcccccaaccgcccaatcccctatccctcgcgagactttgcacgcttaagccttaagcttctactaccatttggatccggagaccgggagaagttggagggcacggactccggaggcgtcacccgcgggaggtcccctctgcaccggccggctgcgggcgcggctctgatggcgcacgagcgtggcggcgccgcgtcgtccgccgcggctcccgccaccgaggaggatgcgctgtgagtctgtgttgcccaaatccctaggtccgtgtattcctagtagacgtttcagtcacgcttctggtgtcacttgatctgaaggccgtggcgattgcagcgaaattcagggtccttctcttgttagtgtcgtgatgcgttcagtgtagtcgaaaatttggtggttcacttgggctctggcattgcgatgtagtactaaattttgggcgtatgcagggaattgagactttgagagaagggaagagaagagcacaggtgatgtttgcttgtggtatccctccagttggtattaattcataaaattggccgtgtacatccaaaccggatgtagaggccaggttttaatccatcttctagtagaaaatttaattcataaaatgaggagtataagcaagggtgacatggtgtccattaaggcattaatacagggtcacttagttgagctgacttagcattcacatgattcttctatgacattgttctaatgttgatttgtctcgatgccttcaggatgtataattcttctttcatgtaggtttattgacttgctacatgaagctcctctctctggtcatcgagagcctagaagcattgttggtggcaccttgtactgtatcttgttggttagtgcaaatttcttaattacccattgtttttatttgtgattatgcctgaaaattatttcaaatgtatgagttcatttgataaattatctacaacagctaaaacatatgtatctctttctatcgctaaacgccattgccttatggtactgtcattacccaacaagtccttgttttgcttcctttgtccattttgtaatagctgtattttatttctctctctaggcaggttatgctgctgtggcagtgtcagccccatggatattttaccttgtaccagacatgatccccccattgctatgcagctccaatgttatcattctgattctaacaggttctctttgagatcagatgtggcatgtttctgttgctgttttctgtttgctactctatttagttattttgttggttcatgttttatcacttactatgacttatggtttgcatggaacataacataggtatttttcaacaatattgggttcaccaggtcagaaaagtgagattgcaggtatttaaatgaaacaactgccttttgttttacttcaattggactctgttaacaccaaaatttgatacaattctttagtggactcttactttaaactttgcatattaactagcacatttctgctttggatgcaggggtattacgattttagtgagaaattgaagcgccttgctcaacttccatttgccaccgttgctagtggtaagtatagcaccaaataaatttgcccgatgctgtaatactagtgcgttcttcattttttttaatgtttataacaagtatgtcctacttaactgcacttgtttcaacatgattaaactattgtctttggtatttatttaaggatctgttaaggaattgagattttgagaggttcatatgtaaaatatttttttggcattgaaatgacccattgtccatattctttttgttcttttggcaggcgttgcttcaatgctcttaatcatagtctggcaacctctagtacacatactatcggtttctttattgctaaggtacacctttgtaattgcagctaacctctgcaaatttctctgttatgtcttgaacggaagttgaggtttatccggcatcttttggcatgaggtttggtctgcggattcccaaacaagtttgggaacatgaattattctcttctcatcctttcagtgcatgtataatttctttcatttactattatgcaggattgctattgtggttgaagctatatgtgctggatgtttcatgagcttatacttatgtgagtcaagtactcaagtcatttgtgtccttgttagatagttcatcttgacttctacaattgcagcagttatgcttcccccaagcagatcctcagccatgcaggacaaaccttgcatgctggagggttcaaagccttgtcatcatgagtttcgatctcgtcattctttttttttttttgctcccactaagaacagtgttgcttttccttagaaatgaaagtttcaagcccgattatttgttttttctaagatataatgcccactcggttctttttacagggcatatccacaagtacaactctctgaatgggcaccctgatattttgcggtccttatattctgcactccaactccaaccatctagttctttggaagaacgaaggtacaacataagggtgtacattaaatgcattgaacttttccttcttaatttacaataaaatactacctccgttttttaatagatgacgccgttgactttttctcacatgtttgaccattcgtcttattcaaaaaaattacgtaattataatttattttgttatgagttgttttatcactcatagtactttaagtgtgatttatatcttatacatttgcataaaatttctgaataagacgaatggtcaaacatgtgagtcatgaactactgtac

SEQ ID NO: 5717 - DNA, 4604 bp, Oryza sativa
  unsure (1)..(4604): unsure at all n locations
tcatctattaaaaaatggagggagtagtgtttgaagacacgtataaacatgtactatgcacagtttctaccacttcaggcttggcgtttgattttctggcagtttggaaaagcattctttagtccatgtttatcagaaacatctgtattgaacctatatctagaaggatgtgccttcacatgagttacaagtgttgatatgttgccgaatatgtcatatgtgtacttggcatactgccagtagagtttcacaagttatttttcttttcaccaggtattatgatggtcgtttttctgaccagcaaatggctctgcttcagtaccaaagggagaatattcattacctgagtgaggaggtacttggaagatcaatgcagtatatccattttaaaatttgattatgttagattgtgttattatttaaatatttgtacaagacaacagtagattactagcattactatttcatggaggaattagctgatccttgtatttagttctacattaacttaattggccagttctgtagtcagtgctgaagttctcaataataatatgttggaacttccagaaaatttcttgttgaataaccaaaccttttattttcctgaaaggtgctccgcttgcaagaatgcttaagcaaataccagagaactgatgttgggagcactcctcaggtctgcacaacactgattgattgtgttgcattaattaactgaccagcttcgtaggtgcaaaattagagaaaggaactttgtagctattatgtttatgtgaattgatggacttgcatcaacccccttttaattctacaggccgatcttgctcatctattagcatcgcgtgatcaagaacttagagcactctccgctgaggtaattaaacctatattgtaatgctataatgcctctgatcacaaaacataattaacttgcctgcttacactccagtccttgttattttgaccgcgttgttatcttaagccaagcaattttctatattctggccaggcaggtctccaaaatctcacctgtctttggcctactttttatgaactcttgcaaaagctattactatagatgtttatagcacgataatttcttaaaattatattatagctcaactttgtagctgtaaatgataagttgagaaccatctatttgagttgttcatctttagcaccataactaaaggtgtaaagtctttattaaaattttcatcttctactaataccatactaattgaattcacagatgaatcaagtgcattcagagcttcaacttgcacgtagtctgattgatgaaaaggactcagagatccagcgcattcgtgtgagcaataatcaggtattttcacaagtaaccatcaagaggtttagcttagcacgtggatcatgcttattttacttatatcgtcttccaaactgttcctgcttgattacaaacatgttggatgcagtatattgaagaaaatgatagactcagagccattcttggagaatggagcgctcgagcagcaaaggtacactggctaaagttctgttgtgggttgagttgtactagcattatctctcattgttttgcatgtgttcaacagcttgaaagagcactggaggcagagcaaatatcgagcattgaattacggaagaacattgcaaaactccgagggcagacttacaaggatcaaaacacctgatctcccttgttttcaggatatattcacctatggcgatgtttgagcaggtttatcaactcttcagctgctaaaggtgccacctgtgatatccttgaattccaaacctctagtgataagaagagtgccaacacagtccagtttcgctaacaacaaagcaaggtacaagatcatcactcaatctgatatgcatcaaggaaaggaaaaatgcctttgctacacctctctcgtgaatgtacagattgatgtttgtaaatgttgttcgagagtatggtgcagcactggttttttgtgcttctacctgatgcttctacaatgacatcttatcatggcaagagttgtgcattgttttctgagcacttgcgaaatgaaaagtgagcatttgtgcctaagctcccccaaaaaggtatatcagacttctaatttcttctgagttgagagtatcaaatctgtactgcagtctgagatgctttgctaccctttgattcagtttgctttgctatcttagattcagttggctagttctttttcacagtttagtagctttatattacatatgtcttgggcaatgaagctcatgaccaacaaccaatgtgcaaaagcgttcttctccctccttttccttttggacaactggtagagggagaaagttaacaccgacaagtcaatacagaaccaaggaatgttcctgagaataattttgctaaaattctacctcgagttgtcccattctttattaatctacttgcaaattgtaaggtggaattccacatgtcgttaggacgttaggccggtaggcccccatccttgactattgttgacactgctatgcttgatgctgtcttctttaatctctagaaagaaacttgtggggcctttggttgttgaaaatgcaacaacaaacgaccctgaacaaccaggtgcttcaaatgaatagggacatttgagcaaatatcacatacttcgtgcacgagtccaatttgttataattttcaccatacaaaattttgtagttctgcatctgaacaacttctgaagttgcctcaagcaataagcaatttgctgcgtctgaaatacggcaagcactgattattgaaggattactgaagcgcctttttcaaactcacggtaggattgacctcatctggaccgtccgatcgagatccagcggctatattcctcccaaaaaaataaaaataaaaaacgcgccgggttccaaccgtacgagccacgaatcctctctttcccggccaccttcctctcgcgttccactgcatccttcctttccttcctcgaatcgaatcgaagctccgcctgctccgcttcgcttcgccgacgactccggccgccaccgcaaccgcacgcggcggcagccttaccggatcctccacccccacccgaacccgcgaacccgcgtgcccgtgcttcacgcgcattaaagcggcagcaaggccacctcctcgcacctcgctcaccgcacggcacacgcgcccgggggatttggaaattggaaatttcagatcccagatctcgtctcgccgatctcgccctccgctaaggtacggatcccccgcgatcgctgcttgcaagttcagaaatgttgcggccgcggctgctcagcgccggatctgttgtgttttcctgtggtttttaggtgtttgggattttttttcattttgttgtgcaatgtatggagtgtgagattacttgtggaaactgattagtgcaatgattttgcagccatgggttcggttgtggatgctccaacagttgtggctggacaggaggtacgcataatgctattggtgtactaatttagtaataattttccctactgtttattggttgagcttaatgaactgctagatagtttcctatattatttgagtatgtttttagaacacaactgttatctgagaatgtgcaacatgttttccttgaggcatcagagattataaattagatttcctgatcctttggctgtgagtttcgctacagtcaagggctggagcttgaaatcttgcttcctttctgtttataaatttaaaaaccatttatttaggctagaatatgtcgatgtatttctgttgtgtatgattcatttaatcttcatgtatactattataccaatataaattttgactccttgagtcacaacgtaagctcatttatttgtttattcagttcatatccttgcctcatactgtactataatttatgccatccatagcttgtcttatgggtgaaatctgcccctcatgcaggaggtcactgacaacatgttgggtgacaagaaagttacagttgtatttgttctaggtaactgcttaccttctactttatgtttgattataatgtaagtctcatatgagaggaaacgaacttataggaaactttagatatgcaatgaattgacatgataaaatttaagtacttacatagttatatattatatataaataaagagatatattatcttctgtttctaaccaaaaatttacacaggtggtcctgggagtggaaagggcacacagtgtgccaacattgttgaacactttggattcattcatcttagtgctggagaccttttgcgtgcagagatcaaatctggctctgagaacgggtatcttattttcattccataagaaacccaactgtttccttttgtttggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5718 - DNA, 229 bp, Oryza sativa
acctttgacgggcttctattcaacggcccatcactggtatccgctcacctgtgacgggctagaaatgaaagccgtcacaggtggcggcccatcacctctgacggcttctaatgtatcggcccgtcacaggtgaggggataccagtgacgggttggaagaaaaactcatcactggtatacctctgacgggttttcctttcggcccgtcacaggtgaggggatacctgtga

SEQ ID NO: 5719 - DNA, 709 bp, Oryza sativa
cgtactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaactactatcttcttttctagttgggcttggttgctgaacaagcttcacaaagcgaggttgagtccgcgccgaagaggcgcgaagatgacatcctcacaaaggcgctcggaaccaaagaacatcctagccgaactcggggaattggtagcgatgtgccctagaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatatacccccagtcacaacacctgctgtgcaaccaactcctcgtgtacaacacgacgcgagtccgtcacagctgatgaactactgt

SEQ ID NO: 5720 - DNA, 655 bp, Oryza sativa
aaaaacaaattattattgttggttctaatttggtaagcctccaaggcttttaaattctggcattatcgaattttatattttgttgttacaatgatgatcagttaatctattgcttatctttatctgggcatcacagaagtaattcctgttataactctagaactaccatgcatagttgttactcaatcaaatcattaacatacgttgccgcgtgttatttagccatgtgctttagctctagcaacacttttgattcttctttatgagtttatttgttattaaaagaggaacgcttgaaccttataggtaagtagatttgttaatttatacaattatgtccctaccatgtacaatattttcttttcgagttcttgtgtagaacctttggttggttctttgctgatgaataacaagaattcagcatttattgagtttttacttacatttcatgtcaacttttcatcatttccaatggccagggaatgctttctgcttcagttttgtccatcatacctctgatacgcccatatcagtggcagagtctactcataccggtacgttgacgttgtgactttggatgaatcaaatttgagcagagctaagcaatgtatttgctctgatattctacattatttgtttccaggtcttgccaaac

SEQ ID NO: 5721 - DNA, 10478 bp, Oryza sativa
acattccaggctagtgaacgccgtggttattgatgccaacaagaatcaggtgcctgttattgcattaacattccaacaattttactcttttgctggatattcaattatttgcggaattgtgaatacatgtaaatggatcagcaagtcttgttttttgagtcttatctttttattatgggacctcgtgatgaaaactatatgttccctgctatctattacaaaatttccaatagaaaatcacataataccgtgctatcactggtaaaagaatgatgtgagtcatgcaaccagctatttgctgatacatgtttttatcttgaaatgtagatcaagtctacttctgtcccgcaactcccgcagcagaaggagttgctttctgccctgcgtccataccattccagactagtgggagagagttttctagcaagaaagaggcccgtttatgaatgtacagatgcccaggtattttcttaatttgtttgattcttcatgttatcttgtatctcgtgatctgttcccaacttaggatgcatcctgatattgttgaacttatatttctttctcttttgctgatataattgttatagaatccataaatgtgctccactggtttcatggcacgcttatccttgctgttgcaacatggtctctgttagttgaagtccgatttttttttccgaactgatttttttttcctggttcaatatttttttcactggttaatgaactgtatgagctttcatatttagtcaaagccttgagggatattcaattttctcaaattgcaggtggaagctgccaaaggtttcttggcagtgcttagatcctaccttgattcgctgtgttccaacttgagatctcatacgattactaatgtgcaatccaacaatgacaaggtttgttgttaatatagtgtttgttctggttattctgtgtcccctttctttgtggacaaataaactagctgttatgtggtgcagataccagacaaaatgttctgtcagcatgtttacaagtgtagcatacaagttactaatgattgttttctgtattgcacaggtttccttgcttttaagagagagcttcatcggttctttcccgacccgtgagaggccctttatgaaggtataaactgtagtcttcccttttcttcttgtgttcaatggaatttctgagttttgatagtacagcttatacatgtacggatagtctagttctgtttctttgctactaaagtattgtaataatatacttggacaacactgaataggatacttcacttagcattttaagtcttcctatactgaatactatgtccatcccaaaataattgtaattcttggttgtttagcatatattaaggtttgagaagaaagtctatgatgcccctcattagatggtgtataggtaagagtggaagggtggttgagagtagaatagggagaaatttgaatgagaagtgattgattcgacaatcagtactctattgtgacaactattttgggacagagatagtacgtcttttttggacatgcaccatatcaaactttcaaaactttgcacatcaatcgttttaaatactaaactgtatacatgaaaaatcacattatggatgtctcaaaaatcactttcataccgttataattttgttggattttacaaatagattatagtagaaattagtggtcaaaattgtatttcagagaccatgtcgatacccaaaatgccatgttcttttcatggcctgtatactggtccatggactaatgtatgtggacttttctttttctgttggcagctctttgtggacacgcaattgttctcagtacatacagacctagttctctccttttatcagaaggactaagtctcttttaagaatttaaccatcttcagtgagctgatttgccaaggtacattctctccttttgttatggcaattctggcatggatattttctgaggcaataactgttaatgttactgctatacttagttcctgtgcacaagtctaaagtgatttgtatgtagaatcgaatggaaatcactttctctggcactatgatgcacctgactttgctaccctcctgatcattgtgtgggggaaggaaagtcctaaaagaaaatcatatgttgatgatttgcagagtccagcaaccaattcatgattattaggtgtgcagtgcaattaagtgcagtgcctaggtaccaattttgcctttatgtatcttgtgtgcaactgatctaatagcatggtgtcttatttcggatatctttccctccttgtgaaacagtgaagccgattagcatggtgtcttatttcggacatttttccctccttttgaaacagtgaagctaccaacagttacagcttgaaagttgaaacctaccgcaagttaaaaccgtgctcaaatgtccatgagataacattgcctttgatattaacactttatgaaatactctatccgtcccagaatatagcaacctaagaccggacttgactcaacctagtactatgaatttggacatgtcttctgtccagattcatagtgcataggttgagccccatctgatccaagattgctatattttcggacggagggagtatgtagccaagtatatttcgatccttaggtgtctactgcatgatgatttattctagtgctcattttaactctctctctctctctctctctctctctttgcattacagtgttagatcccgatctcaactgtacatattgatcttgaaaagatgagctgcctttttattacattggcagctcaacgttgggttaccaaactgtatgggtgttcatatgtggttccaaagaaaccatactgaaccagacaaagagtccagttcatggctatgttaaggtactggcacggctcccataaaaatgaatacggctggtttggacgaaaccaccgatgactgttggagaaatggtatattattgagatccagatatggataattagccaaaatgatgttctagtagttatacattaatttggcatggctgttgcacacagcttgccatttaagattttgtaggtagtagttgtcccataggaaaacctcccaggtctctcccttcaacagtgactactaaatatgttaattctgcgttgcaaaatgtctgtaatctgaagtgttcattttgcagctgtaatgtaatctgtatatgagggggaaacaaaaatacgtactgttatttgaagatcgggttctttgaacctcgatctgttgagtgatggcatagtgtagagaagagttcggtatgtccagtagctttggaatcttgacatgaatcttgacggaggatattgttatgctggacgctcatgcatttttccatgtttaatctagtgttaggtggttatattttgggagcgagtgagcgagaccttgtgtttgatggcaggtggcagcagacggtccaatcctggccagtggacatgagcatgataaattcattaaaagcaatgcatattccgatgccgtctcttgttggcggagtttaaattgtctgacagatcgtcgttatagcctttgcatattggactatatcggcgtcatttacccattggctcttagagcagctacaataatagcagactataagccagctgtaaacagataaatgaggagagagaagagcagcgggctatagatttgtagccagctgtagcacggactccaagacacagtgtgtatgataggtgggaccatgtattaatagtgtagtatgtaactattgtatgaatgagctattagattggatatagatgaattggagccagtagttggctatactattaaacttgctcttagccatcccagttacagctccttttttggctcttagccatcagttacagctgtggacatagttttacctcctttttacttcctggatgaagaacgaagggctggtttagtttgtgacctaaattggtcttactaatttttgtcgatgctaaattttggtaaattttgacatggctaattttggcaaagcaaaagttgtgtttggattgaagctaaaatagcctaagttaactattgaaatggcctattttcttaagcatgtcaaaatttggcttcaaaccaaatagacactaaacactttgaaattgccaaatattggtaaggccaatttagacctcaaaccaaaccggcccgaagagcttcattgaccagcattccactattaacattttttatctgcctatcaaagtgaggaggcatagaaagaagagtttgacgaggaggcagcttggcaaggctaatatacctttgcttcatatcaagagatttgagctgtggatgatatgaggagtacactcaagttttgattactttcgaggcaaaagcccaactgcccaagcaagacctgactgtcgagcgtcaggccttcgcttctaaaaacagtggcttattacagcctaaagcctgttgtttcatcagctaggagcaatgtttcggtgcagtagtactcatcagtaccaagccgaaagcagcggtagacgtggactgtggttgcgaggaatgctacaggggcggtgtgcctgcgtgagtcgctgcgtgcgcagggagtgaaagggctccgctttgcccgtggggcggtagcagcagcagcagcagagcgcagtgaatgtgcctgccacaacgtaccacggaaaaagccttcgaccagtggtcgtcacactgccgccctcctcgccgctactactagctcgctgcatgtgccgccgcctgccgctacctacaacgtcgccccatggtacgacgcgtcgctgcgtcacccccacccccgtgtgtaccagtgtacgtacggtggctggccacgccacggccgtcggaaagacgctgctgccggagtttttaagctttttaggcagatgccgcaggaggaggacgaggaacggagcggagaccaccaggatcttctgtgtttgggatcgcatcagcagagtcgtcatctgttcacttccgtgccaacttggccatgatgcatcatgcatggtccctgcgtgcatgcatgcaggtagcttgggctacatagttaagctggccggcgtgtccaccggattaaacccccatggtgatcgagactattctcgctgccgaatcaaagcgtgatcgctgatcgggtggatgcatgttccctgctcctgggtcgccggcaagctagagagccccgctccactatgcatccacacaattcccgctgcacgatgcctggtccctagccccaagctgctgactgcactaactccaccaccactgggctcagtcactgcttcaatccatccatgcttgctcatgatcgaatccttcgccgataaggctactcttaccttctttccttcctggagactcttgcaacttttccttcccagtaatatgctttcctacctgcagcgtcccaaatagtattctgtagctactcctgctctgagtcccctgatccagtagtgcatattgtcgtattttctccggtgggagcatgaacacaaatacaaacagtagtgcatattgttgtattttggctgtgtttagttcagcgaaagtttggattttggttaaaattggagatgatgtgactgaaaaattatgtgtgtatgacaggttgatgtgatggaaaaggactgaagtttggatgcaaactttggatctccagtgggtgcatgaacacaaatacaacagctcgagagaccccaagcctgaaatagcaaaggtgaacttgcaaattcctatagctacacgtctacacccagtcgccggtgaaactgccgcgctagctacactccacaatatcctcctcccagtacgtacgtacgctgtcgtctctggcgccgctgcacgcgagcacgcatgtgcatgtgggtggggtcaaatcgacgccattttgcagcagcatctccgcatgcagccgcgccaccaccaccaccgccacctaccggggcatctcccatttaacgccgacgccgcagcgaaagctggggaacgctgacgagaagacgccactgtccctccctccctccgcccatccatccatccgcctgcttgcctgcctgcctgcctgcctgtacgcatgacaagcagcacactgcctgcctgctgccgaagcatgcatgcagcggggtgtcctgtccctgcatgctgctgctgcagacgcatcagagatgacacagagagagaaagagagagagaaggcagctgtctactccagcagggagcagcactgcacatatgccatgcatctgtgaatcagatgggaagccttacataagctgtgcaggctgtggcaggccaggcaatctgaccacttctttgactcatcatgtaggggagagaagggaccttcagctgaggtagtagctcgtcttcactgttctgagctctggacggacactcccagcttgcatgccttgggggacaaaacatgtgctatcagtgagtgagttgagtgagtgaggagtttgttttggttattcatttgctgatcaggttttgcaggaatattaatggcaatagaaatgttatttcccctcgtagtaggagtaagtggttgccatgggcttcatgatgcattcaggcatgctcgcatcatgcggtgacaaaagtacaaacgttctacgtaccccgtgtacttctcctacaaagtactaccggctgcatttccaacagaatgtagaagtagatttgttgtaacctacctgtactcccaaacatactgcattttccatgcatgtacttcttaccttttaaaagaacgacaaacgctacacattacccccttcggacatgtttagattatagccaaaataaatcttaccaagtttggtaggatttattatttattgaccaaatctagcaacaaactaaacgtagattttttttggcaactttaatttaaaaagatagtatggttgaaaatggtattaaaagtgaacatgtcttcgtctcaatataatctaatagaatgaatccgactagaaaatattgtattttattttaattttatttattttgggacggatggagtaattgataaattgatgggagtagtaagttcaatttttcagtatgaatgcgtggcacatagtcaaaggacacagggaaagactgaaagaaacctttgtggatccatggggtgatccgaaagagtgctctgcaagtctcaatccatgcatgcagcctgcagagctctgcagtgtcacaggttcacagccgaaagagaggccttcgtcagtcagcagtcaccacctccttagttcccttctcctggtgtggaggtggagccccatctatctgttcccctcactgctgcagaaaagagaaaacaaaaacgagctgcattggagacctccctcttaaaatgtagtagtactactctactagtagtaagggggtgtttgggactttagcccctctctcaaaacaccccctaagcatctcaaatactaggtttaaggagtttttgagatagtaaaagtaaataagagatgggttgaggggaaaatagtgtaaaacttaaatgagagatgattataattagatgaaatatagactgatgataaagttgttctaggataaattttgtatgtttattaaaagcggcatagtcaaaagccctatcattatgggatagaggtagtactatttccgtccaaaatattttaacctgagtaagaatgtgacacaatatagtaaaataaatctaaatgaatatcctctattcaaattcattgtactaaattatatcacatcctcatctagattggaagaattatatcttaagatagggggaggagtactgattactcctacgattgtctggtagaagaaaaactcttagttctactactttcttcgtcccataataattttatttgtagtttcttttatttgtcccaaaataagttagttttaaggtaatcattgcatcgaagtttatgaaaaattgtaatatttttattgggagtagataaagtgctgaatagttgtattgggatttaataaaatagatgtattctttaatcctttttattttgtattgttacatgtgggatgagtgaaaagtaaaattattttggaagagaggaggtaaccttccggtgaatcccagttagtaagagcatgataagaaaagaaaagcaaagccaaaacagagcccaataattctctcttatctctgatgggtcaagcacatcatcataaggaagagagtcgatactccaggactactagtagttgctgctcctctgagtgtgctgtctggtagccattgatcattgagccagtgggttggcttatctgagccccaattgctggcccacatggcaggcaggcccatgggcccattgtgttggtgtcagtgggcatgcctccctttctccctactttgaccaatcaagtaccgttgggggtgcaactgcgtttcatgtctgtactgtaattattgtgtgtgtgcgcctctgcagggatggaagaaagctcgcgtatctctctgctcatgtgcgtcttttgttttgcaaaaacagcaccttttcggcgtcatttccttttgatcattatgcctaagtaagagaataattctctatcattgatgcaaatggtaaagctataatttaatttacttctgcctatgctgaaagtttgctttctttttttgcatatgcataggaagtgaagtgaaacattacagaatctcagatggaagtgaagtgtttcaaatggagatgatgaaaagtttagcctagacgtctagggcgacatggccgccacatctggatgcagagaatgcccatgctggtgtttgttcgtttggccactgccaagatttggtcctcttttttgttacaggaaaaagaaacagcattctcaccatcgagcctatgagccctgagccatcacatcggtgtcggggaggggaaaaatactagtcgtaccactactactgtacgggagtaaaacttgttgcgtctttcacctggaggaacagtttaaaatatgcacaaaatcagagagaaacctgaaaagccagaggtatacagtactgtacgtattcccttctgcggttctgcctgcagtttgctgctttctgccttttctttatcacgcagatgctgctaatctcacaagacaatatgtaaacccattgtgctggtagcatatcatatggcagtatccagcatatgacaattaaaaccttgctagttcaggttcaagccattctgggaagtttccccagcaaaacacatgcctcctcgtaaatgcactggtgatgcccgggttgagaaagcgatcgattcattcattcattcattcattcacacgctctgcctctgcatggaaatgaaatgaaaccacccaaccaaccagcagtttacatggaagagttgaatgatggtcgtctctggttaggtttttcacatggaacaaaatggcatgcatatacatatcaacagtggcgaaaagcctgcagcgcgtgagagagtacactgggtatgtttagttcacgttaaaattgaaagtttagctgaaattagaacgatgtgaagaaagagttagaagtttatgtgtggaggaaagtttcaatgtgatagaaaagttgaacatttaaagaataagtttggagctaagggtttgtttactttgatgaaaaaaaaaaccttactaaattttggcatgatttcttatatgctctaaaatttgatagtaaactaaatatagccactttttgataactttaccaaaatttgataaggttaaaaataacattaaagtaaacatgccctaattaaacttggccattctcctgcaacgcggcaagctgcgcctctcgcgtcggctcgtcatctttacgtctcccacccctttcactctctcaccatcaccaacacctggttggtagctgcatgccgcgcagtacgcacatactcctaccactcaatcttctcgctgtcttcttttacgtttgcgactcgcttttggtcagccttgctgcctttgaatcgaacggacgaaacacacacatgtgtgcacagtggtgtgcgtcgtcgcaggggcagggcagggcaggggcggtgtgggagaaaggcttctttgtttatgagtttccgtaaagctggcggtcagagacagcagcaacaaaaggcagaagagcacagcagccacgctgcagacttcacagatgggtgctgtcccccattcccctcctcaccctaccacaccctaacctaagctacctgtagccctagagagagaaacattacagtacagtactcatactctctctctagctctagagagagaaaccaccgtgcgattaggagatcagcagtatccttctttcattccttagagcagttacattagcagactattactacctccgttctaaaatataacaacttttagctataaaatttagacacatagattttgtttggatccttcgg

SEQ ID NO: 5722 - DNA, 9572 bp, Oryza sativa
acagtagtgcatcaagcgtgactgtagcaaatcatgaataaatatacctcgttagattcgtctcacaaaatagcctaggggttatggaatatgatttatcagtaatctacgtttaatactcctaaatagcaagatcccggagtgctatttaatagcccgaagcatccaaacagggccatagttatctagattcatagctaaaaatgcttatattttggaacggagggactagagactattactacctccgtcccaaaatataataacttttgcttataagcatattttaacgagataaaagttaagagagaaaagtagcaagctatagatctgtagccagctgcaacacggactacatgacgcaatatgtgtatgatatgtgagaccatatattaatagcatagtgttaacaaccgaatttggtaacatcagcatcaggaaagaagattagatcgaagcaaaatcgaaggcggagatcgagttcgaaaacaaagcaggaatcggctggagtccaaatcggctacgattaggatcggctgggtctgagtcagactaggtaagccgatagagccgattccggcaacgcagcttgatgtatgatatcgggtaggattgaggtgcttcaaggtgattgctgcatatggatagagtcctcagaagtcaattatatctattaattaggatgttttatgtaatctccttagagatacgattgagcaaaagtctggagcaaagacttatgttatcttagagtttgttagagatagtagtcgtgtccgttatggacatatcttgtaattctcgggtataaatagacccgagccctatgtaacttttaacacatacgttcaatacaatctcggcgcatcgccacccttttgttttagttttatttcgacgagttcttacttttgggttgagctgcatcgttttcgatcttcaacaaagaggtaaaacttgttatgacgacttgtgttctcgggattagtgctgccatctttacgatgctctgacctcgtttatgtaattcgtcaagttatcatatatcttacaataccgctatctaatctataatcggctaacatctgtctgtagagggcagccgactaggttagatatcgatgttgacttagattatataaggtatctaccactctatgaaacttccaatggcttgattgtctagatattgcccttcttttcatacttatagctccatcagttgagtttgatcttataagtcgtgattagaatctcaatctctagcctgccttctggttgccgattagggtagcatcagagtttcagccgatcttatctgatttaactatatttgctctatatgcttcattgacatgttaaatctgccctttatgtcaagatattgccgtatctaagtatattaggcatttgtttgatatattatacctattttaatatcctgatatagagtagtatcggagtattagccgatacatgctagatctgtctgattggctatgctacaaacatatatagctctgttattaatatatatttcgatctaggtgatttatactgtctcggcatggtgaccgatctatcccaatcacttgatttaagtatatatcgatataagaactatatattggaaatatctacagccgatcgaatagatttaattctttactgtctatttacaactgccgatcgattcacatatgacatcggctcaaagataaatgatatgtcatcggcacctagccgatcggctatcatttatagatttaaccgcggtttctttgcctttatttcttattgattacacgatcaaatcatgtcacacccaaatctggcaccgccgtacaacggcacctgataggagcatgtcgtaggaaaaacggcgcgaaccgcttcctacgaaaccgcgatcacagtaccagtccagcgctggtacccacggtgacaaatatgaatcattgcaatccttaaaaataaaaagaagacttatttaccttaacttaggttgtagctcagaatagcctaagaatacaaccgacgacgcgcacgaggaaacaccaacaacaacagcagcagcggaaccaacggtctaacacccaacaccacaggcgacggctggaaaccaggacgaaaccctattcttcacttcacttcatcttcaacttcacgacgaaggaactatatatatttatatagagcaagggtgagtactttcgtactcagcaaatcacgggaatttaggtgtttgatgcaagcttggaagagaggcaaggttgttttgcaaatcttttgtttgaagtccattttgaaaccactaagtgatttatttctttctaagtttgggccgaaaagtgacttgcgtctcgattcgactttaagagatgtttttcaacaactcaatttgtaatgtaccgacctcccgggtcagatcattacttctcggctcacagagccatttcacttgattaagcggctcctagagccttattcatgttctcgaactcccagagtccagctgcccaacaacacaacgatccgcttccactcgggaagccaagtctatgatgcccgcagacatcctgaatcacacagattcgtttcttgaccactcaggtcatccatctgccacataggctgattctagtaacgattcccaatccacaacaatttttcacaaagcacaggcaaacaaatctacgctacaggaaacacctcgcatccgcccatgaccgtgggcacggctgttcgaacagtttaataacctctgcagagggggtacactttacccacacggcattactaacccggatcacccagcccgttcagaacggccacgtatggagaccttgaggctttcatgacaaggcaattcgaaagccgacacaggtttaccatatgccaacgagaggggtcccagaccaacacccggttaggtcccagaccatactatgccaggaagcccgagggttctccccgataccaccccgttgaatccacatgtctcttggcatcatggctcccctgattagctaccggggtcggcttgacccggtcttggccgagctgcccctttctctcgggccgcgccctagccgcccgagggaagtctgtttcccctccctctttcttttcttttcaaaagggtttaattaaatcctttttcctttagaacaaaaatccaataatcttagaaattcaatatcttctcaaccgtatgtccgtttgactccgttcaacttccaaaactcctcaaatctcgatatctatttaatggcacgtttagaggtcaataatagggctttatttttgccgtttgttgagctgtcccgtttcgcgtgtagtttcggagcccgaagacccgtagtgcgaggatttcgaggatcaagctcaagatttcgagcaaggcaagtcacctttgatcatcttgcacctataatttaaatctaagtatttcttttccgcaaatattgcatgaataagtttaacacaagtatttcggccgcggcttgcgagatagcttgccggccacaatcctaattgctgcaattaccctccttgaattattgaacacttagatctcctttgtcgactgttgtgcttcgatgcatgggccttcgggctcgagcatcggaacacttcccttgaaatttaaaatatccaacgatgggtaaaacttggggttttataaaagacttggaaaaacccgacacctgggtaggtgcttgcgaactaaataaatttccaaaatcgtagatcggggaatgtaccgggagtacggtttcccgctcttgcacttaaggaccgttttctttggaatttcatccaaacataaggcaaatgtgaccacataggtggaatgggacgcccctggctgagtaattagctaatcaggggagccatgatgccaagagacatgtggattcaacggggtggtgccggggagaaccctcgggcttcctggcacagtatggtctgggacctaacctgatgtcggtataggacccctctcgttggcatatggtgaacctgtgtcggctttcgaaatgccttgtcatgaaagtctcaaggtctccagacgttgccgttctacacgggctgggtgatccgggttagtaatatcgtgtgggtaaagtgtatcccctctgcagaggttattaaactgttcgaacagccgtgcccactgtcatgggcagatgtgaggtgattcctagcgtagttttgtttgactactgctggtgaaattactgttgtggaatgggttcgatgtttgaaaaatctgcggctgatgggatcagccaggcccgggtggccgtttgaaagctgttggacgggtgccaaccttgaatcaattcaaaaactgatacattgcacatactccgaccggacgagacacactgtctcatccgtgtcgtttgagaagcactcacttagttgtttcaaaaaggagtttaaataaaaccaattgcaaaaacaacagcctttcttttgaagcctgcattaaacacttaattcccatggcttgctgagtactcctgtactcacccttgctctatgtaaataatcccccccaagttgctgaagaggatgatgtggatcctgctgatgaggagttcttccaggagcaagtcggctacgatgagttttagggtttcggcctagttcccaagtcgcgcctgtgatgaatggtccaagtcttggcttccgctttcccttttgtaatgcagttgtgacctcgggatctgtccacagcccaacttgactgtactcctactctataataaagagacctctgttgctatgatattctgtcttcctgtgataccagcactgtttcctgagactggtatcgattaacaggttaatttggagcgtcacaggctagttccgttcggggctagttcggggcgtgacaaatcaactggcacgctagtacacccaaaggcgagctttggacctgcactggagttaagcaaatctcccaggcctcgtgttttctgtcactacatagtaagcaactattgtataaattaaccattagattggctatagataaattggagctagtagtgggctatactattaagctttctcagatattataagccaactataaatacatattgaggagataaaagaagagagagagtagcagcgggctacagatctgtaaccagctgcagtacggaatctaaaacacaacatgtgtataatagggaccatatattaatagtgtagtatatgtgatatgtttatagataactatcgtataaattgattattaaagtgatcgtaaatgatttaaagcaattagttaattagttagctacaccactagtacattaaacttgctctaatactagtagtagtgcaactaggactgtagtaggagtatgtaatcatgatgttgtacttgctatcctgattaggagttgtgactgacgcattcataggacgagacagtatgattaaacggaacaatgactgttcacttctaatgacacattaattcgaccaaaagggtgtgcatgctctcacctggagtggtagtagtacagcgaagagggatcctgattttttatacggtgggtatcgcccaactggtgaccaacagtacatatttctggtgtactctacacaaagaaattgcacagttttttttctgagtatatatatatatatatatatatatatagagagagagagagagagagatgagtgtgaggtgggtgtggggtgggtggctgcaggctatctgcgtggggtgtcagagtctgcctgtctccctctcactgctgctgccatctgcaacctgcaccgttgcagtcaataataataataaacaataacattcaagtggggcctctcgctactgcgcatggtggcaccgtggcagcatccacccgcagggctcctctgacaccgaccagcattgcccattaactatagaaacccatagtgccttctactgctacatgcaccaactaccattcgacgcccgaaagattttactactaccctagaaatactgttcttgcggtaatattcagaagaaagcccccaaaaaataataatataacttatctgaaaactaaattgtgctcaaaattatttgaaatgtataaaaataaaccacaaacatcagcgctaagcctggtaatgtcaaagtccaaaaacaccatatattttgacaccaccatgttgtcgttgcgtcctaaacgagttgttcaccgagactaggccagaagtttaagatatcaacgaggctgtggtggcgctacgttttatcctccgtcaccattttgtgctaggtgagttgtccgcaatattagctaggaatttcgaagcttgacgagaccacaccaacactgtatttgatagagctcgatgagggatagcaatggcaagctctaggtgtatcgtccttgcaaggttcctttgcactaaccacttatcaggtggatgagtagttctatgctaagatcatggtttattttttatatcaatgtctgatgtggttcatcgttgaaactaaatttttccacaaagatcgaaccgtcaaaaatttggatagaagaacaagctatacgccatgcaaagggccttattgtttggcttttttcatagtaagccaaaacggcttattagagaataaaaataatttgtagataaaagttttatatatgtgttctcggtgatttaaaagccaatgccgtaaaagaaactacgttaaaaatatctcaaaatcaatgtcaaaattaagtttaaaaattcaaattttgtttttttttctttagttgaataggctatccgatgggagccaaagtttcccggtgacagtctagactatagagacgacgaccaaagcgcttacgactacagtaaatacggcatcaagcggcggtggccagttgctcgcgtcgtcgccggggagaggggagacgcgaggaacctgtggagtttttgcgggtgagattcctacggctgcgcgcgcccacgaggggggcgcacagcagattctgcagcgcactctctgctctgcctctgcatcttgactgaatgacctatcttctgtacccgggacataaattatcggagttaaatatccggaaactattcaaacaggccatcgttcgcacgcctacgtttttcttttaagaaaaaaaaaatatgtcctctgcttcgctcacacgcacgtactactacgtgggctgcttggttgcaagcatccttttatgacaaatctgtactgtgcggtagggttattttccattcttcctactcctacggtttgttcttgacattttttttcacaaagaaaaggacggaaggagtataaagcatgtcgcttgtccaagcaaaagaacagtagccagtggcaaacaaagccctgtttaattcaccccaaacttcccccaactcctaactttctatcacatcacatcacatttaaaactttcctacacacacgtaaactcccaactttttttccaaactaccaactttccccaaacttctccccaatttcagaaactaaatacaaccatagtaccactggacaaacgagtcctgagaatgaaagtgattgactaaaaactattatggccgagtttagtttcaaagttttcttcaaacttccaactttttcatcacatcaaaacttttctacacacaaactttcaacttttccgtcacattgttacaatttcaactaaggctgtgtttagttcacaccaaaattagaagtttggttgaaatatgaacaatgtgatggaaaagttggaagttcgtgtgtaggaaagttttgatatgatggaaaagtcaaaagtttgaacaattattttcgaactaaacacggagtaaacttccaattttatcatgaactaaacacaccctatgtgtaaatgtctcactgttaatgagaagtgaaagatctataaatttctatccggcctagaaacagttgaagtaataacatcactaccttaactaaagatgttgggtttttttttaaaaaaaaacacattataaacgtacacccacctgtaaacatatacactcactttgcatattcggttatattccgacaatataaatggcaaaacttgaaaggtgccatgcatagggaaaaaaactgtcatgctaaacaggaaaatacatacttggtgtcaactacttcgtgggttattatattttgacgaacgcattagtgttaattcacactataatatatttgttgaaatacttttcactaaaaacaccctaatcgctgaagcggtaaaaaaagattagatcttatttggactatagggctcgtataatatgtttgatatgtcattttaaagtttaattaattagataattaccttctagtttacaaatgtctagaacttcaataacatatctggttcatatgatgtcacaataaaatgccagtccgagtgattttctttctaaccgtcgtctaagccgtacatacgtaaaatactccatttgtttctaaatatttgacaccgttgactttttagcacatatttgaccgtttgtctttttcaaaaacttttgtgaaatatgtaaaactatatgtatacatataagtatatttaacaataaatcaaatgatagaaaaagaattaataattacttaaattttttaaataatactaatggttaaacgtatttaaaaaaatcgatggcgtcaaatatttagaaacggagggagtatatataagttagactcatgataatccaactctatacgttaatattgcaattttaaaaggtaaaatatactttttatgcaggactaattgactgtattgaaagatagttgatgcatttacgtagtagtacagtaacgttttatagaattcacattcgtttaattaaaacccaccgtttattaattagaaaatgtattaataaatggccgaaacctgatatttttggcaggcaggagcgcatttcgcagtattaccctcgggttttcttctggatccggaaacagcctccggctcgcaagtcttaaatgcgcacggacgtcgcttcccaccctcaccccacccttccccgcccattacaaaaccccagccaccgagagctctcccgctccactcgccgcacaccaccaccctcacccctccccccatccgcgtgatctcccgagcagctagagcgcgcgcccgcggcgcctgtactgcgagaccgcttcgctcgcttccggtcggtgaagaggcggtcggtcgcagctgaagtagttgttgcagagatgatgatgatgagcggtcgcccgagcggcggcgccggcggaggtcggtacccgttcacggcgtcgcagtggcaggagctggagcaccaggcgctcatctacaagtacatggcgtccgggactcccatcccctccgacctcatcctccccctccgccgcagcttcctcctcgactccgccctcgccacctccccttccctcgccttccctccccaaccttcacgtacgttacacacatcctcctccacgtacgtacgtacgcgttgttgccgatgctaacaaagtccatattgtgattggtgttttc

SEQ ID NO: 5723 - DNA, 13556 bp, Oryza sativa
ccccaccaccaccaccacctcctccccggcgccctcctacagccgcccggcgccgcacgacgcggcgccgtaccaggcgctctacggcgggccctacgccgcggccaccgcgcgcacccccgccgccgcggcgtaccacgcgcaggtgagcccgttccacctccagctcgacaccacccacccgcacccgccgccgtcctactactccatggaccacaaggagtacgcgtacgggcacgccaccaaggaggtgcacggcgagcacgccttcttctccgatggcaccgagagggagcaccaccacgccgccgccgggcacggccagtggcagttcaagcagctcggcatggagcccaagcagagcaccacgcctctcttcccgggcgccggctacggccacaccgcggcgtcgccgtacgccattgatctttcaaaagaggacgacgatgagaaagagaggcggcaacagcagcagcagcagcagcagcagcactgcttcctcctgggcgccgacctccgtctggagaagccggcgggccacgaccacgcggcggcggcgcagaaacctctccgccacttcttcgacgagtggccgcatgagaagaacagcaagggctcctggatggggctcgaaggcgagacgcagctgtccatgtccatccccatggccgccaacgacctcccgatcaccaccacctcccgctaccacaatggtgcgtagagtactaaccttcgtctccactgatcagaaccgtttcttgattcttatggcgagccgtgctgacgatgatccaacttgcttcctgtttggtcttgtgcaatctgcagatgattaatctcttgaagaagccaagaagtgatcaacacgcggaagaaatcaacagcttctttcacggcgtgcgagctgcatgctgatgctccaggatcgatcgatcgatcattgcatctccaaactaatcacgcttcgatctttcaggacttcatcaatgacaggccgaaacctcctacgagttctctgatgatattcttatttttttcccacttcttttcgttgagctttttgtaatgttgcttcgagtgttactcctacattttctccgaaatggcctcagaatgatgcggtcgggctgattaattaggttagactcttcctgaaccaactaggaatagattttctgcctggttcctgtcagtccttgtaatatctgcagcagcttgtgagacaagcgtgttcgcttttgtgaacgccctttttcttctttccgattcctctgcctgtgatagtactcgctccgaaaaaaaaaaaaaaagcaaaccgtggattcttgggtcaacgtgtccgttttatattgtccgttttatatgaaatttttttataattaaaatttctattgttgttagatgataaaacatgattaatatgtgacttattttttttatatattttttttaaataagacggacggtcgacacggttttttttttttttaagaaggagggagtaagtcacatctctggattctgctgaaaagctcactagcgccatcctgcttcagagaatactttatgctttctgacaagtcggtgtaggagtagtagtattgctaggtgtactccactcccctccttaagtacattaccagtgcaacgtaaaacagctttgctcctgagcaacggaaatgcttaataccgtactcttgcacttcgtcagttggttgagtacactgtgcaagtaccaaattggtcttcttaagtgttactactaggttgatcacttgttgaaccgtttaggctgtcgatcattagcattcagggttatcactgcaaagtcccaaacaaaaagattctcccagggtctattctcccctgaaccgttttcccattgaccggccaatgctgcaagaagctggatgcagagctaggagtagctgcagtgcccccactcctgcaccttcctgcagacactcagagagagggagagatggaggactgtgatgactgaccagcacccctgctttggtctccatggattcaatgccaactgcactgcaattgctgccggccccctgagacaatgtcaggcgctgtcagctctcgcgtccatgcgattgaatgatccattgctggcgtttggaccgtcgcctctcctcccctgcctcgcacacagtctgcagcgcatgcatgcatccatcatgtacagtgcagcattggacacaagcctctcctccttgcagctgcagccttcaaagcctgcacttgctgtctgccgcgagacggtgtctgccggccagcaccgtgacagtctccggctcaagtaccggtagctgtgccactgacgcgcgggggccacctgacttcgtccaaagcgtccacagcactactactggcactgcaccacagggattgccttccctgacacaagcctccacatggagtaattgttactgaagaaattcccagaaattacatgtcccgcgttacagctttcggttcatccaacagcagaaattaacctgagagagtgtttgggaattagtactaaactttagtttctcttctagagacttatgttttttagaaagaggctactcccagacaccccctcagttttcgtagtactggcacctgcctatatgtgctggttttcgacgcgtactctactaatctggagtttactccaaaacgaggaaaaactcagctgtcactgtatcatcttcatcaccgaatccagcggagcacgtactgtatgacgtatctgttctgacagcgaagttgaacaaatccacggcgcccagtattcccacgacagagcccacatgagcccgtctccagcacgtacgcgtacaataaaaaggctgtactactactctgtatacacatctgcggctctgcacccatctcgtcagcaaaacgaaacgcatgcatagagaggagaacgttcaaaaccattcattcatcaaccggaggatcagctgcacaagcaagccacagtgcagcatgcggtgaatcgcacgtggagaggctcaggtgaccccacgacttgcacggttttggctcgcaatatcgcgacgagacgaggccgtgacggcatgttattctgctcacactgtcttcgcctcccccactaccacgaccactcgcgtgttaagcccgcatgtgcttgcacctgatcccgtggcacgtactccctcggtcaaaaaaaaaaaaaagagaaagacaaacccagaccgtccgtcttatttaaaaaaattataaaaagaattaaaaagacaagtcacacataaaatattaatcatgttttatcatctaacaacaataaaaatacgaattataaaaaattttatataagacggatagtcaaagttggatacggaaaactaggatttgtcttttttttaggtggagggagtaatggagattttttttcccgttttggacgggttgttcagtcagtcatggctgggagaaaaggctgtggagatgagatttttagcagcggtgcacacatgcgtgcacgggcaacctagacagttgggattttactactgacaggaagaggttgaattaaactagtgtcgtcattcgcggcaactctgagttaggacagactgattgcccagattattcggtttttagtgtatcggcgagggcatctgacgccctcgggatatgaggccctgcaacgtggtggtcgcgggcgccggagttctctcccggttagtttacggagcaggaggaggtcggcgactacttctactacgctctcgttcagtttcagattcttaccgctgtatcgtggcgtttagtttaaaatccctcgcgcgtttggggtgaagggatccgatgtgttttttgcagggatgtggcctggttttccgtgtgtaggggagggagatgtcacggcgcgcgacagcatttctcgtgacagccgcttaactaaacgcctcaatctgagagctggtcgtcagggatcagcatctgtcaggaggccgcaaccagtggttcagctgcaagtgttaagaacagtaaatgatcagctggtggtggtagtagtgctgctgctgctacttgcagtccctgcagtgtcagctgaacgtcaggggacccttcaattcgctggaattgtactgcggtgacatcatacaaaccctggaccaaacgaaacaaaactaggaccttgatcacttgatgcggctcggcttggttggctactggatttaacccactctttgctttcgtccaccctcgatggccggtttccagttgagtaaacaatgtacagcttgtgttgttcacaccaaaattagaagtttggttgaaattggaacgatgtgatggaaaagttagaagtttgtgtgtgtagaaaagttttggcatgtttagttcacactaaacttcccccaaactctcaactttctatcacatcacatccaaaactttcctacttacataatcttctaactttttttccaaactaccaactttctccaaacttctccccaatttcagaaactaaacacagcctttgatgtaatgggaatgttgaaagttcgaagaattattttggaactaaacacggccacagtttcttcatagatttgttgttactactccaggagtactatcttttataccggtcaacgcacagcttacagcaaaatgcaatcccccccccctgctagtgaacagtgtctcatatcccatccaatgacccaaaacctgcacctgattgaactactcaatgaggctgtatttagtttctgaaattaggaaaaagtttagggaaagttggtagtttggaaaaaaaaaatagaagtttatgtgagtaggaaagttttggatgtgacgtgatgtgatgaaaagttggaagtttgggggaaatttgatgtgaactaaacatggccgcacaatgatagaagtgcaatgtgcaaaatggtaagcaatcagccaatcaccacaatactggaccgcgttatcactcatcggtgtcaaccgctgcggcaacgtgggccgaggcttcgaattcgccgcgccgcgtgacggcccatcagaatacgagatgggccggcccacccgcagcgaactcatccctgcccaggccagcccatccactctgggatattgtggccgtccgatgcgatcatgccaaatctatccaacggctggtgtatctgaagcgtgtcgatgtcttcctccgaaaggagcagcctccacatcaaccgcctctctcattaattagcggaccatttctaattcacccctcgcatcttttcgaattttcgagagctcaaagcctcgaaccattcccttcttcctcgtcccaatccaagttccaaccatccagggcgggggttttcccgttaatccgcgcctctccgtgtcggattgaattgaagcggagagggggaggaggaggtggaggtggaggtggaggagggcggcgggtggcgatggcgatggcgaggctgacgccgaacggcgtggcggcggcgctggcgggggacacgaacctgaagccggtgctgcagatcgtcgagctgcggggcgtccaggtcaacggcgcgggcgtcacgcgcggggagaggttccgggcggtggtctccgacggcaccgccgcgtcctccgcgctcttcgccgcgcagctcagcgaccacgcccgatccggcgccctccgacgcggcagcattgtgcagctcagcgagtacgtcatcaacgaagtcggccccagaaggttttgttgcctcctcctccactttcccccccattcccctgcctctgatcgatgtgtgattgcgtgcgatttttggcccgtttcgttttagggttcatgcttgcccctggttttatgtgtgtcagtctgcgtgtggtttagattcccgctttcagctagtttgcaatttaaattaatacttagtacttgccattctgttggtaaattgtcgatgagcttcatgtttcctactagatactagtagaggtgcatcaaaatttttctgacaatggttttgtttatgacatcatttgatcggtgcttgttaaccatttgtccaattgattttaattctgatttgaattattattgtcagaaagaggcctcggtattgcagtactaatcagtggtaactaaggctgtcctgtgacacaaattggtgtttgtcgatactcagtagttaattggctggcattagtattaacgattacaaaatagtgtgatatatgtgcttgggtagcctttggtgttcgccatttctggcaggtagcatgtcaaacgatgaaggtaatatggtcagtttgactactacacactttacagtgttgtctgatttagttcactaatttagttgtgtgcctttttttctctagccaacaaatcgccatgtttgggtgcatcgatttggccaatgtagttagatattgatcagcattaatgctgcaactgtctggtgctgtgaacagtttgggtctaagtactaagtattttttatcttttagctgtagccattcagttcaacacaacaccgtactaaatgcatttcttttgtatctggttcataagtaattggaagcatagttgtgtccattcaaatcatgttggcaaggcgacaaatgcaaaagtgaagataagtttctgaccaaaaggtgttgtaattaaacatagtattcatgtagcagtgtgaatcatcatattctgagccttttgcattcttattttcaactgatctactggttgatagagcagaatcaagaattgttttttgttggttgagctgacttgttgcaatacctgtaggattattgtcattctgaacctggaagttcttgtttcggagtgtgagataattgggaatcctacagcgctttcagaaactggatctcctatcccaaatccgacaagagtagagcaatttaacggagcacctcaatatggtttgatggcagggaactcatcaaatacaaccacaaagcctagtgacaatgttccattgttccaaaattcgatggcaggaaactcctctaactttgccactaggcccagtgacaaagttccggtcttccaaccaacagtccagccatcttatcgccctgcacctaattacaaaaaccatggagcaatcatgaaaaatgaagcccctgctagaataatccccatatctgctttaaatccttatcaaggccgctgggctatcaaggctagagttactgccaagggagatatccgccgataccataatgctaaaggtgatgggaaagtattctcttttgacttgcttgattctgatgggggagagatacgggtgacatgcttcaatgctcttcttgatcgattctatgaagttgtggaagttggtaaggtctatgtggtatcaagaggaaacttgagacctgcacagaagaactataaccatcttaacaatgagtgggagattttattggagaatggatcaactgtggatctttgtcctgatgagaacagttccattcccacccagcggtttgacttcagaccgatcaatgaaattgaggatgcccagaacaatgctatccttgacatcataggtgttgttacatcggtcaatccttgcaccacaatacagaggaaaaatggcatggaaactcagaaaagaactatgaacctgaaggatatgtctggtcgaagtgttgaggtaaccatgtggggtgacttttgcaacagagaaggctcacagcttcaaggaatggttgaacgtgggatctttcctgtgctggctgtcaaagcaggaaaagtgagtgatttcagtggcaagtctgtcggcacaatttcttcaactcagctcttcatcaaccctgattctgctgaagctcatagtctcaggcaatggtttgatagtggaggaagagatgcttctactcagtccatatccagagatatcacgcctggagcatcaaggaatgagatccgaaagacagtagcacagatcaaggatgaaggtcttggaatgggggacaaacctgactggattacggtgaaagccaccgttatattcttcaagaatgagtccttcttctacacagcttgccctaacatgattggcgacaggcagtgcaataagaaggtgacaaagagtactaatggcaattggacctgtgacaaatgcgatagggagtttgaagagtgcgactacaggtatctcctgcagtttcagattcaagatcactcgggaacagcttgggtgacagcattccaggaggctgggcaggagttgcttggctgctcggcaacagagctcaacgcacttaaggagcgcgaggaccctcggtttgcagacaccatgctcaattgcttgtttcaggaatatctgctcaggctgaaggtcaaagaagaatcatacggcgatgagcgcaaagtgaagaacaccgcggtcaaagtggagaaggttgatccttcgggtgaaagtaaatttctgctggatttgatctccaagtcctcggcgctacattagcagactgtgctactctatcagctgctcgctcgtgcgtggtgaggtgagcgaggtgaggtgttgcagtgcccatagccctcgccctcctgctcgatttttgtgccggtactttaatattaacgccacttaatagtttatatccagattagtgctttaatagtttatatccagattagtgctgatatttccatttttgtgccggtactttaatattaacgccacttaatgtatcagcttttatacctttttctcgatcaaatgattgccttctagctgcagtgcaatttctcccttagttttggtttgtacatgcctgcaaagccttactctgtcgcgactaagaaatctcttgtgctcttccatgcaatcgaacatctgttttacattcgcaaggctattaggacttgggttagatgcaaacaagcggatccagagaagaagttaatatccgtgcaaacgaaaaaggagcatttattctttcaataacaaggtgtttaaggtgactatgtcaatctcaaggtacgttagtcaaatctctcggagaacataggaagtgttcgtgtgtagaaaaaggagcaaacaatacatacgtcgactctttcttttgcacgagaacgcgagtcgcgatcacaactttgctatacaagtgtggtattcacagacgtccaaaagcgtacatcaatctcagtggtttccccctctatttgcatgcaacacgtggatcacaagaaacccgaaactttcccctgtacaaccgtagtgctctgccctgaaaacttgatcggcactctcacgtcgccagcttgagactgcatctcagccagtttttttactcgtagcagaatcgacactggtatcggtatggcagaaggattgctcttccgtggacaaacaccctgttcagtggcaaagagaaagttgggtaaataaatcaagatgcaaagcaaaggggaaaaaatgccagaacgtgagaaagtaggtcgaacagaacagcctgttcatcatacatcgttttcagtggaaagttgtgtctggctggccctgatcagattccgccatttgtcctgaataagcatcatgattcattagaagaaataaaatgcacgaacaaacctaggagttgaaaaggcaattgcaccttaagatccaccgaggtgcggtacgaatatgatgagaaggctagtcttctaatctcggaccatttgccagccccatatcgggccacaccatcgaccagcttcacaacctcacacaatgtccatgctcgatgatgcttccgcttcccaccccgctttgttttgggattgtcatcagagtcgcaaaaatccttgtcctgcagaccctgaacatccttttcacaagatgtttctacatgtactcctttcttcccagtgttcttctgctagcaagttgaagaaaaatattatataacacataatacagaagtagattacacagcattaagccattgaggtactatgtgtttcaaatatatttctagtcagtacttcattctgaagttggattttcactatattgtccaacatgaagaaacatcatactagtggaacttctatggctttgcttacatggttcttccgttcaccttccttttccaaattcactacatctgcagcaggggcctcagtacattccacagaaggctcaggatcctgatgcaataaaaaaaggattcaggtagctacattgagataattataccaaatctaatagcgtatgacacatgaaaatatggttttgtcctaaattattctgaattggtatatggtgcaatatggtacatcagatcaaatggaatattggcacaatgatgaggaaactatcaaataaagactacaatggcaaaatcagttaacaaaaagttcagagatttcccacatttaatttatgaaatatagcacacggtgtttgtaggaagtaccatgggcaaagagtgaaattgtgaaaaagaaaattaataatctgcttgattgaaaatgggcatgagtctttagttagttggcttccaagaacattttcccttagataagtttcttaggtcagatgcattctgagcaggaagcaatttacaggccaaaatgcgttaacataatgctttatggaaatccatattattttgataaatagagaaggtacttgcaatctcatatcaaaagaagaaattctaaaaaggagcagaaaaaggaagcatctaacataaaaagaggacatccctaaaatagttccaaaaatggagtaaccaaatatattgttggtcctgtatacttgtatagtaatcgaatatttgcgcaaatgtcacaatgataataaatggtagtcaaattgtccagagctggaagattatataatgcataggtagacaattaccaaaaatggaatgaagttactcctagggcgcccccttctcatccttgaaacataaggcacatgcacactacaccctccaagagtatcttctctagtaggataggctgtgctcaacgaatcaacctcatgcaaaggcgctatccgtggtctcaataacacctcatcatatacatgcctttttccaggtgaagaaagtctcccagtggattcatgagtgtcaatatctgagagctcctcaatgtatctttttgttggctttctaattctcttagtagttccttgttcggcaaaaatagttacttgtggttcatcattatctgttggtactcttttgagtctcttggacgatctctgttgctcctcactatgataggaaagacttgatggtaaatctctctcatgtccaggattcattacttggtccctaaccaaattagcctcaagttccatctttggtattgcttcaaccactggtatttcttgtttggcacccatggcaataactttataatccctaacaacacaacctgaacttggaacatcacatgaattgatcaaccccattgcaatccgtcttttgagccatagcttgtccttgacagtagtttgacgcccaaatgtggctctaaatgcttcctgaagttctctcattgtaagatcatccaagcagacttctccctttaaaatggaaaaatcaggaactgaactagtaaccccagaaacagattgtcctgcagatgcctcatttacaggtttcgagcaggcatcagccttttctttatcagaagaaaggtcatttaatactgttgattttgtagtctcagtcgaagcattgtcctgttgggcaatgatatttgccccttgttctgtatttagtttatccagctgctggtcatgaacagctgaacaatttgaaggaagaactatcgaatcattcaatgtacataacctgtcttcctgtgaaatgatatgcatctatttagtgttacatcaacttgaatatgtagattgaaagaagatgtatacaggtgcatgtttagtggatggttttaagggaagtgctcaaataaaaatagattgccctgggattgtatttcacacagatcaatctcttattaccacatctttcaatgatctacagtcagtcagatatgtctcaccgcatatcctgtgttcacttaaagaactcagcatcttctcattacattgaagctcatcccatagttttgatccatccatccatctctatgtcagttcttgatgacgataaaaatatgttcctaactagtactaaacaaagttgttacatacaaaagtggaatttgttgagaccgcatacaattgaactttgaactgctaattagacaaaaaagaactaatccatatttttaccatgccagaattagcttgaaaaaaatgaccacagaggtacctaagaacaaactaaacctattatctaatagaattaacatactatctggtcataaaatgcttatactcaatcgaagatacttcacttcgattagtgagggtattgaatgaaacagaaaataggtttagtgaatcatgttcatgatgcacaatggataagcaatatacctcataggtttagtgaatcatgttcatgatgcacaatggataagcaatatacctctaagccagcatctaacttttgtgtctgtacatctgcagtgtctaatttggaaggcccctctgtgaaaatatagtaataagtcaacatctcaagtaatcaaaccaatcgaatcaattcattaatcatgctagcttgcaaactacaatttatcctcacatggcatgatattcagttatcgatctaaggaagtatgatcacccaaacagaaatgacaataaagtagaaattgagatagaataatatttctgagggcaccttcaaactcaggcttcttcactatgcaatcattagtaaaatattcctccacatgtgttacatcgtcaatagaaggcagatcatcatcaaccttctcatcatgaaggaaagtttcaaactgtaagacctcatcctccgtagcaggaataagtgttccatcaccttcaacctgaacattttattttaaagaaaatgtgtttctcaaagaactgactaaacaattggaaccaattatgtatattagtgtatagccaatagaccctatgatgagaacttacccgaactaactggtaaacaacaggatcagaattgtcattcttatcaaagtcattatcatcacttctgttgtccagagcatcttgtggaccacccacctccatagatcagtacaagcttcatccaatacccttactaatcgaagtctaccaaggtgaaattctacagtcagctaataagtttaggattaagattaagtcaattaagtaattcagcaatcctggagagtagagagaacaaatataaagaacatttgcaaggatttatgactaaacaaaaggattcaggtaattgttggacagactattgcgatatgatccacgctatctttaggcaccactctttttcccctattacaaaatgagcaaatccatgtgtggtgggaatgacaaaagcgatcacacaccatagtgagatcctcaaaatcccaccaaaaactactgaactggcagacaggggcggatccaacttgggacatgggggaacaaacaaactgttttttg

SEQ ID NO: 5724 - DNA, 520 bp, Oryza sativa
tcatcattgatttgcatcgaagtcgggggctactgtcagggttatggataccacatacctaatagtagttgactaaatctcggcaggatccaccacataccatgtcttatacggaaactgacctcgagggagttctgaataaggaaagacaaccatagttctacatggaaacgacaaggactactcggattatatccatattagtttccctaattctacttggacaagttgacacctatgggtataaatacaagcccccctaggaggagaggggagacgaacaattgacgatcaacacgatcaacacggacaacacagacgaccacctcaatcaacacacctaccacaatatacggaacaacacaagtcacaacatacaagccaacatactccaagacaagtcgccagatatcaacttcagggataggcatggctattcccctacggtatctccggatactgtcaggagagacgaaagcgctatctctaatctcgccggacacggattcgaggaggaggg

SEQ ID NO: 5725 - DNA, 663 bp, Oryza sativa
attcaggggcctgaacctgtataaaaatccctgtctccatctcttttacctcagtctcgtgtatatcctagcaccaacgatccccatactgtccaaataccgtagtcgtgacatcaaacgtcgacaagattagctatagatgatttggagccatcaatgggctatactattaaacttgctctcaaaaggcgagcagcctaggaggtagtgccgagccaaggagagggagcggagcggccaggcaaggaatcgtcgggggaggaggttgaggaatcgctgggcaggggagacggcgcggctgaaacgggccttgcggcgcacgcgcacgcgtcgggaggtctgtgaagagggtgggcgaaaggtggcgggatggcagcgagaagtggtgcaagaggagggccaccccgtgcatgcgcgtgggcatgcggcgcggccgagacgtgcgcctgtgttcggcgtgcagtgtgacgcgttggctcagagaaaacgatcgatgctttggcttggagtagtgacagggagaaaaacaatctaatgggcttttggcacatggatatgggtctctccgggatggctctatcgtttcgctccgtgtcgcttcagcgttggtacgataggcaacatggatgaccatccagagctgctcatgatgaacgactgtac

SEQ ID NO: 5726 - DNA, 313 bp, Oryza sativa
atgtgaatgtgtaataatcgatatgtcgaaacaaaaacattacacgagcgaacatccagtctctgtgtgtcgctcacgagcaggagcactgcgagctcttcttcatggcgctggtctccatgatggagccgacgtccagcgtggtccccttcagcgacagcacctcgccgccgccggcgccgccgtcgcgcatccgccgtgcctcgtcgagctccagcgccctgcgcgacacgacggcgaagatctcctcgagcagcgtgaggaaggcgcggtccacgttgtcgcccgacagcgcggacgcctcggagaagaa

SEQ ID NO: 5727 - DNA, 12305 bp, Oryza sativa
atgcttaagaaataagaaaggaacctgcagtagcgtgtttcgcaaattcagaatttcttcctcccaatgttcactttgcgagttctatgatcacacaaagtataagttttgcatgatcaagctgtactaacttaaacagagctttttcaatacatacccttagtttcgctcgaagttcttcaatttctttcctttggcgttttaataatgcagcatctgttaaaatctttacagaaagatgcgtttcaaatttatatattttgctctttgcacagaaagagtaaaatgattggcattaacagatatttcaatacctcgttaacacatgcacaatttgtaacacgtaatgctctactggcaaattgtaagctgcttttggtctcatctgcatggacctgtaacacaaaataaagtaaacagcgaggacatatgctaaaaggtaaatcaaataggaatgtttggatttaagactataatattcaatgatacctaaaaaattacttcagttgtccaaattatgctactaaatacattgcttaagcatagtttacatattgtacacattacttgagaatatcaatcaagcagtaacctgaatagataataccaagcacaacaatctagcaacatttttaaactaatccaccaatcttctttcattatgagggagagaaaactagaagaatttatgtctacttccattgtccaacaatacaggaacatgatggatagaagagagctggtacctgtgcaagagttatattacatataatggctgtattggcatttccacccagagcaggttgcaaaatccttgtcaacttactatctcggtaaggaacatgccccctgataacaaattccattagtaatcagatgaaccacaaacaacccaaagcaactaaaaccactagttaacaagttaataacttacccctgaccttctatgccttcgcttagtttcttgatgactgtaccaagggtcataagacttttgttaatgtgagagccctccttaagtttaacactttagcaacagtttttggagaccgtttgagacaacttaattttccagaattttcaacgttaaattagcatttaattcaggggcaaaaactaaaagcctatgttaaataagactacatctcatacaagacacgctggttagttttttgttttttaacattggacagttatcgaccagaacagatactcgaacagcatcacacgactctcccgcttcactttcatcaaccttttctcgactctcgattacctgagtaattagtgatgtgagaattcaaggtatgatgtgttttgtaagacaacagataatacagtggagagtaagcataccatgcgaaatatggtatgagaacgactgctgtacacattcatgtttgtttccccaatatgacggtgagctgcagttttgctcataattattaaaaatcataaatcatgaataggcagtgcaagcaagcaaataaaaaaagctcacattctccaaatgacataaactccagtacttgttcaggacaggtaacaatttcctctcttaagccagcaacatatatgcccctcttcagaagaacagcattgccatgttattaaagaatggaaaacttatgaatttcattataatatgtggattgtttacctcgatgctttcatgaatctgcaatttccgatgttccgggacaagaagatcatttatttcctcattataaatttccatataagacatgcggagaagaaattctctgtccaaatgctaaaaaaaatagtgaaaaaagtttaagttaaaaataaactcccaggttaagagtagaacatatgaaggagatcccatatcgaagacataatgggataagggtattttataaagcctctgtatataaacttagcaagtctttttggtctttaggaaaggttacatcagcattgttttggtctttatgaaaacaacatcaggatcagtttagaaagcaaccaaagtgctagaagatcacaaccaaacacatcaatatataaataaatatctcctgttgttaccatcatgcaaacaaaggatatgacagctactccctcagtttcaaattacattccattctagttttgtgctaaaccaaacatttatatctttgaaaatcaatttctacaaatttacatagttcaacatcataacgtatatgtttatagattcaccttgaaagatacttcatgatatatagttcgcatgctgttaaattatacgaatttctagaatttacctcttcgatagtcctgaatagatcatgaactgcaagaggtattatcccaggttcattaccagaccctctcattgtataagtcttcccactgttagtttgtccatatgcaaaaactgtgcctgttatgcgtgaaaacatatggttagcttttaatgcatgtatagcttggttgagaaaagaagccactgtgcctatagttagccaaaagcccaaaacaactaatctaaaacacacacaaaaaaaaactcaaataactaaaaggcacgacctaactagcttcccctagaaaacgccgctatcagcaataggatgcagaggtaccacagattattaccgttgaaacctcttactgcggagtcgacgatgtgcttggtgcgggccccgtagacgtcggcggtgcggcactcctcgccgaatatcctatctgcgagaaacgaaccctcaagccaaaaggaatcgaagctggcagcagagcaacggggcggaagggtgcgagttccttaccgaactcgaagcggatggagggctgggtggagagcgcgatggcgttgccggagacccgccacgggctgcttccagcgtcctccgccgtgagcggccgcgcccgcacggcgacgtggatccgctccatcgccgtccggtccgcctccgctgtcctgggaggaggaggcgccgccgggaagcagcggcggcggcggggctcccgtcggaggcttcagcggccggagcggagggcgaaatgggggatttcgacttttcgcgtgggtgatgccgattttgggtttcccgctagaagaaaggagagagaaagatgaaaaatactagtaggaaggactgaaacgggttcgtgttgaggcccaaaacttcgaggagcccggcccttggtgttcttatttaacgggctgaaatccaaacaaggccacattatacgctcacacttgcacagagtcggagttcagatttcgcacgaatattgctggatttctcacaaagatcagctaaggcgagtttagctccaaactttttcttcaaacttttaactttttcatcacatcaaaactttcctacacgaataaacttctaaattttccgtcacatcgttccaatttcaaccaaacttcattttggcgtgaactaaacacaccctaaacctttgtgaaattcaggttttgttttttttcccatgtcccagctcaataaggagtaaattgcatcgccggtacacgaacttgtcaagtgtgtgcaatctagtgcacgaacatgtaaaatggtcatttcggtgcatgaacttgtctggtgcggaggaaggcaaaaaggacactacatggctaatcttttttatttaggggctgattagaatactacgtaaacatatatctgagaaggttgctattagacatacacctcttcaataaaaagtagaataagatatagtgatagtagaaaaagattaaaaaaaactaagcaagatacaaagttagaaatatatgaaattcaccacttcgatgatgaaggataaagtagagaccaaatttataaatattacatgccttatatatgtcgcactatacgtatgcacgtcacattctaatcaacatcagcttcgtaaaattaacgttgtcaagttattttggtcctcgtctgcacgaactagacaaatttgtatactgaaacaaacattttataagtttgtatattaaattgcacccacctaataagtttgtgtaccaccactacaatttactcaaagaaaaactagattattttttggtgtcactcagtggctatcacgagtgacgtatcttggattcactcaatataaactcggcaacatccaatccaacatgtacacttgttcggcttcgtgaagagacgatcgttgcgtcaaagttttgtacatgcggcacggcacggtaagctcagggcgtcacgtggtcagaatggcgggaagcttcaacgacctcctccccttcaccggcgccgtcgtgtccgggaagcacccgtcggccgtcaggtcggccacctcgccgaactcggacacggtgatcgggaacggcagcaggtgccccagcaggtcctccatcgtgtcccgcgtgtacgcgtcccacgtcgcctccgccgctcgccgcaccgcgcgcacgcactccgcgctctccggctccaggaacacgccgccgccgccgccggcgtggcccatgaggtgctcgtgccacagcgacatccggaacgcgtgcacgagcccgcgcgcgcggccgctcgggccgccgttcaggtgcgccggctggtagctcccctgcgcgatctcgctgtcccggttgccggccagcgaccgctcgttgaggttcgccgagccgaccatgacgtactcgtcgtccactgcggagaagaagacggtggtgaggcggccgcagaggtgagagctcccgtggcagaggttgaagagagcttggcttaccgatcatgagcttggcgtgcacgtagatggggaaccggcggttcacctgcgcgcgccagtagtccgtgtcaacgtccggcgtctccggcggcgagtactcgccggggcgcggcgcctcccggttcccgaggcagaagaagttgaggtagtcgcaggggtgcgcctggccgcgcagcccggcgtcgtcgatggccttcgtgacgatgccgtacatcatctccacggtgagccggttccaccggaggatggcctggacggagtcgccggccggctcgccctccggccacatcggcgtcacgacgtacgccgcgaaccgctcgccccgccggatcttggcggcgaccttgagcgcgatctcgacgggcaccaggttgaggcagccggcgtcgcggtcctcggcccacgacgcgcagccgccgaggaagtactggttctcgacgtagatgaaccgccgcgcccggcggatggcctcgacgtagccggcctgtatgctccggtcgatcgtgacgtccttgccgttcgtcaggcccatcgccgccgccgccaccggctcggcggggaacccgacgaccgacgcgtcgtcgatggaccggaacacctgcacgttccacggctcgtcgtcgccgaagctgccggggtcagggagctccgcctggctaaggtcgagcagacagccggccatctccggcggcgcctgcttcctccaccgctgctcgaagttggcgagcacgtcccacgccgcgcggccctcgagcctgcagtggacgtcgtgccacggctcccgcggcccgccgcgccgcaggccggcgtgcttgaagttgttctgcatgaagtcatggcggtacgtggtgtcgaggtcccggaacagcgtgtggttctcgtcgtcgtaccggccgtcgcagaggtctatcccgccgatgaagctgacgatatggcgacggctgccgtccgcgtcgcccggcgaggcggcggcggcgtcgagggtgaccgtcttctggtggtgcgtgaactccgctgcgacctcgatgctctgcaccatggtgagcgacgcgtcggcgttgcgcgggcagaggaagcagcgcacgttggtgccctcgaagaagcgccgcgtctcctcgtcgtgtgtcctcatgaggcccccgttgccgaggaaggagacggacgtcttgtcctgccacggcatcaccagcacggccaccccctcgtcggccttccgccgcagcagctcgcccagcgtgacgccctcggcgccggggaccatccgggacgcgtcgcgcaccagcgtgatatccgcgttcaccgaccacccggcgacgtacacgaaccgccgcgcgtcgcggatggcgacgtacatgtcctcccacaggcgcgccggccggtacgcccccccgccggcgaggcggacgcccgggtcgaacccgccggacaggtgcgagttctggtacagcgtcacgcggcagccgctcctctccgggaagaacgccggcgtgacgccggcgaacccggggaggcgaacgccggcgtcccaccacgggtcggactccacgcccaagaaccgcagccggacgcggagcttcggggtgtgcgtcgcgtggccatgctcaccgccgcggaggtcgagccagccctccacgggctcacccgtggcgacgcgcgcggctggcacgcgcgcggcgccgaggacgccggcgccgacgaggtgctggctcttgacggtgaacgccacgggcgccgccgggtaggcgcagtggaggcggaacgactggttccagacggggttggtcgggtggaactccacctcgcgggtgcgcgccaccctcgccgcgccgacatcgacgtcgacgtagatcctgtgtgccagacggtgcacgcccagtgactccttcaagctctccgccgcctgttcgccggcgaaccacgtggcaccaccattaattacttgaccatcacgcacaaaaactattcacataactcttggatgaaattttggatactcgtggcatgcttttaaactgctaaacagtgcatttcgtacagaaattttccatatgaaagttgttccctccatctactttggatagtcatatttccaaatctggaaaatttatttttgatatgcatatttcaatccaacaacctatcatcttaataactttttcagatttaatgcgtgactctcaattcctccacacaagattggctacataggcatcgagaaatataaatattaatgaatcgcttgtttacgaggaatgactagtagtatatttaaatggatgataagtagaattacttatccttgttctatgtgccaagatgaaatatgactatcaaaagtagatggaggaagtgtcagattaatctatttttcaagtttataataattaaaacttaattaatcacacgttattaccgcctcgttttacgtgaaacacttaatctttattttcatctttattatcaggagattcaaacaccaccaaacttttccggtttgctcactgttcgaactgccactagaatatcagtagatttcaacggactcaaaaggatttatatttaaaaactgtgcacttgtgcagcataactgcatcagcaattcagcttgagagaacatttcggtcgggacaaacagatggaccagactgttagtggcagtaggtgatctctagctgaaaaagagaagggcatccttgacggccaatccattagctcataagcaagaagaaaccatgagagccaagcaagcgaacaccactaggccacgatcgaggagaaggaaaccaaaaaacaaaagaatctagaatgacttgtgagcgtgagtgttacggtaatcgtaccttgatgatccggccatggatggcgttgtggaggtcgtcggcctcgtacaccgtcagttcgaggacgccgtggagatggtcggcggcggcgccacgagagcccatgccgtttggcttccttccttctctgccacctcctcccgcgccgctgcgacagagaactgcttttataacgagaggagtgaaagcctcaaagggaagaaaactaaaccttgatttgctctcgcatcatgcaccttttcacaccaccattccgctgattccctactaatttttatacttagccaatgcaattaacgttgtgcagtactggtacactgctaatctctccctgtaattttgattagccaatgtaattaacattgtactactgtactagtgtatggccggctaatctctcccaacgatccaagatccacacgacaatgcagcgtggaggagagagacatttccctgaattcctaggcagcactgccggccacaaaagctaattattcttcagtgccgaaatcatcaggagaactttgttgtaggagtttcaatttgtgtggatggtttggattggttaagcaggatcgtgaacaggttgaaatggagaggttaatgatgaacatggtagtggtcgtccgagcaggaacacaaggcactcaagttcaggattaccggtaaaaagacaagcaaacttaggttcctatatcgatagtgcgccatttgaaaggccaaaactaatccagataactagaggatttccaaatcaattaatccactcaaattcagcagttaggcacatgtcattttgtggctacacaacagtggtacaattttcaaaccttggattattttgcatctgttttaccgtattgaaggaatacaacacacctggagaataaaagatatatatggctttatatgaagggtgtgtaatgtcagtcatcatgacatgaaaagagtgctgctcgttatacagaagcaatacgcatcataacaacttccacatacggataataccacaccaaacgaatgaacaacactcaacagcttatttagttcgatgccgaacaacaaacgcatcataacagaggcatccacaatgacatgtctcaaagagcataagctgttacaaatatataaataacaagcttcacaaaatgcaccaatgttcagttagaaatgcaaacctccttttagctaaagggaaagacacctttgaattttaaggagaaaagagagtttgttaccctagaaaatcacgatcttaaaacagaaagataacagagaatcacaagaaagcgagatcagcgcaacggcatgtacaatggttgttaatagcggactcttggcgttgttaattaggaatattcgttgacatgaaagagcgaaagatgagagacaaaacatcggtgctatgggtaacaacagctcaacaacgactcttagcctatataatatggaaacatggttgcatgagggtgaaaaaatggaaagaatagtaataagaagaatatttttgagtaagatcattttcgtctcaactaatgtaaaaacatggtctctaaataatcttgtattttataaaagactagaaaaattgtctatgcgttgcaacgggaagaaaatacgagaaaatttagaaaaaatcgataaacatttacattatttaattaattaaaatacattgttttgggaatacttgggtatttctaagtaggaaggtctagaattaaattaatttacaagtaaagtaaagtatgtgtgagaaataaaattacatggttgggtttaattttattaaattatccatgattaattacactctctaaaattttctcggaatttttgtaggtcaattgctaattttaataatacaaacaccatttcaatatttatttaaataaaaatcaaaccctcctttctatctagaccattttgatcccatttccttcctcagtctgcagcgagctggcccgctttcctcccttctcctcccctccgcctcagcccgcaatcgcacatccggcccatcaagcaatcaaaagtctaatcggactccccttgctcctgtcattgtcacgtagggccatcgctacaatgtcacagagtccctcagctgcctaacgcctctcctttgtaaaatttgaatgcaaccttggagataatccaaaattgattgagggtttctatccttatcttcctctcttctcgtttttccaataatcggaccaaatctgcttcatatcgagccaagaggaccctagagtttagtatgttttgcttgaagaaaaaaaatcgcatagcagatgatgacaatgacggacaaaaaatcatcccggatgcggttattattccctagaagtaaaatgaattacttttagtagtatggcaagggggctcaagccccctagccctctgaccagtggagctcccttcttttttccctatcttgtgatgcattttgcagttctctatgtttttatgtgaaattgctttaagctataatgcctgtctagtatgagaaataatgatacaatcctagtatgtttagccccgaactatcttttcctaagttcactatccctaacacactgcaatagtggaaaaattatcttttcctaaattcactatccctaactcattgcaatagtgaaaaacgtggtcataggacagtaacatcacatacaccctcgtcatatcctcaaaacatagcaaacactctctactaccatctactcaaaacacagcaaacactctctactaccatctattggtgtatcctgtatagatgcaaaaacgtcaacagaggttgtatgtcccatacaataggcagaaagcccctcctctctatggccgttggagtaaatagattattaggccatgcctgacagataaggtaaagtaatatcgtcgaagctgaaggagcaaccccaaagtgttggtccaatcattacgaataacacataaaaagaacatttgtaatttatatcactcaatttatttaaagtgttagtagtatgttctcggctactcaaattttagaccgtatacccactgttgggttgggacacagggattccggcctaatcttcgcatcatcggatcctcttcctcttctcgcggacaagataatcctcctcgttctctcctccacctctcctccatgccggatcaactatggggacaacagagtcccttctcttttgctatcttgctatgtattttgcattattcacctatgttttcatatgaaactgttttaaactataatgtttggtctaggccccatttggttaatttgttgagcgaattatctacttgattatagagatatttttttctaaacaaaattaacctaacatatatctataaacaagagattaaaataatacgatcgaacaaagtttttaaagcattgagcaaatgattcattttaataatctgataaataatgtaaaaaggaacagagctagtatgcgaaaggaaaaagtacgaattaccccctgaagtattgggtgagtacgaattacccccctaaacctgaaaaccagttatttttcaccttgaactatcgataccggatgaaaccccccctcgagcagctttataagcggttttggtctatgtggcagtccagtcagtaagttttttattaaataaaggatagggcccacctgtcagatataatcttctctctatctttttccctctcaccccctctctcactcccgttagataccggcggctgcggctcgagcgccgacagcagcgagcgccgatgccggcggctgcggctcgcgcgccggcagcagcgggcgcctcctccgctgcttcggtgggagtcgtcggaaatcatatgtgggagcttcgacttggcggtggcgctgttcaacggcggcgagttccacgcgcgccacgatgtcgtggaggagctctggtacaccaccgacgagcccacccggacgctgccggctgctccacgcatcctccagtgcgccgtcggcttccaccacctcttcaaccaagtatattttcatcgtctcatttccacatttaactatgcatattaattattactccaccagtaaaaattgtgattagacacatgatcgtgcacaaacacagaaccaccgtggtgccatgatggagctcggggaaagcctctgcaagctccgcaagctgcgtctcgacgacactacgagccccttctcccgcttcgagaaggaggtcaccgccgcgctcaacttcacctaccgcacacagaaggagctcgcggcatgcaccgacgatctctacctcaccatggatggctccgtgacctcccaccagctgcttggcaacttcgccgctgactagaagcgggagaaggagcggggcgaagcagcggtggcagagcggggcgggcggagcggcggcggccgaagcatgctggcaatagtggggtgggcgtagagggaagaggtgaggaggctagggagcaggctgaggagggagggagaggtgaggaggccagggagcgggctgagtgggcgcctcctcctccgccgtcgtcgtcgtttgagccactcccgccggagtacgacaagcccagccatactcgttgctgcgatgaccacctctggcccgacgacgaccgccgtgccccactacccttccccgacgcctgctcgctgggatctggctagagacggcggtcgcgagggagtccggcctcctcatctctcggccttcctatgcccctcgcgc

SEQ ID NO: 5728 - DNA, 19254 bp, Oryza sativa
aggagtgccgcgcagcgcggcggcgggggagaggagagaagcgcccgcctcctccctctcggcgcgcttgccgcatcccctccgcgggcgccctcttcgccgccgcccgccatcgtcccgagctccatcgcccccttcgtcgcctcgtgctctgcccgccgtcatcatcgaggtgagggaggaagaagagagtggattttggagagagacagagaggtgaggggtaaaaaagagggtgagagactgacatgtggggcccactgatttaaaaagaaaataattgctgactggactgccacgtagaccaaaaccgcttgcaaagctgcttaggggggtttttcgtccgatatcgatagttgagggtgaaaaatgactggttttcaggtttaagggggtaattcgtactcacctaatacttcaggggggtaattcgtactttttcctatgcgaaataatgagcttatgttggcatagtcctccctagtatgtttagcccctcccgtaggcctcccgtttctgagttgagaccttttacagtgtttgcattcctaaaatggcatagatctaacggctcacgatgaaaggtaccttatgaaaggtatcagaggtagaaaggtactatggattaaaaggtaattgataacagggcaattatgtttaacaacgtatggacgtaccgaaaggtatggtgtaagtggatttgaaggtaccacaaggtaccgcgtaagtagtttttaaaggtaacgtaaaatatgatttacgtggtggggacaaaaattacattctcttctattcggtttccaatcttcggtcgttctgtttgtgtcggtttccaaactttggtccgatttacgtggtacatatcatattcgcatgatcttgataattatttccagttagtcattaatttacatagcaatttggtgatccatcttttgatgaatgtaatcaaagatcgaaaggacaacaaattgagaagatttaagaacctaacaagaacaaaacaagttcaatgaggaagatttgcgaaaaaaaactaaaccaatcgtctgacagatcgagaccgtgcggccgcttctagctccggcgaacataggcagtcctggaccacttcctccgggtcctcttcctccgccgcccctccctccaaccaccgcctccggccacaagtccaccgctggccctcaattctccacctttcaacttatcgaagaacacataaaccttacgtacgaacagaacgtatctaagaacgatgcaacgcaacaggctacaagctaattccttcgataccttctcataccttttcatatgtgtaaaagacacatttgtcattctaatatcatcatatttacattaatgccacctattacaatattttctttccataccttgcccctcgcagatcaacggctcacgtcgccccacctccttgtaactcgcaaacatcgtaaaatccctcttccgagttagaatacttgatgagggtgtatcaaagtaccagtgtattaaaatgtcaattcctttagtagtaaaaatgcaagtttacattctaaatgtcaaacagttcaacacggtaaaatatataaatataccatggtgaacttgggtagttaaaaagtcaccccaaacatagagggacaaatcataaatatcgtggaaaacatataaacaaaactagcataggcaaaattttcatgaatcataagggagataaaaatgtactatattaacatagtataagggagaaaaatcatcataattttcttttatgtatatactccttccatacttataaagtaagtcgtttaggacagcgacacggttttcaaaacacaactttgacttcttgtttctataaaaatatttattgaaaagtgatatatttatacttttatgaaagtatttttcaagacaaatctatacatataatttttatattttcaaactcaacagcttgagagttatttatgatttatattcccaaggtttgacttaaacgttgtcctaaacgactttctttatgagtacagagggattactatataagagtaaaaaaggaacatttggtaaacccaaacaaattttgctgaagcaaaagtcaaaaaaaaaaaaatgcccccgaaggccaaaaccatggacaccaaggaggaagacaaacatgacatccgcccccagccaatcacgcaagcacaacacaagcacagctcaactccagtcgcatgggggcacagccgcacagaccacagccatcaaccgcgtcgaacggatggatggtcatggatatctatggcggaaaaaaaagaagtggcgctctcgcccgcccgcacgcacgcatccacccacccacgaccagcgcctcgccccgcccccgcccccgcccacctctccgaggcgaagacgacgcggccgcgaccgcatcggattggatcggatatggagaggagggaggacgcgctcctcctcctcctcgctatccccatctcctcctctccccaacctctcccctccccgtggcctgactgaccccctcctgaattcctgatcccctcacaccaccacgcggccctcggtcttccctcctcctcgccctcgcctcccccgtctggatctagcctagccccccctcccctctcgccctcgtcctcctcacgagatggactacggcgacggggaggtgcggctggtgaggaggaaggggaagaagaggctcgctccgcctccgcctccgcctccggcggcggagaggggcgagagggacaggttggacgagctccggcgggactaccgcgatgtgctcaaggtgaagggtttgccccctctggtttcccttgccctttgcggcgcggtttcgccgatgaatctccttgttcacctccttgtctgaactactaattcgctgcggttgcaattttgtattgcatatgatatctcctagtactctgctccgcttgattgcaggagtccaggggttgattgcatagctgatgtcagtgcgaaactagggttgattgcatagctgatgttagtgtgaaactaggattgattgcatagctgatgttagtgcgaaactagggctgtcaagaattggttatggttgtagcatgggatgatgacatggtcacattgatactgcatatatacacttgcactacattggacttgaatctgatagcggttcttgatgcaggataatgagatgaagaggaggaagctagagagcataaacaagcgaaagctcgtcctgctttctgaagtcaagtatgacagcacttccgtttctttcttgtccctccatgttcccatctatctactcaattgatgttaacgaagcaagctatgtgaattctatcataaatagtagtagtagtattgacccttttatcctcttcaactaatcatggaaactgttttgtttgtaaggttcttacaaaagaagttaaattctttcaagaagaatgattcgcagcaagtacggctgaagaagaaagctccgcgagtcccatctcatgtgggaatcaatgatgcttcagctttttatggggcgagtactgaagtgccatctaccagtaaaagaacagatttagatttaaatcaagattctgcaatggtatgtaacttttttttggagtgttatggatatctgacaaaacgtaatctatttctgacaactaacattgtggttttctgtaactacagaatgatgagctttctgatttcccggggcaccataaccatttggaacttaaaaaggctgaacaggctggagtagatgaagatattatgactgccgatgtcaacctatcagcttgtagggataccggaaactctccggcaagcgatgataagaggagtgtttcatggcaagaccgtgtagcgttgaaggtctagtccttccatagatgtggctatgaaataacatccttctcagatgattaactgcactctgcttatttttttctgaaatattttgcagtgctttgtatatcacaagagtcttagttagacatgccttaatgcaagctcgatctgatgatgtgatgttatgaaatatccacccagattttgaactgacgcacattgactgcatttgtctggattgtgttctgctgcatcctttggaaacatggtgacaaatcaatgttttttgtttgttgttaccatttacttctgaaatggcaactgcagcagactggcatcctggcattttgacatgtatatcatattgtaacatgtgaaatgaattatgaatatcaagcaagttgtattgtaagcaaaaggaaaacatcagcggtaagtcctgaaattaatgattaataattcaattcacattcatacaatgccatcgcgtaatttaaatgaccgttgatcataacgccattgcttcaaaactctcatatctgctgcaacattttatttctttgcattgagcttttcctggtcacgatgatgagcaagcattttctagctgtgtgtgcactgcaaattacaaaccttagctaaattacagaccttagctgaatagctgcaactccaactgtttaatgtgtttcttcccactaagatgatccgccagcattctctggctggtgcacttcaaactgcaaacctcgcaaaaatacgtagccttctgtttatccatcgtcgctgagatttttacactcttgctgctagagccatccgaagacattccttgcagagtccccaggtcactctctttcgcattccatccaagagattctaccttctgctggtgcctcgtgcttctgcggtgatgctcaagctgagattcagtgttacatttggcctggcagagactgcaaacccattccgagggttgcttattagggttctttgcaagcttgggaggattgttcttctcttgtttcgcagcttcaggcaaggcctgaactttcagctgatgcctcctgcccctaaggtggttctgcaagtctgattcacaggtacagacagcttggcaagctctgcagatccatgtcgcctcctcctcctcctccttcttcttcttcctcttcttcttctcggcgtgatggctcacattgctcggttgcgccttggttccatcgtgtgattctgaattccctgaattcttgttgctttgttccagcagggcttgggtatttgcttggtgcctcttgcccttcaggtgggtatcgaaatgccattcgccattgcagtgtacctggcaaacgctgcagctccatctggcagcgtgtgctctctgccctgcaacaggagaaggcttcgccgtcgttttcactgtcgccgtcttcgccttcaactccaatcctgccactttcgactggtgcttctgccctccataatgatcccgtaggttgcgttcgctgcttgtttgcacctcgcacacggcgcagctccatgtctgtttaataagcagtttgagtaaacaattacgaaaggaaactgcgaaattgaagtaaattggagtattacttagtccaatagatcaaaccgtactaatgccacatacatatggttgagtttgggagaactacatcaaccttacatcaaccttacatatggtttaattctttaccttacaactgaaaagaaaattagcaaagtactgaccgagcaaacaagtatctgccttacaaggagctaactttcttaacagtatgctgaagtatgaacaaatttacaaatgcagagagacgcaaaatggatggaatatatatgatcatatctgaatatcataatgtgagaagaagaaaaaaaggttagtcagaagcatacaggtacataggtttctcacctgacttgccgcagtctttccagcggcgtgccggggctcggtgacggcgacggcgaggcatcgcgcagagccatggcgcgctctatcttggcgagctcggcgacgatgatctcctgacgaagacgatcatgctggagctgcgacagcagcgcgtccctcaccaccgccaacgggtctcctgctactgcttgcacaaatccattgttgttgttcatgtgtccttggtggtcaagcacacgcaacattggaattattccacacctaaactagaactagcaaggcctaatcgctgtcaggtcaggttcctatctaagatgaacaagtttcatttgtttttatcttaacgaaaagatgaacaggaaaactcaaatcatcccctaaggggaaaagccatcaaaaaatttgaaaaaatttagtaggatagatcaatatgtgatatatcacttcacaaacatgcaaattcaaattcaacttatacaaatagaaacaaaaataacaaatttgactatgaatagcaattcatgctcaaattattatttttgtttcgaattgtataagttaaattttaactcgcatatttgcgaaaagatatatcatatattaatctatcttaacaaattttttaatactttttgaatgccatgcataaaataaggggatgtcttcttaagagacaaaaatccacttccagatgaacagacaacagtctttgagaagtcctattatcagatttgtgctatttgacatgtatgatgcatctagtttgcaatctaactgtaatgaatgcaggatggagagttcttgacatcaaaacacgatctgattatctgaaccaaagagatacgaaacggatcaccctttcgaccacagatcctgtcctaggaaggctaggtagagagggcagagagaaagagagcttcgatgcgtaccgtcggcgaagcggctaccaccggcggtgggaaactccatcggccgatcagatgaggaccggagcagagcagcgcaccgaccgggtcaccggagaaagcgagctagcaaagcagagcgcaaaaagcaaagcgttgggagatagagtagtttttttagtagaggaataagttcagatttactcccttaactagtgtgaaaagtttccgaatgagagggagaaaagtggccctcacatttttctaatgaatgacaaatgggtctatatatatatatatcttcaattttaataccgcctaagcgccacaccaatactaccatatcagtaaaaccgtcctccaaaaccactggggaagtcaaattacactgattttaatagtttgagagtcgagatatcaaacgataatattcgatcactaattaagatagtcaaagtgaacttattccttttatagggcactcgatgctaaccgggccgcgaaaccaaccaacaatggtggtgaataagctgtgttcttttttatgggttctcaacccatctctatcgtgcacgtttttttcaaactgttaaacggtacacgttttgaaaaaaagtttatatatgaaagttgctttaaaaaatcatattaattattttttaaagtttttttatagctagcacttaattaatcacgtgttaatctatcgttccatttctgtgtgaagggaaggggttcccaacccctaaaaaaacacagcctaaaaaggctgctttgttctcagttctcacgcacacctgcggacctacgttcgcatgatgcagggaaacttagtgggaaaggaaatcaagaaagaggggcgagtactattggttcaatgactaaaaatggaagtaaaaaaagagtaatattaggtcccctttgatttgtagaaaaaatgtaggaattttagaggattttaattctatggaaaaaaaatccaatgaaggcattttaaacaaaggattgaatcctatccaatcctttaaaattcctatggaatgagtaattctatgcacattttggaggaaagttagcaagaggtctaacctcttggaatatttcctctgagtctatccctctcatctgattcctgcgtttttcctgtggtctaatcaaacggtcattcctgcgtttttcctgtattttgcaatcctctgttttacaattgtattcctgtcagaatcctgtgttttttctattcctctgttttttcattcctacgattcaaaggggccctaaaaagggtacagtggaacactctaaaactacatttatttttaggaacaaatggagtgatatttaaaagatttaatggaccccaacctaaaagatatgttttgcgagatgaaattttagactaagaaggggggcgtgcattctaaaacatcattcgaaaaactaagaggggatgaagtagtattaaagatgtctactggacttcattctaaaaagattttttaagggataaattttttaggctcaaaacaatactttttggagtagtattctagggatggagggaggtaagtactaaattaacaatgtgaggctttttttttttgaaaaatgtgaggccataagtatagatgcttagaaaaaaactacccttttaatcatgcaatgcacaacttctgatacccgtataatagtttcactttgattgcaaatatgccgcataagagcaggtacaatagcaggctattagccaactataaatatattttagtgagataatagtgagagagaaaagcagcaggctacagatctgtagttggttgcagcacggactccaagacgcaatgtgtatatgacaggtggaacaatatatcaatagtatagtaagcaactatcgtatgaattggctattagatcgattatagatgaattggagctagtagtgggctatactattaaacttgctctaataacctgagatgaactatgcaggcttgctattgagagtttgtccatgagaaccatagagatgagataaggtgaagtcttgtctactttaatatatatagggctctactttaataaagtaatcatgggtaaagtcttgtccaaaaaaaaaagtaaaattaatgcaccttatattttttgcatggagtgagaattttgtattgtttgtatggaatgatactccatagaactattagtggagagcagcataaagatacgagttaaggatactcattcatcgagttacacccctgttgcataaactggcatatcatttagtttttacatgcctcaaggcaagttcgatgtaacaatgtgatatgataaaatatccactcagattttgactactctctccgtcccataaaaaaccaacctagtactgaatatgacatatgctagtactacgaatttagacatatctctgttcagatttattgtactagaatgtatcacatctagtcctatattcgtttttttcaggacaaagggagtaggcttatgtcactcagattgtgcttttttgtccttttggaaacattgtgattgtgtcctgtttaaataattaaatcgatgtttttgttggtaccattcacttgtaaaataattcaagagggcacatactcgcgtctttgagcaagagtacagtcgatatttgagtattgatttgcacaagtagtattagtggcattttaaaccgtatagattatttttgtactagtatatagaagcaattgaaaagaagcagcagcagtaagtcccaaaatcaaggattaataatctgaaataatcatacagtgccgtcgataatttaaatgttcgttgctcaaaagtcaaaacgccagcatctttaatcagaatcagacgcatctcattccgtcgcattgagctttgcctgaagcactttctcgagcttcgcctggtgcttcttcccataacgatggtcagagagcactttctcgctgttgcactgcagtttgcagatctcgcaggacaactgcaaattctcctgtttcaggtgcttcttcccagtgagatggtacgcgagcatcctctcgaaggtgcacttcacgctgcaaaccttgcaagaatacaattccaaactcaaactctccgaggttgcactggtgaagctagagccatctgaagatggtgcccggagattcagctggtgcttcatgaccttgagatggctctgcaagtctgactgacaggtgaacttagcttggcaaactctgcagatcagtgttgctgccgccgccttggttccctgtgactctggattcactgagctcttcttgttttgttccagtaaggcctgggtgttcgcttgatgcttcttccccttcaggtgggtatcgaaatcgcactcgccgttgcagctgatgttgcagatgctgcagccccatcttgctgctgcaccgggagaaggtttcgccgtcgttctcgccatggccttggttgtcttctccagtgctgcgactttggactggtgcttctgacctccgcagtgatcacgtaggttgcgctcgctggttgttcgaacctggcacacggcgcagctccatgccgagggtggcatcgacttctgaactgccggttcagatttctctgaaggcgatggtttcttggccggtgtagcctgcttgatatgcagtttcagtaaaccattagaaaatgaagttgagaccaattacgaaaatacaagtaaattagctagctagtgcaagtgcacactaattaaccccagtattactgagtctgaaagaactacattaatgtgttgactaccttgaaattgaaaagaacaaagacgaagtatagactgatcgaacaggtttgttttcttaacaatactctgatacatgtagagacacaaaattgatgggtcatggatatgactcaaaaacatgatggcatatacaagtttctcaccacagttgtaatagtctttccggcggcggcggcggcggcggcgtgccggggcgtcggcgactgcgagacatcgcgcagagccatggcgcgctctatcttggcgagctcggcgacgatgatgtccttccggaggcgatcctgctggagctgcgacagcagcgcgtccctcaccaccaccagcgagtctcctgcaagtatatgcaccagccattgttgatgatgatgttcttcgtgattgattaagcacgagcaacatgtctagtgcctaaactacaactaacaaggcttaaacgcagaagtctatcgagtgccgatccaagatggacatgtttcttctctgtttttgtaacgaaataagaaacaaacagttttgatgaaacttttctgcatcagaatctatctgtcacacaagcagatctgtgctaattacctgtatagggtatatccgttttgaaatcgacatttttatctgccatgcatgcaaagtggattcatggcatgaaaaaacgtaagatcaaatcgcatcgcatctgataatctaaacaaccaagggacacggaaagggtcatctgtttttactagcgttttactatacatcgttcggttctaagctccaattttccagcaaagaaacggccatggagacgacagtagaagatgttgatagactagagagcttcgtcgatgcataccgtgcgacggagcgtcggcgaagtccatcggccgatcagaggagcggtgcaccggagaaatcgagaagagcagagaaaaagcagagcgcagaagcagaatggtgagtggggcggcttttataggaatcaattgggccgcgtgaccagctaatgatatagagattaatggctgatttgttctcagtttctcacacactcgtcgcgtttgcaatgatttgcttagaggcaaaggaaaaacgaagcgtcacattaacgtgcaaaaaggaaataattgtcgtttaattcagactcatcgtaatagggaaagcgaatactccacattggagattacggctggttcactgtttcatactactccagtactagcactagtagcgtcggtcaaattactagtgctagcgatatccgcattggaaatcttcgaatacgtggccggtaattaagacactgggaagaactagaggtggttgctttcaatgaagcggcggggataccggtcaaacttttgtactctctctatctattttttgatagttatatttttaaatctaaaaattttatttttgatagaaatatttcaatccaacaaactattcccttaatgactttttcggatttaatgcgtgactctccattcttccacacatgattggctatatggacattgaaaaatgtaaatattaatgaattgcttgtttacgatgaatgagtagtaacatatttaaatgaatgataagtagaattatttatcattggtctgtgtgtcaagataaaatgactatcaaaagtagatgtaaggagtactacatagtctacatgtggacaatgcaaaagagaaaagttaagggcccatttcattcaaatgaaattcatataaattttagaggatctcatttctataggaatttttcctatatagccctttgaatcaaatgaatagatgctataaaatccaatgaaattcctatggaatgcttaatactccatgcaagttttagaggaattctaacttgaggtagaacctcatggaaactttccgtcgagtctttatctctcttctaattcctgcgtttttcctgtggtccaatcaaacggtcattcctgtgtttttgcaatcatctgttttatacttacatttctattaaaatcctacgttttttttctattcctacgttttttcaattctacgatttaaagggtccctaagttttttttagaaaacataaatttacatgtgtaaaacaaataatcctagataataatccgttgtccaaaaagagctaaaactgtagcaaggtgccttggaggatggcctagaggccgtaactaaatttgaaatgtttgagcaaatcctatatacttagaggatgcgttcgggaggaggaacccctcctccccggcaagcaaaacgaagcactattgcatttaaattaagtattaactatttttttttgaaaaatagattaatatggttttttaaaacaacttttgtatataaatttttgctaagataacttatgctaagatttgcttagaatcatatcaagctaacaaaagatgcatgtcgtaaacttgagtcgataatcatgtagctatttgccaaattcgggtgaagattcaccaatagaatcaatagttgatagaattagtagttgtgaggtctttatcttgtttggtttttattaatttgcttctacttttagtttttaactttgactacatactccttgtgtgagtttgcttttgtgttaaccttataataattagatgtagctcttgagcaaaggccgagatatttcattcaattatctaaaaacagatttgcttaggatgaggttttgtaaaattgtagcatcaaaatacctaggttacgtgctgtacgcccgcatgccaaaatctccgtagttctgcaaaatttatccttcaacctcatacaacttaatttttagagtttttctcattgcttggtattttttaatctgaacttttgcaccactaagaatagaaggaaagattgtttttttaataagcagaatacactatagtataaagtacagaagctttaccccaaatattttcaccaatcatgacttataagcatcaggttaaaagttaaaaccctttttggccttgtttggatcctctatgctattaaatatccctctggaatcttgctatttagaattattaaacatagattaacgacaaaatcgattccataacccctaggctattttgctagatgaatctaattatgtatattaatccatgattagcggctaattactgtagcatcactgtagcaaatcatggattaatatacctcgttagattcgtctcacaaaatagcctaggggttatggaatgggttttgtcagtaatctacgtataatactactaaatagcaagattccggatccaaacagagcctttgtttaggtttactagcttttaagccaactcttttgaatggaggatgtttttgtaagacagtgacttcgaagcctgagtttaatggtcgagtaaaaaatacactttccataatcccaaaaaactactgtgacatgtagttttttcttatggcttaaaaaagccgaaccaataaattgatttgtttgtttagacttaaacttctcataaaccgatcgtataaacctaaacaaacatggcctaaacaatctttccttcaaacaaaatggtattttttgcactgctgcaggtctgcggcaaagcggcaagcttgtactgtgtcccatcatcattacatgaaaatggagttgtgccgctccctgtgcctcttcccggcgagatgcgacgccatcatcttctcgctgctgcacctcacttcgcatatatcgcagtagtacatccgattctggtggtggtgtgcactgctgttccattcagatgcctctggcttctcggtcttcttctccgcgggctgcgcagcttcagtggtggccttgttccccgatcgcaatggcgcgaggttagaccggtgcaggagggatgcccggtgctcaaccagcgccctgggagaagtcatggtgaccttgcagagggagcaagtgatggagctcccctgggacctcggcttctttgccagtgaggttcctgaagccagctgcctcttcacaccagaggatctcctttctggtgtaagctgttccagagcaagtttgttatagagcatcaacacaacagtatcatctcaaatatcttatctcagataggtaaagtgataaataaggccagatgtgtgaacgatggtaatcctacagtttaactaactaaatatatactaatactactataaattgtacactgcaacattaaagatgaaacttgctgattttgaatagacattttatcctacacctttaaatttccacctgttcggttgcttacctcaatctgcccgtacaagtaaacacaacgaaaactgatatagtttttctagctctccacacacaattcctgatctgcaagtaaaatgctagtagatcattcttgaacttgatattgtaagctaaaatcccacataaatgggccttgattcctataagtgcctatggatttgtaaacaagctaagatgctggtgaaaggtcgatacaaagaaatatatagcgcaagtgtacactgtacaagtgtggcacagtatggcaatatggagtatgggcacatgcaaacataatctgaacagcattcttgataggtaaacatgaaaaggcagcaaaaactggggaacaacagtaacggaagcgaatcacctcatcattggaacctactcgcttctgcttgtccaatgttgcaatctcctgatctgccggcttattatcttgataacgcttctggacaagttcatcggtgtggcctccagagatggattctgtaggttttggctgctcggtgctcttgcttacattcatctcacccaacagctgcctgccatggccgtcgatggcgaaatcaccttcctcacccttctgaccagtgcaaccttgccctcctggtgtcgcccccttgccgagcaacgcctggtcggcatcagcattggccgcagtctggacaatggcatctgcctccaccttcgccaccgccgcaggctccttggccggcaatggtgtggactgctcgacatgaggagcaggctgcactggaggagccatcgccggtgacccagatggcatacaaacggcctccgccgcaggcgacttgatcggcactggtgtggactgttcgacatgaggtgcatgccgcaccggaggagccatcgccggcgacccggatggctccccacgttcctgccgctcgtcatcgtcggccggccatccccgcgcaatcggcggcgacggagagcgctccacgtgcgggtacaccgggggtgtcactgccgacgggctccggcgccaccacggggtgatctcctcgtcaccagagcgcggcgccgagagggcaccgtgcgcgtgcgcgttcgcgttcgcgttcgcctgctcctcccacggcgtgctccgccacgcgtactcccgcgccgggagcaggtcgccctgcggccacgggagcggtggcgtggcggggtggccgcgggccgcggcgaggcgcgccgccatggcgcgctccgtctcgaccagctggcacaggagcatctcccggtggatcttcgtcttgtggagctcccacagcagctcctccctccgccgccccagcgccgccgtcaccgcgtccccctgcgccggagccggcctagcttcgcgtcctttgcccatgaacacaacaccatcaaaatcaaaataaaaaataaaaaataaaaaataaaaaataaaatcactaaccccgcttacaactactgcatcatgaaaacaaatcttagcatcattcactaccaatctaccaccagatcatcatttgcaacagagataatgcgattcgtagccaaaaataaaaataaaaaaatcgcacaacgaatttgggggaataccgagggtttgggagttgggattggttaccgctcggcggggtggagtcagggaagcggaggcggcggcggtcgtcgtcgtcggcgtcggcgggatgggaggattggccgcggcgggggaactccattggcgaatccagacgggttcggccggcggaggaagggttttagccttttaggcgagagttgtgaatgcgatgaggcgggtgggcggcgatgcagccgcgcacacgatgttttggaaagttttgaactttttggggggcgtccgcttctttttgatttgggcgtgggttccggacttccgttgtgtgatcttcagaagcgatgatttgcgagaaaaataatgtgtgggtaattttcttcaaacaacggtatcatgttgtaacaggatatcatctataagacagtatgatacctgttttggtaccagctacatggtacctgatatctgtgatacctcttacccggtacttgtgatacctaggacctaatacctgtgatactcgtacaagagaatagttaatatgtctatcccgttgcaacgggatcctgttttgtagcagtcctcaattttcttttatatcgattcgagatttataaaaataatggttgaaaaaaaactacgattaaaataatcaaaattaagatttaaaatttaaattttggttgcagctgataagctaaagagcatgatcgttttctaccgtgttagtccaaagtccaaactaggggatttttcaatgcaatcttacgtgagctgaattttatatacagctttatatattaatattaaatttaggagtgaatttcatattataaatttgatcttttgtttttatatgtacaattatacttgtatgcaactaatactgtgcatctactccatttaacggggtaatacttgtataattatacttgtatgcaactaatacttgtatgatttaagctactcaatttaacggggtaaaatttattttatttttcttaataatttctagtcttaccgaacacaatggcgaagtgtgtaattagtagctaatctagtgtgcagatcagattttcacccgacacctatcatcatcttaagaaatgcgggtgaaatgcgggtgttttgttccgtacttccgttcttatgaaaaataaattaaccgtcgtaaaaattctgcagatgatgcgggagtactcgctccgtacttataaaagaaattgttttggatagagatacggttttcaaaacacaactttgactttttttataaaaatatttattgaaaagtgatatatgtatatttttttaaaagtatttttcaagacaaatctattcatataatttttatatttttaaacttaataatttaaaagttatttatgatttatatttctaaggttaacttaaaaattgtccaaaactaatacttctctttctcgaagagaacttgtgggcttttctatctcctgttcaatgcctctcctgacttgatgcgacgtgcattcagggaacagcagtcagaaaaggcgagtgcggatatcactgggcagacggagagctgataattttttcaccctgtctcacgaaataaaatgagtgaaatatttggacatatatatatatatatatatatatatatatatatatatatatatatatatatatatatatatatatataaagtattaaatatatacagaaaaaattaattagttagattacgtataaattgcgagacgaatcttttaagtctaattgcttcatgatttagcaatataacgctacagtaaatatttttttaataacggattaattagacttaataaattcatctcgtagttttatagacggattctgtaatttattttattattagactatatttaatactttaaatatgtgtctgtatatctgatgtaacgcggcaaaaattttcacatagcctaagggtgtgtttggtagagttgtggcttttggaaaagctgttgtgatctgtgggctgtggaaaagcagctgtgtaaaataaactgtgggaaaagcagaagcccgtttggttagagcagctgtgaaactgtaagttgtataagaaaggactgtttatatgcaaattactcgtacaaacctaacctaatatgttcaatattttgtatttaaaaggccaatttgtagaaaaaatgtataagtttttcatcaaaatatattagtttttcatccatcaaagtgatatggtccacataaacagagcattcatacaatgatgccatatctcaaaataactatcctcctcttcaattgttttttttggttcgcttgtcacccgatttttctgcaaacttgaaaacaacatttttccaaccggtagtggtgaaaattcccatgggtatattcccagcttctatctcttctttgcaaacatcaaacaaatgccttataaaatcatcaccccaatctgccttgtcacccattcttgaaccaaataaatttttcttcaatcaatttgcaggccaaaaatcaatttgctgtaatattctagggacaacacatgcatcaacacaagagcaggggcaggggcgattcggcctcacctttcaaaccggctagagcagtggcaaaggcatcggagcagcgtcgggcggcgtcgagcaggggtgtcttcaagcagcgtcgagcagaggtggcttcggcgcggcgtggggcggcgtcgggtgggcgacggggagacggccaccgggcgagcgacagggagacagccgtcggccatcgggcagcctggggcggcgttgggtggcgtgggggcgggcaatggggagacgggcgtcggagcatgccagcgccgggagacgcggctcgcgacgacgggagcacgctggcggcgggaacatgggtggcgcgcggtggcggtggcgcaaaccctagtgccgcgtcgaactgcgaatggccaggcgctcggtct

SEQ ID NO: 5729 - DNA, 3407 bp, Oryza sativa
ccttaaaatataaactgtacaaattaaaaaggagaaattttatcaatgggtaaaatgaatcattttcaatggttttgtggtaaaataagctaaaacatactttgaaagattaagtgacccaatgaaatagttaggataaaattaaatacacttttttctttttcgaaccatagtacaaacacacttatatatgcatgtgcatatttactcgtataaatacgtacatacatcctatattaatatgatcaccttaaggttaacgtagtaaccacctaggtttacattactgaatacgccgtggatgccggacgctggcgatatgacgaaaatcacgaaagtcattcaaaaaatttatagtttttggataaattgagtaaagaaaatttgaattcaaatcctagaagtccacttggcacgcatcaaaatccggttgagttatcgaaattccaagctagatgagcgaaatttcagatgccaacagactgcgtgcgagagaaagagcatacaaatagagaaacatacaggctcaatataggcctaaccggtctgtcatgcttcatggtctcggcccaatatgcaaatgcaaacttctttttttattttcgtcaattgaggtttcttgaaaaaaaaaagagactactttcaggatttcccccaatttttatgcaaatgcagtttattattttttttgccagtctgtaccacaaaaacatgattgtttttaggactttttccccatttttcattgtccttctcaaatttggaaaatctcaaaagtgttcgaactccctgacgaaattgtgctttcgtcccaggccggaaacaacgaaattcacgaagttcgtccggttttgatcgaattttcgagccgtgcaccatagggctttatcttttcgcttaggctaatgtttattagccaaaatttaaatttttaaacttaaatttagagctgattttaaggtttttttattgaagtttatttttcaatatttacttttagattgctaagaacacgtatataaaagttaaatcgctaagaacacgtatataaaagttttgttcacaaattatttttcatttgcaaatatgctgtttcgcttattctacaaataaccaaccgtttgcttgcgaactttctttgcttccatagtcattttcatttccatttgattttttttttgtacatacgaacttaagacagaccaaagtgtctgtgtagagagagctgcaaccaacaaggcagcagctcattacacttgcactgttgcacagtaccagcatacactaaatacttctaccgcaaatcaaataacgcatattatgttatgtattgagcatgacacagagtcagcagacgtcgacaccacctcggcgtcatcatgcatccaggtcgctcgatgtcctccagctctaaactccggccaccgccgccgccgccgcatcatatcactctgtgccgtagaaggccttctcaaagcactggatgtactccggttcgagcgcgaacagcacggacacgccgccgccgctgccgtcgtccttgtccggcgcctgcgtcacgtacgccgtgccgctgccgaacatctgcgccggcgccacgaacgccgggcgcccccacccgaagtcggcgtcgtagatgggcatcccgagccagctcaccacccacaggtccgtctccggcatgaactgcccgcgcgccgcctggttccccttctcggactccagctccaggaagtcgatcaccgagcggacgaacgcgtcgtccacgcgcgccaccgcgtgcttgatccgctccgccacgaaccccagcggctgcgacaggatgtcgcggacgggcaccgtgacgaggtcgcgcacgatggcgttgccgaagtagggcgacgggagcggcgggcggacgcgctgccggatgttggccgggacgcgcagccgcgactcggcgtcgtgggggagcccccgggcgacgcacatggcgcgccacaggtgcgcggtcaccgcgccgtacgtggacacgccgggggcgcaggcggccttgatgtcggcgaggagcttgggcgggacggagtagacgcgggtcacgaacggccgcggcagcccgttgaggtagctcggggagtacaccgggtgctcgaacgggacgtgcggcggcgagcgcgcccggaggagggtgcggtcgtgcgacggcggcgacggcgacgcggccgcggcgtcgagcccacgcgacagccccgtccacgtccggatgaactggaacgcgcccgcgccgtccatcgtgacatggtgcatgcccgtgccgacggccacgcctccacacttcaggaacgtcacctgcatcaatccaaagtttttcaattttttgaatcagcagatcctgatacgatataaaaattcatgctaaattgttacgtgcatcaattgtttgactttgatattaaaattttatctttcagagtgccaaatttcctctgctccatcaagcagccgcccagttctgaaacttttctactgtactataatctagtgatgtcaccagacaaccacacactattaatcatagatataatactccactttctccaaaatgtcaacaatggcgagctaagcatctcccgatcgtgtcgctttgtctcttcataacggctggcggttgccggttagaactcatccaacctttcagaattactacatcatgacagcaacttgtccctacttgcagccaaaaaaatcacgcgaagatccgcatgcgtctccaatacagactgcggctgattcagtagattaacattaccatcacaatcttggcatggacccagggccatttgccttatcttctgtttcttctcagatcagatgatagatggtgaactttcttcagacgacctatgctaatctgaaggattattttttcactcatgtcatcccgactaagccggtgctcgcatcctgatccgagaaccatgggctatcatggatggatctaggggggagccaaaagcaataaaaacgtcgcattcgatagaaacgataaagcgaacgggagcagtgggacaccacatgtctaaactcaatgattcagatcaggtgcaagtgttccaagttccatccagcaggtagcatgggattagctcttggtctcatggatatggaaaagataagagcttggaaatcaaagaaagcttgtgttgtgcagtcacgcctctctgtttctttctcctttcttacaaaacattagcttagctcatggttatacacgatacggcatcattcattctatataagtgctactccctaagtcgcaaaatataagggcttttagataactgtgacacatcttagtactacgattctggacaagcttctgtctagatttgtagtactagctaggatgcgtcctatctacccccaaa

SEQ ID NO: 5730 - DNA, 23294 bp, Oryza sativa
cagtagtccatcacgaagggagtacctgattaacaactaacagtctaacacagtgtgctaagcaaggtttcctcaagagaagccaggagacaaactacacaccgaaagtctcgatgcgagccatgttccgagatcagaaattcagaatgggccatctgcagagcagatagatgtcctcacagaggacagagagtcaagatcttagccttgattgatttcgctttatttctactgtgaaccgtacaagatctgaggtggagctgcatcaaatactagtcatctcatatgggaaaagctgacagttggctaatcactagtactcctccaataacaaatcaccatgggtgattgacaaaaaggtgttctagaagatcatcccaagtaaagatgttctagaaggcggtgcagaataacacactatcaggctctatgattgctcacaagtcaactgctcttttccaatactaataactagccgaattgatccaaaaccaagttgcatctcctatccagtagacacgtctcctatccaagtactctatcatgcccatgcatgagagcagaacaagaacagctactattatactccagtacaacacttacacagttatatgtatctatccaaatggtcgatgtatttgagtatttctaactgtttgtcaacgatgacagaattgcacacctagcaattaactagccacacacactaacatattaaaggctacagcttggaaacatctagcgaggtgggccccactgataattgacagcgtcgataccttacaaacacgagcacgtcgacatgtacttaatcacatactgcagaatgcaacagcaccacacgacgcagcttgcaagcttaggccagattatccagcgggttattatctacttaattacacaatacaatagaagaaacagtcacttaatcttgctcgcaaacctcgattaattaaaggagaatctagaagcagagcatcaaatcagggaggtcacgagcggcacagcaaacctatcagtccacgaaagaaacagtagaaacacgacgaacagtaactacaggaccaatcaagattttatcgagaggtgccgattttttctgttcggatttcgacgaagcttataaatttgccaagggacttatattcgaaaaaaataaaataaaatttgccaatggacggtcgacacgtcatcttgcgacccggtttgcaaattgcaagtccgagtcgacctgtgtgttaactgcatcgagacactgttcaggtgggtcccactacgacgtagccccacatgacagtggggcgatatttatgaggctgaccaaacggcttgtactcgtttgtacttttccaccgacgtgccacgcaaagaaaaagaaatacaaagaaaaaaaatactactactcctttttttttcccggaataatacgaggagaaatttacccaaggggggggggggtaaaaaggtggagaaagttaaccatgatgggggtggggtgattaattaacggagaattggagaatacctggaccatggcgaggacgcaggggggctcgccggaggcggcgaaggggacgaggaggcggcgggcctcgggggagggctcgaagtcggtgaacatctcgtcgccggtgaagtcggccctggcgacgacaaacagcgccccctcgccgttgcagtcgatctcgagccggccgccgggccccgccgccagccgccccgccagcgggtagaacggcaccagcgccctcgccagcgcctcccgcagcctctccggtgcgaagaacccctccgcctccgcctccgcccccgcatccgccggcggcggcgagggcgcggggtagtagtagaccagcggggtgtgcgtcttgggcacggcgaggtcgaggttggagagccacagcgcgtgctgcggcgtcgcctcgctcggcgccaccagcgtcgtctccaccacctccaccttcatctcgccctctctacctctctgtgtgtgtgtggatgccttgcttgtgacagcggcttgggtgtgaatttctgtgtgtgcaaagaagggagaaagggcgtgagggggtttataggcggaaaggaaaggtggaagaggattaatgcgatgggaataacgtttattttttttattactactatattattgtttcttttgggagacaagattaattctgctaggtgatgactgtcacaactgtccaatttggacagaaactttaataccgaaaagcagcttcttgtacaagtttttcttatgaatatttttatattataagttgctcttaatcgatcaaatttgtagaaaaaatagcaacatatataataccaaattaattatattaaatacaatattgaacatatttgttttatattaaaatgttgttatattttcttataaacttgattaaacttaaaaaattttgactagaaaaaaatcatagtgacttgtaatatgaaatagagggagtactgtgtactgttaagcattaaaatctggttgaaaaaactgaataacgacagaaccaaagatctaattatcaataaaggtgtattgatacaccgagagttggcaaatggatggattttttttttcgattccgtttgtatgaaagtttggctgtgggaagtgggatttgggaacatgagaatattagagtcttggttttatctctcccaccatcccataggttatttttttcgtcctataaaaaataaaaccagtacgaaaatataatatattctaataatatgattttgtgtcgcattttgtttcgtggtattagaatatatcacatcttatacaaggattatttttatgggatatagagtattttaattgccaagcgtcctaataatattgcaatataaaggatttgtggtgagtcgacatataaagatataagagtagcattcaagtttgaaacttcgaaatttaggaaaaatgttatcatccacaaccaaataatatgaaaaaaaatgttttgggggttttctagacaaaaccattatccaaatctcctttgaagatataggtggtgtttgtagtgtttcacgtaaaataagggggtaataacatgtgattaattaagttttaattattccaaacttaaaaaatgattaatctgatattttggaacaactttcatataaaaagtttttgcacgaaacataccgtttagtagtttgaaaagcgtgccacgaaaatccaaattttcatccacttcttacagaagaaacgaacgggaccatagaagtctttaaaatttcaatactccttccaccctcacatgcttcgatgttatttttatttcagaaagtttgtcgacaaacaactttattacaactaattttcgttgcaatttcgtactttcaaacttgttttgtgccttcaattttcaacacaaattgtcttatatatcacacattcgtttctatgtgacattacatgcttttttttagataatggaatagagcatcccggcctttgctcaaaaagttatagccaattattacaatctcacactcaaaatgagtgaagttcaaggaaacttaaaagacgaaaccaaccatcaagaagaaacaaactaaagattgccaacccaagataaagagtacacaatttattgaattctgtttgtgaatctccattcaaaattgacaaaaaattgcataaccgttgtctcaagaatacgacatgcagcttttaaaagctcactatcttcctcacacttttgtagttgtgcccaagaccggagccaatgtgttggcctgaaaactacctgcatgtatgaaataaatggtgacttgttaaaaatgacatcattcctactcaaccatagagcgcaacatataacagatgctcctatgaaaataagttttcttttttttttcacccctagaagccaattatcaaaaatatgtgatataccatgaggaaggtaaagaacaaaagaaaactgaactgctctccataaaaacttttcataatgatactccacaaatagatgttgaatagtctcatttttcatacagaaacaacatctcaagctaccattccaatttctcgtggccaaattatctttagctaatacaacccctttaagcaagtaccacataaaaattttaattttaagaggcatccaaagtttccaaataatcttgtttatctcaatataaccattgtttattaaggctaaatacatcgaccgaacagtaaattgaccattttgatgataattccatcgaaaacaatcattcagttgactcaactgaatatgcacaatagaagcacacaagttataccaatttgctaaattctgatcaaccaaagctcttctaaaagaaatattcagcggaacagatctcataacattaataattgaagaattcttccttcgaacaatggcatatagagacggacacttgtctttaaaagccacgttacctatccatttatcttcccaaaatctagtttgttcctcattattaaccaatccagaaacccatatttaagaaagtatttttaactttaatgagacctgaccagaaatgagaatcccttgtttcatatcaacttgagttatagaacgattagagagatacttctttttcaataagtcctgctaaaccccttgcttatttattaacttgaacaatcatttactcaaaagacatttattttggatctccttttgtaacgttacatgctatgactcgaaaatcttagaaagctcatcaacaagcaagcgtagccgattttcattatagttttaactttatttacttgtttcattccttcatctttccacgcaaattgtcattttttatcacacatggacaaccatccatactaaccttattttgcaatacttccatgaacaacaagatgaagctaaggacgttatagagtggcaaaggagtccatgtaagttgccttttaggcatctcgacaagttttcttcttgccactagtgcatgatcatgattgcacattgcgccaagtcaatcttttagtgtagcgccccacattgatgtccttccacataataaaagtatgttaatcgcaagctaattgtgttcatttgtgcttgtagcctctgtcaaaaattttcatgacttcattgagggccggtcgagtacatacccttaaaaaaataaagtgcacaagcagtccttaaatttgtaggatgtgtcatctaagtctataaactctcaaaatacatatccaagtctcagaacttatcaaagtgtgttatcaaggtcctaaattgtcacatctcatccaggatcctacatgacgctgatttggtatgccacacagatgtgacgtggcatcaccttgactgaaaaatggaactcacttaattttttttctttttttttcttctctttttcttctacttctgtttttcttctcctccttttttttttcttctcctttctatgtgactcgagatgtggcggtggcttagagttacagtgagaggaaggagaagaaaggaaaaaaaaagagatgaaaaaaaaaaagaaaaggagaaggaaacaatgaaaaggaaaaaaattttaagtgggttccatttatcagttaaaattatgtcacgtcacacctgtgtgacatgtcacatcagcgccatgtaggattctacaagagttgtggcgatacatcctacaagtttaaagaccgctcatgcactttataaaaaaataaatttaataatgttgtcacgagttcattttcctcttcacatagaccaaagtacgaaactacattgtcatggagcatccaacacaatatcatcgtttatcttcatacgaatgcatctgttatatctctatgaaccaacactactttcggccttgtcacacagtcctcccgtcacatagccgtccatctctcacccctgatgacaacagccgtagcgtgcatcacgttctcaacataaggaagaagacgacacatagaaccaaacaaagcataaagaaaagcatttttagagagtgccaacagacagctgattacgcaccgatagaaaacttgaaaacggatggtattttttccaaatctttttcacgttagcaatagcagctttttaacacgtctgcatcgggatggtattttttggctacaattgcgaaaggtgctagtaaaaaatgacttgtcggaccacattattcaacaaagattaattatgcagtaatcaattagcctttcgctgtactactactcgctgatcacgtgcattatttactggccccaacacagggaatgtttaatcctgcatcggcgcttaattgccgggcgcccgttgaaatttgcagcctcgacgccgatggtttaaattttgcatttaaatttaaactacacccgggaaacttgtctcctgtctcgattgatcagcaccagtacctttcgtggtttgtactagctaatcttcttttcatctgcggtttccttttcatgtcccggttttttctccgttcctatccttgcgtgaggtaaggatatgcatgcggacgtgtttcgccgcttggttaattgcagcaatcgagtatcttttttctttttttttttgaacgacttgacgatgccgccaatttcatttaatagtggagacgaaaactgtaaaaaaagataaaagtatagaaaacaaaagcaatcgagtttcttgagagctgacgtgtcctgtttagacttaggtcatgcatgagatagataaaattgatggattatcttacttattatatctatgtcaaagtgtaaacgagtgatttataaaaaggttacttttagaacagtattccaagacatatagaaattgttttttttaaagaaaggaaccgcttagaaagcgtgcaaactaaaatctataaaatctagagtcataaaacaaatactagaagtttagttcacatggttaaattaagttgggtacggaatgaaaacatagttaatcttaaattttaaaaactttaaattaatttaaggcatttttgtcgttttcatcgtgtaaccatagcatatgtcttaaatcgtctaaagtgaaagtgcaaaagaaaaaaaaaatcttatttaaaagatttaataaattattttttattaaagcagtgttgatcctccctccgtcctattttgactttttgcttgcactgtttcaccatccgtcttattaaaaaaattttgaaattattatttattttttttacttactttattatcaaaagtattgtaagcacaacttttcatttttatatttgtacaatttttttaaataagacgagtgatcaaacagtgcaaacaaaatttcaaaatcccttatagtatactccagatggagtatattataagccctagaaaaaacaaacaaacaaatcactacgtttttggcgaagttttggcgtggttaattacaatatcaaggtgtggttttgttctttctcctcagttcattgatctgccatgcttgcttttattgcctggtttgtgccggtctccgtcgtccggcccatgcatcctggattaattcccggtcgacagaattgtgaagttgatacagtataactaatacagtattcactactagaaaggtagggtctttttttaggcgaacataacccttgaagccaaatgaccgcctacaaaaatataaattagggtgattttcacaggcggaccacttaagcagcgtcagcgaaaatctattttcacagatgaaccttatgtggtccgcctgtaaaaatcgtacctattctaaaaaaaatctcaagtacttatcttcttctccaccccctccccaccactcatttccctctctcaactctctctctctctccctcaacacttctccctccaccgggtgggccatccccctcccctcccctcccctccctcactccaccggcggcgcggacgtagcggcggcggcagcgtggacggctcccctcccctcccagatccgcccgaaggaaggcttgggaaggccggcgccggtggctcccctcccctcccctcccagatccggccgagggaggtcggcggcggcgaggcacgtggcggtggcagtggggcgaggcgtgtcccgcaatttttttcgttcattggatttcataggcgggctgttgccccgactattttcgtagttgttggtttgtagacggtccttcccctatctgaaaagattacttttggccatctgcaaaaatgatttttctagtagtgattacttcaacttaaatccggtcttaatctagagctatcaaagtacattgcaagtagtagtgtgtactatatcgacaccggcgggttctattgcaatactataaaacacggatacttagcgtgcttgacttgtaatattcgacatcatcgaattgcagaaatattagtgctcaattcaactttacacagtataagtactacgtaaaatatgactcacaaggatatatgttcaataataattgaataatctactctctggagttatatgccagtgcgtacaaatcaaattaaagaagcacaacaagcaactagaacggcagccacaggtttgaaattgtcttcggtcagaactaagctagtgctcatagaaccaagctaattaaacattttcatccatctatcaatggtgccattatattcttgctttcgtgccagtgtttgcagtcatccattcgtcgcaggatcggtatcaatatctttaatcaatctgggtaatgttaattgaagcttattaaattgctaaccgatcggtgtagcctttattaatctgttagtggatgtccatcatgctatggcacatattcatcgtctatccaattggtcactgaattgttatttaattagtgaattctttctgaacttttttaggtaaggaagattcttgcttaaccactgtaattagtactctgttttgtttagtgaattgatgtacagataggttatctgctgatctttgatttttggaaattttctgttcatgtatacttggtacatcctccctatgtccatatcatcctctctcgatttcagaatatatcaatccagaatcgaatgagatatatcatagtattgtacaaatctagatacgatatctgtctatattcgtagcactacgatacatcccattcgatgttaggttattacaatatattataagacaaaagaagtatataaaagtgagattttaaaggagtttgaaatgtgcactgccactcttggtactagtctaggtctggtacactctactatacgatagtttctggtcaatggtcatgtgctcgagctcgtcgtaaatctgcatcactcaaaagataaacctgccccttccgtacaagcatacctggaacactgatttgtttagattcgtgatagaagtaaacaactgagccgtatcatctaaagttcaatgtcctcgtgttcaatccccgtgttttactcaaactgcaggtgtttctttgtgtacgcagtctcgcctctcgcgctgacggacggagaccgcaaatggtcatgaaaacttgcgagagaacgcgacgtttttctgagcacgtcgccttcgccgcctcaccgggtatacggccgaacccgcgggacacggccggccaaggcggtgcctcctctgatttcctcgccgcgtgacgtcgcagccgccgtgcgccgtgcgcggcgtggctggaaaaagaaaaatcagcgatcgatatgcacaaagtcagcgatcgatatgcacgataaatcggtaatcgagtagttatcgctaaaaaaagggaacagatttcacaaagtaaaaaacttatattcctacaggcccaaaattgcatggatgaaagttcaaagcagaaaattttggccgataacaacgcgaattttgtccatggcctgacgatttatattgacaaataggaagcacatggttcgaacttcgaactttggttgataaaaaagatgatgaacggtcggtgttatgccaaataaaaagatgaatatagcttaactggttaagttaagtttctagtgctaaaatatatccatcccggttttaattctatgttcacacgtgccctcgtatttacgtataatatatcttttttttaaaaaggaacttttcttcatcgatctaaagatatattagtcaagtatcataaaatttatgaaaagtgaaaatttaataaattgtattggttgtatcctagtctttattggttgagtcttaggccctgtttagatcccaccctaaaatttttcaccctgtcacattgaacgtttgaacacctgtataaatattaaatataggctaaaaaataactaattgcacggattgcgactaatttgcgagacgaatattttaagcctaattactctatgatttgacaatgtggtgctacattaaatatttactaatgatagattaattagaattaataaatttgtctcgcggtttactggcggattctgtaattagttttttttattagtactcaaacacccccatatgacaccctatataatacccgatgtaacacgtcaaaactttacacccctggatctaaacacccccttagttctttcaaatgcctagctccaccactatttacattccatttcctcgtttcaatgtggcttaatatgtaggggtgaaaacggagcggatttggacggacagtggtcataccatattctaaaccatattttttaagcggattcggagcgggtgtggatagtgtacggatgcggatgcggagcagattgtttcggatgtcagaaatggtgtggagttagtgcggaatcggttcggaaacggattaaatttatcggatgttacgtgtgtacgcaatcaatacaacatcgagttagcaatgcaaggaacaataatacaataatcaataaacgactcatcgtaataattatatgcttaggtgttaaacaacataaatacataatgtccataatataaaaaatacaactacacaagtgtgaaatgagacgatgaaagcttcatactaaaaaaatctaggttaattgatgaattaggccattggatggaccaacttatgttatattctatagataaagtggttacatgtgttgataatttcggattatccgacaaacagcctatcggataatctgatagaaatgtcagataatccgcatctgctggattttagatataccatattctcatctgcatccgcatcatatatactatccacatccgcatccgtatccgccgaatttcttaaaaacctataccatatccttatttcagactgattcagagcggatcagatcggatcggataatatccgatctgttttcacccctattaatatgtactcttatcaagagcaagtttaatatttatggtgtaatataactttacgagtgagcccgtaaatagtggattgttgttaaaactattatgaggaatattaaaaaagctcggatcggataatatccgatctgttttcacccctagtaatatgtactcttatcaagagcaagtttaatatttatggtgtaatataactttacgagtgagcccataaatagtggattgttgttaaaacaattatggggaatattaaaaaacctgccttgtgaataaaaaattttcagatttaactacattataattatattataacttttttttagaattacacagtacaacgcagacactcacaacgcacgcgcactcgcctagaaaattcgctcccacccaagaccttaggtgctaaggaggctcttgtaaccaatagactacatgccctttcgctataagttacataaaaactatggtttagttagctaacatcgggatcttacgcaggacatatgtgaaaatttcttttattttttccttcatgccaaatctaaaagtttttggagcaaaaatcttacgaaagttttctaacaattccgttcccattacaatatagttagaatttaacatgagatgaaaaaaaaatgcttcaattcttatttatataagacgcaccctaagctagtgctattcccaagaatacatatggctcattagtaatgcaattagtcttcagggtttttttttttcatactttgtggttgctctcaacgaatttgggaacccaatttgctcggcctagaccggacgtacgtggcggccggggtgtgtcaggcggcgatcgaacgcatgcacgcgtacgtgcaaacagcacagcggtgcggctcaccgtgcatcgacgtggagacttgtggacgcctcctgtcaactgccactgccaatcatcgccccaaagccgtggaagcggcgcgcggctcacgcgacgtgccgacgccccacacgacgcctccccccaccggaggacgtacggctgcgaggctcacgtgacgccgcgcgcgcgcggccggtccgccccgttggtttggttggttggttggttggttggtggagtcgtggagagagctggagatgcatgcatggccggatgggggtgacggcctgacgggcgaacgctggctggctgaacgagccacactgaacacaagtcactgccctgaacacccgtcactgttgatcacaatgtgacatatatactgatctctgatgctactcttaacattgacattttccctactaacgtgtctatggttcttaccattgcttatatcattaataatggttcctccaaagcaactttaaacatcctgatcacaatgtggcatatctggaaagctagaaatgatcaaaaaatttcggggggaaacaaggagccgactcaggtatacaaggcggctgaagcaatgagcaaaacatacacgaatctttcttctcatactttgttgcatgtagatcaaaacgaggagacaatcagaagatttgataaatcacctaatgcatggtccccgatgttatactgatgctacctggaacaatggccaaacaggacttggaattttcttccatataccaaccactcataatgctatcttcattaaagccacaaccttagtggcccaatctcctttgcatgctgaattgatggctcttcaacttgctatggaacttgtcaaacttcttaacattcttgcaaaaaaaaaggaactttgaagaagaaccagggcactggagtctaagaccaatatggagtcaaatctgttcaagaattccagaatgtcttttgcaggttagctgaatcccaagggagataaacaagtcagcagataggttagctaaagaagcaaaatccaagcagccttctgctcctgttttcatttgtcaaaacatatctcatctagcctatcgttatgcaaactctgtcagagacaacatcagtctcagaaaatttgtaatctagcatgttctatgcttctaagttggaataaagtgctctttagttttctttttttaaaaaaaaaaatcatgtcgcccagtacgcggggacgtggagacttgtggacgcttcgtgccattgccaagcgcaaatggtccgtcgatggatggagatgggtgaagccgtgaaggggtgaacactgacaagtgacagctcgaagaccgcccttgctaggctaaatccgtcgcttaggctgaatccgacgctgaaatatcttgaattgagtgttcttgaagtactagtgcagggccaatggattgaggcccatgcttcaagtccaacgccgcgaatcgcatatcggcatcagtatcgtcaaattaaggaaaaagtacaccgaaggtccctcaacttgtcattgagctataaaatcatcccccaaccgtaaacgcatcccccaacttacaaaaccagttttatccgacgtggcggctgagtcagcgtggaacccacgtctcaggataccatgtcgacaggccagcctctcccttcctctcctttcctcctctctctcacacacacacacactcttctctctagactgggcaggccggccagcggtagggaggaggtcgctggggcaaggaggtccgacggccggccggcgacgcggcggcggagacacgggagaaggggagggtagcggcagggcgaggcggcatcggcgggcgagcacggtggcggagaggcggcggtggttgcgacgtgggaggggaggctgccgccgacccagaagcggaagccgaaggcgatggcgtggcgagcgtggaggcagaggaaggccatggtgacagacgccacgtgcgcgaacaccctcgcggcggcgcaacacggcaaagagcttcctggggcagcgaggtcgacgatggcggccgcccacagcgacgtctccgttagacatggcaacgggaaattccccgtcggagattacaccaccagacccgcctccgcggacgagaatttcccccatcaccatcagcgtgaaatgcaacggggcaacatctttcaccatcaccttctccgtgcgggtaatttatccccgtggagcctccatccccgcgagccttcatcctcggcgtcctcggtgccgccgagagaccgagacgagcggcgccgggacttggcggcgtgatggccttgcgcgagcgtgggcgcagcgagcggcagccttgcgtggatgacggcggcgctaggacctgctgaggcggcgcggcggccctgcgcggacgacggcggcggctggacctggcggcgcagcggccctgcgcgggcgcgggcgcggcggcatggggacctgctgcggtggcgccggaccctggcggcgcaacggccctgcgcggacgacggcagcgtcgggacctgctgcggtggccctgcgtgggctctggcgcgccgctagctacctatgacggcgtggggattggggacggaagggataagggattggaatggctagggttttgtaaatgctttatatactctatattttgggcctggtttttatgggccagatgggccaaatatacataataatactacatatacactattatgtcgggcctccacggagagcggggacgggggacggttaaccaaacccgcctccaccagacccaatggagggtgtttttgctccatttaatcctccgtggagacatattttataccaccctcgcctcataataggaggattcaccgtggagaatcggaggacgggaaccattgccatctctagtcctcatggaggcggtgatggccgacgcgtggaggaagcggggcggagcccgagatgtctggatcgcgaaggatggccggtacgccggtcggtgatgggcgcaagcacccggctttagcggcgaggccctccaggttgggtgccgagggcgatgacgacgtccagtgcggcgtccagcggccaccacgctcgcccacgccgtcgccttcggcttccacttctgggtcggcgccggcctcccctcccgcgtcgcaaccgccgccgcctcttcgccaccgcgctcgctcgccgacgccgcctcgctcagtctagagagaagaatgagagagagagagaggaggaaaggagaggaagggagaggctagcctattgacgtggcatcctgacatgtggggcccgcgtgggtcccatgttgactcagccatcatgtcggacaaaaccagggtcagaaccgtcgaaggacctagtttgcactggttttgtaagttcgggggtacgttgtatccggttttgtggttgggggatgatttagtaactcgaggacaagttgagggaccttcggtgtactttttccttccagcaaaccacgccaacagcccaacagtccatgaggcaacaaccgcgcgccgtggtggttggcccgacccaccgagcagaacacgatcgcggcgcccaaccccacgcatgctcccgcccccgcgacggcttgggttgggtggcggctaggggtgaaaacggtacggaaatttccgagaattccggctaccgttttcggtttgcaccgaccgtttcaatcggtatcggtaattgtcggtatcggaaatggaaacggtaatctttttcggaaatggtagcggaaatgatatggggttttttccgaccgttttgtcggtaaccgttttttatcggtaatttccgtcaaatttccgacaaaattccgaaaaaggaagtcggctgggcctggctagcaggaggaggaccccattatgcattaaggagcagcccattccgaataaagaagccaactaggcctgaccgcatcgtcgtcttcatcggcgctggggcaccgccgcgccgtgttgggcgccgccaccaggtcgcggacgccggccgcaacctctttcgccccgacggcctccgtcgcagccggccacctttccctcccccatgctccaccgccggcttccgtgccaccgagccaagcgccgagcgccgccgcaccgccccagccttcttctccccaccgatgccgcccctttctcctctctccttcccccaccgccgccttgcgccaggccgccatctccggcgcttctctcctctcgggcgcgcgtgaaggagccaaaggcagagaagagaacaagagagaaaccagagaagaaatcgagagagcaggaaaaggacccgagagaagggaaggataagagagagagaaaataaaagaaagagaggaaaagaaaggctgtgggatccaccggcgggccccaccatcttgactcctctctgtgatcgacctggaaataccaaaaagtctagtttagcatgaaacttaattccaacggtagttaacagtgtcaacataaagttcttatgcaatgtgccactgtaggacgacgataaagcaatgccatttgatgatgaaataatgaatgatatttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttgtcaatcttattgtcaacttattaatcatcatataacggtgttgtgtggcagcataatgatgcaagggtgaaatataaggttatcttcatacatagttaaatgcgggatgataccacagttcgctgtttccgacatgaattttcgacttccgtccgatatcggtatattcccgttccgacggttccgtttccgagataccgatataaccgatatccttaccgtttccgagtatacgttccgattccattttcgagaaaataaaatgaaaatggaaatggtagagggtttttccgaccgtttccgaccgttttcatccctagcggcggctgcttcggcctgcgcctgcctctcggctcgatctccggccgtcgcgagcgagtgttggctggccgctttgcgtgaccggcccaggctcccagcgatagctccagtaagagcaggtttaatagtacagctataatagctggcggtaaaaatgcttatctcagcaaaaaattgagcctgaatgtacaatagctagctattgagttggtaaacacgagtccctataaatcactttataattttctactctaatttgtgtccctacccgtccttctatcctctctacgcagtgcattgggaggtgtataacaagggctgttgcagccaacatcgatggaaaggttggctgcaatgcctcgtttcgtgtgtgtagccaggcgacaggattagcgcccgttcctttctctctcatcgtttctcacccttccagctcagattatgttgacgtggatgagtataccgcctgctgactggactttattgtatgtaacaggcaaagcagcttttacaccttttagcgggctcccggcgcaagaacggcgtgtcgctcgaggacaaccccgcgggcgggctgattctagaatcgtttcgctcttggttttgaggcttatctggctcttagctaaataaactcaatcatatactctcttcgtccaaaaaaaaaactcaacctaaaaacgaatgtgacccctcaatctaggagggaatatctaggaggggttacattctcttttagattaagttttttttggacggagggagtaagtaaatatttcgagtcaacaaaaaaaacttgctatcattcgtttggtttgcaacgaaattttgtctttgcctaattatttggtttaatttcggcataacctatgggtacaaatttagaggcaattcaaagaagctcatttgtcaaaactttagcaatggctagcagatcaccggatccattccctatcacttccacatcaatagagacatgaaaagatgtataaaaccatgtccatttgtttgctatcaagaacattacataagtaaacaatgtacatagatatatggtgggttttctctttattatcgatctattctcgagtaaaagcaatcatcaatgtctcacccttcagttgtatattcaaaaaatttacgtaattatcatttattttttttagttgttccaaataagccgtgacccttgagtcatgttgctaagcagctgatatcacaggtaggatcctatagggactggttttttaagcataacaaagatatttaaatttagattttaaatttgaattcttgtcaaatttcgcacatcaccagtcgcaggaacccatctctcctatccactcctctgttcccctcgccctctcttcccttgcgtattctaggaaatagattctaatccctcaagatctttttcttccaaattcaatgcaaacaatcataattttgtttttaaaataatgataatgtgaaatagtgacatctagcactaaggctgcattcgtttgtttgtgttctcctctcctctcctctgttttccgtgtgcacacgctttttcaaattgctaaacagtgtaatttttttaaaaatttctatagaaaagttgctttaagaaattatattaatctattttcaagttagttttagttaatacttaattaattatgtgctaatgagctggtccgttttccgtgtcgaagagggaaagttccctagcaacactaatgaaagcagcctaaattaagttcaaattcaacctgcacattaagaaaaaaacaaattcgggtatgaatagtaccactactattcatctttcgtattaatttttcttttttatatctcaactagttgggtggcccgcgcaattacacgactagcacccacacaaaattatcgtttttacacatggttttctttaaaatttgttaaatagtcatcatgttgtctcatgattttaaaagatcggatattattgccaccgtgtttttaattttatagtttttaaaattcacaccagtcttcaccccttactccttcgccatcatctattcttactcgacatgctacaacttttattcatccccctctacagtttttactgttcgttgtctcgtcaggtctagttttatagatttagaagttccatcaaaacgtcagcactatactcctctatgcacacccgctgacctcctttattgtcattaggattttaaatcaaatagtattgcagttaattcgttttaacttagttctgtcaaccatcagaaccgtgcttcttcacaccttgctgatcgcctcttctcctaattgtcatttggattctaaaaatcaaacctaatcattatttaggggttttggtttatggttttcacatatcccagtaaccgccaccaccctaccttcacagttgtctgctatccctctcctatttaatgtcatttgtctatgtcgtgtttaatgtatcatgttctttcaaaatttcttatttcttattctatctgttttatttataagctgtattcctacttaagcacttatttttattttactaattttgcaatttattttttattcatatttttagttaatccatgttgtattctatataaactgttctttcaatatttatttttatgtcaaattttagctatttctaaatcgtgttcttactcaaattctcattcttatttttctatttcagaattcttttattgtttatttgaattgtaattgatttcttattgtgttgtacatgtactttcaacagtgattttagttatttataaattgtatttctacttgaaactcttttttataatttcaaaattcattcttttttctttcgaaatttacttaatctcgtattgtgttctacatgaactattgcttcaatattacttattttattccgaatttgaattatatctacattgtatttctacgtgaactcttttttttctaatttcagaatttattttatttttattctgaattttaattaatctctaattgtgttcttcctttactcttctttacatatttattattttttattctgaatttcagttatttctaatttgtatacttgtttgaactctttttttctttttcttcgtttaacatgggaatttgtagcatccatagtgaacgtggtgtctacttctaatgttgttttaataatatgatagatttgacagaatgactcgcacaattacgtggctagcatggatacaaatttacattatatgcaaaattatatatatctttttctacatataatcatctttatagtttaatttgcaaagtttacccaccaccgtcttcatgctcttgtgtcatcactctagttgcttgcccgtcgccacttctattcttgtccttgggaaaaaaaacccaaacatttgtgtttttaaagttgaatcttaatgttgtggaggctatatttttatagctttctaaaagttcctgtagccgccaatttctttccttcactttgatctatggcatgaccgtagccgccagtgtcattacacgaccaagccgcccagggagttcccggcaaacagcccgcaaaaaccaaccataagcaataaatacaaccgcctatgtcagcgacattgggctatgctatcagcttaatgttttcaccgttagtttctgtttagatagaatcaaatgtcgaacctgatttcttttatgttatttacttttccttctgtattcgaccatgatttattcatcaaataatccgcttatatatattagcactaccacaacttcgatacattttcaaatatacgtatcaaatatctcggctatatataatatagacccacttgatccaacggtacagatatttttgtttttcaccaattaacaattcctaagactatacggatcaagcaatgtggtgcatttttttagctatttttattggatattatttatcgatttcatattttggaaatacgaaaggtggcttgacgtgtgaaaaatcgggaacatagatttttctttaaacaacaataaaatagataacatatttgattaaatggcaataaaaatttatttttgttcttgtatatttaacttgcctttttctgttgtcatttacgttcatgtatttaattgcctttttctcagtatatgcatgatggccaacagtctataatcaccattccaagtacacgttggagagtgccgcgccagctagtttgtttgcctgttcgtatgcatcgagcagaatcttttgcttttatttttcattaataggatgtatgtttctgatcctctacgtgaatcctagagagtcatagacaaacagacatactactgatccgtttcagcaagtactcttgatcattttcgaattggagtttgattctgacacactatgtacctaattttgcacacgcgcagcagaattgtattatgtcaacaactctaatatctgttatagtccaatcaatctgcaccgctataatctaaacctgttgtgatccatcggtgtggatatttatttttttctcagattaacgtgggaatttctagtctccacagcgaacgcggtgcctcctttcaaggttgttttgataatataactagctaggtggcctgcgcaattgcgcggctagcacccatacaaaattatctattttgtaatatggttttacttaaaatttattaaatagctatcttattgacttaagacattaaaagacaaaacattatcatccttttgcttctaattttgtagtttttaaaagtgatatcagctgctacaccttactttgtcacgtcttctttgtctgcttgctcgatccaccactgtttctatttattctttctttttagaacatttaaaaatcggaccttatagtttttaaagtttatttctcattggttacatttttataattttagaagtctcatcgaacgttgtcactatactcctctatgacccgtccgctgcctcatctctttattggctttgagattttaaaatcgaacaaaattattgttgggttcattttttactttctagaagtcccgccaaaccttcagcggttgtgccattgtactcctctagagctcgtccgctgcctcccctcgttattgtctttgagattttaatatcaaacatgattatcattggggtttattttttactttttagaagtcccgataaccgtcgtgaacatgttgcttaacggcatgtccgttgtctctccttttaatcatcatcgagattctacttaggattttgttaatatttttagatatctcatcaaccgtcaacactcaactgctttacaggtctcatcgaactgtcggcagcttcgttattatactcctctacgggccgcctgttgcctcccctctttttttttttgagatttaaaaactaaacatgattgtaattagggtttattttttttactttctagaagtcccaccaaccgtcgtgactatgctgcttaacggcatgctcgtcgttcctcatcttaatcgttattgggattctatttaaagttttgtttatagttcttagatgtcccatcaattagcaccactctagttctttacgagcatattgtcttccctctttattgtcatttgtcatcattgttctagaaattccatatttttcattccgatggtttttttataaacgatattcctacttgaactcttttaattacttttttgtttttggaatttattttatttgttattccgaatattagtatctgttcatatgttcttagatggtctcttatttccatagtctttattttttattacgaattttatttttattacgaattttagttatttatagattgtattcctagttgaactcttcgttttctttttctaattttagtaatttttttctaactctaggtggcctgcgcgattgcgcggctagcacccataaagaattatctattttttacatatgattttacttaaaaattttttaaatagctatctcattatcttaagactttgaaagttgtcatcc

SEQ ID NO: 5731 - DNA, 784 bp, Oryza sativa
cttagctttgtaatattccccttggtgatggcagaagtggccaatgtgggaacaaagtcgtccatcaataacaatgaagacaccagtcggcggcgacgaaggcggtcgacggtgaaagcgaagatgcccactaacggcggcataataggccagccgtgtaagcggaaacaccagtcgacggcaacgaaggtgagccaacggtgaagatgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtaaacgcccaacagcggcggcataataggccagccgtgtag

SEQ ID NO: 5732 - DNA, 7584 bp, Oryza sativa
tgaaaattcacacagcaaaatagctataaagaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaatgatattgtatccaatcaattgcttaaaaacccaaacagcaccatgactatataaaaaagccagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatggtcccgaataacaaatcttttggtaatataaaccaagtgtagttaatatgaatagcttctgatctgaatgattatcccttatgggatactccaaaataggtgtaacaattgaatcccgactggcgcaagtattcggttgatagcccttacggggaataataattggtccagtctttgagcatagaaaatagactcatgactatgaatccatgtggaatgtatccggaacaagtccaaattggaaatataatcctcacgcttgagttgataagcccctgagcatatagcttgtccttctgtcgtagtcacaatcgtccattgatggtagctgacgcagttggcatatagacaagacgaccaatatagagataatattgcccaccagaggtggcaacaatactggtggtagtgaagatagtgataccaatctaaagtaatgaagtcgcatagccatggaggcgaagaaaccagtcggcggcagacagataactaacaatgaagatgaaggaacccagcgataaaattgtgtagccatggcagcaaaataatcagtcggtgacagacgaggtagatcaaaggtgatgacaaaatccaccaatcatgaagatgaagaaaatagttgacgacgacaaacgcaaccgacatgatgaagaagacgatgtcggtgatccagccaatagcagtgtagcaaccaatgataatgacaaagacgctcatcagcatttgcatagtagtcaaccgtgaaggtgaaataataagtcggcgaaaacataatcatccattagcaacagcggagatgtcagggccgatgaagcagaggtgctggtgatgatgtcagtgacaataatccatcaaattaatgttatggctgtcgtagatgcttcacttgaaggagagttgatgaagtagaatgtctgttccgaagcaaagatgaagataatgactcctggagttgactcattggcttatataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagccacttgttgtagtaaaataacacggcatcgcatgccgagatgtcgagattcacaacaacgtcatggttggtgatgtagcaaaacttgtgaagtagcagcaatagagtttgctggttccgaagataataaagatgaagtcgctccaccatgatgacaaagttgtgttgccgtgatgaagtgaacacgagtcgtcggcaacagaagcaaactggtagtgaagacgcgcagttgtgaaaataaaagcactagtcggcgacggaagacgatgatgttcatcagtagtggtaggctgtataaaccagatgtagagacgagggcactagttagcagcagacgagacgaccggcgatgaagatggtaaggccaatcaacactggcagaatcatgcagccatggaagtgaagaaaccagtcggcagtcatggcaaacgtaggcagcttgtgttgaagatactgatgcctattagtagtgacagcgatgtagccagccgtgaagaagatagcatcagttggcgttataacaggccatccgtgcaagcggtgacaccagtcagcggcggatgcggcggccggccggtgaagacgtagacgcccaacaacggcagcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaagccagccgtgcaggcgaggacatcggtcggcggcgacgaaggcaagccggtcggtgaagacgtaggcgcccaacaacggcggcataataggccagccgcgcaggcgaggacaccagtcggcggcgacgaaggcaagccggtcggtgaagacgtagacgcccaactacggcggcataaaggccagccgtgcaagcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatttggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaattatctttctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtatttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaacggcggcataataggccagccgtgtaagcggaaacaccagtcgacggcaacgaaggtgagccaacggtgaagatgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacacccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcctgttggtgaagacatagacgcccatgtacggtggtgtgaccaaccaaccgtataggcgaaaaccaatgaacggcagatgaggcggcgttaaggcgagttgcccattagtcgcgctagagtcggccggatcgatctcttgcaatgaatccatcgcatatgcaaaaagaaagcaaacatatagatctctgttagtgaacaggaaaatatagatgcttatcatatactagaaaacatctatttaatgtatagcatgataaaaaattttaatccacgcgtgttgattggatcaacacatcgggcatgctttccagggagctgtaatttcctggcctgagctttcctgtgcatggagtaggtatgcatggcgagagcacatatatatccatattaaatcacatgcacgtagcagctggtcaaagcctggaagcatcagcatgtcgcatggttcccgtgaagacgtggccggcttacgacttggactcatgatgagtagacggagcgctttgtcttgcacggcagcagcttgttaggtagttagcgtccatcagagcaactcagccgccagtagtatatgcggacgtgcaaaagaagaattagaaaaacaatatcaatctgtgattagaaactaatctaacagagattaaattaaaaggatgaacccagatcatgcatgtcgatcggtcgacatgtgcatgtggattactcctggtggctggcgatctcgtgcgcgagccgtgagcactgccgttccacgttgctcccatgtcgggttacaccgccaccggcatctgcacacggtgcatggaggaacacgaggtattgggccgacacaccgggatgacagccattggtcttgatctcagtcggcatgcaaaaacaagagaaagtaataggagattaatctgtagctagaaatcaatttaactagtgaaacgataaaattatccaatgaagttggagattgaatcgatgaaatcgctgagattaatcccttcggctgaattgaatccaagacgaaaaagacatgcttcacgaatccggcgatgccgaagattggttccatcacacttgtcgacgaggaactcgacgcacccctacctggcgccccaactgtcgaaacatgatttcggcaataataaaagggggtagcgtacgagacctaaaagtggatggatgcggagacaaaggatttagacaggttcaggccctctcaatgagaggtaataccctactcctgtttggggatttgaatccgccgagtgtgtattgatctgacgatcaggttgtctcatcataccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaatacccgagtcatgatctattacatattccatagatataagttatcccctatgactagtcggataaccatgccgtatgggtatggggtacccataatctccacaagtagcacgaatgtgaaggacagtaattcgctccagttccatatgtattaatttcctgtcgttttaaacattaccttatttactcactagtgattatttaaggtgtctatttactaaggccatttactaaggccattcccaacccaaacactagacatagttttcataaactccacatcatcaagaaactagtactagacactacttttctaatgtgaacaccactatccatacttaaatttaatgctacttatctcacatgatattttggatgttgtgtagaaactatatctcatgcaagacatggtttccttctctttccttatttattcacttgccacattatttttcatcctaagtggcagtctatttaatgctatgaacactatcctagtcattgagttgtgaatggcctaagtagtagtctctccgtattttaatgtacgatgctgttgactttttaccaatatttaaccattcatttgtttcaaaaaatttatgtaattattatttattttattgtgacttgatttattattaaatgttatttaagcatgacataaatatttttatatttgcataaaatttttaaataagaagaatggtcaaatgttggtaaaaaaattaacgacgtcatacattaaaatacggagggagtacattttaagcataggagagatgtcgttggagaaacaacaacttttcattaactatataagagtaaactcatccaaaatgtttatactccctcaattccaaaatataaggtacaaatactactttttaaagttgtttcgtaatataagacgtgcatgcatgcatataattaattagcatgttctctcctctaaattattattattttaaattgtacactcacaagatttttaattctattggttgcatgtattgtactagttagggtggttcatgacaatgatgtgatattaattatttcttggttttggattatgggtggttatgccttatattatactcctttcatctacttttgatagccatatttcatcttggcacaatgacgaagaataagtaattctacttatcatccatttaaacatgctactagtttttttagaattacacagtacaacgcaggcgctcataacacacgcacactcacccctatgaacgcacgcacgcaaaccttacccctatgagtatattcgaagactgaggcagcaaatcctgaagattgacgaagtcaccgcaggcgcctcgctgtcgacgggtatgtcacctaccactgaaagcacaatgccgttaaatcttgaaaaattcgctcctatggggagtctaacccaggacataaggtgctattgatgctcttgtaaccactaggttacaagcctttttcgctaaacatgctactagttattcctcgtaaacaaacgattcattaatatttatatttctcgatgcccatgtagccaatcttgtgtagaagaatgaagagtcacacattaaatccaataaagtcattaagaggatatgtggccggattgaaatatatctattaaaagtaaattatttagttttagaaatacgtttatcaaaaatagatggagggagtattaatctctccaactacagagcattttcattattcatcctagtaaaatgcttcaacgacaaaggaaattaatataggactggagggagggagtacaatacgaactaaaccaaattaagctaaaccccatttaacttcttgatggaacaagctaaccaaagcacagtcacatcccc

SEQ ID NO: 5733 - DNA, 2405 bp, Oryza sativa
gtttaattaatcactcccgccttacccacaaagttaaccgcctccccctcgtcgtcgtttgactaagattctcccccattaattaaaccaacaaaccaaagcacatcgcacatcaggattcgatcgactgacgccgcatgcggcacgcgtacacatacacagtaggagtacgtgatttccaccatcaccaaacacgcgatccgggcgcgcggtggtgaaccaccaccaccaccatcaccaccgggacaacgccccactagaaacaccgcgggatcacgagagaaaaccacgcgaaaacccaaccgcgcgcggcgcgactggtggacgcgcgcgcgtacgcacgctgcggcgcctcgcgtcacatggcttggaccgtgccacgccggtgtttcggttaaaaatttttttgagagagggcaccgccaccgcgagtagtctccgcgacgtatcgtacattcgtacgtacgttagcgcggcgcgcgcgtggttgatcggcggaaaaatcaagcggccggcagccggtttcgcggcgtcggcaacgtaaacgcgggcgggcgggcgcgaggccgacggcgggggtcggcaggggcagcagaaaggtgacggggcgagggagtattatagtggtacgacggagggggaggtcacggtggcttttgggcaaagctttttgtaacatattgttatgtggtgatcctcccaatctttttcagagcttggtcctccgaggtgtgacgtgcttagctagggggggcttatcggctaagcagatagagtttggcccatgaaaaggtggttgacactagtcacaatgtagggaagctaagctagctgttttgctaatctgcgattaatttttcttttgaaaagcgatataagcacaaacgctcacaatatacgtacacttatcgtcataaatacacacatacttcttaaccatgtgaatacctctaaaagtttgggctggcatacgttgagattgacgaaatcgtcacagatgtctcgctatcgatgggtacgcaatctagaatttaaatcgggataagggctggactagttctacaaaagaaaatataaccagttgaactacgatcaatttgcaatctatcatttttaattgttagtttctgctgttcttctgtaggaactgtagaatagaaaaaccgctagctttccgctgctctagtgttaatctgattccaagcgaatattaacactacttgaccgattcaagatcagataaaaacagctactgttttttttaaaactgtgatgctcaacctagaggggattttaaacctgtgagagaatgtgttctcctttttttacgcaatgttcaaataattatgaaaaaaaatatgatatgactagaaatcatagatcattgtacatatatgttacatattcctcacaactatgcaagatcgaatttattttacacatggagaaggagaagttgattgaatgtgttcttgtatatttgtgaactgataatgacacaaccatcaatgttttatcttcttttttttgccactattttttccacaagaaaagatgagtgcatacacgcttgtgcttaaaataatagctccatcaatttccttgctacttaaaattcagattcactttccaaaatgtgttcttccaataaagtacttctccgtggatttttctgatctgacattctgttcaagtatttagcatatattcctttggtcctgtgaagtacacatttcatggacgtccctctcctctctgcatgtagcatgacgctgcggccttaccaacctctttgtctgccgtaactttcaatccaaaatgggatcaatttgtataaaccaagcaaaattcagagaaacatttgctcatttatctcaaacaaaccggcttttgtgctggaaacaattaacttacacctagcacacatttttgaactttcaactctaaccaatcagatttttacggaggaattcggctttcaatacaaaaggtttgagtttcccttaagatttccaggacatcacacttatttccaaagaactaagaacctactctctctgtcccaaaaaaagactaaccttagagagatgtgacaaacctttgatggatgtgacccctcatagtacaacgaatttggacatccaagatttgccttttttttttaagacggatggaataggttacataccaagccaaatgaatggtggggagctaatatttttctaaagaattccataagtaaattgctagaaggtcaatcactgaactctactactgtagtacatagtagtttttttttttaaaaaaacaagtacataggtattcgagttgtataaacaaatgtcactatacatgttgcatgtcaaacttaggataacatatgtaaacagtacaagttcagagaa

SEQ ID NO: 5734 - DNA, 1003 bp, Oryza sativa
acactactaccaaagaaaagcaccctactaaacaagtgattagcccagctaattgctggagtaagtacggtattatatataatcatagcgaaagtaatcatctcggagcatcagctaagagcatggtcatggtgtaagtactattattagtgcgttgaagtgaagaaaagaggtgcagagatcagaggaaaggcaacaagtctagagagagagagagaggagcagtatgttgacattgcaatttgctagtgagagcagaagagaaggcggcttcggcagaggagagagaaagaggagtgagaggagttaataatatcccatcattcacactccacggcatcattggcaactcctctcttccattccattcaaccacatctgtttctttaattgctgcgtttaatcactctcctcctcaccaaccgcttcgttctccgttggtgtatagttgccgcagcagcagcagcactcgccactgttctttctttctctctttctcctcctgctgctgcgttgctttcttcaggcagctagctcagctgcttgtgcgtgcatgggaaggagtaggaggaggaggctctgagagggagggaggaggaggaagaagaagaagaagatgaagttcatgaagctgggctccaagcccgacgccttccagtccgacggcgccgacgtcaggtgaggcgccgccttcgtctcctctccaatctttagcttcggtttgggtgaagaaaagtgtgatcttcgcttgcgtttctttgggtgtctgactctgataacgttgttaggatgcaaaggtggtagtcaaaatctgttcttttttttttcctttgcttgtttatgggaggcgtcgattacgaacgtgtctggttgctgttcatcatgttggtttgctaattattggattggattctttcttgggtagtggtgtaaaagaacgatttttttgaagcttttttggggagatatcttgcaatagaaatcgttcgtttgatggcttctc

SEQ ID NO: 5735 - DNA, 26467 bp, Oryza sativa
tggaaaaaaaatgtttaggaaaaaaaagacagaaagtgataccttttgtttttgtctccttactggtttgtctgtcctagctcttttccttttgatcgatcctgaaaactaacagaggcaaaacaagtatgaagttaaagttattgatagctgtctgtggtagtagaaaatgatattttggaaaaaaaaaggaagaaacatatataccagatcttttaatgtgctgacgagatctttttttgttatgtatttgtcagaatcactggtttcttcctcttctgaaatagagttggcataatcagaatctgccaccttgttgtccgacttgctatttgatgaacattcatcatctgatgatgtcctgtcacttgccatactggaaaaaagaactagagaagtaagcacattaaaaggaaaaaagagagatcttgtcaaatgtcttgatattttcatgtgtaaccaatcaaaccccaaaaaaaaaaaattctcaatgtcctgataggctgctaagccacatgttaaactgtgccaaaaaaaaaagaagcagtgccaaattcaaacaataccacttgcattcttgttgctttttgagaattcgtgcaaaggttgaaatcatgtgcaaaactgcatatgcaggtataacattattaattcacaaaatttaatgtgttgcacagaaaatttgattactatctcatataagtaaatgtcaactacaacatcttggtattgtgaaaaaatgtgttaactattagcatgattatagttgcacaaaatcataattaaagttgcacgaattaataaccaaagttgcacaacattaaaaaatggcgaccgtaggaaataggaaggtgcaatttttgcatataaaagtaacaaactggatagatatgacattatattattcgaccgcccacatttccaagctcaccagcaaaatcaaaaaacttagcagaaggaaatgtactcttcttggcctgcagcaagctcctcccccgtagatccaacgctccctgaaaacaaaatcgtagtgagttattacatctgagcatacaatcagtctgaagttgtgcttgtttataaccaaaattaggaaaaaaaatcatatagtagtcagctaaaaaagaattagttgcacgatttattaattgaaattgcatatatttataacataacttgcgcgaaatgtatagtattagttgattttgctatttggctatgctgctggggtgtagatggttgaagcggaaaaacacagtaaatgaaaaaaagagacacacttgatgtcgtgtgttcatgagaaaaaaaagatacaacatgaaaagtagtatgggttgcaaaaagcaaaaacacatgaaaagttggacaaaaaaaaactttataaaccaaacttgtagagacttaacctagaagttgcccatgtttgaaaaaaaaaggcaattactaagctatataaaaacatattaatggttgcgcatgtctagaaaagtgtcaactacaacatcttgggtgtgcaaattctaaaaaaagaaatcagtactgccaaagagattatgaaaaatgaagaaaaaggtaactaataacaagggaactaacttctagccacaagctccaccatcccactgtcgaaccactgccaatccttctatatccaatccatccttagactactccccaagttacagccaaaaaattgcaaagagagtcactgttgattatactactactgtattagcatccgcagtttgctcaggtttttcaccagatcaggtatttcaggtttttcaccagaaaaacctgagctcgccaaacatccaaaagaaccgccgatttgttgtggcgttgatcccgagtcccgcaaaacaccaaatgaatccccttcccatcataataaaaagaaaaagaaaaggcaatgaaattactaagaaaacaagttgtctaccaaaagtcctcacttgtatgcatgttttcccaaacaacaaacgctatttatcaaagtaaatggaaatttggttaaaaaaacattagttgcacaaaattattacatgacttgcacaaaaattcaaaatggctactacaatagtcagggagtgcaactagcgtagatacataattttcagaaaaagaaataatgaaaatttaaggccatgtgctgatcgaaagcataggttttagtttgaggccatatttaaagcagtaaataagtgaatcattgatacaacataactgtacatagcatatgaagagatatgctttatactgtccatttatacagtactatcgcaaattatattatccatttattctctgtattttagtttcagattaatcctactgtttccattaatctcaccctcgtttgcgtttgccactgtcatttgctgagttgctaatgacacagaccgatgcttttgcgaattgcgattactctcctctctcagtgatctactggtaatctcaaaaagattaaacataattgataggagcagagcctggagttcatttttagggaggcttatctcagattgatcactgatggaatggaagcaaaagtggcttagtatgtcacagttgagcaggagtatgtcacagttgagcaggactaccattaaaaaaaatacacagcacacaaaacaacagatagcttttgtctacaagcagaaaacacaactcctccctgtatacagtgacactgaaatcccaaaaaattgtggtatccctgtatacagtaacctctgattaaactccctgtataatctgacaatactggggacaaatgtaagaacatttgctgggatttaatgaaatattggttagttcttgagctcgaattgctaccaaatccctaaaccccttttaaaatgccacggcacagaggtcatcactgccctacaggattaacgactaaatctagagcaaaaccatgtgtgtgcattccatgatatatcagatccaactagtgaaactgcaaaactccctaacaaatgaagttagagagaaaataattagtgccaaggtttagaaccaggcagaggcacagcccacctcccgccgactatatcatacacgatgtgcagtaaaaccctaaaaaaatttcccaaactacatcgaacaaaacatcaaagcacacacaccatgtggtttcagatccaggatgctttactcgacattgggcaaaatcaactcaaaactcaagcaatgaaacaaactccacgggattccccccccttgaaatggtagccaatccagccctaatagctcacaatccacaggatagaaatctggaccaaaggaaatcaggccgccacggcgtgaggatttgaacaaaaaagagagatgaaaaacctgcagtgcatcaactcctctcccccgcctctcttctccggcgccgtccgcggccgctcgcggtgcacagcccacctctcgccgcccccctccccttcccctccactgcctaccttggaagaatctccggcgccttccgctcgcaggactccgcctcctactcgagaaacagaaacgtcgagaagcagaagcgctctctagagagtcacgggtgtggtggatttttccagagctatttgtgggctgtgggctgtgggctgcgggctctgggcttattagcaaggaaaaggtgatggaaaagcacgacccatataaaaaaagagcctttccactagcccgatagcgcgcacaaaagttgactgatcgattaaaattttgcaggcgattaccaaatagcaaatgcgttgtttttatgtaaaagtttgaataatttgtgttactcctctcaaaacttaaagagaactgtaaagaaagtagccaacttggttggtaacatatgacaaaagcctgcatagcgcataaaagaataagttcactttaggtccgatcgaatataagtcaagtttgatttgcattcttcgaccgcaaaacttggtacaagacgtgctccaacttctaaaactagggcaaatcaagttcatcggtagcatttgagagtggtttcctatatgtcatcctagttagcaaaaaataaaataaaaaagcaaaggtcatgcgggacccacttgtaagtggccaaccaccatcttcaacttttgtctactctttctctctttaatccttgtggtggcggcggcaggatctcctggaggtcgtggcgaggaaggtggacatgccagcaacagaggagctcgaggaggccacggcgacatgggagcttgatgaggccggcgagaagggtgctcgccacgctgtccccatttggccctcacctccccaatctcccccgctgtgctcgttggccggcaacaccttcacggagccacagtggacttattatttcgtgcacaaacacatactccctctatcccataaaaaacgaatcaaatctagtatgatgtaacacatctgttactagattggtttttttatggaacggatagagtacgtgatacgccccgatatggtttagaaaagttgctcacacggcccaaagagcccatagaagttcggccttttggggccaattgggagcccaccaaggagcaatttttatgggtgggcttcgagccttccttgtccagcgtggggcggggcactcccacatccaccgcatcccaagccgacggccgcggtggcgacccgccgagtcgccgcgtgccggtgccgtgtggaccgggagcgcgccgtggcgcggttgaagggagccccaccacacccccttgagttcttgtcgcccactcagcctcccgtcgctgccggcgtggcgcccaccctaggacgcccgccacctgctcgtgcaaatgcgagagccagagccggccacagcggtgctacccgtttacgcgcattgtcgttggggggaagagtgcggtcatgattcgcgtgtgcctccagtaccgtcctgttggcaggctcacagcagagccgctgcggggctccggtctctgtcgtggagtcacggaactgctacttcgtcggatccttcatggagattcaggtaccaacctctcaaatttagctggtttacaactgaaccaaggtgaatttggtgatgattgttcaatgttcagtagatatatgtctgattatcacgtagtagtaggattgtaggagttgtttttcccttcttgaggatcttccccaaccaagtcaaatttctttgcagggaacaaatggtgcaattttcttgttccgaagaagttgacagcacagaaggaaactcacacgcttgtgcatatggatcacttccactataattctataaaggtcagaattagtatttgctaatttatcttgtaggtagttactgataaggctaggaattagctgctttggaaaggtagtggcatgctggcatgcgttctcttgttgcgtaagctcatgggaacagcatgcaactctaaatataaatagcatgcacaatcttcttaagaacaggcatatctttgatggtggaatagtgccagaaatgtgtaaactgaatatcattcttttagttaggaacacaaaagggggcaaatgaaacattctcaactctcaaagagtgccccactagatttggttaaaagggctggcatgatgtacctaacaaatcatttaagaactgtcttagacatgtaggcagatctttctagccacacagtcctgcaatatcacaatgtgctaattattctttgacactttcttgatcacctagatgtcaaaaaaaggagtgagtgtcataggtagagttttctggcccaccgctcgtgcgaagcagcaaaggtcactctcctaggctgaaatttatattccccataaaaatctacaattgcagtgttgcatcataggccaaaccgttgaaaatctgatgtgtgaatcatatgtgaaccttttgaaagctggaattttttgctggacatatataggggcgagtatgcatgtttggcatgatgaatggaccccatgtatataccctgtgaagtcgggtcctgatggcaacaggccagataaatgacgtctccatgagagttcagttagttgaggccagcttatgtgttcttcaggggtatgtctattgctcccaactcccaagttattgccacgcatgcaaaatattacgtgaatggtacttcctccgtttcaggttattagacgttttgactttggtcaaagtcaaattgctttaagtttgatcaagtttgtagaaaaaaatagtaatattttcaaccaaagacaaatttattatgaaaatatatttaattattgatttgatgaaactaatttagtattataaatattactatatttgactataaacttagtcaaacttgaaacagtttgactttgaccaaagtcaaactgagggctaggaaaaaaaatcacataaacccctagaatgacaagaaactgaaataacccagagagatatgactacgtgagataaacagaccatcaataattccgtcctccttttgtattccttgtccttgtgggagggagaagttacttcttctgaattttctcttctttataatgggcctgtttggagaactatcccagggatattttttgggctaaagattatcccaccaaaatagccccctaacaaaatagccctcttgctgtttggatccaaaggctatttagctattattgtaccatcccaatcatttgcctccactaaaagtatacagcagccggatcttctatggctaatccaatacaggcacatacaagcatacacaattccttacaagcacaaacacataatttgtctcaaatatataagcaagtatgtaaaacaatcgtgtcacataaaagatacaattccatacaacaatcgtctcacataaatatacaattacataaaacaattgtctcacataaatattaaaatccatacaacaattgtctcacataaatattaaagtccatacaacaattgtctcacataaatattaaagtccacacaacaattgtctcacataaatatacaagtcctcaaaccgtaaaaaaaaattacaatccattaaacaaagcatttgccaagtcatcgcggaagaaattcatgttgctatcctcaacaagaggttcatcttctggccagttagagtgaggtgatgtaggcattggaaaataatctgcatccgcatccagctccttcctcgccgccaccctggaggaaggcaccgtactcgtggaggtgagggaactcctggcccgacgccgcctgggtgttgaggtccagcgtgtccacgccggcgcggggaacggatccgtgggaagggccggacgccgacggctgcgacgaccaaatgttgccggcggcggacgaaatgggatcttgggagaagaaatcgaagccgttggggtccatctccgcgcggatccggtgcaaggcgatgcgtcgacgacggatctgatggccggcaacgcgggtggggtgagtcgccggcgtggatgcctctcggtggatctgaaggaagggcggcgcgattcgagggagagggcggtgcgggtgaagggccgggcggcggcgcgggtggggggagggggaggcgaagctggggccgggcggcggcgcgggtggggggagggggaggcgaactggggccgggcggcggcgcgggtggggggagggggaggcgaagctgggccgggcggcggcgagggttctggagagcgagcgagggcgagagcgaggggtgagagcgacgatttctgccgcaactggatccggcacaagtgggggaaagtgggaatcggtggggcccacagcaaatagccccaattagcacccctgggggtgataattttttggggtgggctatttgcaaatggccctaaaatagctctcatgtttggatccccttgagctattttaaggctaaaaggggtgggctaaaaaaaatccataggatccaaacacccccaatgttttggtttaggcccaaagcctcaaattagctaggccatctaactggattatgctagcttaaacagttttatcaacagagatctacctggtccaaacttgcttcttatctagccagattagcctcgcaactgaacacactaaatcaatttttgcatgttgcttaacaggctccagttttggtttttatcgttttaatcacttccctgttgagaacactgtatggaatggaaaccaagttgattctgtccatgcatcctgcaggctgcctggcaaacaccacacaccactcaccggtgcaacccgcaagtgcagccgtgtgcaggtggaagacgaacagtattaggggagcttaagattttgaaaatcagttggtgagaagctcacgggtgagaatctggagactttaattcattttttgaattctaaaactataacttctcaaaatcagagtgaaaatttggactgtttggggaaagcttttggtatctgcagattccagaaaaatctctagctgcgagaagctctcccaaacaggctcaaaacccgcagttagctagcgtgcgccaagcccctcctacattccggtgcgcgcgcgccagcgcccggagcccaccgcgagtcgtcgaatgtgcgcagagccccgtccctttcgtccgatccctcggcgacttgcttccccggccggcagcctactcatcatgcacgaacccatcgccccaaaaaagagccgcgcatcgtgcgcagcataatcatagctatcgctgaaacgcctgcaccttcccctcctcctccattcgcttacctcgccattgacatcgcatcagctcttctccatctgtatctgtccgtttttctttcatccatctccgtcttttcgtgcaactctccagcttcagcttcagtgccttctctctaccaagtacgtgaagaagagcttcatctatgcctctactagatcagagatgctagctagcgctctagctagctgctagcaaggagcgcaccagcaagggcaccaccactggcttaagtacatggctttaggggagagggcgagggcgagggctcctcccatggtcgtgcggcgcacggccgtcctcctcctcctcctacatctcgtgttcgtcatcgccgcagcggctgccgcggtggataggcgtcggccagccgaggcgatcgtcggcgggtggcggcagcggcggcggctccaggctctgatgcaggagaaggccacgctgctggccttgaagcggggcctcacgttgctgtcgccgaagctgcttgctgattggaacgactccaacaccgacgtgtgcggcttcaccggcgtcgcctgcgaccggaggcggcagcacgtcgtcggccttcagctctccaacatgagcatcaacggctccatcccgctggcgctcgcccagctgccgcacctccggtacctcgacctgtccgacaaccacatctccggcgccgtcccctcattcctcagcaacctcacgcaactcctgatgctcgacatgtccgagaatcaactctccggcgccatcccgccgtctttcggcaacctcacgcaactccggaagctcgacatatcgaaaaaccagctctccggcgccatcccgccgtccttcggcaacctcacgaacctcgagatccttgatatgtccatcaatgttctcacaggccgaatcccagaagagctctccaacatcggcaagctcgaaggcctcaacctcggccagaacaacctcgtcggcagcataccggcgtcattcacccagctgaagaacttgttctacctcagcctcgagaagaactccttgtcaggttctatccccgccacgatcttcacaaattgcacgcaaatgggtgtattcgacctcggcgacaacaacatcaccggcgagatccccggcgacgcctcggatagcctttccgacaggttcgccgtccttaatctctactccaacagcctcaccgggaggcttccgcggtggctcgccaactgcactattctctacctgctggacgtggagaataactcgctcgccgacgatctgccgacctccatcatctccggcttgcgcaacctcaggtacctgcatttgtcgaacaacgtccatttcgcgagcggcgacggcaacaccaacctggggcccttcttcgccgcggtgtcgaactgcaccagcatactggagatcgaggccggagcactgggcatcggcgggcggctgccgagcttgctcggctcgctgctgccgcctaacatgtcacacctcaacctggagctcaacgccatcgaaggcccgatccccgccgacatcggcgacgtgataaacatcacgctgatgaacctgtcgagcaacctgctcaacgggacgatcccgacgtccatctgctggctgccgaatctgcagcagctcgacctgtcccgcaactcgctcaccggcgccgtgccggcgtgcatcagcaacgccacgagcctcggcgagctggacctgtcgagcaacgcgctgtcggggagcatcccgagcagcatcggcagcctgaagctgtcctacctctccctgcacaggaaccagctgtccggcgagataccggcgagcctcggccagcatctcggcattgtgcggctcgacctctccagcaaccggctgaccggcgagatacctgacgccgtcgccggcattgtccagatgtcgctgaacctctctcgaaacctgctcggcggccggctgccgagggggctcagcaggctgcagatggcggaggtcatcgacctgtcatggaacaatctcaccggcgcgatcttcccggagctcggcgcctgcgccgagctgcaggtcctcgacctgtcgcacaactcgctcaccggcgtcctcccgtcgtcgctcgacggcctcgagagcatcgagcgcctcgacgtctccgacaactccctcaccggcgagatcccgcagaccctgaccaaatgcacgacgctcacctacctcaacctgtcgtacaacgacctcgccggcgtcgtgcccaccgccggcgtcttcgccaacttcacctcgacgtcatacctcggcaacccgcggctctgcggcgccgtgctcgggcgccgctgcgggaggcgacaccggtggtaccagtcccggaagttcctggtcgtgatgtgcatctgcgccgccgtgctggcgttcgtgctgacgatcctctgcgcggtcagcatccggaagatccgggagcggctggcggcggtgcgggaggagttcaggaggggccgacgccgcggcggcggcggctcgtcgccggtgatgaagtacaagttcccgcggatcacgtaccgggagctggtcgaggcgacggaggagttcagcccagaccggctcatcggcacgggcagctacggccgcgtgtaccgcggcacgctgcgcgacggcaccatggtcgccgtgaaggtgctccagctgcagtccgggaactccaccaagagcttcaaccgcgagtgccaggtgctgaagcgcatccgccaccggaacctcatgcggatcgtcacggcgtgcagcctgccggacttcaaggcgctggtgctgccgttcatggcgaacggcagcctcgagcggtgcctctacgcggggccgccggccggcgagctgagcctcgtgcagcgcgtcaacatctgcagcgacatcgccgaggggatggcctacctgcaccaccactccccggtcaaggtcatccactgcgacctcaagcccagcaacgtgctcatcaacgacgacatgaccgctctcgtctccgacttcggcatctcccgcctcgtcatgagcgtcggcggcgtcgccaacgccgccgacgtcggcgcctccaccgccaacatgctctgcggctccatcggatacattcctccaggtaaattaaccatcatcatcaagcaaactcatcatcatttttctcgtgacaaattctaattaatcgattcgattctgaagagtacgggtatggctcgaacccgacgacgaagggcgacgtgtacagcttcggcgtgctggtgctggagatggtgacgaggaagaaaccgatcgacgacatgttcgacgcggggctgagcttgcacaagtgggtgaagaaccactaccacggccgggccgacgcggtggtcgacccggctctggcgcgcatggtgcgggaccagacgccggaggtcaggaggatgtccgacgtggccatcggcgagctgctggagctcggcatcctctgcacgcaggagagcgcggccgtgcgcccgaccatgatggacgccgccgacgacctggaccggctcaagcggtacatcggcggtgagaccacggccacgttcgcgtcgtcgctgggcttctcatcctcaacatttgaagatctcgacgactagcagcaggcagcagcatctcctaaggacgcatatgaatcatgcatgatgtgtaaatagctaggaatttagctaagaggcaggaagattatttgtcaggaaattaaagaagtgtgcaatttgtgcagaaatattgcgagatttataggattctttggaagtatctgattaaattttgatggagtgatatcttcggttatagatatcgataaatacattaatcccagtgtgtagctgattcagtcgtattgcttatgcatgctcttccttcctatctctgcgtctgttcaaactgtatatgctgcctgaagaacatgaactctagacaaccatgctaaattgactctagcttagcaagaaactgcagtgtaattaaatgagaagcaaaattgcgaaaaggtcgactgaaaaaaaatctaatagctttgacacctttcttcttaggctttacaaagagggttaggtcatgaatgacatggtgtagctgcacataaaattttcagaccaaaatctggtctatatgactctaagctcatttattaaggaataggctggtgacaaagctggttattggaaaattgtacacgcatcgttgaggtaaaccgagcgtgcgatatgagcacgtttgaggatgtgctgtgcactggcaaactagcaatgcctaaaatggaccagtctagcaaatataatagagggcaatagcatgatcttgcatactatgcggttatgcagattatgcatatcattgttgcgctcttatccaaatattagtctactaatgttccactgatgaggattctcattggatattgttaaaggctttttttagcatgttcagagcaagtttaatagtataaccaattactagatccaattcatctatagccaatctaatagctcattcatacaatagttacatatatactacactattaatatccgatcccacctatcatacacacactgtattttggagtccgtgctacagctggctacaaatctatagcccgctgcccttctctctcctcatttatctgcttaaaatatgtttacagctggcttatagcctgctattgtatatgctctcagagcgaaaccgatcattgccgaaacttctatctacattttccggtggcaaagcatatttttgataaactttacaaaaatattgtatactcgtcttctctgcaggatactctgtgacactatataattcactatattttctgtctttcttccacaatggcggtctacaaaggtattgtccatgatattttgttgtaagatccacttcaccacataagctatctagcatgctatcgtctgttttttttgtcccaaaataagtgtttttagacttgttccaaaataagatttttttttacttcttaactatctccgttttataaattaagaagttttatcccaatacaccttaccttcccatcctctattaccatttctattaattagatccactttgattttttcctcactacaaagttttcaccagatataaggatccatttattttaagacaaagagtacatggtatcgtgagtatccactaacaaaaaggacatatacaccatggtccattccatatgcaaaactttccaatcccatcataaattcagaattcaagatccactagagaatgaaaatttggcaattgaaccctttttaaaatcttaatataagaacagatcatgtcaaaacttatttcagtaataaaccgtaacttgaatacacatagtataataacgccaaagtacaacatctcagccaaaaagggtatgttgctacgaacatcgacacactggtgcgaaattcccatcagcaagggcaccaaggtaaattgtgttgaccttatttataggttaaataggtgataaagaataaccgtggaaaatcttatcaatcaatcaatcatcaatccttctcaagccggcaattttacggatgcaggtcgtttgcaactgacatgtgggccccacagcccctcggacccacatgtcagtgaacattactgtaagggatctcaattgcaattttaccggatgttgattggtccacgtggcgtgccaacgtttaagataaatccaggagtaatgaggattaaaaaaatgctaggatatgtaaaaggagattaatgaatagaagtatctagaaatatgcaatattatgtgcatgaagtgaatgatctagatgcatccagtcatgtgtgtgaagttaaaaacaaaaggtaaatccaatctatatcaacgggtctcagcttttagtatctgccttctctgtaacacacacagacatcaactaatctcaagctagcatcaattggaccacatgatgttgttaaatattgagataaatcaagcatttaccgatggggggaaaaaaaagaaaactcacttgtgtaggacaagaaacagagagagaagaggttaagatatgagaaatctagaaccttctcaaatataaactaaaatggagaaagcgagagcctttaaaaatctgaactgctgtcttattctccttcggttactccaatacagaaaccagtaacaaaaattcacagggcaaatttattaaaaaaaaatcataggaaaatttaaaaggaaagaggaaaaattgatggtaaacacatagggggccatatagcggcgcgccaaaaggtacgctacttttctagtcttatcttatcttatcttatcttatatagtgaaagcagcaagctttttcacacgaggatgcgtcacatcaaaaggtacacatgcaataaaaaaacaacaaatgggcgtatggtaatttccagaggtttctagtgccaagagagggggcaaagataataaagaaatcaaaaacttggaggcttctagtgatttctcatatagcacaacttagctaaatctatagttagcttagaccaattgatactttgtaaatcaattaactcatgttataaccttctataaactaatataccgtatacaaaagttattatatgggatcaaaagtcgcgcagagcgcaactacgtggctaacatatggtaaaaatcacatcctaggtagaaacttgtcgaggtgtgatcctccctagcgggaggctgtgaggctcccctttgtgagttcggctaggggaccgggtgcaatgccaaggaacgtgtgctcacgcaagcgaggtggatccgcggggattgggcttatgaggtggaaggcgagggattatacaggttcgggccgctatcaagcgtaataccctactcctatttgagcgatgatctttgtgtggttacaaagacttcagaccctgggagtaccagctagggcttggccggcctcttcccagaatccggctttctaagagacgtccccttactcgtagggcatggtccttcttttatagaagaaggggataccacatgcatcgcccctacactctcctcacaggaaaggggcccacattgcctatattaaaaagcatcccatgccttgggccagaagcgatccatgcagctgcccttgggtggcccccactgaatcctttcgtctgacacgggggacatcccctgtcatcccctattaaacgtttgacgactttgtgggcacacgcgcatgggaggtggcgatctgcatgtcctccccttgtgcatgatgggacggggcataccagcccccacgccgtctgacacaaagcgggacgtgggtgcgctgccacctatcccatccatccatcaccgggtcacagaccggtcaaaaagcggtcgccaggcgcacgtccatcagtgggcggggcacgacctgccacgtcgcattaaatgcgacgggggcggttggagcgccgcccataaatgcgcctggcgaacggcgccctgcccgctcaagcccccacatggccgtcacgtggtggccgagcgagggcctcgggggcggttcatcccctcgggcccgaggggtacgacaaggtaccccaagccccccccccccccccgagggggactgggcccgccgtgcgcgccgcacaggaagagcttcccttccccctagttcaggtatcctcgggcctatatcaccgacaaaacttgaaaccttttatatatatataaaaggtcttaaaaaaatctcaaaaaatcacacatgtaagtaatgtgtaaacaaataaccctacaaagttgcacgaacaaattcaactccctttatgagatataaaattaacaaatcatagaggaaagccactatcatctttttctccaatgtttctcaattttatatctcataaacggaattgagtttatttttggaactttaaatggttgtctaatatcaacttagctatttgtgtgatctctttcaaaagatcagctgtttagctgggagggggtgtaggataaagctgtcctatatatgatatccaagaattaaaaaaaaaacactggctagtaaagtgtaaaaaaagaaatgtcaccaaatagaaacaacaacaaaaatattgctgtagtgtcaaacatgcctcgtccacatatatgcacaaacttcgcgccaccgcactaagctctaattattgctcggatggcgctattacttttgtacctatataagtgaggtcagcgccaagcttaatagcgctaaaccttacggatagggatttcgtgccaatgtgataatgttctaaacgctaaaaggtatgtgcgcggatacattatacttcagcgtcatcctcgacgatgttgaattgtgatttatttctaaaataatttcttggcacggttctttttgttgtaataagttaaaaaaaaccctaaattgtcaaaatttcggccactagttgggatattctgatctgatccctcatcaccgctagcagatctctgtaatctcaccactgaagcactgctgatcagcagccaccaccaccggtcacccctgcaggcctgcagctgctccaacggctttccccctccgtcacccactccctatccgcctatcccatcccaaaacctcctctcccctccccccccggcagccgccgcctccaaagttctctgctttcgtcaccgccagcctccctccaaggtaaaccacagcaccgaatgtgaatcttgcagttcgcgagctgaccagctgatctttttgtaaagaatcgtttggtcctgcacctcgctgatcgcggtctgtttcgctgttttgctatgatgcgcaggtattgttcgatccggagtagtgagtctatgcccttgtccggatccgaatggctgccctgcggatctgcacgccgggtggtggtgctccggaggccagaagaggcagtcttgctgctgccgggagcgcggttcagcatggaccggatttgatcgggttcagttcttgggtgctgccaatcagcgccggatatgccgtggaccggaggcacgcagcagctggtggagttgccgcatgccatgggctctcgtgtgctgacagtgggaggaggaagaatcatcccagggcaagtctggtgaatggtgtggtttcatctttggaggacagtagcggcggggagcctgcgctatgcgggtatctgattcccaccctgaagacgatagctccagtggaaaagtgttgtccgatttgcgtcgggacatggtggatggtattagtggtattccaagaatttctgcgggaaagaagaaggggatgaagttcaggagaagagggcagggtggaaatagattgacacggcgtagtgctccgaggcgtgccagtggaaagagtgggcaagatcagaggattttgttgagcgaggatgatattgctgcaattttgtccagtgttacccatgaatctagcatcgaggagtgcaattctgttctcatctgtctcgagaagcatagtgataagacagctcttggtttctttgagtggatgaaggctaatggaaagctgaagggaaatgctgaggcgtatcacctagcgcttcaagcgatcgcctggaaggaggattgggaagcagctggacagttgcttcatgaaatggttgctgattcgggttgcgctctggatgctcaagcatttaatgggcttatatatgtttgtgccaaacggaggcttgttgactggggaacaaagtggcttcatatgatgcttgaaagagatgtgcagccgaatgtgtctacagttggtatgcttatgggactttaccagaggattgggaaccttccagaagctgaattcacttttgctaaaatgaggaaatgtggcattaagtgtgttaatgcctactcagctatggttactttgtatacacggttaggccattttgccaaatctgaggaggttattactctaatgaataatgatgaagtagttccgaacatggaaaattggttagtgcggctaaatgcttattgtcaacaaggcaaaatggaagaagctgaattggtattgaagtccttggtagatgaaggaattgctctgaatgttgtggcatacaatacggtaattacaggttatggaaaagtttctgacatgcagaaggcaatggaagtgtttgataggcttaagagtgcaggtttagctcctgatgaaacaacctatagatcaatgattgaaggttttggtagagcagacaaatacaaacaggcaattttgtactacaggaaactccgaaactctggatttaaaccaaatgcatccaacttttacacaatgattaacttgctagcaagacatgatgacagtgaaggtgcaacagagattctcgaggacatgcgggcagcaggctgccagtgttcatcgattgtcactgttcttgtccgagcatatgggtcagtaggaaggatgcataaagttcttcagattctaaaagcatgcttctataagaagattttgtttgatgccacctcatgctctattttagtaacaggattcgttcaaaattctctagtagaagaagctatgcgtgttttgcgcgaaaagaagtggaaagattctgattttgaagacaatttatatcatatcttgatctgttcttgcaaagaggctggctgttgtgatgatgctgtcaggatatataatcagatgcctaagtcggcaacacatccaaatctgcgtatttattgcagtatgattgatgttttcagcatcatggagagattcactgatgctgaagctttatatcttgaactgaaagcatcatcctgtgttcttgacatgattgcctacagcgtaattgtgaggatgtatactaaagctgggcgaccagaagatgcctgtttggttttggaagacatggagaaacaaaaggaaatagttcctgataagtaccttttccttgacatgcttcggacttaccaaaaatgtggcctactcgagaaattatctgatacatattactggatactaaagagtcaagttgaattggatgaagccatgtacaactgcattataaactgttgtgggcgggcaataccggttgatgagctctcaagaatttttgatgaaatgattcaacaagggcacttggccaacactgttaccctcaatgtattgctagacatatatggaaaagccgggctttttaataaggcagaaaaggtatttctcatggctcgcaagcagggtatggcagatatcatatcatacaataccattattgccgcgcatgcaaaaaatggggattttcgtagcatgatttatttcgtccagaggatgcaagaggcagggttccctgtttctctggaggcgtacaactgtatgctggatgcttacggtaaggcaggacagttggaggagtttgctgctgttctgcaaaaaatggagagagcaggatgcgagtttgatcactatacttacaacattatgatcaatatatacgggagaaagggttggatcgaaggagttgcaaacgttcttgcggagctaaagagccgtggtggcgagccagatctgtacagttacaacaccttgataaaagcatacgggatagcaggaatgcctgaagatgctgttaaactgatgcaggagatgaggattaaaggcattgccgctgaccgagtaacctatactaaccttatagctgctctacagaggaatgagaatttcctggaagcagttaagtggtctctctggatgaagcaaactggagttgctgcaactcgaacatgatgtgcctaagaattcagagttttggttgcatgcaaattctggcatccgcacacgtttatatttcatctttcagtagagtacatacatacatgtgagtgacattgtacagagaactatttctgattgttctacacatcctatgggtaccggagattcagaaaaacctcctacctttccattctcttacaagatgaaactcaatcagtggatagcaagataggaacttttatcataccaatcatacaattgtaatttttttaccagaactggtttgaacttctgataataatgatcaaagattcattgagaaacccaagttcaatgtccattgtaccctctcatgtctgtcaatctgtcattgtaaaatctgtgcgctttctgcgatctcaattcaggcaacttttcccgcttgattttgacgtacctgaccaaatgttttcggtcagtttgtagttgtatggccttgtttagttacccaaaattttttctcaaaacatcacatcggatcttcgtatacatgcatggagcattaaatatagataaaaataaaaattaattgtacagttaggaggaaatcgcaagacaaattttttagcctaattagttcataattagccataagtgctacagtaacctatatatgctaatgacggattaattaggctcaaaagattcgactcgccgtttccaggcgagttatgaaattagttttttcatttgtgtccgaaaacccctttcaacatccagttaaacattcgatgtaacacctaaaattttttctttttacgaaagacccgatctccaaatttcaacctttcgtagtactactaaacggtcaaaaaaaagatgtgacggcaattccacttcctttgactatccatactaaaaagtcaaaaaaaaatttgccgaaaatgtcagcaacacctcgtcgcctccatgccttttagtcaacgcctcgccttgttcagatgcagcaggtgaggtgagagctccacctcccggagctcgaggcttccccggtgaacacctcctcccggacaaataaactaatccaaatgccgacctcgcttccggtgctcgagctcatcggcgaggcgtccgcacgtgcgccaagaacccctcatgagcaggtgaggtgatccttcaagaaaccagcaaaagaaatccaaggtcaatgccggaagaacaacaagaagcggaagaggggatcgccggcggcggcggcggatgggcgagcacggcgctgcagccggtgcggtggctgcggatgctgtgccgggagctgggcgcgacgttcgtcgccggcgtggtgctggtgtacgggctgagccaggggttcgccgggtccttcttccgcgtggcgtcggactactactggaaggacgtgcagcgggtgcagccggccaccgtgcagctcctctccgccgtcttcttcatcccctgggtcctcaagcccctctgggggatcatgaccgacgtcttccccgtccgcggctaccgccgccgcccctacttcctcttcgcaggtcagccactggaatcctgcatctcaaaatgatgagattgatgatctttagttggcgtgcatagatagtagagattagagaatcttatcagtagatagagtatgcgcacagttaaagaacaaaaaaatttgtgaagattttagcaatatgcttgctggtaagaacatcctgaattcctcctgtgtccataatgtcgtagaaattttagttgtggtggcatatttggtactccctccgtcccataatataagaacctagtctgggaccctaggttcttatattatgggacggagggagtatttggtaggcatagtaagttcttaaatgatatttggggtctgatgtggtggtaattgaaaacatagtgctagttcagctttttcaaaaggttcagggggttgctgggggtagagaattgataacacaacgagtgcttggtgatagtacatacttttagactttgtagagagaggttgagtggagactggagaggtagttccaggcacgagcaggaactgtttatgctaggtatcagcagctcattggatggaattggggatgaagatgtgttggttcaactaccatgtggatttcgtttgggactttggatatttgatgatatatgcattgtttattggaggtctagccagatcttaattagtaggtgcaagatttggtgtaagatgttatcttgccaattcttagaacaattgaagtatcaatgtgatgtatctgtgatattgcactttacaaattgctgggcatgatcattttaacaattccttgctgtagtaagtttttaaagtgagtctgagaaagtagcaaacatggaacatattgatcagaaacttatatgttacattttgtcgatttctacagcagttataaacttgacaaataaatcccatttatttctggtgctgacaggagtacttggaacggcttcagctgctattgttaccatggttaatggactaccgatgacttccgctatactttcctttgtggggatatcaacagcagttgccatagcagatgttacaatagatgcatgcattgcgaagaatggtattgataagccatcattagtcccagacatgcaaagcctttgtgcattctcatcatctctaggtgcacttattgggtatgctacaagtggaatgtttgtccaccatcttggggcacaggtcaattacagcctaaattcttgaagcttattgaattgccaagttccattttttggtatgttgcttcattgataatttaaattttgtatgattctttttgtagggtgcattaggtgtgatggctttacctcctgcaacgttggtttttctaggatttttcatatatgagctgaaaatgtatcagcataatgtgaaagagaaggtatgccgaagtgaaaagcaatattgttctatctacttgtgacagttttatttgtgtgcattgaaattttgttccctttacttgtgacattttttatttgcctgcattgaaattttgttccatttaattatgatatttttttgtttgcctgcattgaaatttaccaagttttgaatatcaatatatatttttggtgtcttcatatggtcgtacagatagaggatggtttatctgatatcgctgcatgccacttggcttagccaagctgagacgagtggcttgtgtattgttcttctgagatgtgtaacatattagcaaagttcacaataaaatgaaactgatgcttcagtgactgagattcatcacaggtcttgttaaagcaactaagacctttacggattgaatcccaagtaaacacagacagtgaactcaataggctgtaaagcataggcagaaaccaagtatatcttaatatatggtataacaatgaaagaaatacacaatatatagtttctcaccaagatgctaatgtgcaggttttgaataaggttcatatggcagtgaaagggatggctcagacaataaagtacccagtagtgtggaagccatccctgtacatgtttctttccctggcgcttagtatcagcactcatgagggacagttctactggtatactagcaaggaaccacctaatcctggattttctcaggtaaatgtttttgttttttacctgcctgcttaatcctatcgctgattagcatatttgttggataaaaggcctaatccaagtccatattggaagtttgaaacaatagcacatggttttggactggaaaaccaagtttacaatgtgcccccaagtactcttctttttgctctcaacacttctacacataatacagaagtacaaaacacagggacatcataggcatacagatgttctttaaaacagcaactaccttcatttcttctcaagttcatatcatgtctttatgatgctacctttttttttctcagggtttgtttatacttgtcaataagataatacaagtgaggtgcaataggatatgttgaattggtcctacacactaatcaccaatcactttcaagcaacagaaaataacacaatcaaggtatatcaggaaggaaacctagacaaaagtgtgccctttccttcaaactgggaatctagtatgcactcacacgggttatgtccccacaatcttgcttggtccacaatgctgtcctcactgtctgtaacagatgccttatataagatagactatgttatcccaaaaatatttcttcaccttatctcagaatctaagcctggcacataacaattagtcctaatctccatgatctaagagcttataatgaatagatagtacacaatctccatgttcaagcgttacatggaaacttacaatggcattgttccttaaagcttaggcagtcaggccccatttggagagctgggttttctccagattcctagacatttatacaaatataaagtcagggcatgatgagtatgttttgtgaatagcgaaagcaaatgcataaagcatccctcacaaaggataaaagaagactgttgatcatgaaaaattcacacttgttatagggtgaatggagattagcatcagtagttcaatcccttctgatatatgaattatcttgcttaatctaaaggaatctgatctaatccctttctatcagacaagttctaaaggtattataagtgtgaattaaacaatgaaaaaagacacatgtgcaaaaaaaatatttacacacacattacaaatagtattctgggataaaaaaaaattgtggcatagtttactgcggcataatatttgttgtcatctcttcgctccctttttttttcttttttaatgaacataagctatgtacttcctagttatacagaagcattcttaaaataattgtattgatataattatctaagatcaatagatcttcctttatcttaaaaagacataaacagtttccacatatttcttttttcacttaatctaaccagtttttgttaaacaagtgctaactgctaagggcgtcataagagtaaattaaattaaacaatggaaaaggacgcatgtacaaaaaagattcttacgaacagtttacaagtagtagtttgggataagatcaattgtggtcatagtttactgctgcctaatatttgttgtcaaaatttcccaattctttttctttttaataatcataagctatgtgcatcctacttatacagaaatgttcttaacgatacgattatctaagatcaataaagctttccttcatctgaaaagatacaaacagcttacaaagatttctttttcggcttaatccaaccgcattttgttaaacaggtgctaagggtgtcaataatggattgagatcctctgacgtaaagtcagtggaacatggtgattgacatgtgggccccaccgctcttgggcccacctgtcagtgaccacatccaggggcgaagccacgtgtagggcaacttgggcttgggccccacacgtggcaaaaatttttaatggagaaacactgaaatttacgtagaatttgcacacaaaatttatagttatatggtttagccctactcttgctaaaatgctgcctccgcccctgaccacgtcagggggtaactttacgtcagaggatccgtttccgtcaataatgttgtcacaagattaaaaatagtactcatcccattgcatatgcaggaatttgttggtatggtccatgccatcggcgcagttgcatccatggtgggcgtcctggtgtaccacaagtacctcaaggactaccctttccggagcatcctcttctacgcgcagctgctgtacggcgtctccggcctcctcgacctcaccttcgtgctccggtggaacctcctcctcggcgtgcccgacgccgccttcgtcaccctggaggagtgctgcgcccgcgtcgtcggccgcgtcaggctgatgccgatgatggtgctcagcaccaagctgtgcccgccgggcgccgagggcaccttcttcgcgctgctcatgtgcatcgacagcgcc

SEQ ID NO: 5736 - DNA, 2380 bp, Oryza sativa
cgacggcgacgacgaggagaggctgcagctcgcgaaattcgctgatcacgtcgacgacgacgacgacgacgactgaacatagttgatcatacgacattgttgcagcgcgttcttgcatgcatcctgtcactgtcaggggaggatgcagctatagtagctctgatcaatcgatcagatagattcgttgattccttcatggcgaacgcatgcatgtctctgatgagacgttgcccagtgacagaaatggcatctctctctgtacgggcaacccggagtggaaagatgagctgggatgtacggattctgttttctgttcatttggttagcataggaggattctacagagaaaaaaaaaaaagggagaatttgaaccatgccacacaaattttacaaaatttgtgatatgccaccctgacccacatgttattgactcatgtgggtcttatatgtcattgagatacgggtggtatatctcaaatttataaatatagggtggcatggttccaacaaacccaaaaaaaaaaatgaagtgatactaaactctggatttgttttagaaaagatgctgaactttgggttctatctcaggttgcagtacatctctactttataagtaagttataacaactgggaatatatatagtagactatatacacagatttgttattcattgatcgtctgatttcttgctcatccttacttgatatcctcatcatggaatgctttctaaggttcgtgctctgttggctttctaggtttctccggcaacggtggcaatggtggccatctcctgtttgaaagtgatgattggctgatgaaatgaaatgggacgactcacttaattaacgtgatacattaatattttaaaagataattaattaataactaggaacaagcggatggaaaataagtagaaaaacatattttataggcatgaagtaaataatccataaataatacgagccaataatctgccgaaaaaaagttccgaactagccatatataggcatctactccatctgtcccaaaataaaacaatctcgctaagatgtgatacatcctagtatatgtccagattcattgtacttggatgtgtcacatcttagtacaaggttagcttattttacagaaaaactaatacacggaatcccgtcgggggcatagggacacgtgataaaacaggggtaagcattatatatttcctagatccgtttctcccgaatcaagtttcccccaccgatttatttttctcccctaccgaggagtagcacttcgtcttcctcctccctccatccactcctctgccccagtggccatcctccttctccctgtcctcgattccttgaccatcgtcttcaacgccgatgatatcccctatcctcttttccccctttctacaccgaatctggagcatgtgagagtgtggaggttgtcgagggcatgggggttatagccaaggacgaagccaactatgactatgaggttgggggttgccatgtgcgagcagaaggaaagagaggcggctaggccgagggggacgagctcctgggcaccaacatgaaggtggaggcgtccagtctcgacgaagatgatgaccttggtgttgatgaagtggatcgatgagaggtcgtcgggtttcttcatgctccttgctagcctatcacttctactcgctaatgttgtgtacaggtatgtcacagctgataccttaggtattagagggttgataccaaggtttgataccttggggtatcatgtctggtacccaagtactagggtctggtaccttggggtatcatgcctggtacccaagtactagggtctggtacctcgggtattgtgcctaatacctaggtaccaggatctggtaccttggggtatcatgcctggtatcttaggtaccagccggtacccataggtactaggtgcatgttatcaagtaggagtattaggtatcgggtctggtacatatggtatcaggtgccaggtcaagacatgaggaaagatagtgcattgtcatcgtttggttgaccaacaagtcactatcattgtctcatcttctcttctcccttcctctcatcgacgcctccctccttcttttgttgttgttgtgattagtgagggcaaggagctaggggtgccactgtttcatttatttacaacatgggtgctcgaacatggggaagacaggtggtgggggattagattcataaagtatcccgttggaatggaatcccgtgctgtagcaatcctcttattttaggatagatggagtagacagcaatacaatgtttgttgtgagatagtggtaacgacactaaacctacccttgatataggagtttatggttgattaggacgaaggatttgcaattgagtc

SEQ ID NO: 5737 - DNA, 6670 bp, Oryza sativa
attacgtagatcctcacaccagcgtaccccaataccctctatatccggtctacgggtatcccccgtcgacataatgaaagtgatgtcttatctggcgaaggcatgacagtagtaacaacaacgatgatagctaggttagtgtttagagtttcggggtaaggattgggggtagggctaaggttagaggttagtgtaaggggaagaaaagggtttcctgtgttagatggtggaccgacagggacagtagacatgtgttagtagtgagacaacagagccatcaacaaagcatgagtttgaaggaggacaatgagcgaggtcgatgatagagaagttaggaggtaatggtatctctggcagccttaaccaccaaagatgggggaagaatatggcagggcagagaggggaggcacctcaccgttgtttgacttagtaaggagagggtaagaggaggggggaggtcgaccttgtaggactcgtgggtacctcaccgttgtgcacgaagcatgttaggcgttggtggggagaaacacctgaggggagaagataaggttggaatcattgtagcaacatggatcttgttgcaatctagaccctctaaatatgagtgaaatttatagtaactggaaattagatagtcaacttagacaattacgatggtgaaagaaacaaagtggttaataagtggtgaccatgaatatgaatccatggtagtgggtgatccctggttaacttatcattgtgaaaattggtggaatatcatagtgtgacttggcccaagttagccttgattttggcatgttgcttcttcactataagaaattcaaacaaccaaacgtcatgtaccagttgttcagctcccagcttataaaatggcaaaggctaatacaccaaaatgttttcaattgatttccatgcacaagtagaacccatgttaaaaaaacacaactttcctatctcctcttatactgaggcaagaggtgtaccttgcgcaaaatttggtttatcgtctcgctttgccatactcttttaggtatgtgcttgtttcattgcaaagttggtgcatgtcatagatatttaatttttagaccccacgtgctatacatttactatgttttagtcaaatcttatcttagatgcgaccataagtttgttagttgtcttcaatatttgtctcacctaaattatctttagggtgtaattcactagaccttttaacaatagtacattatcattttcttctcgttttaaccatcaaaccaacaatattcccttattcccttatcatcctcgtttgttttctccccccccccctcgttttttctatgagagcctcattggtcgcccatatttcctaataagaaaaacggtttattagaggaaaaaaataatttataagtaaaacttttatgtatttgttcgtagtaacttaaatgccaacattaaaaggaaattacgttgagaatatcttataatcaacttcaaaattaagttcaaaaattcaaattttggttttttttctttggttcattaggtcaaccgatgggactatgaaatgataatcctctactaattctctttaacttagcttaaaataatatatacttttaatagatgaagagagtaactttcgccaagtttaagagtgaaccaaacatgacctataaaccctggagtgagccctaaacatggtaaaggctgtgtttagttccaccggtaaaaagaatttattgggtcatatcagatatatggataccacatttgaagtatgaaacgtagactaataacaaaacaaattacataatacgcatgtaaactacgagacgaatttattaagcctaattaatctatcattagcaaatatttattgtagcaccacatcatcagattatggcgcaattaggctgtcgacgggggatacccgtagactagatatagagggtattagggtacgctggtacgaggatctacgtaatacgacatcaagcaacaaaaaacagggattatactggttcaggccccttaataggtaatagccctaatccagttgatatgggattatatgacggaaatcacaaattacaaagggaatagtggaactcgatgataccgacgagatcgtagttgagttggttcgactagatcacccggcgacttggctcctgtaggttctggctttgtaggctgtagtggatgtgttggcgataagattcgatgccttaggtcctcccggggggtctctttataccgcaggtcagttggtctccaagtaggactcggagacatcggaccctacacgatacagtgacgacccagttctatccgagtaggaatctttccatctgtggactccgtgatgaatttccttaacgtgtacagagaacgtccgtatacgcgcagatataccatatcgatgtatgacgtatatccaagggtagagggtataccttatccgtaaccctgacataggcttaaaagattcgtctcgcaatttatatacaaactgtgtaattagtttttttaatatttaatactctatggtcatgttcttttctctaacaaaagttggattaagattaagatttttgtggcacgcttttcaaactgctaaacgatgtgtttcgtgcgaaaactttctatatgaaagttgctctaaaatatcatattaatctattttttaagtttgtgtaaaactcaatcaattataagttaataccatcttattttacgtaaaaaacttaatcttcatctttatttttaagagattcaaacaccacctatccaacgtttgatgtgatgaagaaaaaaaatttgccggtggatctagacacccccgaagaatcaatgtgccatgagtcatcagtcatgactcatgacacgatgggcacacggtcacgcaccacatggcgccggcgccgtgccacgctgacccttcttctcttcccccgttgcggctgacaaactattaatgcccccctcacgccccgtgttcaattcgccccccaaaaaccaaacctcccttctctctctctcctccttatctccagttctccacccacccaccctcagtgccactaaaataaaggccaccggtgtcagcgcgtggggcccacctaccggcccccaccaccctgtcagacacgatcagagacaccccaacccaacccaacccaacccaagccccgcggcgacacccgagagagctcagctcagctcagctcggcgacgacgacgagcgcgcgcgcgtctgccgctgctgcggctgccgagcaagaggacatgcatgtgaagtccccccgctactactcaataattcctccgcttccttcctctcggctctcaccccacccaggccgcagcgaccaccaccaccgcgccgcggggcccacccacccctcgcgtcctccagccgccagccaagccagctcctgcgcctttgttcccatgcgcccgcaagaaaccccacccccaccaccacccaagaatctctctcacacacttcactcggtcttcctcttcttcttctttccatctctctctctctctctctggtctcagtgaggtgaggtgaggtgaaggtcagtgatggcgtggggggcttgcgctctgctcctcctcctcctggtacttggtgcgggaggaggaggaggggtgcattgcctggaggtgacgaggagcaggagagccttgcagaggaggcaccacctgaggtcaagtgagttctctttgcattgatcccttctttgctcatcgccttcttcttcttcttctctccttctttcttgatgctcttcgatggcatgggattgggtagctagctagctagaacggattccatgcttttcattgcttggtgttcaggcttcagacaccatagttttctctgaacatgcataggtgttgacgtgttgttgtaacacgataatctgcaatgtgttggtttgatggtgcttgcgttcttgattagttaatgattactgctcccagttttacatcgtagtgttgccaatggggggaaaaatgacccgttttggcaagaaaagtggaggcgcgtgaattgccaagatgtgagtgtgactgcgccatgaatgtgatgagctccttctatatctatggtgttcgttggtcagcggctcacccggggcgtttgccaaaagtagcacgcctccaatgtagccttcgaccatgggaagaattgcataaacaatgatgggaatagtagctagtgagctggtagattgatttccatgtggttggtgaatggtggtgactcggactgatcgatgatgctttgaggtttttcaggagcagagagtggcgccaccatactggagctcaggcaccatggcggcggcggcggcggcggctcggggaagagcggcgggaggagcagggaggaggagctcggcggcctcttctcctccgacgccgcgcgcgtctcgtcgctgcagcgtcgcgcaggcggcgggtcttgggcggaggacgaggcggcggcggcggcggcgaccgggcgggtgcccgtcacgtccggggcgaggctacggacgctgaactacgtggccaccgtggggcttggcggcggcgaggcgacggtgatcgtggacacggcgagcgagctcacctgggtgcagtgcgcgccgtgcgcgtcgtgccacgaccagcagggcccgctgttcgacccggcgtcgtcgccgtcctacgccgtgctgccgtgcaactcctcctcctgcgacgcgctgcaggtggccaccggctcggcggccggggcgtgcggcggcggcgagcagccttcctgcagctacaccctcagctaccgtgacggctcctactcccagggcgtcctggcgcacgacaagctgagcctcgccggcgaggtcatcgacggcttcgtgttcggctgcggcaccagcaaccaggggccattcggcggcacctccggtctgatgggtctaggccggagccagctctcgctgatatcacaaaccatggatcaattcggtggtgtcttctcatactgcctacctctcaaggagtcagaatcatcagggtctctcgtcctcggcgacgacacctcggtgtaccggaattcaaccccaattgtgtacacaaccatggtttccgacccggtgcaagggcccttctactttgttaacctgaccgggatcaccattggcggccaggaggtagaatcttcagctggcaaggttatcgtcgactcgggaacgatcatcacgagcctcgtgccttcggtgtacaatgcggtcaaggcagagttcttgagccagttcgcggagtatccgcaagcgccggggttctcgattcttgacacttgcttcaacttgacagggttcagagagtgcagattcctagcctgaagtttgtgtttgaaggcaatgtggaggtggaggttgattccagtggagtgctctactttgtcagcagtgattcttctcaggtttgcttggctctggcctccctgaaatctgagtatgaaacttcaatcattggtaattaccagcagaagaatctgagggtcatatttgacactctaggatctcaaattggatttgcacaagagacttgtgattatatttaacatgatttgatttggagggggaagggggccatgagctatgtgaatatccctatacctggagatctgttttgagattacttctggtaattggcaaatggtagtacagtattagttattgtcaaatgtacaagcatctataattgcttcattctgttttttttttttactgccgtttctttgtgcttcagttcatcctagattaatatcgtttcaagaaacaagtggattttttttgtttgtcttcttgtttcattagatcctacaacttccttgtaatttcagatcctactgtagatcatccagtgcatattgacaacaagaagcacaataccaacttgtaaatttagaggggaaggcagtagtggttatgttttttttttaatgaaagaaattaggcataagtgagcatgtacagcaactgcgcaatcacttgagagaatgccgaataagaaaatttatgtaaaaagaaagcagatcaggacatgccgatcctatagcgatcagatctgacacatgaggtcggcactacctttccaaatgaagacatctgcaagaaacagcagacagagaatatacactatgcagaaatgtgcttttacaggatacagatcaaatcatacgccagagttactgatagtataaattaaaaatgaaagaagaataaaaggctagaatcgcattctcagttctcacatcacccaattgggaatgcgagctccagtggtttcaggtattctatctcatgaaaactgaaaaaataactggcaaatgatagttgtaacttatgaacaaaatatatttgcctataacccagtacatgtctcctgaagtttcacatttttcatgcattttttttcaaccattcactttgttctggctagaatggaagaaaaaactaccaaacaaacaagcagtcttagccactgagctaccaatactgcaatacatactgctgcaccattatgtacttacatgaatactcggagggaattttttttaatagaatacaaaaactgaagtagtagtacaatcacggattcagaatctaaagcaaggtacagtctcgcgctaagcact

SEQ ID NO: 5738 - DNA, 735 bp, Oryza sativa
cccctctgtcagcttcagcagcggcaacgcccttcgctgttgcaggaacgacacaaaccttacaagcaagttaaaatatattataaagaacgagtaagtcagtaatttctcaaaacctatggacgagtatttcaggtaatgtttaaaagaatgttatcctgtgagcaaaacatctgatcggagagaatatcgtaattggatgggcaatcgggcacactttttcctctatatttatatgttgtgtgctctttgaaatatcagcaaggtgatatgttggactgcgatctctcttatcacaaagtatgctacgaggcacagcagatactggaacttctatagactactgttcttgtacttgagtggtttgcacaggttacaagacgtttcgactttgattaaagttaaactactttaaatttgactaattttataaataaatatgataatatatcaaaaggaggtagtatgtcaaagttaaaatatcttattacctgaaacggaggtagtatgttattacaattttcagagatatatacatgtatcagacaactatactcgaccataaggatttggactgggaggatccaagagcagtcgccctacatacggcatcagttgttctcgtgaagttctagctaaagatgatcacatatgcattctaaccccagaaacagtaagagtaataacataggagggggtctgtcttcggatctcgtggatatgtgatcatcttga

SEQ ID NO: 5739 - DNA, 226 bp, Oryza sativa
ttcccggactgcagctggagcaccttcacggcgaccatggtgccgtcgcgcagcgtgccgcggtacacgcggccgtagctgcccgtgccgatgagccggtctgggctgaactcctccgtcgcctcgaccagctcccggtacgtgatccgcgggaacttgtacttcatcaccggcgacgagccgccgccgccgcggcgtcggcccctcctgaactcctcccgcaccg

SEQ ID NO: 5740 - DNA, 869 bp, Oryza sativa
accacagtaagaaaactgatattgtgacaaggcacacattcaaatgcaacaggtggaggaaaccaagtgatccaaaggagaaggacctgcctgaggttgatgaagttgaaaattgtctgcaaacaaacacaacaaatcctttattaaaaaattgaaaacagaccaaagtggttaccccaattgcaaaacttaaatggggataacattgaagaggggcttttggtacattacaaggcttaatctagagcacaatcatccactatctccaccaaaaaaaaaaaattcctaaggtctcacaaacatatgacagatcaggagaaacttttgataagaactctgaacaaaatcaatgtgcccacaaggacgattatgtctgttttgtcatatgttaggggtggcttgtctacagttccttacacaaaaaaggctatgagcaattatagagattgtgttagaagagaaagtgggaaaaatgacatgatgcagtgtttggatttttttgagaagaaaagatcagaggatccattgttttattttagattcagaactgatgagaacaatgttgtgaagagtctgttttggtccgatgggaacaacagaaaattttatgagatgtttggtgacatagttttgacacgacgtacaagaccaataggtatgatttgccctttgctccatttgtagggataactagtcatggtgacaattgcctatttggttatgcattcctacaagatgaaacaagtgagacttttcagtggttgttcaatacgttccttgattgtatgggtggcaaggctcctgctactattataactgatcaagacttggcaatgaaagctgctattgccatagtttttccagacact

SEQ ID NO: 5741 - DNA, 3020 bp, Oryza sativa
aactgtgtcctttgtactaatgtatagcatgcgtgatttttacagttttttgaactggatccatcacataccaaagtttttccttcttatctttcaaactggcattccttgtttctcttgggattaattttctttcctgtctatctcctggtcgtgaattctatatgctaggtgttaaacgtcttagtttacagtgatgggcaatcatctgattaaataaattactctcgttgtgatgcggttaatcattgggcataagctgaagccaaattgccttcctggtatccgtagcttggtagcagttgtttcttggttgtgtttgaattagattgctcaaagtcatttgtcgactaaaaagaaaggctttgtttatgcctgctatatctgagcatgtacttgtttctttttcctcctctttgtggctagggcgctaggttagtgcagaatagatctgagggttaggagaattaagcttcactctgttactattatatggtaggcaccactatgttttgttgttttgggcaacttggtaaagttagatggtttaatttattattaaggaaagaagaaaacgatggtcatctcaccatcttcctaataattgataggagttcactttcccttcagttaaagaatccacactgcaagttgcttcgttacggccggcttttgaaacaatctggtagttctgtactactgatgaatgcaataacatagtgatgagaggcataaagcagaatgtgatgttgggatcttatggcaagatgctttcgtagcaagctaacctgatgaaaacaaggcaacctgagcttaagtcatccttttgtacagataatcctcaaaagagagaaagggatggtgctaatcttaagtgaacatgataggtttttggacattagtggctaacagatgcatgcgtgtcctgattaccaactctagtggcgcctttcgcatgcttttcttaagtgaactggaataaccggaaagcgaggtgtgcaaatgtgcagtctatttaacagccacctcatgttttcgtccattgtcgatagacagtgcatgtctttggcaagacctttataccttagaataataggaatgtgttttgttgttgtcatttgtttgagagagcgactgttcatgatttatgggcagccatatgctggttggatacgcatttgatttcagaatattgatctgagactgcctttaggctcatatactagtttttttttgcaccattctatggttatccaccattgatgtgtgtaatttgaaaaaaaataactccataagaaacgttaaaactaggtaaaagctattattagaattttttaggactattattatattatctagggaaaatatatgtttgtttttgcaatattatttgcttacggtttctattttatgcatgcagatatgtgatctcagacctcgcaacagatgtcattgtgcatgtcagcgaagtcaaattttacttacataaggttgggctcctaatatttctccacaactgcactgaagttaactcaaaagtattatatcttttctttagaatagtgacaaaggtagaaacaagcactgctgctagacatgtattacaacttacatatagtatatcctgaggcttagccgcataggtgctcaaacttaggatttcattttcatactctcagtaacagagcatattcactattcagcatttatgtttcacatctgattgttgctgcgctatcgctttccaataagctgcatactgtttcatgttaaatttttcattggcagtatctcaataaatgtttggtgtgattagtatttatttgtaaatattagaactatagtgaccttgtcatattttcgtttgcatggaaagtttctagcttaaagaaagtgatctatgctgcatgaaaagctgttgaatcaagtaaataataggctgcatggaccacttctgtacttgatcagttgatctctgtgctagcaacccttttgcaagtaattactgttgtgtgagatagctatttaagtcctgctgtgactatcagattgtttcaacaacaattatttgactgaaaatactacttaaagaaacagtaccttggaataagagggatacactgactagtgcaattctccaccttttaagaaaaaacaaactccgacattttgcattgtacaaacgttatttcttataaatgtttatgttttcttgctggtgaatggtgatgattggtattcagggaaatgtcttattgacaaacataactgaaaaaatatttttgattttgattgcttgtgcagtttccccttctgtccaagagcagcaagcttcagaggttagttattaaggccaccgaggaggggactgatgaggtccacatagatggctttcctggaggagtgacagcgttcgaaatatgcgttaagttctgctatgggatggttgttaccctcagtcctcacaatgttgttgcagcaagatgtgcagcagagtaccttgaaatgactgaagatgtggacaagggaaacttgatattcaaaatcgatgtcttcataaattctagcatcctccgtagctggaaagactctatcattgttctccagagcacaaaagcactattaccttggtccgaagagctgaaggtcatcggcagatgtatagatgctattgcttcaaagacatctgtggatccagctaatgtaacctggtcatacagtcacagcaggaaaggaatgagctgtactgaaatagttgaatcaacaggaagaacatcaatagctcctaaagactggtgggttgaggacttatgcgagctcgatgttgacctctacaagagagtgatggttgctgtcaaatcgaggggagaatgtcacctgaattgataggggaagcccttaaagcatatgctgtcagatggctgccagattcttataatgctttggtcgcggaggatcacatagaaggaaccaatgtttggtcgagactataatatggttattgccgtcagataagacat

SEQ ID NO: 5742 - DNA, 3003 bp, Oryza sativa
tgagcttaactttgaacaagaatccactttggctttaggagagctggttgatggctatctatctgaagtagcttcagatccagacctttcattgtctacatttgttgaactagcaacagcggttccagaagcagctaggcctgttcatgacagcttgtactcagctgttgatgcatatctcaaggtatgttcataacacttacaaatatgtgtatagtactaccctgtttgggattgtgactcatcaataagttactcggtgctgcactcttctaaaactcaagattaatgcatttttatttttcttttgctctggcatagaagcagacttgataaatcacttgtatccaactcaacccctgtaaatgttgtatgttataacttataacggcatctgatcatttgcttctttctaatcaggagcatccaaacataagtaaagccgacaagaagaagatctgcggtctgatagatgtcaagaagctttcaacagatgcaagcatgcacgccacgcaaaacgaccgcctaccgctccggttggtggtgcaggtcctcttcttccaacagctgagggcgggttccagcaatgcgcttgctctaacggatggtggaggacacacgtgcgcaaagcctattatgaaggatcagagtgacatttgcgaaagacggataccaaggcatccaaactcgctgaacaagcaagcgaccagcctaagcgcgagagaggtcgagcaccggaagagcgagcacaggggaggaggcaggaacagcttcaaggaccagcttggcggcttccttctgcagtcaaggtccaggaggatctttgacaagatatggagcagcaaggggcagggagagaatggcaaaggttcagagacgtcaggtagctcacagagcccgccattgtcggctaagcctgcagatgtgaagccctctcccctcccacctcttaggaacaggagatattctgtttcatagggttcttgtttacttcttttaatttagctctgggttaggttgtacagaaaagataagttgatcagctggctgcacatcatttttggtttgatccttgctcagatcagtgaagagaaaggtgtgggggtaagggtgtaagcactaagtactaagcacttgttctacctgctgctttctgtatgtttatcaagttgtagcttactatagtgtcatcttgacttgagagagatttgctagggccttttattggaaatgtctatgaacaagaagcgaaaaactaatgaaaagggttcatgaggttggtgtttaacacttatcctgttgtttataccagaatacttgagattgcaactttgcaaggcatgacattgaacttaagagtaatggattgcatgttggcataagtggacttgatttttgcactggacttgtctggctactgcactatttgccatcacaaaaatcataacactacgtgacatctccaaattcagctatcactgaacactgatttagcaaaagaattggcgaccacagaagattcaatcaacggagctaaaaccacagcacatccaacagtgaagactggtgaatctggaataatatgcctcaaatcatataagataataacatggaagacaacctctcccactaggcaaatgtgcaaagctagcatgttattatcccttcgcaagttccatgccaacaagagtaaattttctcagccattcgaaggtattgagctaagtactagcacattagctttactaataaccacccctcagagcaaggacaagatggaggacagagccaccttcgatgttatagtccttcgcagtcttgtcgtcggcaagctgcttaccagcatagataagcctacaagaagaaaccaaatacttttgtcagctcagataatactagtcctagatatatagtagcagaccacctttgcaccgatgtgtgaaaaatttagaaactggtttgagcagaatatgaaatgcagttccaagaatatacacctttgctgcacgggaggaatgccttctttctcctcaacacgctccttgatcctatcgatcgtgtcggtgggctcaatgtcaatttcaatctcttttccagtgagggtcttaaccttgatcatagtgccacccctgagcctgaggaccaagtgaagagttgactccttctgaatgttgtagtcggccagtgtgcgcccatcttccagctgcttgccggcgaatatcaaacgctgttgatctggagggatcccttccttgtcctgcgacagtgaacaaaataacttgttagcttagtttccactgaccgaagtagctgctacaaactgtcactgcacttgttttttacaattgtaagacaggcatcgacaacgcagaattatggatgatattctgatcaaactggcaacaaacgatatgataggaccaatagaccaatgatacgcttctaaatctcatggaatcgatcaatcattagacaaagagtatggggaccttcactgaaagaatgaattccataaaggcagtaaggttcgcatgtctaggagaaataaaggacaacgtcataaataatgagataaaatatgagtatgccattggaccacaccatttgacatattctccactaccctaggcagcttttcaagattaccatctatctttatttcttgactattgactaataatctatatactaatacaacacacaactcaaagcatctttaattccagacaagtcaaatttcatagcaagggacgatgttattgattatttattgaattgtacagtactattcaacctgacaaacattgtgcaatcacatggaaatggagcgttcattatcaaatttgcacgaattcggcgatctcaacctcaagaggagcaactaccgtattcatcctcaatgttaatttctccccgaacatattatcctactaccgtattcatcctcaatgttaatttctccccgaacatattatcctttcgtgcttgatctaattttagtgc

SEQ ID NO: 5743 - DNA, 281 bp, Oryza sativa
caatatttattagaacatgagcaacactgcagctagccgagggagagaacacatcaactcccggcccaatatatagcacaccacaaggaacagagaacagcaggccggcgcaaggaggggctagccccagtaagctacagtttccatagcgacagtgatacttcgcctttaacacgaggcagatctcgcaacaacgacaggatgatcaccagccaaaatcaaaacttgcgtcctaagatgcttcagccagctgctgctgctgctgcccctcacctgcattt

SEQ ID NO: 5744 - DNA, 12586 bp, Oryza sativa
ctgagtttctatcttggagcacaagacatttttttaagggaaccagggagtggaccatttttgtgacagaacccaaatcggagctaaaaggcccaaaacggtttcatgtgagagcccatttgttttgttgaaaaaagcccaaatcacagctaaaaaactgaaaatccagactcactgaactataacccaaaaagacttgggcccataccttcgttggcccataacacagcacaaaaaactagggcccaacattgggcttttgtaagtttttggacccaaaagtgtgttttaaccagttttgggctttgggctttttgttagtttttgggcccaaacatccgcaccagattgtgatcttttttgcacgtcacgttttgattttttgagctttaccgttagatacatatctaatggtgcataaagttgactgaccaaacgcaaaaattgcaatcgactgcagaataggcggtccctaaaaacaaatgcatgcacataaagattggatcgtggttgtatcatgtaaaattaaatgattgcttacactcaaaagtcagagtaaacatgatggagtaatatcaagttctttctcacatattcttcattgagaaaattgctcatgcatctcggttttcatgatatcctttcctgcccctgagtttctattttcatcccatctatgcctattatgtatctgaccgtgttctgaccattagatttccccaaatgactacattgcccttctcacaagtcacaagcatgttttagtaccttcatatcaaaatatagcaacattgggttatgaatctaatcacacagttatctaaatcaatagctaaaatggttatgttttaggatagaaggagcacttactttcttaaaaaaataataacttccaatgtgaaaagatttaatttagaataaaatcaagggggacaaaattatttgaccccacatttgaaaaaacaattccaaacaaatgtcaaaaacaatgaattttgtagaaaagtttcactgaggatttgaaaaccaaaactattttttacttgaatttaaattccaatgaaactattgtatgaatttcagcaagtttgatttgaaagttatttagaaatttcacttttctaatgtatgatcaaataagtctatcctttttttatatataaatgaatgtgttcaatttgagaactatatttattagtaatccctccattccataatataaggcacaactaaaaagatgtttcataatataatggcatgaattcatgctattaactagccattcttttgcactaaattattattttttaagttcttcatcctcaatagctttaattctattaggtgcatgcattatatttattaatgtgattcaaactatgaggtgataataattatttcttggtctttaggttaagagtgattaagccttatattttggaatggagggagtaataagctagcacataagcacgacaacatataatcgtttcaaaaaactagcaatcaattcaagatcaattaatggaatgagaatagaagggaccaaagtgaaaattcatgggatgtagggaatgaatcaaatttcaagggaatgcaatgatgcaaaaggagtaaaaacctaattagcagccgttcaaaaggaaaaaaaaaagatccactccacaggattaattacaaccaatactgcatctttgtactaaaaactgaaaacatattacaagttgggagctttgtaaaacatatcatggtcatgataataacataacatattatcataagctgataatctttttaaagcataccaaggttatccccatgcattaaaagaaataacataggtatgcatgcatgccataatgtgaaagctggataccttaaactagcacgactgatgattactcttctaatactagtatatccaaacacagtttcaatgctttgacatggtcatggtaaggctgataaaatatcgatcggcaggataagttaaagatgcgtgttatctggtcatacccatgcatgctgcgcatgcacacgcttgaacttgaccatacttagcttaatttctttgattaatttctccccgagaagaaatgcccggtggcttgcatctgactgacctgcctagcgcatctgatcacatttcacctctgcttaatcaattgagatcacaactgatcaggaaacatggtatagataaacagagagagaaaaagaatatcaccgtgaatcgtgatgtggtgatgctttcgctcgtacgtactgtcgtactctctgggtcagtgggtcgtacatctgccacgttgtgttattaaggccagagcccagagcggcgataattatgatggctgcctccttaatttgattgctgcgtgttaactttgctggtgcagtgcttactaagcatgaatgcatggtgtgtttttctaaaggggcacgggggtaatcatagtgccgcgcacgttgcttccgctctaatttattctccattgtccatccaaaagaccaaaaagtagtagcagtatcaagtaccttaagctgtgcgtgtgtacctcgtaacgctctacggctcatttctttttattaatacgattgacaaaatagataaatagtaaaaatacagttttatctaggagtgaaaacgttacggaaactttccggattccggacctattttcggaaacggaatctgtcggttgaaattttcgtaaacggaaacggattcagaaatattttctcggaaacagaatcgaaaatgacaatggcagtttccgtcgaaactcggaatcggtcggaaactttctggaaatttcctcagaattttcggaatttttcttggaatttccagaaatcacgaaatacattggattctttttttaagtactaaatagttaatactatggtgtttggctgttatttttttaaaaaatatttgttatacaaatctaaaattacataagaatattttttccctgcattaggatttatcaacacagcattactaatttattccatagattgtgttttatgatgtactgttgatacttaacaattggacttatatgattgtgttttacgatgaattgttgaccattgagacttgagaattgggtttatcggtttaagggggttttttttattccgataaattttcgttatcgtattcgcaccggttcgttttcgctccgttttcggtttcgataatattcgattctgttttagtatccagggtttccgattccgatttcgattccgaaaagatatatgaaaacgaaaacgataaaagattatttccgtccgtttccgtaccgtcttcacccctagttctatctaataaaaatgggtgaaacagataattgcaaaacgcaataaaaacacttgaacgatcgtttaatagacaaaaaaacaaagagagatagactaaaataattttttaagggattagagccattgccgatatttcttcaagatctatatgcattgagccaatacttaggaattcattgaatatgaaaaacaccaatctttgtttgaaaggaccatttaggaaaaatcatataaaatttaaatcctaaaaaaattcctctacaattgttttgtagtagaaaacttgtacttataagagcatatgttatatattagactttatggatgagtaggaatgatatgatttttgataaaataccatttgttttatatatgcagataattttcaaggcaacacattagctcatgtctttggcacaactacaaaggtgtgatgaagatgaccagcttttaaaggttgtatatcgtaatattgagacaacgattatgcaattatttaccaatttaggatagaggttcacaaacagaattcaataattgtgtactctttatcttgggttgatagtttttggtttgtttgttcttcatgatttgtctttatttctataattctatttaaattaattgcactcattacgagtgttaggctataataattggttgcagctcgttgagcaaaggccgggatgttatattctattatcttaaaaaattgctttgttttaaagccagcctaaaactgagggcctgtttagatcctccaaaatggcaaaagttttgcttttctgaagcactttttactattttggatttaaatactagtagcaaaagttgacaatttgttatttgccatttgctagtccatagtagcaaattatgccaaaaagtgctttgggcactcactctttctctctctccaccaaaaagtgctagaatggcaaaagtttaggatgcatctaaacaccaactagtatttttgtaatgctaaaacttttaccaccaaaacttttgctatttaccatttaacatttgctattccaaatgaatctaaacatgctcctggaaaacgacagcgaattccaaatagcagtgggcgaggcatcacgcatgcgcagcgccataagccagtggtgagtggtgacccgatcagttattgccagtttgccactggaacgtgggaatctcccgtacaaacacacatctcaaactggcgaaatgttttcgcaacgaatagttgtctctctgtgatggacgggtgcgcgcgcgggagggtgcggcgtgtcgcgatcgggcggcgcgcgcggccaccatgtgcgccagagtgcgcgcactgatggaggcgtggggcggggaaacgtggcggttggagagacggcgaacgtggtcaccacgatggggccctcccggccggcctccccggctccggttctatggctccacgtacgtatggtgcgcgcctgcgcgggaaatagagagcctgacggagcaacggcaggcagaggcaggcatatgtgtgtcttcggttcagaaacatcaaaacatgcaggttccatataaaactaatcactgcctgtccagacttcaaaattaatataccaggttacccatagatgttctcatgttcagaatatgatatgactttggcaagataaaaaaagagagaaatagagtgatatttcgccaagttagaattctgcaactaactaaaaatacagcacttattaacaataaaaatgatttttatatataacttttatatgtgcgataaaagaaatatcataattaactttttaaattatgttttaaaatttaaaatttagtaatggctgataaaataaaaagcaaacggtggagccgatgtctcatgatcatgagaactgcgcatattgtgggctataacccgcatttgacttgaagcactcaccgtttcctcttaccatatgtatgtctcaaagttactctcttaattttgtaagtaaaattgatgttttaagacttgtcttcaaaaatactttcatataattgccagtaaagccttatttaaaaaaacaaaatacccttatattttaaaatgaagagaatttaggattataaaagtttgatcgccatcaattttggactctggagggtgtttgctttgatttggattcttcattgaatggactgttcttgaatgctattactagccgcctagcttactccatatcagacatcagtgtcttccagcgatgataaagattgaaaaggtcatcgtaaaataaaggggtctctaccctagagattaggtcagctaatgaagcctaccggcatcattgaccaggctttgttaaatcgtgttaattacttttaatttggtccaaggagatgagctaatccgggaagaactcgcctgctctccttttttcctatgttgttgcttccgttgaacaaatcagttatgaccatgaggtcccatatttctacctccaactacaagtctacaaaattccgattgccccatggaacataaatattgtttgtctgcaccctgcagagaggtactagcatgctattcattcatgtacccatgattcgacaataacatcctaaaaaattgatgtaaaatgcattgttatactcgtatgcgtttcacatttcggtaaccaagctacccctccatcccaaaatataagcatttttaggcttcgtcatcgtcttcgagatgctacttttaccaacaatatctataaaagtaagatattttaaataaaataagttacatattatggtagtttgtttaatgataaatctagtaatatcaattttatatgattgatcttttttatattttttctattaatagttaaagttaaaaacatttgactttgacactatgttgaaaatgtttatattttgggatggatggagtatagattggacaatttatatacgatggatcataaacataaccctcaaagtatttatagtgtttatatgattataaacataatatatttttcaagtttttaaactaatattgaattaatctcgcgctaatcctttgttttgtttttcgtgtcagacagcaagggtgcctccgaactcagtctaaacctgtagttaaccgcagagagacaggagtgttaattctctctgggtacgaagttgcgtgtgcacgagggaaaagcccaggaccacagcccccacctagccaggcccagctcctccaatcccctcatcgccctactgcacagcgcactggtgggggccggggtacacgcccggggtacacgtaccggatcccccgccccccgggtggtggtggggtttagtagtagtcctccatggcttaacaacaagagaagcgcgcaattagggaaaccgtttggtcttccttaattgcgccctcgcccccgcggcaaccgtccttctcctccatctccccttccacgccgctgccctcccctctcctctcccctcccgccgagaaatcggtaagtagtggactagtcgctgcgactccgcgagggttccccggctgcttgtccacgggatcccacgacccggcggcgttgcggcgaggaggaggagagcagtttgggggtctcgccgcgatcgctgaggtgaggttccacgtttacttggtgcagtagttacggtttggttggcgtggagagaagctgcggtgtgtttttgattgaatccgattgagctagggggggaaggaagagggggtttggagctcgtaggctaggacgatgtttggatggtgctccgcgcctccgccgcgtgggttttgacggggatggagcatcggcgagtccggattggcttcgtcgctgttctcggatgatcctggtgcgtggtttgggtttctcgcggcggattccgtggggaactagggtgttgcggcgtgagttctgaggaatctggcttggcatggtttctattggcttgttgccttgttcgttgtctgtatctagggagagttaattttatttaactgcgaaattactttttctccgtactttgagctgttattataggtgatttcggtgcttggggtagtaaacagtgcatttttaaattatgtgctagttaaaccaatttatggcgatcgagccgtacaaatcccctgttgtgaatcctaagagccagggaatatgcctccatctatgctatatgtggttgatttgctcttgctgggtgaattcttctagctaggattatctaatttagagcccaacaatgtaagcatcatgctgttgcctttgagtgtgatattgtttttgcgtttggttagtcgatttgatcgaagaaaattcccggcaacttcaagtgaactctgccaattttatttggcactatgtccactgttatattttttctctttgtctgtattggagcatacaaaatctcaatgcatgtgcatggttcataagtggtaatcattaaaaaaggtccctgtttcccatgctgcttctgatgagaaattattaaacttttttctagcaaagagattcgtctcatctcatgcatgtggattgtcctgtctgttccaaaaccatcagaatctccgcaaacagtttgtttatttgcttcgtcctttctcgaatgctgcatgatcccatgtagcagctgtgattttacccaaaatatctttttttttatgttctgtaatggatgtgcaatgtattcataaatgccaccctcctcccttgcttccaagccactattagatcacttcccatcaccaatctgccttcgatatccctgtgagaggaattgcagcaacaatcatagctgtaaatatttttggtccttgaactggtatagcagcatctcatttctgaattcagccatctgcgatatctgcattacctttttattgcttatttatttgtatatgtgagaagtttctcttgcttacttcaagttaaatagatgattgctttttgtattcgaaaccttctgattgtttggtgttcttctttggatgtttggtagatctcagtttgccaaggggttcaagtttcatgagtcatcttgacgttgttactactgtggaagttgcaattcttcatggatgtcctcaagagtgatgtgaagaagactggtattctcaatgagactctaagaccaccgctagttccatccgagaagcataatgcttctccagtaaaccgtgggagagatgttgcttccaggtacaagaatggtctgtctgctcattctgctgccaccacagcaaggagatgcacatcaccagtcctgggcggacctccgcaaatgaatgcacaccagaaccaaaaagagctcaatcagcagacagaagaaggccctcaactccttcttctagagtgtcaacaccctccacccctgcatcaaggtctgtcacaccagttcgtaatactgttacagagggacataagagttctaggcgaataacaagcacaaggaatactgatggcttgtggccagcaatgcgaaacctatcttcctctttccagtcagaatctgtggttacccccggtaataaaaaggataaggtagtccccagtggatctttggatcaaacgaaggggcaagctagtgttatagccgagaggaagaggagtcctctgagaaggaagaacattggtgaacaatgtgagaatgctcaaccctcagaggaccaacctaggagggtaatcgaacaacaccgctggccagcaatgcagagtggccgtgtggccagcaatattttgtcaaggagtattgacatgtctgacaaagctggcagatcagtcccttcacaaatatttctagaggtgtttcaccaaggaagacgcttgcttctgaaggcacaggcaaagggtttaataaatcattggatgaggtagcaaggagattggctattcatgcaggtggaagagatgacaaagtagactctcgctgtcatgcttatcacagtcaacagagagatgtaaatccgttagccgtccaagtagggcagttactttacctgttcctgttcttcatcgctcatcttcgccaagcaaggcctcttcagttacatcctctatttctaggtcctttcagagcccatctcggacaaggccttcaacacctagccggtcacaaagtgctggaagtattcaatcaggtgttgcgtcacctattattagctacatggttgatgcaaaaaaagaaaagaagaactccagccaaattgaaaatatccaccaattgcacctgtcttataatagatacttgcaatggatcttttgtaaatgcttatgcagaagatactatgtctttccaaaaagtgacagctgaggtaaagttagcatttggtttgcatcacattgcacagtcttccttgttccctttgcagtgtcctcctttgatggataccaacataaccataggtccataagtgtgtttatgcaatgatttgcttcctgatctgataagcttttgagattacttttctttatgatcaattaaaacaagcttccagactatgaaatgtgattaagtaaaatatcagctagatctactggtggttatttgtttgacttaaaaactgacaattgattttgcactgtaaatttgaggtctgctatttcttagcattagtctcttgggtgtgtagatgtactctcctttaatatttgccattatttttttagtgatctttaattgttgaaagttctttctatgttgtcatgtaaaacagagtattatatataatgttttgaggaatacctcgaacttgcgggatgttgttaatatgagaagaatcatggttcaatgcatacaacaagagttgaagctacatggcattcttaaagagcaggtaagctcttcccactcattaatgatttttataattgtataatctaccaaggttgttctaaaatgcaagttatcacgcgttcagatataatcccaacttgtgtcaggttggcacagacttgctataatgctcataatcgaagcacggctggtgaaagtaaatataaacaatttgctatgtagtctcttctgtgaaagataaaggctggttacagagtaaaaagagtcttctgatgcaaataggataaacttaggataacttagcaatgttgaagtaaatacattgaactgcacaataaggacatagttgtgagcttgttatgtcacactttggttttctaaagatggtgagacgtgagatttgaaaagtaggggtttgcaagagatcatttatcctctattggacagcagagagaacatttaatctactccagcagatcacatgacaacactaacatcttcttctttgcaatcaaagcagtgtcaggaaaattcaaaataatgtgcttagaaagcacaaagtctaaatattgtgttgtatcagggaggcatcgctattatatatgcaaaaattaagtatgcaacacagagtaatcggtatctacaatgataagagaaaatataaattgtcaaatgcatacaacaaatttttaatctgctgttattttgattcagattgattaccttgaacaatggccagcacttgaaaaggagaacagtatttcattattccacgcaactgaagctctaaaagcaagcacattgcgtcttccagttacatcaggagcaaaggtatgctgtaaaatgttgcattactgaaatcgcaaacaatttcgtaatttcttcattattaactgctactttgtgattatggctaatggttttaattattgtgttaacaggctgatgtagttgctcttaagaatgccgtaagctctgctgttgatatcatgcaaggtttgggatcagcggttcgctgtatgcttccaaaggtcagctaacagtgcgcatacaactgaaaattttactgtccacttttatctgtctttggaaatcatttttttaaccatatgaagctgattttgttagctcattgtttagtacacatttagcacaagaattaccttttataaggaaaatattatctctggttgtgatcttccatgcccgcctgtagtcatctactcatctttgtgacagttagagatctctaattccctgaaaaaaaaagagtaaagtgtaggggcggtccttaaacttgtaggggtgtgtcatctaggtccctaaactctcaaaatgcatatccaagtcccaaaacttgtcatagtgtgtcatctaggtcccaaatcgccacaacccctttatgattttacgtggcgttaatgtggcatgccacacggacatgacgtggcattattttgactgacaaataggacccatttattttttttcttttttttcttctcggttttcccctttcttctcctttctatgtgatccgtgcagaagaaaggaaaaaaaaagaagaatgagaagaaaacgaaaaagaaaaagaaaagaagaaaaaaaagaaaaaggcacgtcacgtccatgtggcattgccacataagcgacacgtaggatcctataggggatgtgtcaatttgggacctaggtgatacactttgataagttctgtgacctggatatgcattttgagagtttagggacctatatgacataaccctacaagtttaaggaccgctaatgcactttactcaaaaaaaaaaaaaagaaggaaccctgcactggtttctgaggatgaatatacaatagattttaatttttaagtatctaataaagaacaccctccatcttctatcaagttcttttcattggttgcttagttttttttttccgctgggccagccaaaatttattaagaaggggagggttttaaaattacaaatttacagcaaactgcccaaacctggcttagtttcatactgtattatcttaccaggttgaggacaggacatatttggtatcagaactttcagttatagcaagacaagaaaaggccatgcttgatgaatgcagagaattattagctatggcagcaaaactacaggtacttccaatgtaatcccatgtaatctttcctaaatctgaacacagagcccccttgaatatcaaataatgtaatttctctgtaattgatggcaaactgcccatgatggcaacagttcatacacaaagccttacctagagctgttgtattattaatcaggtacaggagtccaacctgcggacgcatctaacacaactgaggccggaatacgctcatatgatttgacaatctaagggaagatctgcatgtccaaaacaacccttctgaacaggtacaccagtgcaagttgagcctatggcgatatgaacatattgagcaaacatacaa

SEQ ID NO: 5745 - DNA, 4564 bp, Oryza sativa
agctctactcttttcgtcagcttgaccaacttaagcgttgggtgaatgctgacatctcactcgtaccaatatatattttctttggattgcagtttactctaaacaacactgttgctgggcacatttcagtttgttgaaatgtcagaagtaccttatgcagtagttgaaatttaaaacataagagttgaattctcatgggatggccaatttgccgtatgcgttcttaggatgttctctcagatttggtatccttttggtttcacttaggctttacacctaggctaagccttgcctaacactttcttacctagatgcaagactcaaaattctagtatttgttttgtttgagtcagtttaaagcaaagctgcctgtgctgcaatctgaatatattccttgtaggaatattacttcagcccttgaccaaatcgattcatatacttttaagctacattaatgcccatggtttggtccaaattacccatatatccctagtaggagcaatgagaacacagctgcaaaaaatctaacaaacatggagtgagaataccagcccttgttgcttaacattcaaatatggccatctgtccattccctcttcaaaagtttaaaccatttctgggtcccaaaatattacagaagaacatagcacgaactcaacacgagcaatacaaaacttttacaaatcgatcttcttgctgcccccctatgcacaaatcttcagaaatcgctgacgccctctctcagcagttgatgccgcactgcctgacgtcagggcccctggccttgatggtgaagggatcaatcctgacccagagcaaggaaaagatggaggcgagcagcacggaccagatgacaacaatggtgggcgtccggttctgcctccccatgagccccttgaggaaggggtagaggtggacgatgacccagaaggcgaagaagagcttcccgaagagcgggccccacgcctcggagccgttgttgatggcgtcggagacgccggcgacgacgccgatgatgttgaggatgagcagcgtggtgggcgggatgaggagggtggtccacttgaaggcgtagagctccgcgaactcgtcgtcctcgtctccggtggccttggacgtgacggtgaagttggtgtcgatcccggccagcaccttgagcaggccctgcaccaccgcgaacaggtgcgccgacacgccgccgatgacccagaactgctcgttcctccaccactcctcgatgctcaccccgctccacctcatctccaggatgcccgtcgcgaagatggagatgaagagcgcgatgaagaacaaactcgcaaacgtgctaatctgcatcaccaagaaaaggttcagaacatttgaaacttcagttttggcgggaaaatccatggaagaagaggagcaattgatggcaggatgggatgggactgaccggaggcatgatgaacttgccggtgaggaggcagacggcgggtagggtgcagtaggcgaggagggggagagaagtgaaggggtagatggtggtgttgatgtaggagaagcgctcgagccacttgaggttgccgttcttgtagccgtagaggagcgggctgtgccggctgaagaagatctcgacggagccgagcgcccaccggagcacctggttgagacggtcagataggttgatcggcgctgaccccttgaacgccgccctcttcggcatgcagtacaccgacctccacccgcggcagtgcatcttgaaccccgttaggatgtcctccgtgatcgacccgtagatccaccccagctgcatcacacacatccatggcgttcacaccacaaactcactcaatggtaatatggcttagtgtctgataacggtggttacctcgagaccccagtcggtcttgtcctcgtagccgcagctgatgacatggatggcctccttgaggagcgcggcggggctggacgacggcgggacgccgccttcctccatcagcgtcgacgtcacgaacgccgccgactgcccgaaccgcttctcgaagttcatctgcgacatgagcatctccttgtcgctgtccatccctgatccaccacacacaaacttacattattccatcagctgaaaatcttctcacaccataatttcttcttagctctgaatttgggagctcaccgccgtcggcggcgacggcctccgggaggccgtccttgccgtgcttccgcttcttcctcccgaagcaagggcagcagtcgcaggtcaccatcttgggcctcttgggtcccttgggtgggttgtatccgtacagcgcctgccgcctgaacacgcaccctgtcccgacgtacaccgggccctggatcccatcaagccccttcatgttgatctgatgatctcaccaagaacgcaccacacaaaatttcagtcacattgctcgatcgatcgtgatttgctctggatttttcaagattgtatatattcatctagtttgtgtgggagagagctcacgtcgaagaagacggtgttgcggttggcgtatcggtcgtggacgtcgatgccgtcgaacctctgcgggaactgcacgtagcaaaccttccgtccgacctgcggatccatgaggaagcacatcgcctccctgatggccttgctgttgttgatgtagtgatcgcaatccaagttgagcatgaacggcgcgttcgtcagcacggccgacacacgaatctgccaagcaaaccagaaatttcgatcaaatcgagcagagttgtgttgttttgaagatgaaggatgtggtggcgtggcgtacgagggcgttcatggcgccggccttcttgtggtgctggaagccggggcgcttctcacgggagacgtagacgaggcgggggagctcgttgccctcggtgtcgtggccgccgctgtggccgaggaacacctggatcatgcccgggtggtcgcgggtgttgttccccggccatggcgtcccgtccttcatgatccacccttccgccggcaccttttgcgccttcgccaccagcgcgttgatcctcaccttgaactcctcgtactctctctgctcgatcaaatgccaatgcccccacaacagttagctcttcgtcaagctcctacagaatcagcaatgacgatggcgatcgatattaccttcatggcgcggcgctcctggacgaagttgggatggaccttgtccttgaggtagtcgaccttctgggagaagtagaactccggggcgcggggctcgatgctgaacttcttgcagaatggcacccacttgcgggcgaactccgccgtctccgacagcgactcgaacgtgagcatggacgcgccgtcgtcggagacgtagcaggacaccttgtcgacggggtagtcgacggcgaggatggacagcacggtgttggccgtgaccagcggcggctccttgagcggatccaccgtgctgacgaacaggtccaccgccgacagcagcgacggctccccctcgcgctcgtagcggagggagaggcggtcgaggtaggtctccctgtcgatcgggtaccacttggggaactggtcgaggatccacgacacggcgaaccagatctcgcagatgatggaggtgagccacagcgggatggcgtcgggcaccgggtggaggatgcggtaccggaggaagaagccgagcaccacgagacggaggatgatcaccatccggtacgggttcaccttgctcgacgcgatcgacaccttcctcgacagcggctgcctcgcctcgtcgttcctgcaagccacagagagttcaggcatgatcaatatactagttgtcatgcatgatcagtgtaagctgctcagctgaggattgcgtacagtgggacgtcggcgtcgtagtcgtcgggatcgggggcgccgccggcgacgatgccctgcttggatttccagtcgtccatcctctccttccagctcacctctttcttctcgtcccactttgcactccctggtcagaattcatcggtagatgattgagatgatcaatgtgtgttcatcaagaacattgattaattagtgtagtgaattcgttatactacctggctcagacaccgggtaggggtggatgcgcttgtgcagggaagaggagaactcgccatggccatggctgttcgatatcgggaactccccgctcacctgaatttttttttacaaagaacatttcgtgaacatgttgaggtgagaagagggagagaatttggtgtgagtggggtgaggtgtgttgtgtgtaccgggacggagcgagcgccggtgatgatcggcgggagcggggtgctgttgccgtcgccgtcgtcggggcccctcccgtagctcatcttgccgtgcagcatcgcctcggtgatgtggctgttctgcatgccatcctgatcctgctgcagctgcttctgcttctcgtcgtcgatgttgaactcgtgctccaggtcgtcaatgtcctcctcgtcctcgtccccgggcaccctcgggctccctgtaacaaaaccaccaccaccaccatcgccattagagatcaatcaacggaaacctcgcgatcgcggtatcaagggcgtagcgtga

SEQ ID NO: 5746 - DNA, 698 bp, Oryza sativa
tgagggtgtatcaaagtaccagtgtattaaaatgtcaattcctttagtagtaaaaatgcaagtttacattctaaatgtcaaacagttcaacacggtaaaatatataaatataccatggtgaacttgggtagttaaaaagtcaccccctcaattgttttttcactaggaaaacaaagaatgtccaacatcgaaagttcgaaacattgtagcttcccacgtgatggtttctcacgcatgtatagtaattggtcatgacttgtgactatatgatttagggtgaaaattcttccatttgatttactcatgttataagaagacttttcacaatggagggcaaaaggaatagactgaagacttacattttcattcacaccggtgtcaatgtttctttctttcttcagaagtcgttctgattcttcaaaagtctccctgctgcacaaactttctagtgtcagtagtaaatcagctagccgaacatttgagcctacggcatattaaacaacagatggcgatgtatttgttttcttttttcgaggtaacggaagggagctcctacattacactatagaagaagagagttgatccagtttataagggaaaaccggaccctaaaaccttacaacggcacggttaattatggaaaaccagcgaaaaccccggccttggacatactgaccccaagaccctaataacagcag

SEQ ID NO: 5747 - DNA, 1390 bp, Oryza sativa
atttttcaaattgaaaggagacactagatggagtataaaccagctacgactaggtgtgtagtcatgtccaatgaaaaatgcatgcattaaagttactttcttttgttctaagttacttctataatatatgtaaattacctttaggctttgctgaatttacttttatatgtctaagaagtaacttagtgaaatctaaaagtaatttagacatatcataaaagtaatttatgatttttcatcaaaatataatcatgtgagatcttgttataaagatttaattattacgaacacaacggtgtaatcggatcgtagatcggatgagtagtttaagagaaaattttatttgaaatataggtggatagagtctctcatagatatagaaccagctaccactagctgtgtagtcatgtctttttttatgtggttccgtctttcttctaagagggaaaaatgtatgtacggtgagccaggttcttgtggatgggaacgaccaatagtggtccagcaatttgcaattaattctgtgcaggagtatggtttttgaggaccctgatataggccaaagtggtctatcaagaagttaatcaagatgcgcatcattaactgctaatgattagctaattagaaaggtaacatctcaagttgttgtaagcaaccaaagataggtcacatgcatctctccatcgatcagctatcacaaaggctgtagcagaatgtaaatatgcatgtagctagccatccccctcctaaaaaccgaaagcccaactctttgattctttttgtagggcatatgcaccggcatcatgacacattttgccgttgtgattatttaactgagattaagctgcgagttgcggctgaaatgattaagtgttatatatcagggatttatttatctggcgcaagctgatggctacgtgtgcaataatgatgtaaactctttttcaatatataagagatgaccatataaactcatatattgatatagatagtgtgagtgtaaagtactacaagtgattttttttttcaattatatggcagatgcacacacaagtatacaacaccatgctcacacatctcgaatgtacctctaacacacgcttaaaagagaggaaaaccaaaggcacaggcacatccttgatctcattaaatttattatattattaaaatggttttgaaagaattcaaagtaccatgttcattgtggaggctagaaattctaacatcaatcagagaaaaaaaataagagttcaagtagaaatgcaatttagaaataactgaaattcagaatattgaaataacaatccatccagaataccaaatgataattaattaagatttgaattaaaaaataataatttccaaaatgaaaaaataaaaaaagattttt

SEQ ID NO: 5748 - DNA, 20928 bp, Oryza sativa
atacacctcttaattaatgaattaatttatgaaacattggtgttttaactatgtctatccacgtgcggatatagaaaccgaatttctatacattattaaaaaaataaaatgttcttacaaaatgtatgatatacactaatgaccatatgactctttttaaggtttatggatttacctagtatcgatctctctacccgttgagtgcatgtaagaaaggatgcacatatgatatatgtgcatgcgtgaatggtatttgttatacaagttatgacaggatatatatgcaacgtgcacatgtgtgataattgaaaaacatatattaatcagggatggacacacccatagggcatagggtggggcgattggccaactatatatggtccacgccgcccccacacccctatatcatcaccaattgtcatctcgcactggtgaagaaatcgtttttagttccggttcgtaacccactacaaatccgagactaaaaatctctatctttagtccggttcaaatactcaggactaaagatcgatctttaatcctggttggtgtagatgggagcggcagtcccagttagtttctttttgtttcatttattgctacttactacttaatctctaacttattttctcccaaattgggtgggatgcatatccccaaatcaaagtaacatcccaaatacacaaatcatatacatcacatatccatgcgatgaatcacatattctcaaaaatgaaattatacatctcaatccatacaatgaatcacaaattctccatctcaatccatacaatggatcacaaaatcttaaaaaaaagaaagaaaagaaagcgaagccgccagccggcttagccgttgccatctccccggccgccgccgcgcaggccgctgtccggcccgccctccccctcctcctgcgcactactcagccacacacgactagggataaggaaagaaaagaaataaggaggaaggaaagagataaggattagagatgaagagagagaagtttgtgtagacgggaaaagaggatgagtactagggattatatagtgcgttttgatatttagtaccggttagtaacaccaactgagactaaagatcatcgtgatctttactcccggttgataatacaaatcgggactaaagatcctggagggccctaacagcgtaacaccaaccgggactaaagatcgtgtagtcccgttctgcttataaaccgggactaaaaaccatctttagtccaggtttttattacaactgggattattgtgatttttggtcgaccgggtaaagatggtttctccactagtttcgtctttactactaaacttgccacctcgctcgtgtaatgactattcatctcctccgctaactcgcttgacacgattcgtgcgatgctagttttgtgacctccttactatggtttgatttgagtgtgttctatgtgtgattatggctatgtctttgtcctctgcggtgcatctgttctatatacgatcatggctgcgtcactgtcctgtctggtgcatcagtaccatcttagatgttcttttgcgtcttaattaattgattgtactttatttatatgctattgcaatataataagtcccgttatttaattttatcgatcattaacctgtattttaaagctatgtctgtcactgatattaaccgagaaattaattaatgttctaattaacactggtggagaaaccatctttcgtcggtcggccgaattccacaatagtcccggatgcaataaaaaccggggctaaagatgatctttagtcccggttaaaaagggtaacgggcatatttgatttttagtcctggttgcctttttaaccggttcaaatgctgtcagggcctgtcaggcccctcgggatctaaagattgtaactttagtcccggttggtaaccaatcgggactaaagatctcggggatctttagccccggttggtaacaccaaccgggactaaagtcccacccctatatatatgtcttctgcctccttcagctgcccgagtaagcttcaaaatttcttcaaaaaagagaggaggtcatgccaaaatttctagtgaatttattttggtgataacatacaaatcggaggtgcctaaaaggtttgcaacttcatcctccaatgttttttttgtcatattacatttgcagctatgatttgcacacttttttgtctccaaaatttagttgtaagttgatgagggagaaaatttgtgtggggaagaaagaatatatagaaattaagttgatttgctaaagaaggttttataaaatagttgagaaggaaaactatactgaaagttaatcttgaatactagaaaacaaactaaaatgaaaattaaaagaagtaaaacacattacaattagtttaaaactttagaaatagtaaaaaagaattatttggtgtaatattttatgatttttgtatgaataaagatatgtcattattgtatgactgttgaaaacagtttgtaattatcttataattattgtatgactgtcattattgtaagaataattatttttgtacgattttttttcgactcatgtagatggatcggcaatggatgtacgctgaccggcggtccaaagagtttatttacggcgtgcactatttttgagagtggctgaagctaacaggcaaaggggttttatttgttgtccatgcaataagtgtaagaatcagaaggagtattctgcatccaggactattcatttccacttgtttgagtcggggatcatgccaagctataattgttggacatcccacggagagcaaggtgttgaaatggaagaagatgaagtggaagacgacaatattccggactttgctcagtacgttggatttgaaggaaatcaaacgggcgaggaggaaagggatgctgatggtaacgacgttgcggatgatcttggtcagatgttgcaagacgccaaggaggactgcgaaagtgaaaagggagcccataaattggacaagatgttagagaaccacggaacttcgttgtacccaggttgcgagcaggggcacaaaaagttggataccactctggagttcttgcaatagaaggcaaaaaatggggttagtgacaaggcatttggcgatttattgaaactcgtcaagaacattcttccggagggaaacaaattgcccgagacaacgtacgaggctaagaagatagtctgcccgctaggactggaagttcagaagattcacgcatgtccaaatgattgtatcctatatcgcggtgaggagtatgacaacctagaagcatgccctgtttgcaaagcactacgatacaagattagacgagacgatccaggagaagttgacgggcagctaacaaagaagagaattcctgctaagtgatgtggtatttccctataataccacggataaggcgtttgttcaggaacaaggggaatgctagaatgatgcgatggcacgctgaagagcgtcaacaggacgggatgctgagacaccccgccgatggttcgcagtggcgaaacatagacagaaaatttaaagaatttggaaaggacgcacgaaacatacagtttggtttgagtacggatggcatgaatccttttagagagatgagcagcggccatagcacttggcccgttacgatgtgtacctacaacctccccccttgcctatgcatgaagaggaagtacataatgatgccaattattattcaaggccccaatcaacctgttaacaacatcgatgtgtacctaaaaccactggtcgaagatcttaagctgttgtggaagaaggaaggtgtccccgtgtgggaccaggacaaacaggaggagtttaacataccatcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcaacaaaccacccggtacggaagaaaggcaagcacttcgaacataaggctgaccaccgtacgaagcctaaatatcgcaacgagaaaagagtgtttgctatggttaaagatcttaaagtagtgttcggaaaggggcctggaagccagcctatagagagcaaagatggtcacgcagcgatgtggaaaaaaaactctatattttgggagttaccctattgggaattcttggacgtacgccagcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaatgaagtcattacttgagtccagccagctacactcttagcaaggcagagaaggaaagtatgtttgaatgcttggagagcataaaggtaccgtctggatactccacgaatatcaagcaaataataagcacgaaggagaagaagttcacaaacctaaagtctcatgactgtcacgtgttgatgacacaactgctaccagttgtaataaggggtatccttccagacaatgtccgggcgacaataacaaagctatgtgcattcatgaacgcaatttcgcagaaggtcatcgatccggatagattagaagcccttcagaatgatgtggtgcaatgtctcgtcagttttgagttgatatttccaccttcatttttcaatataatgacgcatctgctttgtcaccttgtgaaagagatcagtattctcgggcctgtgtacctacacaacatgtttcctttcgagaggtacatgggcgttctgaagaagtatgttcgtaaccgtgctcgtccagaggcaagcatcgccaagggttatggaacagagaaggtcatcgaattttgcgtagaatttatcgaagatcttcgcccaatcgggatacctgaatcacgccatgaagggagactacggggaaagggaactctcggaaggaaagcaataatgacggtagacaataatttattccgtaaagcccattccacggttctgcaacaatcttcattggtagctccttacatcgaggagcacttggctctagttcgcgccaggaacatcggtaagtccgatgcatggattacacggcatcacattgatactttccccgcgtggatacgacaacatctcatgggtaacgagtcgatcaaccaacaacttgccttcctagcgaggggaccgtctgggtcgatcgcgacattccagagatatgagatcaatgggtacacattctacacgagagcccaagacatgatgagcacgaaccaaaacatcgctgttcgtgtcgatgccatgggacacaatggaacaactggcacgtattacggtgccatcgaggacatatgggaacttgactatggtcctctcaaggtccctctgttccggtgccaatgggttaggttgactggtggaggcgtaatgattgatggcagtgggatgacaacggttgaccttaacaaggttggatactcggacgaaccttttgtccttgccaatgatgtaacgcaagtctttttcgtgaagaacatgtctagcaaaggaaagaagggcagagggcctgacgagcctaagcgtcacgtggttctcccaggcaaaagaaaaatcgtcggagttgaggacaagactgacaaggattacgatcagttggatgggcaacccctttcacggtgacgattgaccctagcatcctcctatcaaatgaagacaccccttactcacgtagcgatcacaaggagggaacaatagtgaggagaaagtgcatgtggtcaaccgtcaccgccgatgtattgccgtaattattgtgtacacgatataaactattttggatgtattgattatccatataaatcaattgatgtatggcatatgttaattacgcacgattattagaggttttaacaagtttaaatcatgtatatgctagttatatgcgatacttacaatttttaaaagttttaaatcacgcaggtggcaatttcatatgttaattagagtttttaacatttaatttactataattcatatgctaattataattgactagagaatttttaaaagtttcaaatcatgcatgtggcatttacatatgttaattagagtttttcacaatttaatttactatcattcatatgctaattatatatgactattcgaatttttaaaatttttaaatcatgcatgtggcatttacatatgttaattagagtttttcacaatttaatttaatataattcctatgctaagtatatatgattattacaatttttattaattttaaatcatgccgtatgtatatacgtatgttaattagagtttttacagatttaataatatcattcatatgctaagtatatatgattattagaatttttattaattttaaatcatatatttgcttattacgttttatccgccgcgccgctccgccaccgctccgctgccgccacaccgccgtcccgctgccgccacaccgagaatgtgaacgagcgaacgaacgtgaacgagccaacgaacgtgaatgagaacgagcgaatgaacgtgaacgagaacaaggtgaatgaacgtgaacgagaacgagcgaacgaacgtgaacgagccaacgaacgtgaatgagaacgagagaacgaacgtgaacgagaacaaggtgaatgaacgtgaacgagaacgttgtcagacgaacgtgaacgagccaacgaacgtgaacgtgaaatgcaattataggcaggttaatgaaatatatcctgaaggggcagacaccgaacttcgacacattcccaaagctaagggatcactgggacgagttcgttgcatataagacaggtgaacaagggcaggcgatgatggaaagaaacaaagaaaatgccgccaagaaaaagtaccatcaccacttggggtcaggcggctatagcgtcgcgatgccgaagtgggaggagatggaggctagcttgcttgagaggggtatcgaaccggccaccgctaattggccggaacgatcgaagttttggtacatggaacgctcaacccagctgatggctcactggtcttcggcgatcagatacgagaggttgcgcgtcgactaacagacgcagtggaagtctcttctcagggcacgttccgaccggatagagagagggacgagctgttactcgccctgcagactccagagcatccaggacgaacacgagggaaatgggtgattccttggaagattgggttcaaggaggacatccacacgtacaggagtcggatgaggagcaagagagataccgaggcgaagattgcaaatcttgagttcagggtatcgagctacgagctcagcatgcaagaggaggtggcaaggaaggttgatgaacgcatggccacacatcggtccaatgatccccagcccgtcaggaaaccgtagcagctgcgcctcaacgggacaggtaggatcacagagcatggacgccatgcaaacccaggacgaatccacctgccccgttgatgacatcactcagcggacaccatgtgagctgcatattcctttcaagaacttatcaataaaggtaagctcgtagtttatatattttagatttgcccattccgctagttgctgcttatatatgttaattactaataaataacctctcaccacatgaaggtggcgtcgggcatggccatcccaatggacccttcaggtacttaccactgcaggctgattccagcaggatactccaaggttgaagttgagttggttgaaggcgcatacgaggacctcgagctggattatcctggaggagatggtgagacgcatctacgagacacaagccatgccattattctatggcgcaggtggtacatcatcctccctgggcgacaagcggcgtctcgtgcaccatctcctccggctccgccatctcctcctcagcatcctgcaccgtctcctcctcatgctccagcaccgtctccacctcaggctcctgcaccgactcctcctcgggctcccacaccgactcctccgcgggctcctacaccgactcctccgcaagctcctcttccgtcaccttcaaagtcaagggccccccaagctccaccacctgcccacacaagggctacgaagaaggcgaaagttgacgccgccaagaacaaggactcggggtacgattgcacgcaagaggagcttgacgcttacgtggcatcagaagtcaagagacaattcaagcctcgaagtccagaaaagaagattcctatagacccgagtgtcatgaacttcttcaggggtatgtctgcacctgccaaggaggccattaagctatcggactatgagcgaacgctgaagaaagcatcttctagaaagtccaaaccagtccctcagcttggagagcaaccaaaccaggagatcgagccgttggtgaccggtaaagaaatgacgatagaagaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatagagataagcgccaccggtagagagatgatcagagcgaggatcagggacacagacttcttgcaaggagatgacattctctggatcaatttcaagggaatctacgaactataccagctggacgccctcgacgtctctattatgagttgctggattttgtaagtatatcgttcagttagatttcttactacgtctcctttaattaattaggtccttgtatataagtagactatagaaaataatatactcccttttatcgttgtagaatggagattcaaagggcccgacggcggggggttttcgatactggattcatcgaccctcggaaagtaaacgtcacaatgctcgaccaatatccgcaagccacagaggacaatctcgtccatctcctgaaggtgcagcattacaagacgttcatactgttgccgtacaacacagagttagtttaattttactgtcttcctataccaaatttcattcccgtacaaacttgctaagtgtttcatatgtaatgcatcccacgcacattgcagattccactgggtgcttttactcttcgacctgtcggcctgcaccgtcaacgtatatgactcaatggataaaaaagagtctacgtttgacaaggttttcaaacttatagacaggtaccgtcataagttcctctgttaattaagaaaatcttgttatgttaattgctactacgaatcatagctttaaactccatgtaggatttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagaagggaactaacttgtgcggctattacgtgtgcgagtattgccactgccttgcagaccaaatcatcaccacaagagagctcaatgtacgtacaaataaattcaaaatttcattacgtatcgatttcttgtttaattactaatcaatttcatacattcatatagtttattcgcataagggataacctaaccacgcacaaggaatttatcgcggcggttcaagaacaactcatgggattcatcaacgaacaaatccttgatcccaagggtgaattctactacgacggaaacacaattcataggtccttagcttctgagctagcgactactactacgtcgaaatcgtagctagctaggacatataatggattgtaattaatacatgactacatatatttctatatgcatgtgtacacattttctataatgtaaatatattttggtcatatatatatatatatatatatatatatatgcatttgcataacatatatatgtataaatacatatatattatgcatgtacatatgtattgaaacatgtataaatataatataatatatatatatatatgcatatattatatatgcatatatgtactgaaacatatatatatatatatatatatatatatgcatggtttatatatatataaaccatgcagcaacagggtcatgcaaaaaaaaaaaggtcagctcgatctttagtcccggttgataacaccaaccgggacggctgagccatctttagtcccggttggggctatcaaccgggactaaagatagatctttagtcccggttattttacccgggactaaagatagcgatctttagtcccggattggtagtcccggtttggaaaccgggactaaagggaggttacgaaccgggactacgaaggatttctccaccagtgtaagtcatgaacaggatggttaagcgatagcctaccaagcacgttgccatatgtaattatttgtacgatatacgcatctcaccggcagacggtcggtttggtcctggctcctgcgcgtgagcatcgttctccgggaatcacgtctgcacgtctgcatgcagtacgtactatcgtttgtattaacctaattaagcaccgaccatgatcaaaccacacagcctaaacatgtcaacgtgatcacctgctgtcaggctaaatattccgggtgaacggcgccaattctttgattacatatttcttggggcagctctagaaaatttatggtgccaatatcacaatgcactggtcatgcttaagtcatggtgccctgacaatttaatcatggattttgctgatatcgaggttttgttaaatttaacaattttaaccatacgcgtgcccagcctgctcctaattgtttcggatgtacgctgttgtaacgtactccgataaaaaaaatccacttctagcattccaacaaaaaaaattagtgaagatgaagaatgactaaaatactcttggttattaaaaaaacagtaagagtgatagataggtaaagagtattgaagtgataaaaattctcattttactagttggagtagataagatggtacaagttgatttttttagacaaaatttaaacagtagaagttgatttttttttatggagggagtattgtttaggagttaactacctcatactttttccgtcgtaaaatataagacaaccaattttttcttcgaatctcataatataaaacgtgtataccgacatacattaactagacagatctctttctcctctaaattttgatttgttttaaatcttctaccttcaaattaacatcaatcacactgcttatatgcattgagatgatttaatcgaggaggtgattaaatatttttcttgatatttacgttagtgatggttatgcgttactccctctgtcctaaaaaaaacaacctagttagtgatttaacatcacttagtataacgaatttggacatgaggttgtccagattcattgtcctaggtgaggtcaaatcctcatctaagattgcttttttttaaggacggagggagtacactccctcttttctttaatagatgacgtcgttgactttttctcacatgtttgaccattcgtcttattcaaaaaaatttacgtaattataatttattttgttatgagttattttatcactcatagtactttaagtgtgatttatatcttatacatttgcataaaatttttgaataaggcgaatggtcaaatatgttagaaaaagtcaacggcgtcatctattaaaaaacggagggagtactttagaacgaacggagggagtaactctaccacctgcaggtgtccgtacacacttgtgcgtattctatatgaatttcctcttaagatttatttttctttcgtgcaaaattagctcaaactatggcaatacacatgcatgaggtccggacaagccgaagacatagcacacatgttggtcccttccacactccaatgtgcttactctcacctagtagcagatgcctcatgcatgatctgtaatgtcaacatgagcatgtcaacccttgtctcataagttcgagatatcaagtggcaacttggcgtcctatatcagtatcctgccgcaggatgtgccggcctgcttgtaccaccactcctgctaacaatccacttgctgatcaggtcgatcgatcgccttaccgatcttcaagatctgatcaggataacaagtcgcgagagtacgatcgagatatatactgttatttataaccgttgaaatgaggctgtaatgctgaaacgacgaagaatcttcttttgatttgcattggctcctccctttcaaagctgcatcggggaaaagattaacgctggtcatcagctgtcatctggagtgatactcgtacgtgatgcagcaatagcgtcatgtcctttttgtttttttggccataagattggaggggaaaaagaacagggaatataatccttcctcgtgagcgtttcttggccacgaaacactagtgtttgttttgtatgtagtaatttttatacaacatataacttgtttggtatgatctgtgaaatgatcttggtgtttggtgaacaaagttcatctcacaacacaaatagctacacggatacaattcattgctaatcacatgcattgatatgtgcatgttataattaattatttaattataagatacagacagctaatagacaatctattgtaccagtagttagctttagccatgttctattagggcacccacagtggttatctataagctctctacaagagatccatgtcagcatattttcctacttagaagagattaaatgaagagagagagcaaagctatctactaacatggagatagtctatagagaaaaacgaggcaatggattagagagctatagatacccatgtagacataccattgaagtggtttactattaatctagtctattgttgaggtgtacatgttttatagatagcaccttactttaccattgcgggtgctcttagccaccagcggactatactattcacattgctctaaagcacgcacgcattcaccggttttgtctttcctcctcggattcgacggcacgcgcaccggtgaatcggtgatgcagtgtctggctggctcggcctcgtgaggcgtgggagttgcttccttcacgtagaagccagcaccattaatggccggtcggggcctggacgcgtgaactgcgtgtagtgagtagcatcgtgtgagatgagatcatcttcacccatccacccaggtcccaggggcctgtctggctctctcggtgtctcctcatccgcatcttgttttagctgggagttttgatctcttttttttttctccactctacaaggtatttaactatttatcacttttaaaatataataattaaaaatttataactcataattcgtgacgcgtgagttctcacgtgtttatgttatatgagttctcatatatctataatatattagtttaatggtaaaaattttaattgaatatgtaagagtgataaatatttctttggtgagccatcaccaccacccaatcagccacccacggtccagccatggcgtgccgtgccgtgccgtgcattgagccctgctgtaagccctatgtgaccttgttattcatgcgtattagagcatctacaatgtaagatatccattgagtgttctcactaactgaaaacacttatatagacaatcgtctcacaatggaggccatagctagatgggttcctcaaaatctataggtacccctaccaaaaggtcatcgcgttaaatttcctcatctaccctcggcaactcctccctctctctcatcgctcccctctctctccctctctcacgcgccacggctctctccctcatcctctctctaccaccgccgcgcctccctcctcgccctccccagcaaccgtcgccgcctccctcctctccctctcaagccgctgttgccgctttctcccgccaccgatgccctcctctctctccctccgcacggcgggacacggtggccgtggcgagcggagcgaggaggacgtggcagagcgagatctggacacggggagccatggccccgcctcctactccggcccagcgcgccgatggctcggtgagcggcgcgtggatccgtggtcgccgccaacatcgtatcccggtcgtcgttggcatcgtctccgccgctcgtctccctctccctctcgccgccgactcttacctctccccccccccaccctcgccgccgccgttggcctctctccctccctctctcttccgtcgccggtggccgtgagggcgatgagtgagaggggcgagggtggaagaggaaatttttcggtaggaacggtgtccacaagttacaccctcgcgcccaacacgccccttcggctgtgttccctgcaaaagcgagcgagggatatattccctagcagagagacgtgttctatcgcaggggggggcgcggagacggaaaggctaacgaatggtgctagggaacacgggccgaggtattggtgatggccttatgcgccacccctcgtgattcacccggggcaaagctttggggccgagggccgggagagtagctgctgctggtttgccgaggcccacgcgatgtgtgggccccacggccgcatgcagcaggatggatggcaatctgacttctgaattccgatgagctctctgacctgatcactcgaacaaaccgggctccggctagccagggccaggggttgggatgcagccgtgcaggcagagagagatcaatcatttgggcacactttgaaaggagccagccagccagaggcttgttcgcttgagcgtgattgaccagcttgcgaaaaatggagctggagagcgaccttacaaagcatgccacacttttgtaattctatagcccgtgataaagcgtacgtgcagctacgtactacgtaccccccatatgcatgatgcacgtacggatgaatagaccacggtggatcggtggcctaggcgctggacgtctggcctcaacgacgcggacaaaggcaaccgctgtttggacgacttttgatcgatcgcctcgcctagcgcgcgcgctggtacaacaacactgtacgctggatgcattaggcgggcaactcgcgagccggggacccgtcatcccgtccgtgtcggcgtcgacgacccctcggagtgccgcgcgtgtgtcagcgaccgacgcgcgcgcgcggatgcgcggaaaaatggacacgatcgatgggtgtgtgggttgatcagtgggtgggaggtgagcgtccgtgccactgtgccaacacgtgcgcgtgtgtggaggatctagccgacctgacgaacgatatgatatctccctggcgattcgccgtgtgttagtttgtgctcctccgatcccgccgtgctcgccgtcgccatcgatcgatcgctcatcggctcatgcccttccggacaatgacgagctgcaccagtgcacaacgtactcctgctatatacgtactgcgtgcatgcgtgtcggggagagttcacaattccgacgaaaaccggtcgatcgaattctgcgaaactttaaggttttgacgatgctcgaaagtagaagccgtctgagatttcgatgagtttaatccaaattcaaatttgaattgataaaaaagaaaaaaaatcaaataaaatcttataaatagtatgatattcatttaacctattgggatatacattttcgaaaaaattgatatattccatgtatttactaaaatttacagcaggaaagaaaagaataatgaattaaaaaaaggaaaaaaaataagtttaccttttttctagttaccgattgaaattttgatgatttcgcttggaatctcgcctaagccaacaggttttcgcgagcttattggtaaactcgaggaatttatatttaaattttggtttatgaaatctattatattattaaaacatccttgaaaggaggcaccacgttcgctgtggaggctagaaattcccataataatcggagaaaaagaaaaaaaagaaaaagagagtccaagtaaaagtacaatctaaaaatagctaaaatttagaattaaaaacaagcaatatgaaaagaggagttcatataggaacccaatacgtgattaattaaaattcagaataatactaaaataaaatcaaaaattagaaaaggaaggagagtccaagtagaaatacaatttaaaaatagctgaaattcggaattaaaaataagcaatattgaaagaaatttccatataagaacccaatacgagattaatcaaaattcaaaataaaaaaaaataaaatccaaaattagaaaagaaaatgagagtccaagtaggaatacaatttaaaattagctgaaattagaaattaaaaataaggaatattaaaagaagagtccatataagaaccaaatacgagattaattaaaattcagaataaaaaaataaatcagaaattagcaaaagaaaataaaagaagagttcaaataggaatacaatttaaaattagataacattcgaaattaaaaataagcaatattgaaagaagaatccacataagaacccaatacgagattaattaaaatttagaataaaaaataaaataatatccaaaattagaaaaattaaaatagagtttaagtaggaatacaattttgaaacaactgaaattgaaaataaaaaataaaaacattaaaagaacacaatacagtattaactaatttttttaaaaaaaattctgaaattagaaaaaaaaattaagatttcaattaggaatacaatttataaataactaaaatttgtgataaaaataaataaaatttatcgaatatttttataacccaatacatgattaattaaaattcagaataataaaaaaataaatttcaaaattagaaaaagaaaaaaaaagaagatttcgagtaggaatacaatttataaatagctaaaattcggaattagaaataaggaatattgaaagaagagtccatacaataatccaatacgagattaattaaaattcagaataaaaaaaattaaaaaatccaaattagaaaaaagaaaagaaaataagagttcaagtagaaatacaatttaaaattaacttaaattcggaatttaatataagaaatattgaaatgagagtacatataagaacccaataatagattaagtaaaattcagaataaaaataaaataaaatccgaaattaggcaaattaaaaggagagttaaagtaggaatataattttgaaacaactgaaattaaaaattaaaaataaaaatatcaaaagaacataataataaataaaataaattctgaaattagaaaaagaaaaaatgatttcaactatgaatacaatttataaataactaaaactagtgataaaaaataagacaaatgaaagaaaagaccatctaaaacatatgacgagattaattaagtaacaggcctatagtggagcagagaggtggcggttgatgagacatctaaaactattaataaatgaccaaatagaattctaatgacgattaaaaggaaggacgacgggcaggtcgtgaagcaatcagtcaagacggttggcggggacttctaaaaagtaaaaaaaataaaccctaatgataatcatatttgatttttaaaatctcaattacagtaaaaatgagacgcagcggacgggtcgcataggagtataatggtagggccgccgatggttggtgggtcttctggaggagtaaagtggcagcgtttgacgggatttctaaaaattataaaaaacatgaaacccaacgagacaataaaactctaaaaactataatgttcaatttttaaaggttcatgcttctaaaaagtaaaaaaaaatccccaacgataatcatatttgattttaaaatctcaatgacattaaagaagggcggcagcgggcgagctgtagaggagtacagtgacaaagttactaacgttttggcaaaacttctagaaagtaaaaaaatgaagctaaacaataattatgttcgatttttaaaataacaatgacagtaaagggaagatacagtggacggttgtagaggagtataatagcagcatttgacgagacttctaaaaattataaaaaagaagcccaacaggacaataaactctaaaaaatataagtttttagataaaggttctaaggagaataaatagaaacaatggtagatcgagcaagctaataaaaaataatataacagaagtaaggggtagcaactgatgtgtcttttaaaaactacgaaattagaaacacgaggatgataaggtttggtctttcaaaatcttaagacaacgagataactatttaataaattttaaatagaatcatactaaaaatatataattttatatgggtgttagccgcgcaattgcgcggaccacccagctagtttattcgaaatctaccggctttccgacggatttcacgaaaaccgtcgttactccatagcacgaaacggaagatcaactcagaatcgtaaaccctggtagccaaccggctgtgcagccgttgtgttttttcacccgtgctctctgctcgatctatgtgtgatctatttgtcgatcaatcgtttgctggttctctctgtacatccgtatctagtagtggtactctgtacgtgccactgtacgcatctcacgcatgctgtttggggagcttttgcgtggaacagtggacgagaagctagctgagacagacggatcacggacaccgacctggcgccagccactcgaacgaagctacagcactgctcgtggtcatcgtcgtccctggccgtttctgcctctcgggaaccggaacacgataaagaacccaagccaaaaaaaagcgtgagaagaggggcatcatcgatctctcggctcgcccaatgattgccggagtaaagcgaaaccacggcggccacatgggggccccgccggccggtcacggcgagctcagctcgaacgacgcgcggccactcgtcagtcatgatcatcgtctccaccggattgatgatatgctcctgatgatgagtttgtttcaaatggagacgaggaggaggctagctgcagccccgcagtgcgttgcatcgccggcatcacgagcaatcatgcggccacaccacacacacttcccctctcccatgaaatctctactctcacgctaacctattattcatcatcatcgattaccttaaattaggccgggatactatattccattatctaaaaattcaattaccttaaatttctgttgctcccggcatgaaatccagaccgttcatcggccacggacggctaagatgagaccgatctcccagtgtgggacagtaataacgtactcactctgtcccccaattataagctctatatttttttacacggtttttaataacatactttaactagtattttaacaaatataaaattagtatcacatgaaagtaatttgaaagtactttaaagtattaatctagtgatacaacatacttagtgtagatataattaatataattattagttaatagctaccgagtttgatttttgttaaaacggggctgcgctataatttgagacggggtactagggtggacacgggacaacctgctatagttagctagcgtggggatgtcttggtgtctatgattgcgtattatttcactcgagaaaatctgtctttcgagagtatcttggagacgggatcagcttagcgggcgtgattgcgcgaatcatggccatccattttcacgctcgcgtgagggaatcgacgaccgacaaattttctcggttacttgccctgcggctgcatgccgtcgccgatcattgtggaggtgatcagctttgtgatgttgccttgcacaggctttggaatggaggctactgcttccttgggtcactgtcgcttgatcattaggggcccatgcgtgctagctagctccagttccaaagattctgtacttagttgtaccctcgtttgttttacgagacagtgccgagtcgtgccggtgccatgcttgttttggaacgccctgccgttgtggccgcccagacacggcccggcccattagccagcctgctacagccgtgcctgggccggcaacgatttggcctgccttatttggacagcagtacagcactatggccaactggggatatccagaaaccagaggcccatatgagttgtacaactaaaaacatgctatcatagatcaaccaaaagagagcatgtttatacacactgcaaccgtttacaactattgatcaaattcagttgtacgtgggttagacaattgggtcatatgcattgcaatttccgtcccagatagaggaagaggaagagagatctaggcgcaaaccgataactaactcaaatgcacttgcaaacaatagagaaaatatcacttattgtatcgcactaaccagaactcaaaatcacccgatcggtcacaatttgcagttattgtacaatgtaagcctccactgcagcacgcaaaattgccaaagggggcaaaaacaaagctgctacctgatgtttaacatgaagtgtacaaggaacaaatatgattgggaagggcggtactgttcgtgagttggtaccaacaagaccttgccactgcatcatttgcaaaaagcgtgcagtctaacacccaacgtgaggagttcgacaaggaccgatttagcccacagcacccagaaaatttagtaggtttgtttcgtatcatgcagcttgcgtgcgaatgttgcagccacgagtaacgggaaagcgatcgtagcatcacagtgcacctgcatttccaagagccgcggtat

SEQ ID NO: 5749 - DNA, 8769 bp, Oryza sativa
gctccagaatcactgccatcaaattcttgagctgtgttgatatagactgcaaaatctgcaccattgcgaaacatatgggcgttgcatatatgatgcttcggtagacctccaccaagaactataatcccgggcttccttggggttgcatgaatggcttccccattcatcaatcttatatctgccaagtttttcaagcataatatgagaaaaacaaaagtgatagcaaaagcaagaaaaccaagcacacaacttgccttgtacaatgtcaataattaggccaggattgcgaactgcatgacagaatagcatgtctccaagtgatccatcagtcaatgctgggcagtatacaggaatattgttctgatcaagatttggagagtcagtactgtctcgttttcagtctttgagttacagatcataacattgcacttggccatatgaattttaaaccaaggaacatgaaaataccatgctattgtaacatcaagaggaaaagaacaagtatcttgatcaaatccactcaactataactctaaaagtcaaaataaagcttcaaatatggacaccaagtacattagattaacatcagtaagcacaactttaaggatggtggcacactagttcctaggggaaaagatgtacatatggcactattatgaggagtttccacatttagaaaacattaatacatacaaaaataactcaaataataatatagtttatttgtttgtttttaagggaactctgaaaaaaaattcaacaagactacctagtatatcattgtgtagtgtactcaagataaagatgcaggggctttatgaacaggattgatggtttgttctcccacttgcactttgcaaggatatgcaggtgagttaataaatatgttaccttatatgcccaataaaggtaggaactttcatcgtttatttctttgccaagacggccaatgaccttcgatggtgtccaaacattctgcaggtaagtaaaactgattgcgcttcatgaacagaagagagagaagcacaaaagtagttggaagagttgcttctgaaagaaagacgcatatctgataattgaatagttggacatcaagggcatagcagtaaagcttacaaaacatatctaccagtgtggaaccttttccttattgattcttggcaagtgaccagttgtacagaaactatacctggtaacctcatatttcagtgctatttggattatggatttattcatgtaccattactacgtaaattcacagaggccaacttgaaacggagctaatgaagactggttcaaataatgacaacctttctgtaccattacattagtggatttctaagcactataagttaggccttttcatattactgccccctacatgatgcctccactttatagctaatgagccataagcacatgtgcgtcatatagaatcaaacaccttgttgcaagctactgggcttcagccagaagaaaaatgttatagtacctccctggattgctcttgtaacatctggtaaaaaaattggcatgatccagttctcaaacttgcagtagttatcattaggaaccaatagatttccaatccgattcaatccctttgaccgcagcagcgttccaggtaaagaaaaatcccctctgtaagtaggagcaagacatttgatgagatcctcctctataccaccagcagtcgtaacaataacatcaacctaaataacacatttttttttccatagggaattagctacatcatagggatgagatctcaatccttttaataatgctagtatgttaccaaaagcatgccaaaacgtgtctaacaaaccagttaataaaaggaaattaaaaaagtggagtattcaccatgtgatgctgaactagaaaacggacaacatcccgaatgccagaagagacaaggtttgaggtgaatcccaggaatattttgcacttcacagattctctatatgtagggtcaagctcaggttcatcacagtcctcacgtggcttctcatgggacagcctccattctaacttcaatgtattgaagtacagaaaagaaagggttaggaaatataggaattagtaacctcttaggcatgtagaaaaatcagtacaagcatgaagatggggaaaaaaattaaggaacacacatgtaagattattacagagatatttttttttcatctggattacctccaggttatacaagagaaaactcaaatatatacagtttgaatttgtccaataaattcacgatgtaaataaaaaaagtgtgtagcatttttttttatacatctactccattccaatctactaataacggtttcgtctcacaggaattatcgagaaaaccaacagtagagtgttagctttaggatgaacaatagctgcaaggttcccattttattttacagcaggcatagctatggcttcacctcctactctccgagtacaccaacaacacagcaatacgccctatctagtccaaaatgcacttcatcagaagctccacagatccagaaccacaacaatttcaagctacagtatcccccaatctgcctcatctctatcatgaattgtactaaaaaaggcagcaagggagtagtaacgttaccatctggttgacgacgtcaacggcgtcgccgaggttagaggcctggaatccagtggtggcgagcgacgcgagcatcccggagagcccgagtccggcgtcgttgaagtcggcgccggcgatcctcgtgaaccgcccctcgtcgagggactccgagggcttcagcacgatagagcgcacgccctgcagcgcgtccatgtcgcgcgctcctcctcctcccgagccgccgctgcctccttcccaggccatcgcccgcgaagccgccgccgccgccgccgcgagctatcagcttcgaattactttttcccgagaaaaaaaaaatgtgcaaaagaagaatcagaggttcagcgtcaatctacttcgaactcagccctgcgctgcgactcctcccgccgcctaggctgaaaatctagtgtcaattcggcccaacatggccaatgtcccctcaggggaggcccaacgtccgagcacaaaagccacggcccgtcccgattgcaccggcgtcggcaggccgtgtgtttctgggccatcgcttggcgtcgtcactagatgttccgatccgatgagcttctcttctcacgtgattttcattggtgtcgcgtcatctccggcaccggctgcacgcctgcacccgcgagagcgacgagaccacgtttcagatggagacggcgagcggcacaagcagcttacactgctctgcatcaccggcatcatgcgcaatcaatcatgcgtccacacttcaccactatactcgtaagtactgtagtaggtatatacttgctacagaccagaaccaaacgaaaaaccagtatctatatgtcacaatatgaataactcaccctatatcacagactcgcagtgcgagaaaggctgttaaaagttctagacggtccactgctttataatttgagtcaggtgcattaggaagtaatgatctacagggaattgtagcactatacacctacctgaaacaaatacactagcagtatacaaaagttgtatgaagtggcattgaggcaataccaattgtttgtcatatggttagtactaccacgagtttctccacacaagaattactcagcagaaagatttcagggtcaagatgctttaacttgtgattctttaagctgttctttcaacctcagaacctcacgacagtagaaagaaaggtccttcttcagcttggtggatgcttccagatactttgtgtccatcagcttcatctcatttattgcttctttaagccttccacggtgtgcatcaagttctggttgcatccaccgaatctgcatcctaagctttgtgttctctttgttataagccgaagcatcctgcaaaagaaagcatgttacggaattactggatacagaaaagtgcaagttgtcagtgagtaattagtaaggtggcttgttctctaaagaggaacaactagggccatcgttgaattgcttttcaaaattaaatgacatggaaaactgaaataagatacattcaaattggaaaatgattttcctctatgcaaagctatcacttggataattaacaaagcaggaatgatagagtcactgctcaacagtagttatttcttcaggaaatgcagtgccttttaagtgcctaacattttctcttaatatagaaattatggctatccaggttcttgaggatgccttggcccttgggatttatagtttgcagtacactgattgagttatactgtatgtatctgtgcttatctactacatgcctgatgcatccacaagctttgctggcagaccacccttatcccaggcttcccaacaataaactagatcccatcggttcattgaatctggtgttttccagttatttggcaaacttttattgtattatgtcaagcttccatgttttcaaaatgcaggacgaacataaattacaatagtccgtcaaaatagcaacagaacatatgcagtcaattttgcaaatgtttaggtcaaggcttagaaccagcagcctaaaaggggcacagcaagtttcaactggggtttgcaattccaagcaaccatagaaaggaaagttaaattagattactagacaagtagttccatgctgaagctcggaaacagactttggttatagacgttcataatacacagaggcggagatggtttggcgaaaggcagcaaggaccagttccagttctccccttctccctctcacgctgtgacagaaagattatgttctcgttgaagattgaagctgtcttctagtagcttttctttttttgtgtcttttgtgttttcccttgtgcgaggtttagagtttaagaactcgtgtatgttttggctgtgtatatccttcatgaatacagaggccggattaatgaaaatccattatctaaaaaaattgtagttcctgtggtggtccattggtaatttgaaaaaaaatacttcgactgtgcaacagaagcaattttggcatctgttctggagttcaattgaaactcctggactttttattttatacagttttggttttgaagtcgtactcccccatgttatggaaaactttgtgacattccttgtctaaaaaaatgaatgaaatcaggtagaaatatttgttgataacaaatgcacatgctcttatgagaggctgcacatggaaccctactcacaaaacattcatctattcctaagtttgataatggtaaccagtaactctgcattcgaagatgaaatattttaaacagcagctacagtaataatatacttccattaacagtaaatgacaagtacattaatgcttacatttttcattttggcttccacgatagatatcctagaactcaactcatctatagtagctttggcctgtattaactgcacaaataatcaaaaagcacatgagaaaaccactcactcacagagattaagtgcagcaggtcaacaataaacctaacatgcctttttactatgattctcttttaaaacctctgattcattgatgactgaattcatatatttaatctcagaaagtaacttgtcacgttcttctgtaatcgacaatagttgttggtgaagttcctgctcaaaacaaaatgagagaaaaactgcaagataagttactgctcaattgttttttcactaggaaaacaaagaatgtccaacatcgaaagttcgaaacattgtagcttcccacgtgatggtttctcacgcatgtatagtaattggtcatgacttgtgactatatgatttagggtgaaaattcttccatttgatttactcatgttataagaagacttttcacaatggagggcaaaaggaatagactgaagacttacattttcattcacaccggtgtcaatgtttctttctttcttcagaagtcgttctgattcttcaaaagtctccctgctgcacaaactttctagtgtcagtagtaaatcagctagccgaacatttgagcctacggcatattaaacaacagatggcgatgtatttgttttcttttttcgaggtaacggaagggagctcctacattacactatagaagaagagagttgatccagtttataaggaaaaccggaccctaaaaccttacaacggcacggttaatttatggaaaaccagcgaaaaccccggcattgacatactgaacccaagaacctaataacagcagtccaacaagggaaaaactcataaaacgaagccttcaagaagaaaacaccgacagaacggcgatatcgcctgatcctaacgaatctaaggttttaaccggagaaatcccttgatgtggagttgaacgagggctccaatagcaacgccttcaacaaggtgaacgatgcccgatggcgtcgccgttgctagcatcggcaagccgagcaaggctttcacctcggagtcccatccaaacatagtgtccgcaacggaagccaccaaatgccaccaaatgccacctgcacaccgcaacacctgcacaacaaccggacaagcgctgttgacaacctgctctgccacctcacccggaccggcggagctccactgagctgcggagctcatcggcgccacacaggccacccacccgtcgacgccgccgccacgaggggtccggcctcgcccaaccccgactaggacacacccaaatctggacctggaggggccagatccaaccgtcccccttgctgccttcaccaccgccgtcggccgccgccgcaactccagcctctcgtgccagggagacgcgcggaacccgccagagatgcgctggatctggacctagcatggccagatcatgccgtgccccgtgcagccttcaccgccaccgcggtccgggatgggaggccaccggtgccggacgtggggagggccaagctcaggaacgacgtcccccgggtcacctcagatctagagaaaaggaggaagggaaaaagagagaggaagaaggagaaaggaaagaggaaggaaatgggaggaaggagggaggcgctgccgccgccgaccatcactgcaggtggcggcaaggccggcaaggcatgctggggagacgagcttcgcttcccgggtcgccaagagaggccgtgatgtatttatttcctactaggacaatttcacctatctgttcctattgctcacaaacagctattggttcaccccgtcaaacatttttatgtttattataactgtccttttagcacatcgaagatatgtgcttgttagataaggcacaaccactccagtttgttcattttgtatattttcagagtaactcctttaaaagaatattttaaacttcaggctcaggactagaaagtattgcaaaagaaatattaaaagtagcttaaggcatgctcctacatggttgttgtattacttgttgtcccgatcatacaacactgaagcacaatatgtcagattgatggaattactacaagactaaccagtatttctcctcatttgtgtcattcttggagaaaatcattttagcctcaagaatactgtactgttctctgcaacacgccaattcttgtctcacctagcagtatattgcaatatcagtaacagagataccaaagttcttcaaaatattggtgaaaaaacattgaatgtggaggttgcttgactattactttgaacaaaaaaagaaaaacattaggaaaatgaaactagtcgtctagggcaagacaacattagaagaactacattatgtaaatcaactcaatacaaggcaactagggcatgtctagttctttaacaagacgcaactaacctttctaagttgctggtaggaaagcaaattcatgctaaagaggcgagctaaattttgtctcccttaaaagaaggaaacccttgtccagaaaagaaccaaacaaggaaaccaaacatgctttcttccccactaatgttgctaggcaagaaaagaaatgtgcaataaatatttaaataaaaaatatcatagcaaacaaccacaacaggtaagtgcagcagtacatatgacacattgatattcatagcatgatccaaatctaaacagtattgacacaaattgatatagcatgatccagaactaaacaatattgagttgttgataaaaccacatagcatgactagtgactgcatacataaaatggactgggcacacgggagatgtgcaatgatcaatgggaactctattgttgttaccttaatcaaatcttctgataatttgcaattgttcttattgcagatattcagtttttgtttggcttcaagataagctttctccttggcagtccacgttgatctttcagactccatttccagaagaacatcagtaagttcctgtattttacagcagacagaagtgcaataagtttcaactttcagctaacatcaatcaatttgacataagcacagagctatacaattcccatgtcttctttttcccttgataaagaactaatagaagcctcaagttttttagagatagattcagatgcatctaacttcctagtctgcatcaaagagaaacacaacaaaatttcatggtgtcaaaacatttaggattagacaaatagatgggaaacaaatcttccaaaatatgcataagacaaatcaagtataccaagacagcagtctcctcaagcaaggaactagtctctgattctgctgaattcaacctactttcaagatcttccactgctg

SEQ ID NO: 5750 - DNA, 620 bp, Oryza sativa
gtaaaaagaactggttataagcgaataatgtagggttttctggtttacacatataaaataattaacaaacttgaagtaccacgcatattaataatactaatttcaacaaacaaacctcaagttttatcttctcttgaatggaatttttaagtttgttctcggtctcttttaactttgtttttgttctgtcaagttcctttcgaatagactccttctctttcatcaaagaagatgatgacaagtatccaccttccttttggagagttaggagctccgatagaatgctatctttctccagctcattttgaatattacaatcctgagtacaagcaatgattttagaacataaccaatacataaagaatttaatcaccaaatagggcttaagcagtcacagacctccatagctttctcacaactttctaagctagatttcaaccgttgaagttcatctttctgatctagggattgttcatctaatattttctgaaatcaatggaagccaatgagagctgcttagaatgaaaatcaaacaatgggtaaaaagaacttaaacatgcataccttctccatttcaagtttgctgagtttttctcgcaaacagtttgaaatgttctcgt

SEQ ID NO: 5751 - DNA, 16287 bp, Oryza sativa
gtgaaaggggtgacacgacggcggtgcggcggcgcgaggcgcgaggcggcgataggacgcgcgcgcggtgatggaacggcgacagtgacggcgcggcagtggcggcaaggggcgcgaggcggcgatggaacgcgcgcggcgacgggacatcgacggcgacggcgacaacggtggcgcgcggctcggggcgggacgcgacgtgcggcgacgcgacgggcggcgacacgagatcgaggcggcgacagcgacggtgcgacggcgacggcggcacggggctcgaggcggcgacggcgacggcgcgcggcgatggtgacggcgcgcggcgagcggcgatggtgacggcgcgcggcggctcgggtcgcgaggcgacgcgatggcgcgcggtggtagcggcggagcgaggcgacggcgacggtgacggccggcggcggcgcggggcgcaatgacggctaggcgcggtgtggcagaggagggggatggctaggggacgcactcgagcacctagcgtgcaatgaatagtgacttttcctatttatcccgattttagactattttctatttaaatatagccctataaattctaatttttgcataaatgaagtttactcaatatttgtgttattgtaactaaaaattcaccctaaattaatattacccatattttatttttatataatttatttgaatttttaattagggtaattcttgctccatcgcacttaaatttaattattaccattatggtcgcgataatattttatttatttctatcctcacctaatctttattttaaattatatttattttgccaatttatttttagggtttattcgtaattaactattctttactcacaactaatgaatttcgaaatcaaatccaaataaaataggcgaatagaatcggcatgatgtagttaatttaaaaagttttcgaaggtccgcatttttagagttttgtttttattggtcgaattttcagggtgttacacttcagtcattcatcgatatcatcaatgacctccgagtacgtgggttgtcggggtatgaagtcgctgccgacttcattggtaggcggatccagccgctccaggctcgagcccacccagcctctgactactctgggtcggaggacgcgacccgggtttctcctcggggtatttttcttgcattctgggttcccttccttatgcatacattcctcctgacttatcaaaatctggttcttgatctataggtttgaacagcgaaaccgtggagcgccgtgttggccaggtgatgatgagcggccccacgatggcgagcaacgtccctgcccctctttgcgagaaaggggcagctgagggcgaagctgcaatcaacgtgagtgtactcgatgaccctttctctttttcttccaggatcgcatcgtgacttcatgtagtgcaggctctccctctaactgacgtcatcgggccgctcgtggaccaccaggcggcggcatcgctgaaggaggacgtcgccaaggaagcgtccgatgttgcccccgttgctgccacgaccagtggcggcaccgttccgaagaaggggaggaagttttcctccgtgctcggtaaccgtcggaaagcacccactccatcggtaagccgtctttggttattgattgcgtagttggaagatgttgtcctcacaccgtactcggtttacttaggcctcggatgcgtctcccccacctccgcgacggcagaggctggtgacacttggcgagaagtaagttgacgagtttgaggtcgtttgattcatcgaattcaggcggctcgtcttgatggccattacgggaatttttcatagggcggtgtgggcgaaggcggcacaagacgggtctggagggaactctagtgcgtctcctgcagtggccttgacagatgtcgtggtcgtgcccaggagccgtgaggcgacgcccagcggccctgccggcgaccttgtgcctgctcgaggcccacccgctgacgtcctcacctgggaggagctccaaatcgagatggggcgcatcctccaggctggcgctcgtggcataggtcgcgagattgcggcggcgagggcggcggcggcttcgtcggcgaacgaacgcgccgacaagttggcgcgttacctggcggaggttcgcgaggacctccagaagatgagggagctggtggccggcaacgagcggcaatggcaggggctcgagcaccgcatgtcgaagctcgagaacaacctgtcggacatccgtggctcgctgcgggttacctacaccggcctgcaccagctcaccggggagtgcagtgtcacgaccaccatcccggtgaatcccgatgagttctcgctgatgacttcgctcgcgaaactagcgatgatgatggaggcgatcccctccaagcatgcggccaggatcggggaggagacgtcaaacgggatctacaccgggacgtgtcacatcctcgcgtgcgtaaggttggcgcaccctgaactcgatctctagaggatcttggatcagggggcggctaacgacgcgcgtaaggatgtgatggaagaagtcggtaatctgggagagtctgttctcccactttttgaagagtaggacttcggttcgcctgtactccttaattaatcatggtttgtaaaacttttgtcggttccaactgcctttgtgcctttgtgtagtcgccgatcgaaagcgtgcatgctcggatgcgcttctcgtggtatcgtcgaagggcctgttggtagctagttactctgacggcaactcattctcgatgttcctcgagaaggttcacatcgtcgcctcgctactcctcctgatcctggcggagtacttctgtacttgtgtactctgatgttgcagttcagtgggaagcatggcttctgagccgtacacgaggaagaaaggtgtctccttgttggacgttgtcggtgtggtgcgcacggcccaaagtaccgaggggagttcttcgacccacttcttgtcatgtgacatgagcctgtcgtagacacgggtcttgattccttgtagtactatgctgtttgccctctcgacttgtccattgctttgagggtgagagaccaaagcgaagcagatcttgactcccagtccaatgtagtaatcctggaagttggcactgatgaactgggagccgttgttagttatgatgcggtgaggcaatccatatctgcaaaatatccctttaatgaatttgatggtgttgtcggccttaatttcccccatgggtgttgcttcgatccatttggtgaacttgtcgatcgccacgaacaggaacttgtagctgccttgtcctcgtgggaatgttccgagtatgtcgagcccccagcacgagaacggccaagtgagggggatggtttgcagtgcttgtgctggtagctttgtgtgtttgctataaaattgacaagcttcacaccgttgtaccatgtcgcaagcttctttgagggcagttggccagaaaaatccttgtcgaaaggcttttccgaccaatgtacgaccggtggcaagtgatccacagatcccttcgtgtatgtcgaggaggaggtgtttgccgtcgtcggacgagacgcatttgagaagtaccctgtttggcgccttcttgtatagatcattgctgatcatacaatagattttggcttgacgggttattttcttggcttctgcattgtcctcaggcagcgcgtcgctacttatgaatttaattagtgggatccgccagtcgtctgtggtctcgatgtcagcaacggtgcattctgcctctgttgccctcgagctgatgtcgggtgcgactgtgctattttcgtcgtttgcttctttcatcgatggttttgtcaggacgtccaggaaggtgtcgggttcgagtggctcccgtctagacgcacgccgtgccagattgtctggttcgatgttgtccttgcggtatacgtgtcagacctcgattccatcaaatcttttttccagcttcctgacttcagcgaggtacttggataactcggggctagagtacttgtagtctttgtgcacctggtttgcgactagttcggaatcccctttcatgatcagtcgcttgactccaagtgcagctgcagctcttatcccagcgagtagtccttcgtactcggctgtgttattggtcgccctgaagttgaggtgaattgcatgcttgaactgatctcccgaaggtgatgtcaagatgaaccctgcccctgctccttggctattgagtgcgccgtcaaacgccattgtccacatttcgttgtcggtttgactgtctaacctgttttaaggcatagtccaatcggctacgaaatcggcgagaacctgggacttgatggctgttcgtggcacaaaatggacatcaaactggcttagcttgactacccatttcgcaatgcggccggcaacatctttgtttctcacgacttcaccaagagggaaggaggaaacaactgtgaccctgtgggcttggaggtagtggcgtagcttttttgacgtcataattactgcatagagcagtttttgaatctgtgggtatcttgtcttcgcgtcatggagagctttgctgacgtagtagactggtctttgcaccttttctctctcgacaacgatgacagtactcatagaatatggcgtggcggcaatatagaggaataattcttcattaggttggggagcaacaagtacaggggggtttgacaggtagcgcttgagtgcgatgaacgcctctttggcttactgtgtccatacaaatttgtcttgttttttcagcagagcgaagaaggtttgtcctcgttctcccatcctagtgacgaacctgcttagtgccgccatgcatccggttagcttctgtacttccttgagccttgtgggcgacttcatgttctcgattgccttgatcttctcgggatttgcttctattcctctgccagagacgaggaacccgagcagcttgcccgatggtactccgaacgtgcacttctcaagattgagtatgaggcgatatcgtcagaggttgtatgtttcccgtagatcgttaatcaatgagtcgcctgtcttggtcttgacaacaatgtcatcgatgtaggcctcgacattattcccaagctgatcgttaagtgccccttggaccgtgcgttgcaaagtgtttcctgcggttatcagtccaaacggcatcttaacatagcagaatacactgaacggcgtgatgaatgctgtcttctcctcgtcctcttttgccatgctgatttggtggtagccggagtaagcgtcaaggaagcttaacaactcacaaccaactgttaagtccaccagttggtctattcgaggaagagggaagtgatccttgggggcacgctttgttgaggtcggtgaagtcgacgcacatcctccacttcccgttggccttccgcaccatgactgggttggctagccactctgggtggagtacctctctgatgaaaccagctttgagaagcttgtcgagctcttctcatatggcctgttttcgatctggtgcaaatcttcacaatttttgttttactggcttggcattgggtcgcaccatgagtttgtactcaatcacctccctaggtacccccggcatgtcggacggctgccaagcgaacacgtctgcattgtcgcggaggaaggtgatgagcgtgagttcctatttctcgcccagtgatgccccgatcttgacggtcttgtcggcgttggcgctggagagcggaacgatcttgattgcaccgtctggtttcggcgtcttgcttgctttgctcactttcttgggtggctcagctgtggcgggtgggctggcagtgtgctcgaccatgtcgaggctccgcttgtcgcattgcaccgccagctttgcattcccttgaatagtgattgttcctttcggcccgggcatcttgagcacttgatacgcgtagtgagatgcggccatgaacttcgcgagtgcatttctcccgatgatggcgttgtatgctgtatcaaattcagcgacatcaaaggtgatatgctccgtttagaagttatttgcttggccgaaagtcacaggcaacgtaattttgcccaatggcttggacgacgactgaggagtaatcccatggaagggttgattggtgggagtcaactcgcttcgtgggattcccatcacatccaaggtgcaggcgaagaagaggttgatggagctgccaccatctatgagaactcgcgcgactttgatgttccgaatagtgggctcgaccacgatcggatatcgtcctgggatgatagcagccttgggatggtcctcatctgagaactcgatcttctgttcggaccacttcatcttgggtgcggccccctgccatgtcgaacaaacttcacgctccattttcttgtattctcgctttgagtagtacgccgtggaacctccgaagatgtgcgagacatggagatcggaatctaggtatgccgagtccaagtcctgagtggttgcctcagtggccttctcgactactcgtactcgcttgcccttctccaatgccagttgcttttccagcgactttttgaagacgaggcaatcatctagagaatgtttgtccgacttgtgtatagggcaccatattctcttcgtgtcgctgccttgtgggtctgggtgcttgggagggcgcttgtattctgacgcgaggacttccgcttgagctttccttttcccacttttgctacttttcttcttgcttggttcaagtgcgtccttggctggtttcttctctccccccaacttcggcttgtcgttcttgcgtcaaagtgcgtcatccgcatgagcgcatcgatcgacgatctcgaaaaatcttcgagtagttgtgatccgtcttgttgccaactcctgggtagtatagcgatttctgacaccggttttgaaagcacgaatcacagaggcatcggtgatttcggggtttgtatttctgcactcattaaagccgattggtttatactggattatattgttatttcattacatcatcatcaaccgattgcctctatatcattatctacattggatatatagccgattgcttaaaccctatcgctatcggctggtatcggcaacggctattatcggctatcggctagaactactccatcggcttgtcagccgatcggctgttttgatctactatttgcatatcttgtcagttgcaggatcaaactgactcgcacgcccgcatctcattaagatttggacctgcacaggagctaagcaggccggtgtgttcgatttttttcgtcaacacaaattggcacgcccagtgggacacgagttttatatccacatgtctgaagaagaagtcaatgccaagatcatggtcacagtggagaatttaacggaggaacaacatcggcttagagtcagcatcggcttcgaagtcttgagattagccgatgagagttgtcaagccgttagttgtcggattcttgctatattcggttaaggaaattgatctactaaaggaagcttatccagaagagaccgagttcaaagagaatgcggcatggcaagttatctattaattaggaatagtttgttagtttccttttatctttaggaaagtgtgtttagtgtgctataaggactttatcttttccttttatctttaggaacgtttctttcttggccgacaaggacttgtatcaacccatgggtataaatatgtacacccggggtctatgtaatcatcgctacgatcaatacaattcggcgcatcgccaccctttttacttctacttttgtttttacgttcaggcggaacttggcacccgacgcggtgctgcattgtcttcgatcaacggcgcaaggataagtccaatgttccgtcggcccaggcaattatatcgtctacgtcggcgtcgttcaaggctgcatcaatacattcgacctcttggattgctctggtttggatgatatatttgcctaaccatttatcatatgtctttgttaatctagtcttagcatatcaatttagctctatcggctgcttctcgttttagggtttctgccggtatcggctaaatcgcgttgctatattagattagtttagacatctaccaccctgaaaatcagtcaacggcttgattgtctggatattatgattcttttcatacttagtgctgcatcagttaagtttgatctactaagtcatacttagaaccataatctctagcctgcttcttgattgccaataagggtttcatcggggtttcagccggtgagttatctgtatgttgcatcggctcataaggattgcatatacatataagttggatttagcccatgacaataaaggtttcactgtttaatctaatcttgtggatttcatgacattggacttccagccgatgtgtgctttaaccttcggatggatgcttatttatcatatcattatttgccgattggtttatactggattatattgttatttcattacatcatcatcagccgactgcctttttatcattatctacattggatatatagccgattgcttaaaccctatcactatcggctggtatcggcatgggctattgtcggctatcggctggaactactccatcggcttgttagccgattggctgttttgatctactatttgcatatcttgtcagttgcaggatcaaactgactggcacgcccgcatctcatcaagatttggacctgcataggagctaagcagatctcccaggccggtgtgttcgatttttttcgtgaacagtagggcgggaggtgcatcagccatgaacgcgcagaacccttcaatgccgtcggtaaataatttgccaacacgttgtcgtctgctccggcagcgtagagtaccgtggagtagacttgaaggaattcttctgggtcagtactcccatcgtacttctctgttgctcctggttagaatctctcaggccatcggacatctcgtagcgaacggttgaaagctctatacccggcgctgggggcggtgggttgtcggcgatcgtctgtccttcgcggatgtctatctgatgatgaggatgaagaggatgatgacgacgacgatgagtcactcggctctggcgtgcgattccgaggatgacgtctgggttctcgggaatcctgtcgtcgtccaccgttgttgtcccggcgtcaatctccgtcatcgtcatcgttatggcggcgtcctcgaccaatatcacccggcatccgctgttcgcgatcatcgcgttcgtggcggttgtggcggttatcacggtctcggttctcgctcgggtgtcctcctcgctcttcgttctctcgacgtcgtgaagagagacgatgtctggaacggttttcgttgtcttgcgcgcgtcatgcttctcgacagccatttaaatggtcacggagatcgctggtgccgcggggtggaggggtggcttgttgaggtgaggcccgctactcaggtggttcgccattggcaccgccagctggcggctattttgggtgtgctgtggcagcggcctcctcgaacgcgttgctgaggttggtcactgattcccgtagccgttctgtccaccgtgcgagatcatcatttagaacaggatcataaggggtttccctcagtattgcgttgatgcccccgatgtgctgagccggtgtaaccacttgattctctgcttccgcatcggcgcgcgcagacgcgctggtcccgccgatagcaaacacatcgcgtggtgtgcttgtcgacgatgaaccctggtcgtcgagcgagtgtaggactgatggctcgtggggatcaatgtcgatcaccccaacgaatcggtctgagatgaccgtcgctcctcgttccttgttcacatctctaggagagatttgtgagtgctggaccttaggaggctacgtcttcatggctttgagaagaatcttgcagcttgagaggtcgtgattctttgtcttgtggataggacaatagacatcatgagttggagaagtacgctaaattccactctctttgcaggcacggatgtcagcttgtgcgttgagaaaaacccagcaagcttgcaaggtgtgtttcctagttttgtgaataggacaccaggaccttgtcgcctcagaagttgtccttgtcagctcgtgattcttgtcggaaggacaagatttggccacactaggatcttcctcgggcttggatgtcgtcgacgttccgttctccgctactgcgggaggatccttcgacatggggtcgtccggggttatggccacgacattctcgcttccggtcattgatggaccagtcgagaccggcaccgtggtgtaaaccgggaagacgatttcaccgacttgagtccacaccagcattgttgtagtcggaactcctaggttgacgctggggtcgacgctgttgttgacgagacttgacgacaatagtagtagaaccttgagcaccaagtccccttacctggggcaccattgttaacgggggatccccgtagaccagatatagagggtattggggtacgctggtacgaggatctacgtaatatgacatcaagcaaatagaaaacagggattatactagttcaggccccttggtaggtaatagccctaatccagttgatatgggattatatgatggaaatcacagattacaaagggaacagtggaactcgatgataccgacgagaccgtagtcgagttggttcgactagatcacccggcgacttggctcctgtaggctccggcttcgtaggctatggtggttgtctcggcggtgagattcgatgccttaggtcctcccgggggtcccttttataccgcaggtcaggtggtttcaaagtaggacccagagacatcggaccatcggacctatacgatacagtgacgacccagtcctatccggataggaatctttccatctgtggactccgtgatgaatttccttagcgtatacagagaacgtcggtatacgcgcagatataccatatcgatgtatagcgtatatccaggggtagagggtataccttatttgtaacctgacagttgtgttatgggcttttcacctaattgcatattatttttttttaagaattatattctttctagtttttaatagatgccgttgttaacttttactaatatatttaaccattcacctcatttaataagttacgtgactatcatttatttattttgttgtaagttggtttatcgttaatggaacttttcacataacctacattttttatactttaaaaaaaatatttgaataaaataaatgatcaaatttatatctaaaaaagtaatagcgtcaatctatgaaaaaccggaggaactaattagtaaaatgtaaagcgtgaagatacatggctcgcactttttttccatttgacaataatcatagtccatacacaccttaaataattgattgaaatgtcaggatattaaaaaataaactaaaaataaatcgactcaacataaagttaaaaattatttgtacgtagtgcatgtccacgcatgcatatatgcttgcatgaagacacttcttgcagctggcagattgggctatatataacgatggaagtctatgcccttggccccgtgaggcgtcttgagagatatgaagtatctaatatactattttaaattactcatgttaacagaataatgctgcaaatcttaattactatagagaaaaaataggagggaggattacacacgcacgcgggtgaggcagaggagacgggcaacggcgccgcgaaagtatgtgtgggcggaattagggtattagttttcttggatagattaatctaatggtttataatagtagacccaccgatttaactgaaattaagggtagattttctgttttttataatttttaagaatttctctaataatttatttgagcgccatgtgacaactcgagagtgttttgagggaaccacgtggcatcttgagagcgtttttgggaggttaatggactgtttagtatataataatagaagataatagatagatagatatttttatgttttgtgtcacttacatgtgggtattagactattgactagtcaatttgaccaagtcgactttgatccctgctccacttgtcaatgataaagacttttaaaccccttggaaaaatatttagcaaattaattagaaaattttataccccttgggaaaatatttagcaaattaattggaaatactttggaaccacctatcagtgactagagttcttttgttttataaaaccaattcggacactaaaagaaaactatgcaaacagtaggttttcacaattgtttgaattaaattaaatttgaatctttaaacacccataactcactcatcctaagtccaaatctagtgaaacttacacctaaattcatctaaaatcaagatctatttattggcaatgattttgtatttttcgcattttaattggtatttattccttgttagttagtagtggaatattttgagttagtcattcgccatctatattacgtttgtgaggaagaacctttttgaccatgaggatgaagttttcatagctgagcaagctagcggggcacgtgcactgaagaatctttgcttctcgtctcgtttcacttttctttcgttcagtctcgctatcgttataaagtggaatcaaaccacacactccgtttggaaagaggatttaacagtcccaaagggcccaggcccagtgaaggaaagaggatttacagtcccatggccaatgcacttccataaccttttaattgcttgatttctatagagtaaatttcatattggaccactatattttacttaagttacaacttggactagggatagaactcagtttttactttggagcagaaaagtttacattaatgtttcactttgggccagttcttccactggcgctgttctcaagtgaatcttgccgacgcgcaccttgtgcgatgctccgatgctcctgttctgttatcttgcttcatctccatttattcttgatgctctagacaaacttcaggtgagaccgtgagagaggggaggctggatgagaagactaagcgcgctcaaactttgttagcgctgcagccacgctcgaccttcgccgagggtcgcgacgatctcgatcgatttgtgatttggaggaaattattaagtcctaggcaaatagaggagagctgacaatgcagtggctctgctccagcaccgttcgtacaatcacccattctcaggctgccctgtgcatgcattgattcaattattcaatctcattgttcttcatcttgtgtgctcgctagcacttgtgcaaggctgtagctggccgtgtaataggagttggagcaggtctgcaggggatagctggccggccgctatatgctggtactggctgaagagacaagctcagctcaccagtgtggatagagagttgggctcagggagttttgaggaagaaggagaaggaagatccaatgacatgtgggccaccggtacaaggtgcaaaattggtaacaatacctagttctaggtgaagaggcttactaatacggtaatgcctggtctaatgtgcaacataggtaactaaacctagcctaaagtggaattcactctttataaatttttatatgattctttgagcaactagcacgaaagccgttgcgcgttaacgcattctccaccacatattattatatgactttctgaagtgtgaagtgctcagaataatccaagtcgttcgacccctggatgtagccactaatgtggttcaccaggttaccaaagagatggttggcttgaagagtttgatgagcatagtcatcgaacttcactattgtcatgacatcttcatctaactgagtcattttgaagaataaatcaggggttttgtgctccttggtattaggcctataatcactttatagataagtgtcaacctcatattgctactaatttggcttgctagcgaggacttggaatttctgcttataatgaaaatggatttacagctaaggttgagtccaccgcccccttattcgaacatgttgaatcaaattgcgaaatgttttgtttgtagataaattgcatagcatgctatgttgaaactgtgttccgatattgttgctcaagcctatccattgatattgattccatgcaatactttatgtccctagtcgattattgacaaaatgccgtagtaatgcttgttaattgatttatattatatgttgaataatagatggtatgggaataatcgctctgggtagggagtagttatgtttatgcatgtggtgaaacgctacttgtgataaacatgtgaaacgtttgcgaaaaaccaaagttaatgaacaaaattgatttcgactgggtgacatggattgatttgggtggttcctttttgcatattggccagacactgatagtggaacccttatatttaacattctggaaaatgtaaagaaaatacccaaaccaatattggttgaacgattttagttgaaccaattccagtggattcacaaaattgttcaccttaattttgtaaattaaaaaggtacgcttacagtacaagaatattcctaaaatttcatgtatgaaatagttaatataaaatatgctccaacttataaaatttgtagaaaattcattttaacttcaaatgagttgaactaaaattatttagaataaaaaaatgatctggactaagacctggagtaactggtacatataatacatccacatttaggtaatatatatgtaaataatcgtcataattaatatgagaacttcaaaaattcacaggaaaatggttccaactccaaatgaggtgatttcagatttgttagattcataatatcacgatcttagttgctttgaattaaaatgtgccacatactgcaatgtaaactgttagggttacggataaggtataccctctatccttggacatacgttgtatactgatacggtatacccgcgcgtatccggataatttctatgtacgttaaggaaatctatcgcgtaatagaaacaggatcaacaaatggagggagtcctactcggacaagactgggtctttaccataacgtgagggatctgatatctccgagtcctacttggagagatcaactaacccgcagtataaaaggaacccctgggcaggacctaaggcatcgaatctcaccggcaacacaaccaccatagcctacgaagccggggccctacaggaaccaagtcgccgggtgatctagtcgaaccaactcgactacggtctcatcggtatcatcgagttccgatatttcctttgtaatatgtggtttccatcatataaccccataccaactagattagggctattacctaccaaggggcctgaaccagtataatccttgtcttttgtttgcttgatgttgtattacgtagatcctcgttccaacgtaccccaataccctctatatccggtctatgggtatcccccgtcaacagtggcgcgccaggtagggggacttggcgctcaaggttctactactacgacttcaaacctcctcgacgacagcgtcaaccccgatatcaaccagggagcttcaacctcaacgatgctggtgtgcactcaagtcggcgaaatcgtcttcccggtctacaccacgatgccgatctcgactggcccagaaatcaccaggatcaagaacgatgtggttacgaccccggtcgactccatgtcgaaggatcctcccacaggagcggagaacggaacatcgacaacgtctgcacctaagaaggattctaacgcggccagttcttatctttccaacaagaatcacgagccgacgaggacaacttccgaggcaacaagaatctggtgtcctattcacaagaccaaagggcacgacttgcaggcttgctcggtttttctcgacgtacaagctgaaatccgtgcctgcagggagcgtggaattcgacgtgcttctcccactcgtgatgttcattgtcccattcacaagacaaggactcacgacctctcgagctgtaaggtctttctcaatgccatgaagacgtcacctcctaaggtccaacagtcaaaaatctctcctagagaggcggacaaggaacgaggagcggctgctgtctcagatcgattcgtcagggtaatcgatattgatccccacgagccatctgtcttacatctggtcgaagatcaggcctcatcatcaacaagtacaccacgcgatgtatacgccatcggtgggactagcacgtctgcaggtggcaacacacaagcg

SEQ ID NO: 5752 - DNA, 2476 bp, Oryza sativa
  unsure (1)..(2476): unsure at all n locations
agccacccctccgcctcgtggcaccagtgatctccacgaccatctaaaaggtcgccgataggtgcggcgcacgccagaccacaacaactgttcctgacatcgcgtctcttcgcgaacatcgcgagaacgaagaccaaggaggacatccgagcaagagccgagaccgtgatgatcgccacaaccaccgtgaacacgctaatcgtgagcaacggatgtcgggcgatactggtcgaggacgccatcgtaatgatgacgacggcggagatcagtgccgggacaacaacggtgggcgacgacaaggttctcgagaacccgaacatgatccttgtaatcgcacaccggaaccgagtgactcgtcgtcatcatcatcatcatcctcatcatcctcatcatcttcgtcatcggacagacatccacgaaggatgtatgatcgccgacaacccactgcccccagcggcgggtgtagggctttcagtcgtgctctacgagatgtccgatggcctgagagattccatagtactctacgctgccggagcagacgacaacgcattggcaaaattatttgccagcggcgttgaagggatctgcccgttcgtggtttgttcacctcccgccctacttgatttcttcatgggcagatttgtggcagcagttcgtcgccagcttctaaggaacatacaagtgccacgcgatcgaggacgacctacatgcgttgacacagaatccggcaaatcattgagggactatattcggcgctttaatgagggcagaaatatgatccccgagatcactgatgcttccgtaattcgtgctttcaaatccggtgtccgagatcgctacaccacccaagagctggtgacgagacggatcacaactgctcgtaagctattcgaaattgtcgatcgatgcgctgacgcatacgacaccctaagacacaagaacgacaggccgaagatagggggagagaagaaaccagccaaggatgcaactgagtcaatcaagaagaagagtcgcaggagtgggaaaaggaaagctcaaacagaagtcctcgcagcagagtatgcggacccgcccaagcacccagacccacaaggcgacgatacggagaaaatatggtgccctatacacaagtcggacaagcactctttggagacttgtttcgtcttgaaaatggcactcgcgaagcaattggcattggagaagggcaagcgagtacgtgtagtcgagaaggccgcagaagcggctactcaggactcagactcagcatatccagactctgacctctatgtttcacacatatttggaggttccacagcgtactcctcgaaacgagaatacaagaaagtggagtgtgaagcttgttcgacatggcagggggctgcgcccaagatgaagtggtctgagcagaagatcgaattctcagaggcagaccaccccaaggctgctgtcactccagggcgatacccaatcgtggtagaacccactattcggaacatcaaggtcgcacgggtcctcatcgatggcggtagctccattaacctactcttcgccagcaccttggacgcgatggggatcccacgaagcgagttgacacctactgatcaacctttccatggaattactcctcatccatcgtccaagccattgggcaagattacgctacctgtgactttcggccaagcaaacaactttcgaacagagtagatcacctttgatgtcgctgagtttgacacagcatataatgccatcatcgggagaattgcactcgcgaagttcatggctgcatctcactatgcgtatcaagtgctcaagatgcctgggccgaagggaacaatcactattcagggaaacgcgaagctagcggtgcagtgcgacaagcggagcctcgacattgtcgagcatactcccaacccgcccgccacagctgagccgcccaagaaagtgagcaaaaccaacaagacgccgaagccagaccgcgcaatcaagatcgttccgctctccagtgccaaccccgacaaaactgtcaagatcggggcgtcactggatgagaaataggaactcgcactcattaccttcctccacgacaatgcagacgtgttcgcttggcagccgtccaacatgccgggggtccccagggaggtgattgagcacaaatcatggtgcgacccgatgccaagccagtaaagcaaaaactacagagattcgcaccagataggaaacaagccatatgagaagagctcgacaagcttctcaaagctagtttcatccgagaagttctccatctagagtggctagccaatccagtcatggtacgcaaggccaacgggaagtagagaatgtgtgtcgatttcaccgatctcaacaagacgtgtcccaaagatcacttccccttccttggaatagaccaattggtggattcaccagctggttgtgagttgttnnnnnnnnnnnnnnnnnnnnnnnnnnnnnnnnnnnn

SEQ ID NO: 5753 - DNA, 658 bp, Oryza sativa
  unsure (1)..(658): unsure at all n locations
acagggattatactagttcaggcccttggtaggtaatagccctaatccagttgatatgggattatatgatggaaatcacagattacaaagggaacagtggaactcgatgataccgacgagaccgtagtcgagttggttcgactagatcacccggcgacttggctcctgtaggctcgcttcgtaagctatggtgggtgtctcggcggtgaaaatcgatgccttaagtcctcccgggggtcccttttataccgcaggtcaggtggtttcaaagtaggacccagagacatcggaccatcggacctatacgatacagtgacgacccagtcctatccggataggaatctttccatctgtggactccgtgatgaatttccttagcgtatacagagaacgtcggtatacgcgcagatataccatatcgatgtatagcgtataaaagtagggtttgaatttagataaatttaggtccaagtttcactagaatcagatctacggtttaggagatatgggcttctaaagattggaatttgaattaaatctagaaaagacgaaaatgtactgttcatgggcccacctgtcagcctttctttctctttttctttntcttttctccttcttcttccttcttctcgtcttccttttctcggttccagagaga

SEQ ID NO: 5754 - DNA, 49148 bp, Oryza sativa
acagtagttcatcatctgaacttggtgggatgggatattgcatgatgatttctatgctgatggagccacttcctgaggggcgggaatgtggacgtcctcagaaaaccatgacgactcaatagcgggaagctatccttgggatcacaatggatggtggacagaaccgtcattgtttaatatgaacactggtactaaaatttgatcagtctgtgctaggtctaggtttgtgaaaagaattacaaaacttgctttgcgcaaaagaaccatagccatcctttgaatacccctgtcatgtgcattgttgctgtggtggcttgctgagtacggttggtactcacccttgtaatatacaaacttaatcagaggtcggagatgaagcttcggaggatccctacgcttactaccaggagggtgatggagacgatggcgctcagtaggtcttagttacggtcgttgcctgtggcaatggcgtgccgctgccttgactccgctgccttacctacttctgtttttggaatgtattctagaccgctcggtccgatgatttgagactatgcctgcgggcttatgatgtaataattcgcactagactctcgtgtatgtgcatttggtatttcagctatgaactcgtgtataccagactacttgatccagggaaatggtactgattacacgatagattcctgttataaaaacaggggtccacagagttggtatcagagccatacgactgtaggaaaagaccaaaaggcgccccaccccttttctaagattggccaagggagaaattcccatttagtaatactttcaaaaataaaaactctatgtttacaaaactctgtacgattttcatcttactcttaactactttcttcacaaaacaagttttactctcagctgactttgggtttttcttaaaattagatggcagatcaagattcacccaccacctgggagatgggcgtaccccgctcagagggatacgtcatagagctacatcgggtgatgaggcgccttcggtaccccagatttccgatctaccgagtgagacaatgtggacccttttgggagggccggattgaggttcatccgcgagtcccttcagagtcagactacagcttctcgacacgccaccgtcgtgacttaccggagaccgcgatgcaggacgcagcccgggaggccttcctctgacttagttctattcactgggcagagttagcgagtaccgagtttgctcaccatccgtttcgggaggagagcaactctgtctgcacagttcaggacataccttgctgctataacccgatggtgactcgactgtcccgatgggctgaggctgtggacgacttctacgaggaggccctgttggagatcgacgaccagcagaggcgtatgggagagttggagaccaaggtaactgacctcacagcacaacagcttcagctagaggaggagcatcaggcttggggcagcgagatagactcgctgaaggcacagctccaggtccacagcgaccagttccagcagctatctgatcagtacaatgatcgccgcgggatgatggatacactcgaggagcagctgagagagagtcaggagcacgtcagccagcttgaggagcagcttcgagcagctacagtcagcaccacaggagcttctacttccacaacagtagggcgtgaccgctacttcttccttactccgccgtacccaccagcgttccacgctcttttgggagaggttaatatggtagccaccgagtcagcaccttacctggtggaccagacagtgacacagccacctgctccagagattaggaacaccccactgatctccacttcttcaccgcagccagggtccagtttagagactccgattcaggtcgactccgagacagaggggaccgacaccgagccagagatagagccggacatcactgatccttcagaggacgcgactcctgtcccccgcattaccttcatcggaggccctcgtaccctcagcaatgcccgcaagagcacacgacctccgggcaagaagcccaagccagatttagaggccactacttccgagccgtggggactcaagtttgcacgagccagcgaccaccctcttcctgccccaggatcctgcggatggttggatgactagactggaggacttttgcagcttcgatctcgcttcagatggtttttgggtagcatgcgagacacacacacccccttacctagattgacgagtagcttgatgattagtcgatgtatcttttggatgaactttatttggactgcgtatatgtgcggtcgattgcatcatgatttatgtactatctgtggaactctgcgatgttctttatgatgttgttactgttgtgttatgaatgagtttattccaccatgcttgcaaaacaaacttcacatcaaaacaactcccttaatgggataaaaccataagagctagttagaaaattaggatacttacttaatcggcctacacagatggcaagccgacgtcgggcgtcaatcagcaatgaagaaactcaaacacctgacctaaccaccctggccggagttatggccactcaaacccaacttctgcaagccattgcaaacaaccaaggcaaccgcggacgatcaagctttggagagtttatgaggaccaagccacccacgttcactacggcagacgagcccatggaggcagaagattggctacgcatcatagagaagaaactgactcttgtccgggtacgcgaagccgacaaagtgatcttcgcagtaaaccaactggagggacccgctggtgataggtgggatacttacaaggaagctcgggaagaggatgctggagaacccacttgggaagagttcactgcagcatttcaagagaacttcgtgcctgctgcggtaatgcgtatgaagaagaacgagtttagaaggatgcgacaagggaacacaacggtgcaggaatatctgaaccggttcactcagttggcccgctatgcaattggagacctcgcagatgaagaggaaaagatcgacaagttcatagaagggctgaatgatgaattgcgcggacctatgattgggcaagaccatgagagcttccagagcctgatcaacaaagtcgttaggctggagaacgatcaaaggactgtagagcacaaccacaagaggaggcttgctatgaatcgcccacctcagggagtgcctcagcgactcaagggagccacttcgtctgggtggaagccccctattgtggcacccaaccgtcccgccgcgcctagtaatttcaacaggccggttgtgattcagaaccgcacccctacaccaactctggctgcccctggagccaagaagaatgtggactgcttcaactgcggggagtatgggcactacgccaacaactgccctcatccacgcaaaactcctgtccgtactggcgctaatgcaatgactgttcgtggaactactacccctgctgccggacgaggtctattcaagactccgcaaactaacaggaccgctaccggatttggacgcggacaagtgaaccatgttcgagctgaagaggcccaggaagaccagggcgtactaatgggtatgttctctatcaattccaccccggttaaagttctcttcgattctggtgcatcgcattcattcatatctcggaaggctagtcaaaagcacaacttaaccctagtgggacttagaaagcctatgatagtacactcacctgggggcgagataactgtgagtcatgcttgcatagacgtacctattcgtcttagggatgtggtgtttccctccaaccttttggttttgatacctcagaccctggatgtcatattgggtatggattggttgacgaagaacagaggagtaatcgactgtagacgtagaaaagttaccctgaccacaccctggagatcggatatgagagcaaccatggatcaagatcctagactaatcgaacgtgccggaggcatatttaccatgctacccctgaaaggaatgcccatagtgcagcgatttcccgatgtgtttccagaagatttacctggaatgccaccagatcgtgacatagagttcattattgacctgatacccggaactgctcccatatccaagagaccttatcggatgccagtcaatgagttggaggaacttaaaaagcaaatcagagagttgcaagagaagggatttgtacgtcccagttcgtcaccttggggagccccagtgttattcgttaagaagaaggatggtagcatgaaatgtgtgtggactaccgctcactgaacgaagtaactatcaagaacaagtatccacttccacggattgatgatcttttcgatcaacttaaaggagctaaggtgttctctaagattgaccttcgatcaggataccaccaattgaaaattaggaccggggatgtacccaagactgcgttctcaacacgctatggattatatgagttcacagtaatgtcgtttggattaaccaacaccccggcatactttatgaatcttatgaacaaagtgttcatggattacttggacaaatttgtggtagtattcatcgatgatattttaatctactccaaagacgaggaagagcatgtggagcacttgcggttggtactcgagaaacttcggaagcataaattatatgcaaagtttagtaaatgtgagttctggttaaaagaagtcgcctttctaggccacgtaatctcagccggtggagttgtagtggatcctgctaaagtggaggctgttacggaatggaaagcacccaaatctgtgactgaaattcggagttttctaggcttggccggatactaccgaaggttcattgaggggttctctaagataacccgaccaatgacacaactactcaagaaggaaaagaagtttgtgtggtcagaacagtgtcaggaaagctttgagcagctcaaagaaaagctgacctcggcgcctattctagttcttcccgacatcaggaaagactttgttatatattgtgatgcatcaaggcaaggactggggaggagtactgatgcaagaaggaaaggacgtggcttatgcatcgcgacaactgcgaccacacgaggaaaattaccctacccatgacctagaactagcagtcgtggttcatgagctaaagatttggagacactatttgattggaaaccattgcgatatctacactgactacaagagtctgaagtatattttcacccagtcagatctcaacttgaggcaaaggcgatggttggaactaatcaaggattatgatctagaggttcactatcacccaggcaaagcaaacattgtggccgacgctttaagtcgaaagagccattgcaatcatctgaggatggaagggataacccctgaacttaaggaggaaatagcccaactgaatttacatttagttccttatggtcaaataaacaccttggacatccagccccttttgaggacccagatagaggaagcccagaaggacaacggagagatccaagaggtgaaggagcgcatagccgctggttgtgcgaaagaattctcaattgatgagaaggaaacactatggtataagaagaggatttacgtacccgaacagggtggactgaggggattaattctaagggaagctcacgaatcagcatattcattacaccccggaagtacgaagatgtaccaggacctgaaggaaggatactggtggcccaacatgaaaagggatgtagcagaatacgtagcactctgcgacgtatgccagagggtgaaggccgagcaccagcgaccggcaggtttgctgcaaccccttaggattccagaatgcaaatgggacgagataggtatggactttatcgttggattgcataagaccgcaactggttacgattccatttgggtaatcgtggaccgactcactaagactgcaaggttcatccccgtcaagacaaattatagcggagccaagctagctgagttatacatgacaaggatagtatgtcttcatggtgtgcctaagagaattatatccgatcgaggcacacagtttacctcgcatttctgggaaaaagtacatgaagccctaggaagttaccttgcttttagcacagcttatcacccacaaacagatggccagacagagagaacaaaccaggtcttggaggacatgttgagagcttgtgctttggattttagcaaggattgggagaaatgtttgccctacgccgaattctcctacaacaacagtttccaagcgagcctaaagatgtcgccaaatgaggcattatttggtcgacgatgtcgtaccccactaatgtggtccgagactggagaacggacggtatttggacctgacattatccaagaagccgaagaaaaggttcgcctaatccgtgaccgtctaaaagtggcacaatcacgacaaaagagttacgctgacacccggagaagagatctagaatttaaggaaggggattatgtatatctgaaggtttctccgatgagaggtacaaaaatgtttaaggttaaagggaaactagcaccaagatatgtgggacctttccaaatcatcgctagacgaggagaagttgcatatcagttacagctaccagaaaatatcgctgatgtgcacccagttttccatgtgtctcaattaaagaagtgcttacgagtgccggaggaacaagctccgttggaagaaattcatattagcaatgatctcacgtatccagaacacccagtccggatattggatgaagcagaaaagaggactaggaccaaagtgtggcgtatgtacaaggtacaatggagtaatcatactgaggatgaagccacttgggaaagcgaagaattcttggagacagaatacccgcatctattcgaaatccgataagaaatctcgggatgagatttatttaaggggggtaggtttgtaacaccctgaaaattcgaccaataaaaacaaaactctaaaaatgcggaccttcaaaaactttttaaattaattgcatcatgccgattctattcgcctattttatttggatttgatttcgaaattcattagttgtgagtaaagaatagttaattaggaataaaccctaaaaataaattggcaaaataaatataatttaaaataaagattaggtgaggatagaaataaataaaatattatcgcgaccataatggtaataattaaatttaagtgcgatggagcaagaattaaccctaattaaaaattcaaataaattatataaaaataaaatatgggtaatattaatttagggtgaatttttagttagaataacacaaatattgagtaaacttcatttatgcaaaaattagaatttatagggctatatttaaatagaaaataggataaaatcgggataaataggaaaagtcactattcattgcccgctaggtgcacgagtgcgtcccctagccttccccctcctctgccacaccgctcctagccgtccttgtgccccgcgccgccgtgggccgtcaccgtcgccatcgccttgctccgccgctgccgccgcgcgccgtcgcgtcatctcgtgccccgagccgccgcgcgccgtcgccatcgccgccttgagcccgtgtcgccgcccgtcgcgtcgccgcccatcgcatcccgccccgagccacgtgccaccgctgtcgccatcgccgtcgatgtcccgtcgccgcgcgcgttccatcgccgcctcgcgccccgcgccgccgctgccgcgccgtcgctgtcgccgttccgtcgccgcgcgcgcgtcccatcgccgcctcgcgccccgcgccgccgcgccaccgtcgcgtcacccccttcacttccctctccccccttatcccctctctcccctataaaagcccaccattctcccctctccaaactccattccctcctcctctcctctaaccactccaccatgttgccgttgtgccgccgcgccgccgccttcgcgccaccgcatttgagccgccgcgccgccgacctcggtgacgccgcaccgcaccaggtgccgcgccgcgtcctgcgccgccatcaccgtcgtcgccgccaccgccgccgccggtgagctgtctcctccccccctcgcgcccaccgccgtcgccgcccgggtgagcaagagccgagagagagaggtagaaagaagccgggagggaggagagaaaaagaaaagaaaggaaagggagaaaaagaaaagaaagaaggagagaaaaagaaaagaaaggaaagaggagaaaaagaaaagaaagaaaagaggagagaaaaagaaaaggaaaaataaatagaaattagtgggagattaaggaagtttagaaaatttaaaataattagaatttaattatagattaattatagtcgtagaattgcaaaatttaatataattatagataatttttgggtaatctctataagtaatcgactcacggtagaaattcagatttaattactaggaattttagccgtgtattatatttaatcatttagtcatagactaaattaaatcgtacaatattataagataattttaggattttgtccgatatttagctcgcgatagaaatttctaacctattatatggatggaatgcccgggcggattaaattaaaaacttgtgctaataaaatatttatgccacaaaatagtttggggatggatagagttaaacagacggagtagctctatttcacgaacgaaattagataatgtatgaaaccgacttccgctctcgatatcttcttggatttacttggatctttatttgaattctaaccgaattcaaatcgtttcttcgcacgtaattttagagcccgagggagttgcggatccgagcgaggaccaagacccgcaaagcttcgagcaaggcaagtcatcactattctttgaacatgttgatcccaattgcgacattattttgtttataaataaattgcatgcaataatgaacatcctacttgtgattatgccatgccttggttcttgtttaccccttatgccttcgtaaccatgtttacgtatgagtccctagtcagttatgacaattgcttagaaatgctattctagaatcatgcatactcatatttatcaaatgctatatgcttgggcaattacctttgggaaggtaattgagatgcggcatgtggggacatgagcgccacattgccatgatgttgatgacatgatttgtgaaaggagaaatgaaattaaacaactgttttcgactggggcggacggaggatttgggtggtatccggaaaaggctagtaccgtcccctgtcaattaaggaccgagccatgaagttaagcatgaaacgacccccgtataaccgcacttctcgtatcggtatagaccaagcggagtagatagctgagcggaggcagtatccatccatagtggtttcttgttatgtgaggcaggggctctacggtggggcagccattggtaggaccgcgaggcgggtgtctacagtggtgtcgctatcggtaggactgccatgtgagaatctaaacgtaattataacttaatgcatgtgtgagtcttcccttcccgggtgcaccagaactcctctcactgctagaaaccgtgtacgcctagagtgcatgaggatgtaaagttcatggagcgggtactgccaatgcgaggttatcgaaaagctttgccgtgacacgtctcatgtgttgggatgaggctcatgtgttgggcagtcgcggagtgcgggtaaagtgtacatccactgcagtgtgagtaaaccaaatctattcgaatagccgtgctcgcggttattgagcactgggacatgtattacacttggctagactctaaattcttaacttgtgtgggatgggatattgcatgatgatttctatgctgatggagccacttcctgaggggcgggaatgtggacgtcctcagaaaaccatgacgactcaatagcgggaagctatccttgggatcacaatggatggtggacagaaccgtcattgtttaatatgaacactggtactaaaatttgatcagtctgtgctaggtctcaggtttgtgaaaagaattacaaaacttgctttgcgcaaaagaaccatagccatcctttgaatacccctgtcatgtgcattgttgctgtggtggcttgctgagtacggttggtactcacccttgtaatatacaaacttaatcagaggtcggagatgaagcttcggaggatccctacgcttactaccaggagggtgatggagacgatggcgctcagtaggtcttagttacggtcgttgcctgtggcaatggcgtgccgctgccttgactctgctgccttacctacttctgtttttggaatgtattccggaccgctcggtccgatgatttgagactatgcctgcgggcttatgatgtaataattcgcactagactctcgtgtatgtgcatttggtatttcagctatgaactcgtgtgtactagactacttgatccagggaaatggtactgtttacacgatagattcctgttataaaaacgggggtccacatgaagggatggggtcaaggcaggcttggcggtccaaaacggaatcttgtctagttgttcctcagggacaacaaagattggatccaaattttctatctgaagatagaaccacctcgcccgccatttgctacgagaagaggggcacttgaaggggatgtatcgcgacttcaggccatcccgaagtcggaaactaacacacccggacacatttttacgttccatccagcgcagctcgtagtagaaacgaaagagatcaagaaacagctctaccccaatgtagacctcacaaagatgggaaaagatgctgaggaaggccatggagttggggttcagatggagcagagaaagaccgtagaaattcaagacgagaaggaaaaactcagaaggcggcgggagaaaaccgcagagaatgtagtcctcaaccgcaaccatgcggcccaggacaggttcaggttcaatacctcctggttccctctccatggtcccgcgaccggggagagcgccttcctcctgcaacttcttcagggacgcgctggtggaagtggacttgtcgaggtccattgccgccggagatcaccggaggagggaccaagatgagcaagctagggtttgtgcgggagcggagaagacgaagagcgcttggaggctaggaagtttttgcaacaggcgggctccaaaatggatccccaaaactcccttaaatagacgcactaccgacgatgcgaattccaaggaaaggagagagatggccgccggaaatttctgggtccgttacacgcggcagtttttggacttcaatttaaattcactcacgaccgttgaacttcgcatggcgtcgtcgattactccttgtctctacggtcctcacgccgagatcgaccagtcgagaacgacaacaaacccgacatcagaagtcgcgatcggttacatgagttcatttaagcagaagtcaggggctactttcagggttacgaataaggtataccctctacccttggatatacgctatacatcgatatggtatatctgcgcgtatacggatgttctttgtatacgctaagaaaattcatcatggagtccacagatggaaaggttcctactcggatcggactgggtcgtcactgtatcgtgtagggtccgatgtctccgagtcctacttggaaaccaccttacctgcggtataaaagggacccaccggaaggacctaaggcatcgaatctcacagccgagacaaccaccatagcctacgaagccggagcctacaggagccaagtcgccgggtgatctagtcgaaccaacttgactacggtctcgtcggtatcatcgagttccattgttccctttgtaatctgtgattccatcatataatcccatatcaactggatttagggttattacctaccaaggggcctaccaaggggcctgaaccaatataatccatgttttctattagcttgatgtcatattacgtagatcctcgtaccagcgtaccccaataccctctatatccggtctacgggtgtcccccatcgacaacaacataataatcaccgggtcttaattgctagcgaggcttctttgtaaatactaaattaacttattgaaccacatgataaaacccactcttgataattagctgtcagttgtaaaaagtaaacaaaaatcgaagatactaattaaatttgaattcttactgtagtatttgaaattaaatacattgcaaaagaaacaaacaaatatacgcaaaggaaataaattagttccaaccaattacttggatgatttgttggcttatataccaaaattcctaggttgagatcataaactattcggtaaattggtcagattcaataaacttcaaacattttaggacaaaatttgacttctatagagtataagtctatctttaattagatgacgtagtcatattagcaatatgtttaataaacaaatatcttcaactaatttatcctaaaatcgaaaaacatctacagtataaaaaacatcatacaaaccaattccatggttgtgattgcgacaccatattttctcataaataaattcaagacttcacgatttcacatgattttagtttacaatttatatgatgcaagggtaattagaaaaaaaaatcatttccaacgtaatcccaaataaattagaatagagtaaaaaagatatttcaataaaaatatcactcacgcatatatatttgttataaaattttgagtggtgatccgatgctctctactgatactattatatcaccagtagaaatgatctgatccattcgttatttactaatacattgattaaggctaaccttttcatttatatatttttttcgggctagattgatcaatctgtggttatttattgtgctggcatcgctcatattccatcgaaataagccaaacaagaataaaactaggtttagtgactactaaatgataattataccccttacgcactttttttatagtaatgtctctccatgtttgaactactgctatttagggtggtagtataaatagatctaaatcattcgatcaaataagatcaacggattagattactttctactatcaatagagagaatcgtagtgggtctcaaattttaaacgtgttaaacaagatgcccgcgcatgtgcacgggctaccttgttataattagattttctaaataactagtacccacgtatcaacctacagattttctatcgtatcgccataacagtgcacacgtgtacaaataaaaaacgaaatcaaactaccatatctaactgtaggccattcggccattgacaacaattttctatttccacgctgaacacgagccacagttgacagttgaatcgctgagcctcactctatttaaacccgtcactcgtacccatgctaatacaacaaacataccacagtcgcgagaagttaatcgcgatcgagatagctagctagatttcaatttttaatggcaggtcagcctcccaacatgttggcaccaccgaccgacgacgagctgctgcacgcgcaggccgacatgttgcgccacagcctctacttcgtcacgtccatggcgtttcagtgcgccgtcaagctcggcatccccaccgccatccaccgcgccggcggcaccgcctcgctgcccgaccttgtcgccgccctctccctcccgcccgccaagctcccgttcctccgccgcctcatgcggctgctggtcaactcgggcgtcttcgccgctgccgacgacaccgccaccgggtgggccgggatgtaccgcctcaccccgctgtcgtggctcctggtggaaggcgaaggcgcagcgcccgtcgtcgacggccacccgagccaggtgcttgtggtgctcgccgcgacgtccaggcacttcgtggaggcggcgatggggctcgcggactggttcgggaaggacctgccgccgtcgtcctcggcgccgccgtcgccgttcgaggaggtgcacggcgccgcgctgttcgacgagagcatggcgaaccttgacccggagtctgactcgatgttcaacgaagctctagcggcgcacgaccactcagacttccccacggttctccgggagtgccgtgaggtgttccagggggtggagtcgctcaccgattgccgcggtggtgacggcagggcggcgaaggccatcgtcgaggccttcccacacatcaagttcaccgtgctggactttccccgggtgattggcgagacacgaactggtgtggtgaactacgtagcgggcgacatgttccgtgagatcccacctgctcaagctgtgatgctccaggtagtattaactgaaataaattaaaattaaaagtgattttcagcgcacgtatatataccagtgagagtttgatttattattttttataacttgtgatgattgaatttgaatttggatgtttttaaagtcatatatcatatatcgatatatcttgttattttttttataatattaggataacatgcaaatacggaagacatcgtcttgagtcttgagtaattaattagaatccatttcctatatagaagaacagttaacgactagtgcgccacgaagtgtgtaattcaaattgcgcatttgttaacttttctatgacttttttgtgcatggtagcttgtgcttcaccactggaatgacgaggattgtgtgaagatcctagctaattgcaagaaagctattccaacccgagaagatggagggaaggtgatcatcatagatatagttattggtgctccttcaggactgctgctagaagcccagctcctcatggatgtggctatgatggtggtgaccaaaggccgacagcgagacgagaatgattggcgtgatctcttcagcaaagcaggcttcagtgactacaatattgtgaagaaactgggagctcgaggcgtctttgaggtctacccatagcagtggttccaacactaattgtgtgggtcccctctgtggaggatgtgatctaagtgaataaaggaaggaagggcatattttctgaaacaaattgttatatatgtgatctatgtcaagcttggttttgtgaattaatacgtgtaaaacttctgttgaatgtttcatgtgagttaatgtgtccggcttgcttatgtaaaatttcaatatgtaaaatcacttaggccatgttcaatgcgtagccccaggtcgtccccctagcaccctccgtccgaagccgttagccgtttcgcccgaggcgatggaacgcgcgcctctgctgggggacacgtccctcgctcgcttttggcaggggcatgcagcggaacgacgcgttgtgtgccggtgagaggagagggagacgagcggcggatccggctgccgttacgccagatccggttgccggcatgccagatccatgcgctgctcaccgttgaccaccgcgctcataagtcgtcggccaccagcaacggcgttgctccagcggcggcggcggccctcctcatcgcccttccagccgccggctacgggttagagaaagaggcgagcggaggcggagggagagagatggagagggagtaaggcggcggtgtctagacgaggagggaggcgacggcggtgtctgtggcggtgcggcgcgagactcccgggaggacggcgacgggcgaaggaagtgagacgaggcgaagaaaagaagaagaggaggggcgacgaagaagaagcaggagcaaagaaaaaagagaagagagagaggggggagaagagaggggtagtataggaaaacacccaccctgggttttttggttgggacacccattgtggggttgagtacctttattcggttgcttcagattttgaagagaccacttagatgtaacctccattgagagatgagtgcccctgggcactctaggtgtggctttgattgtagatgctgatggagggaatactttaaacatgcaagtcatcctagatgaataacaattcaacatcacccacaaccaacttggtctccccagccttaagtatactggacacatgtttgatttcttttgcatggacgaataagtccatgtaacctcacaattctatttagagggtcatgtccctacactaataatacccgaaatttttgcttggacaaataagtccatgtaaccttgcaactctaccttaatctactggacatgatttgcttaatggggtaggtttgtaacattctagttaagaaaaagcattaaggtttcaaagtttttaaaacttttgcatcatgtcgtgatcattgcttgagttgtatggaaatttattttaaaacaaacctacgaataactaaattccaaagcatacgaagaaaacatgataaaatatttcacgaatcacatgtaaagcaaagacaagaaatcaaatagattaaataccaatttaaattataatctaattatacaacaaacatttgaccaaatatatatattagtaataaaaagaaacatttgaccaaattgtgcatttgttaattttttttggtgactgttttgtgcatggtagcttctgcttcaccactggaatgttgaggattacgtgaagatcctagcccaatgcaacaaaactattccaaacggagaatatagatggaaggtgattatcactgacatagtgaatggggctccttcagggccacttctagaagcccaactcctcatcaatgtggttatgatggtcgtaaccaaaggtcgacagcgagatgaaaatgagtggcgtgatctattcaagacagcaggcacagcaggcttcagtgactataagattgtgaagaactgggagctcgagctatatttgaggtctatcgatcccaagcagtgctcccaaatactattattgagtgggtttcctctatcactactaggaaaatgtttcgcatacgaggtccttttcactaagcatgcatgcacgatttttgctcccaaacgtccaaggcggaggcttaactacgaaaatgtatcattccaggcagagatttaagacgtccgacatgaaagatagtatattatcctagacggacatctttagagctttgtctgcgaagatatttcttcgtgggaggaaccttaagtcgtccgtctgggataatttttttatgaaaatagatgcacaacggagacacgaattttacgtggaaaaacccttgcgggaaaaaaccacgggcaccgaccgacaatgatcaatattgagaagttggatacaaacgcagggggatgcattgggttgtcacacactcctcataagggttacaagagaaatataggagtcttaataggcgaagacacaaagtccaagtaggaaactaatcttataatatagagtcctattagaaaactaatctaaatatactgtagtcctaatatttggatcacatgtttaacaatcttcaccttgagaccaattttcttgtagcataaaaattgtcaatatccaaagaatctcacatagataaaatcattgtgcgccaaacaatctctatgactataatgtaacaccctcgattcagaagaagtagaccatactctcaccattgggaataaatcctgaatctgctagtataaacctgtgtgaactaagcagcgacgcgaaacatgatgcccaaacttcaaactcgccatggaaataaaatcttgagtctactagcatgaatttatgtaatcctagcagaatcatgaacttttgtatacaaaacgaagtacttagatctcatgataaccagtttcgaccatcaatattatccaatatatgaagactagctatgcttgcaatgcataattcctaaataaaataattacttccactatatgctatgctactaacatgtatgcaggagaagcactcataaatgaagagaaggaggaggaaatatatcgatcaattagtcgaaagtctgccggtgatgtgcaattgcatgagaaggcctaaatgtccaatttaacaatcacaaatgggcctagaatgtatgtcactgatttaggggccaacatgggagtctactggagaaagctggggccagaagagccagcaaggggtcggccgacccaccactgagcccaatcagcccccatcttacacaggctactcactacctaaggtcgttatgaccggttcccgcgctattaccgacttcaggaggacagatggcatgaggagaaggaagatgttcgttggatgctatggaggatctccaccctcccaagtcatctccacctataaataccccttcacttccttcattccaagcacacacctcaagaagaagatcaagagctctctcaagtattgtttagtagttctagtgctagtggagtaggaaatagaatagtcttcatagtcctcaagtcttcaggagatttctagtatggctttaatagctttactttcttattttgtaagacttattgaattaatagaatattcttctttatacaagttcggtattttattccattcatattacttgagtgccgactttactttatacttgaatcaatatagtcgtgtaactagctttccagataggtgtattggtgtgggtttaatgtccgattattcggttgctctatgtcggttgcaaggatgtagagtagtatttagtaatgtaagcgcggtgcttagattattagataccattaattggggtaatatacagtggttcagatgctggccgctgatggtgacagcttagtacgggtgtcctctgcatgtgtatattgtcctaagttaatttcctggggagggtactcctccgtatttagccccggttgtatggtcatgacgggctgtcgtaaggaactcggcagtcaggggtggcttctcgaaacaccaggaggacactgggtatgaggtattggttgcatgactgtatactagcaagtatagactaaagatgtatgtatactagaagtacaggaatgatatttttcttattctttctccacttagcttaaactatattttagtgagagtagttcttagttctttcttctgtgtgtcaccctaccctttgaactgaattaacccctgcatagactttgatgtatataagtaatatatgaattgttagcatagttctctcttatcatatcttctcttgcgataccttggaatactcccgggtgaaatgctacaatgatatatccatgcgcttgcggatcatatctgtaaccataatataccaggattatttctagtgctactgctgggaattagtcgctaagaaataccaacaatatcatgttagcaaaattcaccgaaaaatttgatcaccttgtgatctagataggagcaaggctctctcttgacaacttggatgtgcttcttgttttctgcatgcttctcctcttagatagatgtgccaacttgcatcttcacttgccataatgagaatattgcatctcaatctaggagtggtcgataatacttcaaactcgccttgtgaataaaatgcagaaacacaaaacacattcagagtgcaaaaactaagtatttggatcaccgtataaacctcttggtagacttgggttgttaatttagcaattgaacatgaatttggatttaccagaacagaatagaaatcgctgcaaattgaatttatttcctggtacgaaggatgtgtgcacatagtattgatcgcacgtgaaattaaattcatgtagatagggcaatgatggctgattgccttgacctggctagcagatgtgcacaacagtcaacttaattttactccggttacaagcaaatgcatgcggtagatgcacctggcaatatggtagtcctcgatccgatgtggaagcgctgtggctttggttttgatatatgtgaccagttcgatctcatcgaatagaccgaatttatgagaatcgacaaacgtgatggccacaggtaagagatagatatctcctaacaattgaactcgacgaaatgatgggaggatgcgcgcctgccgccacctgttagattcatcgatggacgggccgatagctggtatagatagaactccaacactctgataccacttgttatgaaaatagatacacaatggagacacaaattttacatgaaaatacccttacagggaaaaaactacgggcactgactggcaagggtcaatattgagaagttatacaaacgcaggggatacattgggttatcgcacactcctcgtgcggcttacaagaaatatatatatgagaaatatacgagtcctaataggcaaaggcacgaagagctagtaggaaattaatcctataatacgtagtcatattaggaaaccaatccgaatatattgtaggcctaaaattcagatcatatatttaacaaatttccctatatagctttctttctccccaaccgctattcagttcaaccaaagatctattggtcacagtaaaaaaaagatctattagtcaaatttgtaggattcttcatgacttatagattttctatgatccattaatgttgatgcgacatacatttcattatcttcttggtaatggtttggggttaaactaatttttaaccatatttctagttgtgaatggtgaactatatatgtgcaccctatgtattgtcacatgctaattttctgacatacacgtattatgattccattcttcatatgatgtaggcttataggcctatgcaacattagtttcgtcccattttatctcaaacaaatttcaaaagagtaggctttctttcttcatttgatgatatttgtatcatcatcttggtttggggcttttaatacttgtatgccaatacccaatccaaaatttcattaacagtccgctatcaaaggatcaacttgtgggttgatcctttagttgatttttcaacttctacttgactgctaatgaattttactatgtaaataaacattttccataataggtcttaatgccaacttctattgtccataatacaattttcttatgcttcttgttctcgcttaatgcttatttgcgtaggcatggttctttaagtgtgccagcattggtatgtactccaactgcttgttctcttccttgatggaaagatgtggcatgtctattctgaggtttcataccatttgccaggtctcaacttgctctccctcaattatggggtgtacatttagtgataataagtatgaaagttacatttgttccttttcaccagatgtctctaattactttaaggatttaaggagctggagttcttggcatattattttcgacgtctctagacaagatgatagatacctttacattccttatacctttacattccttggtatttcaccctcgtcttgttcattacattagggtagatgcaatttagtcatgctcttataatcacaaaagtaattaaggacgataggaaattctgacaatacatctgttcttttgatgccttgcattccttagagcttgattgagtatgcaataatcctttgtttaaccatttttctcacaagaatcatctaagactgggtttggctgttggaatccctcacgcacgcaatacagaatgactcattagtgcatgattaattaattattagctaatccttcttgaaaaatggattaatatgatttttttaaagcaactttagtatagatttttttttttgcaaaaaacacattggttagcagtttgggaagcgtgtgctagaaaaatgaggtagggtgagttgggaaaatagggtaaagagcacaacttaagggttcattttctcctcctcaatgtctagaaacaagtctccttttagtcaaggaatttaggctccatacatacctccattcaagcttcctaactttcgaaaagagctcatactgtggtcgtgagatatgcacatgtaccagggaccaccacttggattcttgagtggatggcacatttcaaatggttcaaatgttgataattcgttgcttttgagactgcatgtccattcaagatgcgggaatttgaataacattgtggcgaacccttttaatccatccttagtatttactccatttttgtggatatccagtacttagtgccttttcttagtgtgcttatgacaatatgtgtgttcttgctatatcggtttggcaagagcatagtgtcaaaaataggtaagcacgttatttcccggaatttgtctgcagatattactagtttctttctattttgggtatacctttcaaggtatgtagggtatggatcaatttttctttggttcaagacatggtggtgcgtgcttcatgcacgtccaaggttcgacggtatgcgcaatcaaagtggcacgaggtatgcgaccagtgtggttacggtgtggctgacggtgtaacacgcatggctaatacggcacggattggctggcatgcggtacaacggggttgctagtcggtgcacagtgcaacgtccaacgcgtagcgctggtgctggcctcggtgtgcgtcacggtgtgacgtggtgcatgccgatgaatggctgtaacataccaaaaattagctattttcaaatcttgcatcatgccgggtcttatgttcttaataacctctttaaacctaggacattataattagcgagacctcctaaagctaacctgcataaaatccttctttgatattcaaaagcttttgtgattttcatttaaaattttatcttgaaatattccttgatttggttttaatctaaaaccttctttcgcctaaaacttcctttatttaaatttagtttgaaaaaccctttttactattatgaattatggtccaagaaaccatcctatactgtgctagaacctaaaccaaagcaattccaattttattggaattaattgttaacccatcctttgatcttaaacctatcatttgattctcgatccaaatattcgagtttctccttttaatctagccaccattttaatccctgtggcttgattccctcttcggcacaagaaatattattattacaaatattgtgagtaattgctcttgtgctaagagaatagactttatccctccgccccaaattcaaaacctcatttagcccatatctaattctttaaatttcataccacatattttgggctagaattctatttactctattccctccatattccctccactcaaaaatattcaaatctagagccatattatttatggttttgaatattttgaatttctatttgagtatattaaataaactcctcaaaccaactggagaaatatttcttttggaaattatattcaaatataatttccttctaaactctctctcagtcatttttccttcaaattcaaattattcaaatcctttttcaaaatctagccatccaaattcctctaaatctattatttgaatctctaggaaaattagacttcctccttttcaactttgggcagaattcttcttctctctcgcgcggcccaagtcggcccatagcaagcgcgcgtgccgtgcacgcgcacgccgccgccaacgccttccgtcgccgctaaggaaccggccgccgccatttggtgcgccgtcgccgttgtcctgccttcgccgccaagttgcgccgccaccatcgccgtgccgtgccctccttctccgccgtccaactctgccacggccgccacgtacgcgcgccgcaaatgtcgaccaatcggaagacaaagccggcaccgtcatcctcctctccacgccactgccgccgtgctccccttctccttttcctccgaaaccgtcattagccaccgcctttagtcgtctataaatagacggcaagactcgccattcctcttcagaactcaagctctgagatctttttctctctctcctcccatggccgatcgtcgacatcgtcggtcgatctccccatccgtagctcctcctttcctctcctcgcaccaccggcttcgcctccatctggcgagtccgttttttccctttcccctcttccctacccacttcatcaagccaccacagccacttctcttgccgccggagataagctcttctactcgctgttccggccatctccctcgctccctctgcttgccaccgacctccccggatgcgcagtgagcgggaacatgcgtggccgatgacgtcgccgccctccagccaccggagcgccgccgccccgctcgccttctcctctctcttctctcggctctctctggaaccgagaaaaggaagacgagaagaaggaagaagaaggagaaaagaaaaagaaaaagagaaagaaaggctgacaggtgggcccatgaacagtacattttcgtcttttctagatttaattcaaattccaatctttagaagcccatatctcctaaaccgtagatctgattctagtgaaacttggacctaaatttatctaaattcaaaccctacttttgataccaaatttgctatttaaagattttatttgaatttctttaatttattcaaatatcatttgaataaatatttgatttaaacttataattgaaacttatattcacctttcaattatttccttttattttcaaaataccctttagccactaaacaaccaccgtttggaactttacaccttccatggggacgttcgcacggtctactgaccccgacgtcaaaacgttggttgtaaagtctgacaaaacccaaacctaacgtcaaagtgttgcttctgacaccttacgcctcaatgcgtataacgatcagagcttcactattccctcgacctccactgtacgccacacagtttgctctcaagctctgtgtgatcctagccgctccgccgccactcacggttgttggagtaacacttccacccctctaaacctacacaaacttcctatccctctagccataacattgtctgctgacattggctagacaccaaacctagtcgtcatactacccaattctatgacgactagtaaatacccaaaacccttgccgatgtttatcctacctcgatatcggcttaatcaaatgaaaccctagccagcctgctatccaaactccataccaactatttaccctccaaactacccatagcttaaacatgaaatacgagccgatatgctatttcagcatcgactcgagaacaactaaaccctagccactattccaccaaagcctaatcttgattccctctataacctagcctccaaccccttagagcctacgtataaaatactagctcaataacccattaaggagatatttatacccccaaacctagcctttctcgctcttcatcgttttcttgttattttatggcttttattgaatttggttctctctcttctttaatagagtctattttattctggatggcaacctgtggtatttcgagcatcggataatcaggttgcctatcttggatttatttgtgttggagcaaggcaagttatcattactctcctttgagcataattatcctatactctatagttttattctatgcattagccattcatgattttgaatgcataacttgaacatatagcaaactagatatatgctagattttgcttagccatgcctagttagattgcataaaaatataacaaacttagattgggacaatacttaagatttggttgatttccgggtggctagtactgtctcgatcgatataattgccaccaaatacttatgtcaaatgagtacgactgcagcttctagaatggggatagacctagttattaggttaattaacaatgtggtacctctgtacagtggttcttatatgtaagtcctcgcgaaggaggcaaacttatgccgcgaagggcaaatgtgatatttaccgaggcgcaggtaaatatcttgattatattgcgatcgctgtgtgtgtatattgtgaaaacctaattgagatgacgtggggtctctcaaccagttctctctaaaaacctcgggaacgccagaactcctctcgctgctgataacgttacgttcagagcgcatggggactagagttcatcgaacaggtgccactattgttaataacctaaggctgggctacgactaagctaatgaatattggcaagtcgtggattgcgggtaaagcgtacatttactgcagtaaagtataaatgaatctattcgaatagccgtgctcacggattgagtatcgggactcatatggtatttggttagaaacctaattcaagactttactaaatactgttgcataaagacatcccaggctttcttcctctatattctcagctttctgcaattgaatctagctctactcaaatattaccatttcatacattcattgttgattaatataatagcttgctgagtacgttgtactcacccttgcttcaacctcctttttcagagtccattagatgttcttgccgaagtcaggagttcaatcacataagttaattccctttttacttaatcttcaagtctaggttatttacatggtttaagtctatagtaaaacaacagagttaggtcattctaaaacttctgctgtaatagttagccacaatctcgtaaataccctattactttatgtaataatatcttcttcaaagctatgtctaaacgtatgcaaagacgatccagattgttgaagctgtatcaacttactgatccagggcttgatacagttaaatatgtcggtttccgaattattagttttgggacccaacaatggcgcgatgcgcatggtcagtgtgcgtgacaaataatgtctcatcgttgcgttcgggcatatgatatgagatgtatttgtcttatcgttgcgttcgggcatatgatacgagatgtatttgtactatatccattgcaattttcatgattcttaagattcaacaaaaataactaccaaaatagtcttcttttagcctagatttcttagtgacgaaattgatttcacattctttctaatgattatgctttatgtgcaaatgttttttttccaatttttagggatattgacatatagtcgtttctctagggaaacaatattgtcaataatcgctgtgtgcgattcgaaagatagttcaaatcttttcacagattgaacttgtcttgcatctctcaattttgtattttgtgatgcttcttttcacaatgtttatttcctcttcaacataggctatacaaattgtctatggaaataaagtaaaacatcactatttcataataaggagtaataatttataatataactaagtgtaataatatcaaaaataaattctagccatgcatgacaaatcacggaataaatgttgtactctcatagagcttataaaaccattatttaaagttgttcataatgcaaccaagccaaatcaaaataagcacattatgccctcaaacagaataaataagtgtttagcaccacaaacatttgctcctgcctgacattctcttcacgtgttatgcctgttgcagcggcaaagatgtggagtggagtagtagtggagggagttgccgtggcgatgacgatgacgtgcttggccttcctcttggtctagaatatgtcgatgatgtgctcgggctcctcacagatacggctccagcagccccatgtgccacacctgtagaatgtgtggtcttgctagttgtatggcttgtagtcgtgggatgtcttggcttcatgcatgcacttgccttcctgtgctccctacgcatctggatcattttctgttgtagccgacggcgctccgtggatgcgcatttgaggtgagaaaaacattatatatgccggtttttactattccggcactataacctatagcgccgtatcctttatttgttttttagtagggtttctctcttattctctctctatttttaagctatgctatgtggtagattgagagtgttttaaaaacatcgcacgtcagcttaactgggtattttatattgataatattttttgaacaaagaatcctatatatctatacaattgatccccactaagtatcaatgatgctattttccagccctatggtgaagccacgtcacttcaattaattttagccatcagattagatttgtctgtccgagatttcttctttctccaccatgcacaacctatatggccttttctgtatcccaatgaacattgctgcgagtaggacagcccagcaatttcccaccaggccatttattcctcagtttctctcccctaccaaccgaggaagccgaggagcttcgcgttaggccagtcacaatgggtgtttcatttgagtgtcatgcgcatttaatacagtgacaagtcagcaaaagagcaatatttgcatgaaatgggtaggagagagagtaaactcgtttcaccatggtgacacgagatagcgccgtttcccaggtcactgaaacggggtgaaacagcattgagagttcatcgtttcacctccgggatcccgtgcgagcgctgctcttcgccatcttcgcgcgcatcgccggattcttcccgcgcgagtcccccatcttcccgcgcagcacctccatgttcccgcccccaaagcactggctcgaagcttttttccccaatctcacctgcaaccctagcgccagactcagtccccatcgccccgtccgtcccataccctagcgcaagaaccacgagcggagattgcggagctggatccacaagtaggtggtgaatcctgtccatctgccgccgtccgccgtccagcagccatggatccacaaggaggtggtggatcccgtctgagcgccgccggcagaggagggaataagcgtgggggcaagcagctgggcctgaaaaggtcgtcggcgcctgctccatcaccggcaacagtcagccaccgttgcctgcaagttcccctcctgaagctccatcgccggcaacagttcagccgcctactccatcgtcaagtcctgctgttgctgcccccagttcatcccctgctgtaccgatgtcaaccatgcccccatggccaccgcaaggagcaggatggggctctgtaccccccaattttgcttttctgcaaggaaaccaacaaggcccaagttcatggtattttctccttgtcacagattattcattgtacactatgatacatgatatgactctcttcttcatgcattagtaattagttcctgtttatgctcaatgaaatttgttagaatcagtatgtcagtacattggtaatttgatatatgcctgagtaatgaatagaaaaaatgtagtattcagtatggattgcagtaatactttgttagtgaaaattcagtattcagtatgcagtatggattgcggcttgtataacagaaattgaaagcaaaagattcagtttgcaatctggacagtgtactgtacaacatgtaattcacatacgtaaagcttgttaaatatctccttgtcagtacattggtaacaaatgctttgagtgtaaatgccaagggtatcatcctaacattggtatatatttttagccttctgtatggaatgcagacatggtcttctttgcaaccacagcaacagcttgccctacactctgtgctgtcgtcatagctaaccaaataacctgttagtactgatatatatggtcttctttgcaaccacagcaacagcttgccctacatggtcttctgtatgcttgactaaacttgttacttgacatatatgcttgactgaacttgttgcttgactgaattattccttacacatactgtagtacttgcttgactgaactatgtcaggatcttattaaaaaaaatctatgtcagcactgctactatgtcaggatcatcagtatgatgcttaagtaacctgttagtatgtcagtacttactatgtcaggatcatcttctggaacttactatgtttgattttcttatgctgccatcggttcaattggatttgcttcttatgttttcaggttgtatcctacagaaggcttcgtaaattttctccaacagaactgtctgccgcagccacaagaaggtgaaaattttcaccttgttggtcagactaccaacacaatgtctactccaccaccaacaccccaagctgcagctaacaatacagtccaaattgatattcatgaagatgcaatcaatgatgcaagtgctaaaaagagaagtttgagatattggactcatgatgaggaagagagattggctagtgcttggttgaatgcttctaaagatcccattcatgggaatgaaaagaaaggtgatacgttttggaaagaggttactgatgagttcaacagaaaagggaatgggaagcgtacaagggaaataaatcaattgaaggttcattggtcacgcctcaaatcatcgattggagaattcaatgattactggactaaggtaactcaaatgaatacaagcggatatgacgatgacatgctggagaaggaggcacaacagatgtatgcaaatacatttggaaagccttttgcacttgtgcattggtggaagatactgagaaaagagcccaagtggtgtgcaatgattgagaaggacaaaaacaaggctgaagtggttgatattccagatgaacaaaagcgtcccattggtagagaagcagcacaagccgagcgcaatggaaaacgcaagaaggacagtatgtcagaaggaattgtcatcctaggggacaatattgaaaaaattatcaaagtgacgcaagatcggaagctggagcgtgagaaggtcactgaagcacagattcacatttcaaacgtaaatttgaaggcagcagaacagcaaaaagaagcaaagatgtttgaggtatacaattccctgctcactcaagatacaagtaacatgtctgaagaacagaaggctcgccgagacaaggcattacaaaagctggaggaaaagttatttgctgactaaggttagatatctaatctaatctgagctgcactattatttataataattaaagaatgctgcaatatttagttatattgtctgtatatctgtgctgcactatgcagtcagctgcatatcacgaatttgtcaaatctgagctgcatatctgtgaatggtgcaatatttagttatattaattacccagtgtgaatgatgtattgctgtcagtttcacatatagtatgaatgctgcactatgcagtcagtttcacatgcagtgtgaatgctgcactaggcagtcagtttcacatgcagtgggcgcctatttatgcagagtttagccatctctctactcctctcagaaactcattccctcttttctcatacgaagacctcctcccttttatctttactgtttctctcttcttcaaagatgtctgagcaaaatactgatggaagtcaagttccagtgaacttgttggatgagttcctggctgaggatgagatcatagatgatcttctcactgaagccacggtggtagtacagtccactatagaaggtcttcaaaacgaggcttctgaccatcgacatcatccgaggaagcacatcaagaggccacgagaggaagcacatcagcaactagtgaatgattacttttcagaaaatcctctttacccttccaaaatttttcgtcgaagatttcgtatgtctaggccactttttcttcgcatcgttgaggcattaggccagtggtcagtgtatttcacacaaagggtggatgctgttaatcggaaaggactcagtccactgcaaaagtgtactgcagctattcgccagttggctactggtagtggcgcagatgaactagatgaatatctgaagataggagagactacagcaatggaggcaatgaagaattttgtcaaaggtcttcaagatgtgtttggtgagaggtatcttaggcgccccaccatggaagataccgaacggcttctccaacttggtgagaaacgtggttttcctggaatgtttggcagcattgactgcatgcactggcattgggaaagatgcccagtagcatggaagggtcagttcactcgtggagatcagaaagtgccaaccctgattcttgaggctgtggcatcgcatgatctttggatttggcatgcattttttggagcagcgggttccaacaatgatatcaatgtattgaaccaatctactgtatttatcaaggagctcaaaggacaagctcctagagtccagtacatggtaaatgggaatcaatacaatactgggtattttcttgctgatggaatctaccctgaatgggcagtgtttgttaagtcaatacgactcccaaacactgaaaaggagaaattgtatgcagatatgcaagaaggggcaagaaaagatatcgagagagcctttggtgtattgcagcgaagattttgcatcttaaaacgaccagctcgtctatatgatcgaggtgtactgcgagatgttgttctagcttgcatcatacttcacaatatgatagttgaagatgagaaggaaaccagaattattgaagaagatttagatctaaatgtgcctcctagttcatcaaccgttcaggaacctgagttctctcctgaacagaacacaccatttgatagagttttagaaaaagatatttctatccgagatcgagcggctcataaccgacttaagaaagatttggtggaacacatttggaataagtttggtggtgctgcacatagaactggaaattgagaatcagtaaatgtaattattttatttttcttgtaatttatatatctatggtccacttgtaaatttctgaatgctcatcgccatattttttaatctctgcaggttccaatctatttacaggttccctaaaaaaaaatctatttgcaggttccagtctgttgtcttcacaatgtaagttctgagaatcaaatcactatgtttttctcttttttggtagctacagggtgttagaacatgtgttattttctttactatgcaattgtgatcctccaatatttatctactgcatgtgtaaacctgtttgtcatgtctgaactactttcatttgtacagggtgaaagaatcaatgaaatctatgggtgcatcgtcaatttgcctccagttacctgcttgtcatcgtcatttgtagcttagttctgtcatatttcacctcgagttaacatctattcagttatctaaactttgctatgtagtgaacttggttgaatggtcatttaaatttatcaagtgaacaatcgtacctatctgtgctgaatgcatgtattttgttttgtgttcaagtggctacacacgtttgtgttacatacgatcccactatgtggctggaattaaatgccttgaatttgcattggaaacgctagagtgaaacacactttgagaaggtctgtttcattgtacgtttcaacttgtttcatcttcgtttcagctgatgtggcgtctgggaaacagtgtaatgaaacactgcattgtgaatggccttactaggccgccgctgctagcatctttcccgtcgtttcctctacaatggaatccgagacgacagcctcacctgaaactgttacacacgccttcacttcaacaaactgattgggggcatttatttaccgaagctgcagcggcgcagtaatggccttcagccttcttctcaatctccctcctccctgtcctcctcagcttctccacatgagaagtactaatcattaagttatcctcttctttataaactccctgaaggcggctccattgcatatgccgaaaatctctgtctgtctatctctgaactaatgcaaactggattgcaaattttcatttcactgacaaattttcacgttggaggaatttccattccggtgggcttttcttgctggtgctgcaggcgcctggatggttaaattttcaatgatatttttggtatatgtagaagaaaatgcataatccacgttgtttttctgaagaattgcaccgctcctgtcgtcctcaagcattctgtgtttgtaccttggtatgtgcttcctaccgaggatggatcatatatgcttaaaattcatcctccttgtccaggttttaatgagttctcacacctatttggctattttattagattgattcagttgtccgtgccagattatatgcagattttactgtgcgtctaagttgtttttcacatattgtaggcttaaaggagatgtagacgtcttcgtcactaaagttaatgcttacaaatatattctcttaaatccctaatctgtttttactcagaaggactagctagctactcagtattttttttatttagggttaccattagctgcatatgtaactctgattttgttgagatttactttaccgttcaatattaaaactggaatactgtggagggttccaaagcagccctagctgcaactacaccgatggatataaaaggtttctttgcaaaaccccaggacctgctttcttaatttgtatcacgagcaaaaccgaaacatcaattttcacatgctctgccagtataatgagcgatgtaatggatcgagtgattattcctataataacagtacacagggttcaatatttcagaatggaacttctggaatttcacccctgcaataggatattacggccaaaaatttgagtatttttagttaacgaaaattcattcaactttcaactttttcagccagaaatttccacaatttcgcttctatcagttcccactgaaatatttagattttcaagttgtagattttttattttttttgcaatttcaaacttgcagtacacttggttagttttgcaagcttaatttgactataaaataatttcgattttaaatatgttgaaagatcttaacaaaattttaaatttgttgaaagttcctgttttcgtttaagaagaagagaggtggcctagtttttagggaaaaccgggcccgaaaacctcacaagtgcgtggttaattaagggaaaccggccaaagacccacatgaggaactactgaagttcgaaacaaaagtcatcgttgccaagctcagaggagcagctccgacttcttaagaacaaactacgaactagctaggcgaccacaatgacaacgtagggcagggtcttccaaacgaaacctccaaggaaaagcgtcagagaacacaaacaacgtccgtccaagaatcggaataaagttttcacccgaagaaaaggagagcaagcaacaacgccttcaggaagggaacggcgcccacaggcgtcgacgttatcagccgtagtccaagaccaagcagggctttcacccgtgctcttgctccctgacaaccacgaaaccaaggccgccacaatgcttcacaacccttagacgcttccaaggacgagagaagggggttattgttgccgagcttgccactgcaagaagctccgactccacccccaactcaaccacacggttgcgccacaagagcttcgagcaccacacacctcgctgctgcaaggactttgaaggcgctgacagagtggacggtcttccgatcttcaccaagcagaaccttccaaccaaacccgtgtctctctccttaacatggggcaccccacgactgaagtaggccagtctaagaggtgtagggtctccaatggacgggaggagggaacaacaaccagttgggaggaaccctcgccgtcgaccaggacactgaccacactgctgatcatcgtgtcccacggctttccaacaagcaaaactgcagcaaacgatcggcctctccaagtggcgactccacctaacggcacctgctgcgcctctccggccatcttctttttcagcctctccaccggccacctctactagcaccttctgccggcctcccccaactccactggcctcccccaactccttatggccagcctcctccctccgagcatggaggcgaccagattcggcataggccggattgaccgcctcctccacctgccggctaccagcttctcccaacagccagccaactccaccactgcgcctcctccaactccactcccgtcggccttccccttctggatccaaggtgaaggcagccagatccgaaaccggttgaccgcccctccatatccggccacacccacaccgccacatgccgattccaactcgccgctgcctcttctcaccgcctccaccccgctgctatcgctggagcagctcgccgccgggacgccgcagctgccgctaggacgtcgtccctcatcccctgcgcaggagaggactcgtcgcttcacggctgcctaccccgccgccgccgtccttgctcgccgagccatggctcggccccgcttgctctggcgggggcgaggtggaggatggagggggaaagcggcggtggctagggttttttccgcccgcccagtcgcccgcgatgggagcgacgcaagcaggaaagacaagttttttacaacgcatggggaaagcaatcaatctttataacagtccgcagtaacacatagggaattatctagttttatttatagctaggtttagcagcgaggcctctaaattatagatccggtctggtagggagggggtcaattgatcaatatggctgatgctccgattctctagtgccagtttcatatgaattcgtgtgatactcaagatgaagtgaagtgactgctgaaatagaaagaactcgatccgtccctagaaatcacaggaccatagagataagcacagggaacagtacgtcgagtgcagaactgtcgctgcttttactcgtagatggcttcttttgggctctatcgtatcggcgtatcgccatgacggtgcacacatgtaaaaataaataaataaataaattaaaatcaactaccaaatctaactatataaacgccattaattcggccattataagagcaagtttaatagtacagccaactactagctccaaatcatctatagccaatattataatcaattcatacaatagttgcttactatactattaatatctgatcctacctgtcatacacacagtacgtcttgaagtccgtgctgcagctggctacagatttgtagcccgctgcttatctctctctttctttatctctttaaaatatgtttgtagctggcttatagcctgctattgtacctactctaagcaatatattttctatctccacgctgaacacgagccacggtagagtcactgctcacagcttcactgtatttaaaccccagatgctcacacccatgctaatataacaaacagaccacagaccagagtgaggctagtacatctcatttcaatggcaggtcaggctcccaacatgttggcaccaccgaccgacgacgagctgctgcacgcgcaggccgacctgtggcgccacagcctctacttcgtcacgtccatggcgttccagtgcgccgtcaagctcggcatccccaccgccatccaccgcgctggtggcaccgcctcgctgcccgaccttgtcgccgccctgtccctcccgcccgccaagctcccattcctccgccgcctcatgcggctgctggtccactcgggcgtcttcgccgccgccgacgacaccaccgggtcggccgggacgtaccgcctcaccccgctgtcgtggctcctggtggaaggcgaaggcggggcgcccgtcgtcgacggccacccgtgccaggtgcccgtggtgctcgccgggacgtccaggcacttcgtcgaggcggcgatggggctcgcggagtggttcaggaaggacgtgccggcggccgcgccgccgtcgccgttcgaggaggtgcacggcgcggtgctgttcgacgagagcatggcgagcctccacccggaggtcgacacggtcttcaaccaagctctcgcggcgtacgaccactcgggcttcgccacggttctgagggagtgttccgaggtgttccagggggtgcagtcgctgaccgactgccgcggcggcgatggcgcagcggcgaaggccatcgtcgaggcgttcccacatatcaagtgcaccgtgctggactttccccgggtgattggcaataaacgcggtgatggtgtggtgaactatgtagcgggtgacatgttccgcgccatcccacctgctcaagctgtcatgctcaaggtaatttgtaaaattaatgcaaccgttatctttcacccacaaagaaacttgcacatattgtgagccagctagtgctccctccattccataatataatgcacaactattttttaaaaatgttttgtaatattagacatgcatccatacaattaactaataacttatatccactaaattattatttttaaatcatccaccctcaagatctataattttattgggtgcatgcattatatttattagggtaaaataaactaggatgtgataataaattatttcttgatgtttaggttaagtgtgtttatgccttatattttggaatggagtgagtactatgacctattacttcctcaattttcaaattaattataggcccatgcgttataacggtttttctatttagtttagtgataggattcgcactgggtgagttttttttatatactatggttggttcttttatagaaatacgatttttcacagttacatgagggaagaggtttttatgaggaagtggaggggaggacgattccctctttttaagtatagatatatgactatactgatttctagcatgatgtttgaccactttttttatttaaaaatttagtataaatataaaatataagtcatgcttataaagtacctttaatgagaaaaatcaagaaaatttataaatgatacaattttaaaatgagataaacagtcaaacattattttctaaagtcaacaatgttatacatataataacagaggtagtatattcacgatagacttgagaagtaaacaagtaatagttgaaaaataaaaggttcatcttttgttgctatgtatttcaattttatagttcctgcagaagttgtcaacaaaagtttgcgacttcaccataaagaagaacggttaacgactagaactaaaaaaaagaactgtgtaatgcaaattataagtttgtttaacttttttgtggcttcatctatggtagcttgtgcttcaccactggagtgacgaggattgtgtgaaaatactaactcaatgtaagaaagctattccagcccgcaaagatggagggaaggtgatcatcattgacatagtgattggagctccttctggaccactactggaagcccaactccttatggatgtgggtatgatggtggcgaccaaaggccgacagcgagacgaaaatgactggcgtgatctcttcaagaaagcaggcttcaataactataagattgtgaaaaaattgagagctcgagctgtctttgaggtctatccgtagggtgctcctaaataccatggaggatgtgatctaagtaaataaatgaagggagtgcatactttatgaaataaagttttatatacgtgagcctatgtcaagcttggattgttaatatgtgtaaagcattctgtgttgaatgtttcatgtcagttatgtccagttgctttgtttcgtgtgagttaatatgtccagttgcttacgttaatgtgtaaaacttttgttcatatatctgtggatggatggaatactttcagcatgcaaacatgacaatttgacatcaccttcaaccaacttcgtccaccgaccatcagtatttgggacacaaatttgttcgataacactgtcttcaataaaattataccatgttggaacatatcatatatcattgcttgcttgcttactaacacgatgtaattcaaatggtaaaaaaacaaagctccgatatagtttcaattagtacatttttggtgacattttaccttatgtccgtggttgacggctgaccagaattatcctacttccaatattataagcagaggcggagctagagcgaaatgaagggtggtgccacttgtttaatttactctattttagatcaagtttaagctgatatgagtgcctaagtttgtattgagggggtacatatatacatgctaaaaacttttcttgaccgagttcataggcaccccctaatatacgctagctccgcccctaattataagctgaggtttctgtttgttgaatttaccatacaagattttgcatttatttcctctaatctattcctgtttcaaaattttacttattgtaatcagttcatcaaaacgacttgaaaatttttctagtccggacaaattttaagctttaaattaaatacattgatttagggcatgtttggttgacacgccgaaccccatgcctgagaaaaattgaagcctgaaggtggcctgagaattcatgggttcttcttgatcaggccatcttacgcttatgtgtttggttggaagcctgagcctcataagtcaaaaaatatggtttatgaacgagaaagcatataatactcaataaagaattgcgtttccttaacccatcttatatgaattatacgaagaacagagaggggcaccaagtgagctcgccggcagggaagttcggcctcagaagtaccaacaaccatcaaaatggaataaacagagcaattcgactctaatggtggttgtttgcacttcgtggagcagccgatgatgggcatgcttgtagtatcgaacaccgcaggtcttgtggtagcaataaacgtgtaaagttttgatgaaattagattgtgggttttgattagggatgttttggctgcaaggaattggtgctcggtggccggacttgagaggaagaaggtggtgctcggtagctgaaacccacaattaatgtggggaaaatgcttaggagatagggagcagtgcacacatagaaggaatttttgtttgttttcctgtcggcgacgaattgaaagggttttgcgagcaacttgaagctcattctagtgattttttatctgagtgaaactaacgatgcttgatgttggaatctcctgaaaatgaagatgaaaatagggttggtaataatatgtgactaattaagttttaattattacaaacttaaaaaatggattaatctgatattttaaagcaactttcatatataaatttttcgcacgaaacgcaccgtttagcagtttgaaaaacgtgtcacgagtatccaaaatttatgcttgcagaagaaacgaacagggccgtcacgcctgacgacctgagtcaggtgacgtttttcactcgcctgagtcgtggaggaacccatgatagcaactaaacaacccccaggccttagcctttagtgactacagaagaatttgctttcatttatactttagtcggatatacagtaccaaatatagatagaatatttttatgaggactcgggttagattctaaacttgtatgtcaagaaaataccagggatcctagtcggttacgattgtattttatctgtaatcccatattccgttaggatatggactgtactttgtaatacggatccctttccctatataaggaggggtcagggttcctctcgggacgattcttttttctcccaatcatacaatcaataacacactcggtggaatcatccccggacaggagtagggtattacttcttaaataagaaggcctgaacctgtataaaattccttgtctccaaacccatccactttcctagcttgatagccacccccttttattattgccgaaatcttgtttcgacagttggtgcgccaggtaggggtagcgtcaagttctcgccgactaagtgcgatgggtttcgtttctggcatcgacaacttcgccttccctcccgggcaggcgttccggttcggcagcctcaacttcatcaccaacgacttcggcaagatctctctccttgactcggattcaaaccagtcggggagagaccaggtccccgtgccattcggtattccgaactcggccgaggcctactccaagatcatctctcccgagtcggcttcaaaccactcggacgagatccaatctactcttccgcgaccagatcaagacgacgggttctatccctcaatcctgatgaagcttcctgatgacttggccgccgtcttcaccgccaagacatctcctactcgaagatctaggcgagctccggcttcggccctgatccaatctagatctagagaggttggcgttatactccaacctcttgggacagtctcgacggaagagttggatggttaccttagctcccccggcgtcaattctcgaccaaccgagatcctcgactacgacgacttcggctaccactacgaccacggtgacctcgacaacttcgacgacagctatgaggataactacacgcccctcttcttcggcgtattcatggctgacaacgaaacggaggagcagcgccaagcccgagaagcggaggaagagcgcatacgacaagaaaccgaacatcgccgactggaggaagagcgacagcgacaggagcgagaatgactacagcgcgagcaacaagatcgtgaacggattgcaaaggaggctgaagatcgacagcaacgcgccttggaatccaggcgccgagcgagagagctcattgggcaacaagacgtcgatggaacagtggtctttcgcaccccccagcagaacgcggttgcagcaatcactctcctcgacaccctcctcaaggaagacgcactcaaccaagctgatcatgttgtcaacatcttgaaccagacgaagaccatgatcgctgcctcggttccagccaactccgcaagcacccgcactccgactggtagccaagtccctcacctccgatctcatgattatcatcagccaagcctcagcatcatcggcacaggatctagtcgcaggagcaggggtcacgacgaacgatctgttcactcgcctcccgaacgtcacagggagcgccgagtcgaacggcctcactctccacctcaccagcgtcctgtcgatcttcgcgacacgatcaaccagcgccgtgcagcacgaggtcaccgccattcaacaaatcgctacgacgacgacgtggatggagtagctgccttcactaatgacctgcgtcgagtggattggccagccggctttaagccgactggaatcgagaagtatgacggcaccactaatctggagtcttggctcaccgtctacggactcgcaatccgcgcagcaggaggagacagcaaagccatggcaaactatctacctgtggccctagcggactccgcccgatcctggctccacggactaccccgtggcacgatcggatcatgggcggaacttcgtgatcacttcatcgccaacttataaagcacctttgaacgccccggcacacagtttgatctctacaacgtcgttcagaagtctagagaatcccttcgagattacatccgacgcttctccgaacaacgcaacaagatctccgacatcaccgacgacgtcatcattgccgccttcactaaaggcattcgccacgaggacctagtcagcaagttcggacgtaaaccccccaggatggttaagcagatgttcgaaaaagccaacgagtatgccaaagccgaagatgctattaccgcgtccaaacagtcgggcaccacttggaagccaaagaaggatacatcgaccgcaggagggagtggaagtaacaaccacaaggatcgcaagcgtaagcccgaagaacttgtggcgaccacctctccatcttcccgacaacgttcccgcgtcaacaccttcgacaagataatgaactcccaatgtccgcatcatccaaactccaaccacgtggccaaagattgcttcatctacaaacagttcgcggagcaatacgtcaagaacgcacgtaaaccttcagacggagatcaaggcacatcaaagaagaaagatgatgaagacgatgccccgactggtttccaagatcatcgcaaagaacttaatcacatcttcgacggacccctggcgtatgagtctaagagaaaacagaagctaacagaacgggagatcaatgcggttcagcctaacacgccccaatatcttcggtggtcagaaatagcaattaagttcgaccgctcggatcatcccgaccgagtggtccacccggggcggtaccccctggtactagacccagtggttcgcaatgtcaagctccgacggactctcatcgatagtggcagcgcactcaacatccttttcgctaagaccctggacgatatgcagattcctcgcacggaattaaagccgagtaatgcacccttccacggtgttatcccaggattgttagctacaccactcggccagatcactcttccagttaccttcggcactcgggagaattttcgcacagaaaatgtttgtttcgaagtcgctgatttcgagacagcatatcatgctatacttggacgaccggctttagctaaatttatggccgtcccacactacacctacatgatgatgaagatgcctggtcctcgaggagtcatatcactacggagcgacatcaagcaggccgtcacatgcgacaaagaaagttgcgagatggcccaaacccacgagactactctcgcccgcgaagagatccgactggctgcgaccacggcaagcgagggagaagtgcctacaaccaagctgacgaagaccgaagaaagtgatgccaagaccaaaaagattcccttagatcccttcgatcctgataagactgctgtaataggcgctgagttagattgtaaataggaaagcgcgctcatcacctttcttcagaataataaagacatttttgcgtggaaaccatccgatatgcctggtatccctagagaggtgattgagcactctttacatgttaaggaagacgccaaacccatcaagcaatgactccgccgttttgcataggacaggaaggatgcgatcaaggaggaattaaccaagctgttagcagcaggcttcattaaggaagtccttcatcccgactggctggctaacccagtcctggttcggaaaaagatggggcaatggcgcatgtgtgtcgattataccgacctcaacaaatcttgtcccaaagacccttttgggttacctcgcattgaccaggtggttgactcaacggccggctgcgagttactctgcttcttggactgttactcgggatatcatcaaatccgactaaaagaatccgactgcttgaagacctcgtttattacgccctttggggcctactgctacatcaccatgccctttggattgaagaatgcaggagcaacctatcagcgcatgattcaaagatgtttttcaactcagatcggtcgcaatgttgaagcttatgttgatgatgtagtcgtcaagaccaagcagaaggatgacctgatcgcggatttagaagaaacttttacaagcattcgtgctttcaagatgaaactaaacccggaaaagtacatcttcggagtgccgtcagggaagttgctcggatttatggtatctcaaagaggcatacaggccaacccggagaaagtcaacgccatcctcaacatgaaaccgccaagctcccaaaaagacgtccaaaagctgactggttgcatggcggcactcagccggttcgtctcacgactcagctagcgggggatgcccttcttcaagctgctgaagaagactgacaattttcagtggggacccgaagcacaaaaagcctttaaagacttcaagagacttctcactactccaccagttttggcctcgccgcatccacaagagccgctgctgttatatgtgtcggcgacctcccaggttgtgagcacggtcctggttgttgagcgccatattcaaaaagtccaacgaccaatttattttgtcagcgaggttttaaccgactccaagacaagatatcctcaggttcaaaagttattatatggtgtcttaattaccgttaggaaattatctcactattttcaaagtcacttggttacggtagtcacatcgtttccactcggagatatacttcacaatcgtgaagcaaatggacggattgcgaagtgggccttagagttgatatctttggacatatcattcaagccacgaacttcgatcaagtcacaagctttagctgatttccttgccgagtggaccgagtgccaagaagacatgccagaggaaaagatggatattggattatgcattttgatgggtcgaagaggcttacaggcactggagctggggtcgtcttgatttccccgactggagaaagattgagctacgtattgtggatacatttttctgcgtcccataacgtggcggaatacgaggcgctactccatggattaaggattgcaatctctttaggcattcgccgattaatcgtccgtggagactctcagttggttgttaatcaagtcatgaaagagtggtcatgtctagatgataatatgaccgcttatcgacaagaggtacgcaagttggaaaacaaattcgatggactcgagctcacccatgtcctccaacataacaataaggcggccgacagactggccaattttggttcaaaacgggaagcagctccttcagatgtgttcgtcgaacatctttatgaaccgaccgtgcctagaaaagagatagtcgaagccatggatactcaaggcgtaagcatgattgaagcctactgagagaacctcttgtaaaatttttgaccaaacaagaactccctcaagacaaaaatgaagccgagcggattttcagacgcagcagactttacattattcatgagactgagctgtacaagaaaagtccatcaggaatactgcagcgctgtgtatctttggaggaagggagacaattgttgaaggatatacattctggtatttgtggtaatcatgctgctgcacggaccattgtcggcaaagcttaccggcaaggttttttctggcctacagctgtgtccgatgcggataagattgtgcggaccattgtcggcaaagcttaccggcaaggttttttctggcctacagctgtgtccgatgcagacaagattgtgcggacatgcgaaggttgtcaattttttgccagacaaactcatttgccagcccaagagttgcaaaccattccgttgtcctggccgtttgcggtctgggggcttgacatggtcgacccgtttaaaagggtagtcgacggttacacgcatctctttgtggctatcgacaaattctccaagtggattgaggctaaaccggtcatcacgatcacagcagataaagctagagattttttcatcaacattgtgcatcggtttggagtacctaatcggatcatcactgataatggcactcaattcactggcggagcattcaaagatttttgtgaagacttcggcattaaaatttgttacgcctctgtggcacaccctatgagtaacggacaagtcgagcgcgctaacggcatgatacttcaagggatcaaagcacgagtttttgaccgactacgtcccaatgctggtaagtgggtagatcagctgccgtccgtactttggtctttacgcactactcctagtcgggctaccggccagtcgccgttctttttggtttacagcgcagaagcaatgttgccgagtgaagtggaacttgaatcactacgatttcggaacttcaacgaggagggctatgaagagggccgagtagacgacatcaaccgactagaagaagcccgagaagcagctttaattcaatcgactcgatatttgcaagcgttgcgccgttatcattgtcgaaatgttcgattgcgagcctttttagtcggtgacctggttctgaggaaaattcaaacaacacaagatcggcataaattatctcccttatgggaaggaccgttcataattgctgaagtcactcggccgggttcttatcgactcaagcgcgaagacggtactctcatcaacaattcttggaatattgaacaccttcatcgattttacgcttaggcatttcgtttgtatctttcctctttgactgttaacttcaagttttttccttgaagttttcagtcagggggctactataataataatggagtgtgatttttatcaattcaatttgcttacttgatgtatcattgccctgtttgatttcttggcttagtcaatgaggactgaaagttttttaacaacttttgcgggttttaggctcaacaaggtttgacaaaaacttttaagaaatcaggaactagttaagatatcaagcatagcataaattcatcagtattgtataaattgtgcctccatcatcattaatcatcaaaatcattggtacattaatcagtatcagtcttttcatcatcagaattatcaggaccagtcggtcgaagatcggtgtcctaaaatctctcaactacatcagcagcaatcttgtcagcggctttctgcgcatcactgatgaggtcaagagcaacttcttcgctcgtcccgtctgcaaagccatcaatggcatcaacgtcaaccctcggataaagagatttggtcatcgccaacgccagacttgctcccatacttctagcttctttgatgttcttgaaatatgtatccggagcaactcttagcttgtcgaaaatttcagaagcatcaagtgcgcttggccgttgttattgaagaacatcgcttgaacaattggggcagcagcgttagcaacctcatcccgggatccttcaagtttttttatcttgccaaccaggacgtcgaattgagcttgagatttgatcttgcggtctgcatcaacagattcacattaataagtcagcatatggaggataatggtttttgaggtattgattgttgataccttcaacttcttttaaagccaggtttctttgtcttgccagttctgccttgtcattttccaggatttgaatttgcttctccaactgagatatcttggcagcttgcactacattgattacggttaatcaagattgcaaagataacagtatgagtcaattgagcagagtttgtgcataccttttgatgagccactcagttcaaaatttgattcctggagctcagcgatccgatcccgtagatcatgttcattcttcctggcaagttctttcacttcgtgcagttgattcctggtggcttcgagggttccgagatgagggactaacctctctaaggttgccgttttggcttcgttcctaagatgaatcctctgcaagacagtttaattagcgcatgaattaaatggcaaacgagatgggtgagatcaagtaccagagggcttacatttacaatgcgtgttgcctgacgagtgccttcttc

SEQ ID NO: 5755 - DNA, 2091 bp, Oryza sativa
ctgcatgttgtcatcccaccacttgaccagaatcggagggcatgaatcctcagctgcttgtatacgggggatttcttcttcatcaccaattattggtcctaatgtattcactaacaaaggttagacaattgatcagagttatttgggtcaacatggtttcagacaaagtgtttacctgtaatgatttctggacgaggatgagtggactcagatgcttttaaaggagatccagatctccggtcattgctggcgtcttgtccctgagggttgtctgcttgggtttcgacttctggaatctcttcgtttgcccctgcatccgactggtttccggtcgggggctcctggttagcaccgacttcagcttcggccgactggttcccaatcgggggctcgttgctgggttctacattgtccgttgccggctgattgtcactcggatgatcctcagcagttggtccggtttctttggaagaacttgtgtctacgttagtcgggttagagtctttcccggacggatctatatcagatggtttcctgcaaatttgattatcggtgttattgccgcaatggatgcgcatcaatgcaagagagatcgttatgtgagttgtacctagaagacttcctgatctttggtgcagggcgactgaatgttttcttccttggagtagcctgttttggtagtttcttggttgtctctcggtctccaggcttcctggtggtatcatcggcttcgtcgtcacttagaaccagcttcctctttcgagaatctgactggccgactggatcagaagcacttggttgagtttcggatcgaattcttggtcctccgctcccttgcccagtttggcggcggggagattggcgttgagcaattgggggatccgacttcatcaaagcaaattcctgggtataatatctttcattgttaactgattcaacaaaaagacgatcatattttgaaaaaggttgaagtgtatgaatgcgtaccggtggaggaggattgaatgcattgaacggtacgactggcagcaagtgtgagtagctgacaacgatggcgtttgaaaagatcttatacatcctttccttcatgaccttgaagtcaagagaatctgggtcttcacggtttgggtcatgcttgccgtcgaattcgaaggctgtacgagatctttctttgattggagctaaccgacacttgataaagtgcctggtgatctgttctccttgaaggccctgttctttcagctttatcatcctctccatcagttctactgcttgtgcggcttcatctcccattggcagcgagttccaagtatcctgataaactggaggaagacaggagtactcgggaaggacaggctcggggttttgaacataaaactagtttgcgtgccagcctttatttgaggtcttgaagggcatggagaagtatttttggcttagagttcccctgagttggaaaccagcacccccaacgacgcatggtttgctcttatttggctggggcttgaggaagaagatgcggtggaacaaggcgaaatgaggcctaatgcccagaaaagcttcgcaggcatgaataaaattggcaatatgcactatggagtttgaattcagatgatgcaagctaatcccgtagaagtttagaattccccggaaaaatcttgaggttggaagagaaaatctgccatagaagaaatgagcgaataccacgatctcatgtgtatctggggtcgggaatgcctcaccaaatgccggtcgccacccgatgatctcttttgctggaagaacgacgtgcgccaccatctccttcagattgtcttccgttacatcggagggcgcccactgactttcgaagctttctctttcctctgccatgaatgtgaactggacggtctgatttagttcgagatacggctggaaagggatggggaatcggagcggtggatgcgaggagaaatttcgcgaagtttttgagggtggattggagcggatcgatgaaccctagtttgcccggcgcagttttgcactgtagcagggaatgttgaaaatggcgagagtctcggcggggaagacgaagagccgtttttcacttcg

SEQ ID NO: 5756 - DNA, 10967 bp, Oryza sativa
gctgttaaaatcctttttaacgcgattcaataattctttggaattattatgatgcacattaaaaggtgcccgacagaaaggtgttataccatttttgtaaacctttttaggctacaaaagctattgggttaatttgagatgactggtttattagtagtcattctcctagcatgttatatgcttattttgattgtggtaagggttatagcctaggctaatgaacttattaattaccatgatctttatcatatttggtggatcattttaagagtttcttacttggattcttaccaaatatatctatttttggaccttttgagtgtttatcattcggccctttttatattttttgtccttgatatgttctagttgaggagcagtcggctgggtatcttactaagtaccatgcgtgcttcgctataaaaccactcggttcttgactatatgtttagtttttcacatagtcgggggctacacctaattaggtgcatctactcgatgcaccatgttttattttcgcccttcacagtttctgatttttactactcggcaagctggagcaagttgaattgaagcactcggactactggtttttgtttcgagaaggttatttcgtcaactacgaaggtctcgggggctactgtggagataatggataccccatatctgcatgacagttatattttagtcggatatacagtaccaaatatagatagaatatctttatgaggactcgggttagattctaaacttgtatgtcaagaaaatactcgggatcctagtcggttacgattgtattttatctgtaatcccatattccgttaggatatggactgtactttgtaatacagatcccttcccttatataaggaggggtccgggttcctctcgagacgattcttttttctcccaatcatacaatcaataacacactcggcggaatcatccccggacaggagtagggtattacttcttaaataagaaggcctgaacctgtataaaattccttgtctccaaacccatccacttttctagcttgatagccacccccttttattattgccgaaatcttgtttcgacattgatcatttaaggtaacaaatacaatttcctctacagattactaccatcggagcatccttttccttttggcatatcccttttaacaaaaaaacgttgtgctctaccacactcaaacttatcattttctaaattaatttgcaagaaattgattcttatttcattctaccaatgtctgaagcaaccgtgcaaggtatcaactagtttaagtaatatattgtatttgttgattaacattatgatgagtcgaaaaccgggaaatattcatgctctggacatgggctaaaaggaggtaatggggagaaactagacagagtttgttccaatttaaatttgaaacgaaggctgtgaaataattcaggaagattcctacaaatacatactactataaagtatatcaccttaagcattgtgaaagtaaccttaagtattgtgaaagtggaccataagaatctgacatcaaaaataagcattagccttatggtgtggcaacaagactatagaatgtggaagcgaggaactcctacggtgaggaggttacgtgttgataataatgccacaatcgggcgacaggattacaagagataaatagcttcggtgagagtttgttgtgtacagctaaactacagagattgatcatatcttatctaactaacacaacaaactctatcctcagccatacgggagtattatcaaatgtacatgcaatatatccaaactctaacatagaatataatacttttgtgatgtgttgttcacgctagtacttttggggaattttcattgtgcaaagagtttcacaggaggataagaagtgattttttttatccttcggtgggacccattgggacccagcttattttctcccataggcacagccattgtggatatggacataactaatgcttactatagcgggtcccacatatatggctgatggaaccataagcattggccttgccctaacctattggcacaaaagattttctaaacatattgaaattaccatagtttttcactgagacaataaacaactaaaatgatttctttggtatagcttcagatccaagatcttttaaagtgggtattttacacatgacacatcacatcacatagaacctgaaaatcttaaacatttataatttaacatatgaataaactattttttttattttaaatgaaatctaaaattcttaaacatttataatttaacatacaaccttcaaataatctattatgtaactgtgacgtggaactgtgccaaacaggacctaagcgtgaaaaaagaaaattatgatgggccgaaaagccattgaagaacagcccaataagcccactgatgggaacgtatagctgtccctccgcggtcaatccccatccacagcacgcccctctctccccgacctcgagcatccgccgtcgacgtcatccccacccgccgccgccgccgccttctcaccggagctcggctttcgcccgggagacagacaaaaccgtcctgctgctgctcggctctcgggagcaggcggttcccccaaatctcccacatcctgctcctgctaatggctgcttcttcccccaaatccctaccctaaaaactctgctgctgccgctgcataggccatgggtactgacgccgttcgcaccccctctgcgcgccgcgcagcccgaacccgcagcgcatcgtcgggtggggaaacaccaacggagagctccggccgtaggcgctccaagcaagccgccgtaactggcgagcgcggtggtcggcgccgacccgctgccggcggtgaggtaggtgcctatgctcttctctccggttcgaattctgtgctagtgctaccctttgtgagctttctcaggtattgagctgtgaaatttgagcaaaggccttgtgtgtgcttcgatgtggggggttttggaaccctaatttcaatatatctagtgtttcatctctttctctttttttttctgctacgaggagagtgattaggctacatttgagttagtgatagtgatttgctgttgatttggattctaggaatcatacttgtaggggggcagagatgaagagggtaggaatggatatgtagtggcgcaggttcttcctcctctactacttgtttctgctcgtcctgcaatcttatcgttgtatagaaatggttgcgcatacatgcttgtactgttggctgttgatgtttggacaaggtcaagtgtggctccttcccatggtggtgatgtgtggctgctatatgacataatatggctggtgacttgtaagtgttttgggtattgctagaggaaatattaagctagattaagacacctaacagagcttttatgtaggtaattttgttgtctgtacatgataataactcatggcaaagctagatttatacttcggtgtattctgcttagtttgttgtatgctaaacaaagtgtatgcactgatgtaattttaagtattatacctcaaaatattgttatactcatgtttgtactaattatggatggtgaagatttagtgtattaccacaatttgtataatttagacaatagtatcatgtctaattaattttttgtatataatttgggttaaaaaagttctagcttctaaatttttaaccaagttgccattcttttgtttaaccaatcgcatggatcgaattaagatatacaatttttaattagaatctaattaattgtgggttgtttcagcttctcaaaagccctcgctctggccgccccaagaaccaaccatcaccgccaccgcaggaggaggaagagggaaaccatggaagcgcgcgctatgactgcacttttcaggatgagggaggccatgattttgcaccgccagagcttgtctggggcaaggtgcggagtcacccatggtggccgggccaggtgtttgatgctgcagatgcttccaagcttgcgctgaagcataccagggcaggcgctccccttgtcgcctatttctgggacaagaccttcgcttggagcgatgcctcctcacttctgccattctgcagcaacttcacgcgcctggccagccagagcaccatgtctggttttgtatccgctgtggatgctgcactgcaagaggttggtcgccgtgtagaggtaggcctctcatgcacctgctttggtagtagcattggcaagaggcaagagattgagaattctggcatccgtgaaggggcttatggtgctgttgtagatggtgcgtacatgaggggcgcatatcatggtagaccatttcttgactacatcttagctctgggaatgaatccactggctggtgccgaccgtctcgaacttacaactgccaaagcacagcttagggcattcaattgctcaaggggtagtaggcacctccctgagtttgtgacctttgaggggattgaggatgtttctgtggcgatcccacacaccaagaggaaaaggatggataaaagtggtggggatgatgtgatggacatggagaagaagccaaggcgtggtgagagttcatcacgcaagaaaaaggttttgccggaggctggaaagaaggagattatggatggggaaggttctgtgccaagtataggggcaacagaagatacattaagtaaaacaaagaagtcgaagaaccagaactgtgcagcaaagaagaacagaaacacctcaaaagatgcagatgggcttgatatggatgacaaaggttctgtgccaagtaaaggggcaacagttgatacatcgagacaaataaagaagtcaaagaaccagaacagtgcagtaaataagaataaaaacacctcaaaagatgcagatgggcttgatatggatggcgaaggttctgtgccaagtaaaggggcaacagatgatgcatcgagtaaaacaaagaagtcaaagaaccagaacaattcagcaaagaagaacaaaaacacctcaaaagatgcagatgggcttgatatggatgacaaaggttctgtgccaaggaaaggggcaactgatgatacatcgattaaaacaaagaagtcaaagaacaagaacagatcagcaaagaagaacaaaaacacctcaaaagatgcagatgggcttgaaacagttggtgcaagcaaaaaactgtccaagaaggctgtggatgaaaccttgagtgacagcaaatcagcacgcagaacaagatcaacacgcatgaagggaggcaccccggtagccttgaaaggcaggggaaaggatagtggtgctgaatccttaaaggtggaagagaagaatactgctttgctcaaggagaataaggtggggcgtagagctggctctgcacgcaagaagtataaaaccacaggggatggggacggacttgaagatggcaatgccaatgtttctgtttcttctggcaagaggtcaacgcgtggtgaaacctcggtagcttcagaagcgcgaatctcagagcagggtaggaagaagaagaaactttctgaacttatggcagtgacagatgtgcctaatccttcttctggtggtaaaagcaaggctcgaggcaagcgttctatggatgcatcaactgagaaacttgaggatcctgatcgtgatttggaggatacaatgaagactaggaaaagaaagaaacttgacacattgggggatttgtcttcccagccacagcctgtctcccgcaagagcactacaaaggttggagaattgatgcacaaagctgctggacaaatgtcacagacacgacccgttcgcaaagctaatggcgcagtatctcagaagaattctcgtagcactaaagaaagacaagtaaatgctccagacaagtctgcacattctctgaaggtgaaaaagggcaagactgataccttgacagaaaattccctgtcttgttctgaaatgctgtcacagctctccctagcagtatttaatcttaagaaaaaggagagattttccagtgcaggcatgaacttctttactgatttcaggaagtactcgtatgcttctaggtctgatgttgagaaggagatatatgggaaggcaactaacactggatcctgtgcttcattttctgatgttgatgaggatattcctgagaaagctgccggcactgagcccactcctttggaacagcccttggctgatcatatgcaggatgattattgggctgacattctgattaatgtggaggaaccactgtctagtctcagaaaaaagaaagataagggtgtgaacagaacaagaaagaaggaacatgttaaaaaacctgccatgaaatcatcatcactgggaaatatagagggaccaactgttgaaggttcagagaacaagcaaccgaatgcagaaacacaactgagtgttgcaaatggaactaaagtaagttctgaagaaacggaaagttcctcatttgctggactagtgctgcacttcagcaggccaggtgctgttccgtcacgcagtgaccttatcaaaatctttagccaatatggacccgtcaatgaagccaaggcagagactgcaaacaatgctaactgcgctcaggtgatcttcaagaggcgcatggatgctgaggcagcatttgcaggcgcagggaaaatcggtgctcttggaccagctcttgttagctttcgcctctccgacttcccagccgctgcctcaggaaatgatcctcggcagggtgcatcgaagagtgactagagagtgtttacccacctgttgaacctgttgatactcggtgaggtaaattcgatgtatttcttcctgtatcactgccttccattgacataacaatgcggtcaccttttgctgtattgttcaaatattaagtgagtagcattcttgttttcgcaggtgaaggagctgagttagtcagaaaaatgtctgttaggtggtagattgttacaggattaagcattcatagaacaaaaggttgtgcatttgtcatgtaaacatgtgattgttaagctgtccgcaggtcagatcagtgaccaataaaataggctggctctgtaagaacatgttgtaagctgatctatacctaaaaagttgagcttaatttgtcaatgtgagtagcgatactgatatgcgtctggaagctatttgttgtgccctcgcggaacaggaataggtgggctactgatgaaggtactagatgaataagcgcggcttcaagccacgcccgtcaatgtgtacatagagttagttgaaagtaactaaatgagaaataccagtatataatcaagtatgtgattcagttagcatcacaaagggagagagtatacatttttagtaacaatagtaaggataattggttgtttgttacaaagacaatagtcagttaaacaagctttgccacataactacacatataaggatgccatcaacatgtaactgcaatcatcagccaactggaatgccataagaagcaaggtccaatattgctcaaattgccacatcacaccaacatttttatacatctgtatgaacaatgcaccgagtaacatgaacttgatttctttgtactgtaataaaaccaatatatatataatggattggtaaatgccacgctcaagaacaaaatcaataatttgccaaaaatgccttgatgctcttttcattcccttctggatggatgcaatctcgtggacaggacaggtgtaacaatctgatgcagaacctacttttgagatttcgaataaacatgatcacagaaattgatgtaactgcaaagggaagcaaagcatgatgatatatatagtgtgtcatggtttacctgatatatgaacgtaagaaagaagatacacacaggtaaaacatatgacaatagcaatggcaacagagactactacattgccagccaatttggtaggccaccagggttcctgcaaatttaaggtacacatcagtttggttgatttaaattaattgatatggtgccttataaaatctattagcagttaagttacaaagtatttttagtcctatcacaaaaacagcatatcttaaaacagagaaccctcttggaggtcgcaagctcaatatatgtatctatcaatgcgtacaatactcccaattacaacatcaaccatgcaaataaccaaaccagcatatgacacaactggtgcagccaatgccaaaatcaatgtaataaccttaagctgtttaggtgaacgagcatgagatagtgttgcttccataagaccatctgaaaagaaataacagatgtgaataatgaaggtaaatattaatccatcacctttatcgtaattagtgatctactgggcttactttatcaacagtggctcatatacagtaataactacatcagttgctgcattcttgaggcgtatattggccaagtaaagttgcaagaggtaatccaagaactcagtttgaagaaccaagatttcataattttcctgctgtacatactaacgaaggaatagatatgcactcactcgaacaatgttctgtgcttctatgctttgccttccttttgagatagcctacaaaaatgaagaaaattaagcacaagattttgcactttcctggtcaattcaccatccagtgttcattatacagcatatccaagctatcaagtatcaatgtgcatcaatgaactgaactaccagagttaatgaaatcatgatacacagtagtttgataattttgcacaaatcataatgtttcatggatctatatctatatatgttatggaggactcttgatcattattttttcccaaactttattttccacctagacacctgcaataatacttatctagaaagagaaggatgtagaacctaacatatacctccaacattatgatctaaggggtcatcaattatatgtggtgaacatgatcgcagttgaccccaactaaactacagtaggatcagcaacattagcaccacttacatgtaacaagtcacaaatgaaacatgaaacagaatagcactaaagacgtagcccactcgataaccatgaaaaaagaactcctgacgaacaccatccaaaatttatagaactacagttgagattttggcaccaaaaaatcagagtacatgcacctaacaattcagtccatcctaaaaaaaattcaacaccctatttgaaatttaaagccaactcatccgccaaatctagaacctctcccttggaaacccctagttctcacagaatcaaacatctcaacctctcccaagagaggaacccccaattatcacacaatctaatatctcagcttcaccccggtctagatttgattaaaagcaccagctcactcagatacaataaataaaaacacaagggcagaaaactcgccttgatgacctcaatggcatactcgacctggaacagacgcccgtccagtgagaaaatggttaacccgcggtcttactccatcctgcacccatccaccaggaaaatcccaataaaatcagccccgccatcgccccaacgcggccatagatcgaattcgagttcctgcaacagaattgaagcatacctcatgagaaacatcaagtgggagctaaggattcccccggtggcatcagttccacgcgccacccgcccgacaccgccgcgagcggagggagaagggggggggacaccggcgccggctccgacgccgccacctgacccaacgtcgccaccagagaagggaaaggtaaagtttttggtacagtatctgtggtcagtatcctcatgctgtcagatattcagacattttgagtccaaacggaactaaatggagtactggtacctacctccttgagaacattctcatggctcgctctgctgatcagtgagaatgctagcacaaatatatccgctcctctgtagctcagaatcctcagcctgctgtaatcctcttgtcctggatgaatcaaacaaaagaacacacgatgttcagagattggacagttgcatgagtaaaaaggaaaaataaaatctcagtagaagagagtagaacaatggaagaatcagttttaccagcagtgccccataatcccaagttgatgatgttcccatccactgaaacattagcactgaaattgtcgaacacggtggggatgtaatccagcatagccaagaaacagcatcacaaacgctaccaagaaatgcgcgcgggcacacacacacatggtctaaggcaaagggtgaggggatcgagatgattgggaagatacacaaaacgaggtaagccattagcgcatgattaattgagtattaactattttaaatttcaaaaatggactaatatgaatttttaaagcaactttcatatagaaattttttacaaaaaatacaccgtttaatagtttgggaagcgtgcgtgcggaaaacgagtgacaatctccccaatctcctttgaaagaaggcagcctaaatctgatgcgctgcacactcgtggagggctcgatgctgagccagtccctcgtcctctcgcaagtgggggaggatacttttgggggcggcggaatggtcgagacaggtgaaatcgtcgccgacggctggcccggtgccggggttggaggagacaatcgtcattttcgtcgcagctgccgtcagcatcattgccgtcgtcgcagccaccgtcgccgtcgtcgttgtcgtagctgccgcagccgtggccgctcgctcccgcccgcctaagcccgccgccgccgctcccgagggcggaggcggccaatccgcgcgctgccggcgctcccgctcccgccaggccgttcccgaggacagagaacactggatccgcgaggagaaggagaagggggaggggcgcaccgacgccgacgcacacgtgacgtcccgtgcaagggcggcaggcgatgaaggcgaagatggtgccgcacctgtcggcctccgccgctccgtcgccagcgcctatcgcggtatcttcctccgcc

SEQ ID NO: 5757 - DNA, 10443 bp, Oryza sativa
atccacctccgcctacaccggatctgggaggagggagggaaccccccgttggctccaccctccgcgcagccaccgccttgagccgcctctgccaccgtcagtagccgccgctgccgccgccaccgccctccggcggcagctctggccggaacccgcgccgagagaggagaggtgggaggggaggagagggagagaatgggggaagggtttcgggattggggggttagtgtaggacgttttgtagaaaaccccctatggtttttatgtttacagcgctacccctagaagcggaattttctcttcttcgcattgtattttcctagaagacgaggggttatacgcaagaaatacaacgggatgtcaggcggtccgaggacgtatacgatattccgtgcaaacacaaggagttttttacaaaaatgcccagccctctcacctggagcagccctccaccccaacccgtatgcacaccaccacagcgcccaaattttaattaaccggcgcacctcttatgggcggttgcccctgcgcgcgcaaggagcaggagaagtagcagccacgtgtaaaacaatgagatagcccaaaaataattaaaaaaatgagaaaaacggtggggttaggagagttattgattgatgatatgcgtcttgaatagagggttcactcacttctggaactcttggatcattatggatttttggccttatggggaatggatgtgcatgacactgcggctttattccagaaatatgcaaatatgcaatgcagggtggcgcagctctagcttgctttgctaattgctcttaatatttgtgttgtagcgtgtattacttactagtatttttttttctttttttactctagtaaaggccgttgggtctgcaggattaaaaccaggattaagggcccctttgatttgtaggaaaaatgtagaaattttagaggatttcaatctataggaaaaaaatcctatgaaggctccaatcctttaaaattcctatggaatgggtaatcctatgcacattttggaggaaaattagcaagaggtctaacctcttggaacatttcttctgtgtctatctctctcatctaattcctgcgtttttcctgtggtccaatcaaacggccatttctgtgttttgcaatcctctgttttacaattatattcttgtcagtatcctgtgtttttcatatttctctgtttttttattcctacgattcaaagggccctaaagcagggtccagctatgagctgcaaacaagccacggtacgatagtacagtactgctaacaaacaagccttatacgtctctgtatccaaaatttacaaagatattggccctaccaaccattatagatcgacaggagcacctaaacagaactaagtcgtgcaactttataatcaacatattggcagtgagtaaaatactaaatctatcgtttgaatgttatcaatttcaagtatggcaacaaataacaatcctacaatgacaaagcccaggctgcattggccacgtagtgaggccttgcatctggggccctgctgtcagagacagcaacacagcgagtagcagaatcagacatgatgtgacctctgtgtatcataacggtactatcattataagtatactaacatgtgagataatataagggtggaacccatacactagttgctataatcatagggacattatgatagagaattcttacctgtgatatttatctgcaaaatggatgacatcggtaaaaatatcatgagatcctaccacccactgtgacgtactatgttgtcatttatgtatttcagtttaagatttgcaatttcacgtatgatagatttttgcacttctatctttcgatttttcatccatatgaagctgcattaagattcatgtttccatatccaacttttagttacacccaattatagaacacttatatttggttatggagcacttagttacaatgaatttccactcagttgcagagcacgaaattaaattttataactgtttttgtctctagatttacaatttttgacctgttcctttttttcttatttcattcaaaactagttgtatccattagttgaaaattctgtagatttgaagctttaaatttatcgaacaattaataggtaatcccgtataaataagattatcgcacgcaatgatgtagtagtattgtgcttgcacgaagaagttttgatcctcccgcagtactagaggatccatacaatgagaaattggtacaccgccaacagggtgaagtttcatcagtaataatcaaaacacttttatgtctacccactcccctagcttgcatcccaaccctcattggagagtctacatatagtaatgcaagtagaaaattaattaagtagagtcaattctcaattctttacagcagtgatggtgtcatggccaattattttatttccaggcaagagacgttagttccatgaccagaaacaatactttccctcatagaacatatcctatgcatacaagttttttatatgcactccgtacaaaccaattaacaaatatcacgaaaaattctcgaaagagaatctgacatgtatttttaatagtattacaaagtcttatatgcaaattcattatattttagccttaaaaaagtgagagatctgacagttttcagagtaaaaatctgtcagaattttgtcttttctacaagtaaaatataataaatttgaagatgagatttcatagataatgaatttgcctattgaaaagtccaatcttttttagaatttttcgtgatatttgctgattggtatgcatagagtatgtatggaaaccttgtgtgtataggatatgttccctacttctaattgttaagtagatggtcgttgtcattgattcttatgcttgtatttgactattcatcttattttcaaagaaaattataattataattatttttatttggttttgtcattaataaagataatttagaaccacttttatttttatatttgcataaaaattataatatgataaatgataagtatatcctaaagccaatagcgtcccctattaaaaaccgaaaggattactatttataaccctcgtaatcgcgccagagtcagacagacgatcgataggaagtaatgcaatcatttccatcgttcaagctcagagaagaagtcgagcagacagaaatggcagcatccgatcaggctccaagcatgttggtcccgaccgacgacgagatgctgcaaacgcaggccgagctgtggcgccacaccctctcctacctcacctccatgactctccgggtgcgccgtccacctcggcatccccaccgccatccaccgccacggcggcgccgcctcgctgcccgacctcgtcaccgcgctgtccctccccacggccaagctccccttcctccgccgcctcatgcggctgctggtccactccggcatcttcgcctccgacgatgcagggacgacgtaccgtctcaccccggtctccttcttcctcgtggacggcgccgccgccgccgtgcccgtcgtcgacggccacctcagccaggtgccccacgtgctcgcctcgacgtcgaggcactgcctcgacaccgtggcggggctcgccggctggttcagggaggacttcccggctccgtcgccgccgtcgccgttcgagcacgtccacggcgtgacacctctcgagagcacagcgaggcttggcccggaggatgcggcgctgttccaggaaggcctgagggtgtacgacgcctccgggttcgccgtggttctccgggagtgccgcgacgtgttcgacggcgtcgagtcgctgaccgactgcggcggcggcgacggcacggcggcgagggccatcgccgaggccttcccgcacgtcaagtgctggacctcgcccgtgtggtcggcgacgtcccggccgacggtgttgttgagtacgtggcaggtgacatgttcgacttcatcccaccgagtcaagcaaggtaattaattaattaattaacaacatgagtgagtaattcgtaatccattttgtatatatatcttacacgaaaagaaacctgcactagttctgaatcggtgaaacctttaatttaatctgaacacatgaaagtttttaatataacttgaggcgaacgcgtgcttcgcacgctgcaccagtggtgccatttaggagaatcagtgattacataagttgaggtaggcagttgaaacaatgttctttgtaagttcaatgaaggacatgtataagtataactaaatgatgtatacagattgaggacagtaaatacataacaaaacttgccatgtgtacgatgacaggatatacagtacatagtagctttatagcagtagcattgcaacagttctgctagatgagcacatacgactatattacagatggctaaattctaatgtggtttggatgcctttgcagtaattgacctttttccccatgaattcagaggattgcattgctggtttactgcaagggccttcttgttgatgtgtaaatagaaggcacattttttggtacgatgaattgcttccacttatgcatagttgctcgagaagtgctgcaaaaatacaattttagtgtcaatattgagagccaataatgttgtggcgttgaactactcaacaatattagtcgtcccctcctaattttctttttctgaatgtgaataaaataagttaatggagttatttttgtggcgtatgtttaaattgtaaggatgaatgcagtagtggtgtaatctgtgaatgaattaaccgaaggagcaccagcaggtactgtaccaatcttagaccaatgtgaggaaatcaatcaaacatctcaatgacagggaaacacaaaaaggattgccaaaaccgaagtaatgatttatccatactaaaaacacaacaaacatgtaaacaatctaaattgttctcttagtatttttctcataatcatgaaagtgaaccaaataatttatccaacaacatatttatgcagcaaataaagttgaaatggacaggattgtaaatgtcaatctatcgttaaactattggtgttgtgcatcttttacatagattataggtatgtgattttaacacttaattcattgcaagcacaatatttttgtgagcagatactatcagtatgtttaaaggaatatgatgaaactacaaggtacaagctagtcataatttggttacaacctgcaggacaacactcaacatcaactgaagcttcatggtaacaccgcaagttggttgcctattgttgagcacctaaaatgatgatgagcagaaacaaaccaactgtgcttccaccaattcctacagctataaaaaaagtaaattactcatcaaaagatcacaacatttagtatgtgtcgaaatcgaccagcacagtattgcacagccaatagtttaacaactgcagtgttaatatgtcacttacttaaaagcaaagctgccctgctgaaagcttagaatgagaaaagaggctcagcaacagcagcaagagaatattgtaaaaaagtttatatataagcaaaggcctaatcaaagtgcaaaattagcccatttggaaatgggctgaacaaataacttgtactatataaaataaagagtaaagtccatcaccggtccctaaacttgtaccgctatgtcatcctggtccctaaactcgcaaatcgatcgttcaggtcctcaaacttgttcgactgtgtcatcccagtccctaaacttgcagatcacttgtttaggtcctccaacttgctcagttgtgtcaccccggtcctaaaactgggatttaatatcatttgggtcaaataggcgggttaaaagactttatatttaaaaataattcataaccttttcacgtgaactctaatgaagataaactttatatcaaacttgtagtcctcgacacgatctacaactttgtagttgaattttttttattttaagtcattttttgtcccaaaatgtaattttaaaattaaaatttcaaaatctataaacatgcaacaatattttgggaccataaacagttttaattcaaaaacttttcaactacaaagttgtaggtcgcatcgagggctacaattttgatataaagtttgtcttcattagagttcacatgaaaaagttatgaatattttttgatataaagtttttagaccgcctatttagggaccggggtgacacaactgaacaagttggaggacctaaacgagtgatctgcaagtttaggtaccgggatgacagtcaaactagtttgaggacctgagcggttgatttgcgagtttagggaccgggatgacacagcggtacaagtttagggaccggtgatggactttactctaaaataaatgtgtagtttgtttcaaaagaggaaaaaatgtctcgcaaggaaccgtgccactgtcctagtcatcatataaactacatcatgctattatttcaacttaacttgtagaaaagcaaggataggtaagcaaagcttttgctttaaggtcacaacgggcagattgattaactgcatacttgttttaccagagagaaccaacagctaataatagaggttatatcttaaaaacttcatatagctagcttgtcttaaaaataattactaacttttcctcaaaattaagagatagtgtacagaaattgtgcaaccatgtaggattcaaacgccaaatacaaagtactttacaaaccttcgaatgatattttcaattttaccttgaattaagggaggccgaggtaaaaaatagtactcaatagtttgggggggggggggggaacataggttccagatgaagggctataaatcttttgcagattgccattgttcccttttcttcaggctgctctttgtcctaagatgcaatacaacaaacatgtggagtgcagggtaagtgatagggaaatgatttactgccaagagaagggagaagagtgcataactgtcaggctagcaacagattttattacaaatagactctacaaccccatcaataaacactccatatattaacgggcatatttaagaaaaaagaacattggaaaatccatttgttgttttaaatttcctgatgtctacaaatatgggttctcatcctttgctgaccaaaagcacattagtccatgacagatttagagccaaaccacttccaagaacattttaggtgggcgtatttgcaattgaatgaacacaaccctatagtgttttgttcttatgcattcacaaataaaattttggtcaaatttatacaatgaagcaagcatgaagaaagcaacaagaggaaagcacatgcaccttgtcaattgtggaggccttcttggatttgaaggtggacgtgcaagtgtggaggcacaacgtgaaaccaaccgctggtccatgatttgctggaagtaccgctgcggtggatagaggcagctctgccctgaactccctctccttttttactcttccacagctgctgccaaggaagcaattccacaaacacatagctggtaccaatgaaaatattgttcagcaaaggatgaaaatagatagactacctaggaaattattgaacagtttcaaatatcacactacatgatgagctaacaaaatagtaataatcagtcatcaccaggtttagccaaaagaaatttagctgtgaacttctgttccaattacttttctatatttccatgcaaatttagaaggaattgtattaattgcaccaaaaacagtcaatgatctgaaatcatgaaggatctaaacatatacaaagcaaacctgaagagatttttttatcaagagtgcagcatcattttttttttctagatggaagggtccgattaaatttttaaatggaagtgcagtatcacatttggaagagtggcaaacatgattagtgcctctgccaacttcaagaatcagatttaacaccgctaaatactttgcatcaaacatacgcagctggaccactcgtcggctggccctgcatgcacctctgcaattgtactgttagatgaactcaccatccattcccaggaccagagtgggcagctataccaccatgttgatgtggagtgaaaacatttagatcaaactgacagacaacagttaggtgctaatgcatctaagaactattttagccccaacttaattgcttcaaaaaattagtcactcactgtattattcgaacataaaagatttacccaaaacactaaaaccagaacttcagtcctatctttcaactgtattaccagcatagaacaaataaaatgtagtatgtacactgctagtaaatggataagaggagcactttagatcaaactgacaggcaacagttaggtgctaatgcatctaagaactattttagccccaacttaattgcttcaaaaaatgagttactcaccgtttagtcaaacataaaagattgacacaaaacgctaaaaccatatcttcagtcctatatttcaactgtattaccagcatagaatgaataaaatgtagcatgtacactgctagtaaatggataagaggagcactaaaaccagaacttcagtcctatatttgaactgtattacaagcacagaatgaataaaatgtagtatgtacactgctagtaaatgaattagatcttaaacggtgtaatctaagatctaaccaaaaaggacaagatatttattaaacaaaagtgaacaattaaactaagtattcaagtttggaatagagaaattcaagtgaaggagaagttctccatttttgcggcctacaacaaaatgataggacagatggccacaaagtaaaaaaaacactcaatatgttcagattatgaaaaagtacatacagtctgagtatttggaaccaaaaatctattggatgttccgttttgatagcacggacttacccctctaaatttacagcacatcatgcccaagcatctgtaatatatgtcataaatattaaacatcactttgatggagaccgaactttgaattctgcacaagaaaggatgaaatgcatctaagcttgctgttatgggaaaaaagcatataaattttgaagccagctatcctaagggaaaaactaatgcgagttctcataagcatatactgtcaattaaggtatgttcttctatttaactaaagcgtggagatgtatagttctcgtaagtactcagtagaaaaagattgttttactaaaatgaccaaggttatattttctttgttagatcaaagaagataaaaagcaagagattgcgaacatatgacaaattagctaccacatcgatggagttgttaagcaaagcaatcagcataccatgtaatggatgagcagagcatcacactgaggaaaagagcatttgcatggcaaaccaccacaaatcagagcacacatgggaaatataaagcaaaaacattatgatgtacctgattaacattttgatagcaaaataaggagtgttatgcataatactttcaccaccacaacagcattgattgtccagcaggcctccctggatatccatattatgatgatgcacttgtttgatgcagcaagagtcgctactatatgtcaaagccagcacagctttacctacttctcccaatcaggtcatcgctaattgcaacaaagagagaaaagcacactggctagaattccatacactgaaagatccagcataataggtggtctcagatactcagacactgaaagatatgatataatatgtggtttcagatattgggatcctgtaatctgacaacatagtgtaaaaatgaaaaatttttaatgctggataggttcaatcgatgcaacttaaagtcagtacatggtatacataagttacaaacaacaacagagtaagcagtaggcggtagagggatggaggaaaaagtacctgcagagatcaatagtaggtggtgcatagggacgagcgggcctgtattttagagatgtccaagaagtagttgtactcaaccttgtccataatccctagatccatcatgtcccatccacaaagagacaaccaccatatcctggcaagcagacaacaaccggatgaaccaaaataatcaatcaagatagatcaagctgcaaacggaccgtggccaatgccgcgatctcggcatcttcgcttatcttcgcctcgcgcagccgcacatgggatgggatggaccggcagtgaagggggttgcacgagttccccaccagctctagatcatattcaacttccccacccagctatggatctggatcacggtgagagggagagtgagaataaagaagagggtgggagagcagagcctttccctgtggagtgcgctgccatggatagacgaccgtcgtcgatgttgccgatgtgcctcccgtgatagccctcgcctccgagagaccgaatacgccggcagggaggtcatgtgtgacggatccggcgggc

SEQ ID NO: 5758 - DNA, 3446 bp, Oryza sativa
tgaggagaaaatggggcgcaggggcgagaggagagtgtgagacgccccagagtggggtaggagggaagaagaaaatgagggagcaaagtctttccccatggagctcgctgctatggaaaaaggaccaccatcgacactaccgatgaccctcttatactaaccaccaccctttgggggggctaaaccccccgcggggaaggtctggattccggaatcggggggcaagggcttccctacaccggaaccggccccccggtggcgagagggaggtgcgaaagagtatgccgcggcgtggcgtaagggggtgaggagggcgtgaggaggaggaggcagcggcgtcggtgttggctagggaggagcgaatggtggcggctagggtttcggaggaggggttggtagggataaaagtttttgctaaatagcccattagtttccatgtttccgagcgcagtcctattttccaaattttctcttctttggattgaatattcaatattttggaggtcttaaatgcaataattttaaacaaaaaaacttttgattagcatctatcacgaaatatcaccaaacgcgagggcttatctgcaaatttttcaaagacgacgcggaggcacgagggctcgcgaaattccaccgttttcccgcgcgcgctaacgtgtcgcgacgcggcagcgtccacgccagcgcaaaacgctgagggaagagcagatcggggctggtttggttcgaagactttagattaaggtttgacttttctcacatatttatgtaatatgtaatatatatgttttctgattgattttatattaagattaagacttacataaatttatctgtgctagcttattcaaattattttaataagacaaataaccgaatgttaaataaaaatcaacatcatcatatatttataaaagggagcactatttttttttgtgttgttgacttgcacaattttatccatggttaggttaggttgcaccattggagcgacgaggactgcataaagatcctagcccaatgcaagaaagcggttccgctccaagaagagagagggaaagtgataatcatcgacatagtagtcggttctgattcagggccaatgctggaatcccaactccttatggatgtggccgtgatgttggtgaccaaaagccgacagcgggacgagaatgattggcgagatctcttcatgaaagtaggcttcagggactacaagattgtgaagaaattgggacctcggtgtgtcattgaggtctatccgtagaagtggcccttggatacatatatgatatatatgcgtctgtggtttcccttctttgttcatggtgtgatcaaagcgatgaataaacaaatttggtccttcattattttctgtgatgaagtttcatgtaagatctgaaatagcgagatgagatgtgtcaagcttggcgtcctagatctgtaaaactttcttttggagatcagatcaatggaaataggtgtatcagtttcaaaaaatggaaataggtggtgtatcatggaacaagtttaaaaaaataaaacatttcgtcataggttaatatcaatttcccctaggcgttcatatatttcacactagtgaaaagtttccaaaatattttcctcatacacaaaagtgtgaactatgcgagcttggggtagaatatatatacacaaaaagaacgattctgaaatgcgtcagtattactctacgcatttagtgactacccctcgctatcaccaaaagtcagagggctgtcataaacaattttggtgacagcataccatcacaaaatactgtcacccatgattttacaaaagtggactttgaacaatgatttttttttattttttttttaaataagacatgtcaaagtaaagtacagttaatgttcgtttctcaactaactccaataaaattgcgtgaagtttttttaagtgtctacggtacacccctaattgcaacacaattagcacaaagtcaataacagaataaacagacatatgcatacccactatacatgcaattatgtgtacttctaggattgacggataccagctcaagtctaaagatttgaggtccggtgggttgggcgaaaaggacactgtcaaatctatgattttaagatttaaacgctaacagattggatacacaaccaaaatagctatctggctacatagtaccttccatcaattattgcatttcaacatgatgcatccatatccatacttgaatagtttgcaatcacttgttccgatcctttaataggtggactttgaaacaggtaaatattcaatggatccaatggttgatagattgttactattattagtcgtccctctttttcaaactgcaattgcctagtgagtttttaaatccatgtatagaactagtcaaaggaaaggcatgccttccaaataataaagggagaataggagctgattttcttaggattactcccttggtcctaaaatataggatttcagagtactatttctcacatctaaacatctcttatttaattttcactcaatattacccaaccatcctcctactccccacatacccacatcatagtcttttccctgtgaacttaatctctaaaaaattcctaggatcacttcatattttgtatggagggagtacgtggccctatttagttcgggaaaagaaaatttttttgttgtcacattaaatgtttgaccggatgtcggaagggcttttcggacacgaatgaaaaaactaatttcataacttacatggaaaccgcgagacgaatcttttgagcctaattaatctgtcattagcatatgtttgttactgtagcacttatggataatcatggactaattagactcaaaagattcgtttcgtgattcccccctaactgtgcaattagtttttttatttatctatatttaatgcttcatacatgtgtccaaagatttgatgtgatgtttttgggaaaaatatcaggggaacaaaacggagaaggaactaggagcatatgtcaaatcctactaacataggagtactacaatagcagaggtaccatgcataaaagcaccgtcactactacgtaacttattttcccgggcgggcatatctatttttccgtgcggtcatttggcccgcctgcacaccgctgtctgtgaaaatcattattttcgcgtgcgggcatactataccacccgcacggaataaaaaaaccaaaaggaaaaaagaaaaagaaaaatcgccgcccgcccgcctgccggcaagcgaaccagccgccgcccctcaccgccgcgggggacggccgccgccgccggatctgggcgggggacggccgccgctgctggatccgagcgcgtgggggccggttgccgttggccatcgccgccgcgcccgctcgctgccgccgcctcgccacgcccgcctggtcgtcgcctcgcgaaagtaggaa

SEQ ID NO: 5759 - DNA, 28590 bp, Oryza sativa
atattgttttataaactataagagagatatgtaaattttgtacaaatgttaccatcacttcgtcggatgaagaaatgaccaaaatagaagtatagatcttcatgagttatacaacgttgttatgtatgactttttcagctgaaatcatttagtatttgaaaatgttttttaaagttttgaaattcaaatttttaattgataaaataaagtcacaaaaaaatggccaaaataatagcagtaagaacataataacatgataaagcatgattttagaaacatttaggaaaaagaataatccaatttggagttcatatgagtgagatacactagttttaaatttttcaaatttatttttgcatacggctccttaagactcccgtatggaaaaatcgatttttccatacgggcgcttaagtgagccgcatgcaacctcttaagaggcttgtatgggaaaatcgattttttcatacaggcgtattaagcagccgtctgcgaaaatgccgctcgatttttgcatacgccactagttatggtccgtttgcaaaaatgaagaggtcttgtacagaaaaatcacttttgtagtagtgattgattttgtctaaatcttatagacccttgtccagcactgcccgcactcgtgtggggagaccatacaacctgatgaatccctcagcgtttttgcctggttatatatctttccattctcgaacgaggaaatgtcctccccgtacaggatgtaggggctcttccgggatgcaatgtttactgaacccttgtacaacttgagggtaaccgaaccagttgttgtctcggtaaccttctccatgaaggcatccatggattgctggagcgggtcgaaccagcggccaacataaaccaacttggtgtacttgagggcaagaatgtctttccactgcatgatctccctatcaagggtcagggactcgagctcacgaacggcagctgccattatggtgtcaccgggggtcttgtagacaccgtgcgatttcatgccaacaagacggttttccaccatatcaatgcgtccgatcccatgctgtaggaaatgtcctccccgtacaggctgtaggggctcttccgggatgcaattttagtgaacccttgtacaacttgagggtatccgaaccagttgttgtctcggtaaccttctccatgaaggcatccatggattgctggagtgggtcgaaccagcggccaacataaaccaacttggcgtattttgagggcaagaatgtctttccactgcatgatctccctatcaagggtcagggactcgagctcacgaatggcagctgccattatggtgtcaccaagggtctcatagacactgtgcgatttcatgccaacaagacggttttccaccatatcgatgcgtccaatcccatgcttcccaccaattttgttgagctacacaagaaggaatgctgctgagatatttcttccatttatggagactggaaccccagcaacaataccaatttccacatatcgatctgcatgcacaaagtgcaaaacaaaaaactaatttattacgtcatcacatccaaatgttatattactctatctaaacgtcgtgggagcggtgaaaaattagcttgccacgtcatcgattttttcagaaaacatcctgtgcttctgtttaattgtgcaggggtttcagctactgtgatccgttcgatcttggctaggagcaaatccatccatccacgttcctcagcgtgccatttctttgggctggtcgttcgtttggcccagcccaactgtgccggctcttccatagccctcggatcagtggaaggacgaacgaacggccttgatctctccagtggtgaagcgccaccaaaaccctagtgcgccgtcgatctcgccgctctcgcggccctttctctccccgccagctcatgcctcgcctccgtgcgccgcgctcctcgccctcgctctcgctcgtgcagtgacatgtcacgcgccgccgccttcacctcctccaacggtccattgacgatgaagacggaaagagagagggcgagagctagaggggatggggagaggaaggcacgcagcgagttcccctccttccttcgtagcaattggtgcttccaccagcaagctttctataacgtggagtgtcgccgaccacggccgcagcctccttcctctggattggactccactgggaactcctccgacatatcaagtgtgcctgtccaccttctacctctgaggcaaagattggatcaagcaagctgggttgggcttcctgtttccacggtgctaaatcctcatttcttctccattctctacactcacatcgtttcctgttttttttacagatctgactcagcaccttgatctgctcaacaaccggagcccccacctccttatacatcccaaaggtgatccttcgatcgatccatgatagacaatcttggttgatttctgtgtgttctcttatgtcctgttcatgcctcatacaattgacagttttttaacttgccacagatggatatgcatcttctgtattcagttaggataaggcttccaaggtctgcataaagcaaccgtgagactcacatgctacaaaattttggtattttcttcattcttccaaaatccttggttgattgctgttgggaccgacctaatctcatgatagttatgttaactattatagttccttaggtgccagcaaataactaacctggccaagtaaaagaccataagaatgattgctgcatgaattaccacttgctgtataactgtattactgctctttatctgtgtgtgtgtcagtgtttttgctgcccatagtttgttctctaaatgtgtgttgtgcactgtaaattgtctacagaacaaagagtggatgatgcattgtatggtgatagaaagaaggatgtgacacatatttaagcctaaaaacaattcaatttagaaaggagctatggtggatgctttgcttctcccgcagcatctttctatttcatttttcataaattgtattttgaggcaccattcttgctctaattattgggtggtaaatggtcgtcgctttcctatttcaggtttcacatgatgtttatgactgaaagtaatgcagtatcaggcatgcaaaaatagaagtttagttgatctactggtgcttcatctgcaaacaccatggatcagttcatgacagcatgaccataaggttgggagggacaagaacaaggtgtccattaaagttatggagataatgctgttcaggtaatgttaattgctaacatggacatcataaataatttattttgttcctgttttcatcatgctgccatttacgcagtgttgagttttaatggtggcatgcacattagaattttcttactgatgctgtgatcaggtaggttggataaaagttctgctttgcttctagctatgtccgctagcatattcactgttgcaaaataaacgtaatggagccagttttcaggttacaacttccaatctacataatttaatattaagtgttttataacatttgctctattttctacattatcaacaagaaccagaatgagaagactttaccaagctagaaataatttcaaacttgcagttgcaggctatggctcaaagtcccgcatattcatctttaagatgttaatttggaagtttcctccacagcgaatttttattcttgaatagctttttccatgaatcaataacgctatactagacatgtaggatgaacagccaaatttgggcattttcttcctaaatttttttttctaacatgacaaagggattcggaattgtcgttttcttctgcctgtatttgttaatgtacccttagcataaggatgtattagtgcatgtcatcggtctatattaatttggctctgacatctaatggttgtgtatggattgtgtatatcattttttttccacagcaacatgtacacacaataaaatcaattacttacatatcctgtataagcacactcatttcagtgcagttaaccgcatgaaatattttcacatttaaaggcctcccacatcttccatggttatccgtgttcgtacgtttgaagccaatatattgccatgcttttttttctttttctgctactagtatcatatttatgtgtaatatagttaacaaaatgttaaccttatgtgtaatatagttaactacagaaaaataatatatggtgtggattaattgttatttttgtgtttgcaggccggtccagtgaaaagagattaaagaggattaaattgtttgcaggtcaacgttttattagttcagtgcaatcattccctgattgtcatatttagtcataaattgattgtacatttgtacaaatcgttgaagtagttctatttagatttataggttgcattactatttgaaaatgtgtggcactttatctaagggcctgttcagattgatgtcattttcaaccataccatttttgggcatagttgccaaaaatgtggctatgtttagtttgttgccaaattttagtaaatacataagaaatcctgtcaaaattttggcaatattgccaacttaccaaaattttggtattgcttaccaaaatttgcaaggtttattttggctacaatctgaacaggtcctaaaagttgatatattcagtactaagtttactattatgttgtttttttgttaggactacaagagaatacatttgtgtatttgacgaaaacccgagttttgtggtccatcaagatctcactattttctttccgaattgtcaatgcatgtgtcactgcaagctgtttggtcgtctatatatgatcaaaagatttatgttgtgtttaatattggattgtaagattttcttatgccatgtatatgtacactttacaactataaatgccttcaacatgcatctcagctcatttggattatactatgcatgtccacacgcagcggagcgcgtgtctcttgctagtatagtatgaagacagactgaggacaacacagccatttgtcatgtatttgtaataaaacaaaaaaaagttctaaatataattgaatctgtgatactttttaaagttaaaattaaggcctaaaagagctttcaagtagagttaaaacatgtggtgtccatcctatgatgtgtgaaacagctattatattagttgcatagttaacacagttatagtaagttgttcaaacacatctcctttttgtcttgacatggtgtgataatatgagtacttaattaaagtaactatagagtcctgtgatggaacttcaatggaaatccctcaagaagacttagtttagatgaccttttttcactagtacagaactccttaactctaacggcttttgccgtgtcgggatcttgcgtgccgtcacagcatcgtcatctcaaacgggccaaaataaacaccgtcaaagatatagtcgtacagacgtaatacatacgcatgcatctaaagcccgtcaccgatgattcctatcggtgacgggcttatgtttaggcccgattgagattatctttgtaatctttgtcagcccctaaacgtatgcctgtcaccaataaatctcaccagtgacgggcactaaactaggcctgattgagataaaattaaggtatcgatgacgggcttagtataaatctcactgatgtttgtcatcggtgacgggctcagtattacacccgattgagataaatgagtgctcgtcatcaatgtccgttcagtgaccgttactaatatttattgcacactataaatacttcacccctcctccccaagggaatggttattccactgttcactattttggtgggagattgagggggcgatttttgtctcttttttccaagaaaaaagaaaattcataaaagtaagtgaaaaatactaatcaattccaattaatttagtaatacttatcttacaaaatgtttatctaatattttgttcacttttgcagcgatggatcgaagttggatgtatagaagaactgtgcgacgtcatagcaaatagtatagaaattgagtattaaattttataaacaccgcggaggaggataggaaaagaagaaacaagattacatatgttgtcaatgtgcatattgcaaaaatgagatatgtttgatagcagagtggacgtacatgctcatctgatacaacgaggattcatggagggctacacatgttgggtgaagcatggagagcaagaatcacttgacgatgttgcagctgcagacagaagtggagcacaaaattaggaaaatgaagatgagcataatatgtttgtaccttctccattaggcggtgaaatggttgatgtggatcacgatctgatgcaagacatattacatgacgttgaggacacagcttacaacgagagagattccataaaattcagcaggttggtcggtgactcggagacgcctctatacgccggatgcaaggcaaaacacaccaaattgtcagataccttgaacctaacgaagctgaaggcaagtagtggatggacataaaagagtttcatagatctttggggaatactgaaagcaatgctatttgatatattgtttacatatcttgctagttacatgatcaaactgattggcacacatgcatctcatcaatttttggacctgcactggagctaagcagatctcctaggtcattgctgttgtcgacttagttcgcaccaacaaagttctggcaccataggccaagcgcatatttttcatcaacaccgtgcacttgcggacttatttgtagccatcacaaataacaacagggagagggggcggtgatgataagttacccgagggtgacccggcagggccctggggtgtgagttgtctttctaaaataagagtgtctaattctatatatatctatatatcctatcaatagcattggatcctctcatgctcaataaattcatgtcttatgtacaattgcaattccaaatcaaatactatgaagcttaaaatgttgttttttaagtcatttctatatcctatatagttggagcaatgcttattatttgatcaccatgtcacatgcaattgagattatccattgatacttgaaatttattccaaaatttggttagtcatgcttcatttgatacttaaaattgaatcaattggcatagaaaatttcatttgatactttttgaatcggtgccaagaatttgagttgtctgttgttttacttttggtatctcttatcacacacaatacaccccatggatacaaagagttaggggggctctcacattctcaaaaatatgtgcatataagttcacttcatatatttatatgcacagatttagggggagatcaaattaacatttggattcaaaatcatttattatcaatcttttgtaagttttaattgtgttgtcatcaatcaacaaaaagtagaaattgaaaaggcatctatgcccctagtgggttttggttaattgatgacaaacaattaagagactaatgtgcttattgagtgtacaaccaagggattagtccgatgaagagacgatgaagatcgggatggagaagatgtaatagcttgtggtttcatggaaggttttttctgtgggtgctaatggttcttcccctaagtaagttaatgcagaggttgcggacatgaagctagcaccgatagtgggattataaagatcatgcaccatgacctctctcataagacattgaataattaaggatgggaagctaatctgaattacttcaaaagaaagctcgacctcccttaagcactcatcgctcatgatggtagtcaatcctctcaccgtctttttgagaaaatgttattcgagcggcgcagagggactacacgggacaggtggtctcttctgatgggaataggtcgaggtacttccataatcttaaaaaagatcatcctcgaactagaaaaggatttccagaggcagaatttcttctttcttcggtacccgaggctcgagtgagggcttaacagttgaattttgggatgtggaagtataggcttggattcaacgggtatactcgacttcctagcgggtttcacatcggacgatgggaggtgttctctacgatacaatccctaccttctgcagtgcgactagcctccggtgaaaaaatcaacatacgaggcagacttcttctcactctgctaaaagccgagaatttccatccataggaagacatcacgggttaacaggaagaaagcaagacaaaacatgcttttgagttctccccattcaccatgtgtcttcctaactgtgcgagaaggagtgctcccgaaccatggctacaaagctaggacggagttcaaagccagatgggttttgaaaggtagtggcttagagaactcgccttttgaagcggaaaggttttgaatagataggctgctccgtggtagaagagaagagaaaggaggaaagaaagaaaaagaaatatagaggatgaaccaagttcgtagatgatacagcaaccgttccccggcaacggcgccagaagatgatttgtgcgccctccattccgtgtactcacgtctgattggcaatatgtgtattttgtcgtatggcgggtgtgttttctccataattcacctgcatacaaatattcacccagacttgtagaaatggttagtaataaccactacctctaagtttggtattttattttatattctttcatttgcgtttatataggatttgacggttggatttggtacttaaggaccgtcaataggcagcttgacagcggccagtcccctttgaggccaatggggaacaagctgtggccgacggctagctcagcggcttggccattggcttgtagactgggctagtctagcaaaatgggacatgttggtaggctggactagtgtttggtggtttgtgggctgatctgtttggctaggccagcataggagaagaaaataaaggaaaaagttcacttgaggtcccttaatttgttgtagagtttaaaattcatccacgagctataatattaggtatatatagcccgtccccaaacttataaaaacgggttatattagctcccaaggcagtattgctccggttttggctgacatgacgacagagtcagcatgggactcactttttaggacatttcattctaaaaaaaaattggtggaccccacatgtcatcaacaccacacacacaaacagtcctcctccctctatttctctccatcctctctctgcaacgggaacgctagctcgcgtcattcaggggaagtttctcctcctcctcttcctcctcccgtgggttcgtgtagcacccggtccaaatcggcagccagcaaaggtgcccgcgactcgagttatggtgacgtgaccgcaacgtcatggatgacgtgtacatccccttcattcttgaggaggcggcgacatcgtgggccaagatgtgggagagtaagctccacaccaacagttccagtttctacgaaagcggcggaggcatggacaatcactaaatactcgccatcgatccgacactgcgcgacaccatttgagcggacctgcaccagttcgtgagcaatcacgagcactacgcatgagtcggatgcgtgtggacacggggctacctgctccatgacctgcccagcaccggctagggtttgaaatttcgaaagtaggatttctgccgcaggtgggcgatagaaccaaaatttcagatttttttcgtacgaatttttttaaaattttgactgattttgaatggatttgaataaaatttgaccaatttcacaaaattttgcaaaaaaaccaaaagtttcgggcgagatatgagcatttcggggggggacaaatttcgaaccaaaatttcaaaccttggcaccggcaagaccagcctcgtggtggccatccaacctcctcgagttgaacatatacgacctggtgctaactcaccacagtgatgtccaactttgatctccgaaggctgctggcctcgacgcggtccaagtcggtcatggtcatcgaggacgtcgacttctccctcagattgttagaccggacgcgcgcgccggcatcctaggacgacgacgactagggccatgggatactgcgacactcgctcaattttatgccaccagtgcgtttcgtggaggctactgtggacgtgccgctcgccgtggtggtgccattcagaccatccccggaggtgaagcggctatacccgagcatcgacggcgcccctgtgaaggaggagctgcaggtgcaggtgtatggtgcttggcttcgtgtctcaccatcacatcgccaacgagcagggccactgcgagcttcctggtggcatgggggctcaccacatggcagctgcccgtgggtgtggtagcgctgcccccatccgcgaccatgccgcatctcaagtcccggaccttgtcggggctcccgccgtcgcagcactggcggggatacaccaccttccagggtttgcaatttcgaaatcatgttttttgctgcaggggagcgatagaaccgaaatttccgaaaattatttcgtacgaaattttttgaattcaaatttgaaaatttcacccgaaatttatgggaaaaaaatttgggatgcactgagaacaattttgcagtcatacaattcatgatttcaaaagaaataaatcatcttggaagcaattagtctattatagttgcatacaccaataaatccatcgcaagttcatcacatagctttaacagtccattacataagttttaacagatggtaacatagctttagcagtccattacataagttttaacaattcatcacataacagtccattacatagggttaacagtccatatgacaaatagtccataacatagatttcaaacattccaaataggcttaataatacatcacaagcataaattgtctcaacgtagcaaaatagcataatccaacagagtttcaacatcttccaaaagtagtcattcatggacatccatgtcctcattctcagtgaattcttgttggagttactttttctttgtctgatctgaaaaaagtaaagtatatatgtactagtcagtgcacattccatatgatatattacaggcttcactagcagctccttttatatatatattttttcagcataatagctcacatggagttttatggagtaatggcaaatatatgcagctatactttttttttttttgcggggaatatgcagctatactttaaacagatgataatcataggctgagcatgaatatgagacagtgcagcaattcagtttaacatgtatacaggattacaaggcagcaagcatcaattttaacatgtacacatccaattgttcacttcctagttcctacaagtagcgagcagcccagcatcataaattcagcagcaagcagcaaaattcacagcaagcagcaagcagcaagcatgctttagaaattcagagtgggcattcacaaaattcacaagtgatctgaatacttactgttataaaccaatgcattgacattcttcagcctccttgttgtacgccgagcatgctgcatctcaacacctacaaatagagaaatacattagtcaaatagagaaatacacacacctttcagccaatatgacaaacatcaaatatttaaaatgcacctgtagatttcattgcttgtaaatctctttggtcaggattcacatctccatcatggtcatggtcattatcactagaactactgtcccctgactctgcatatacagggctaccatcaatttcgctgtccgtgtcatcaccacttgcaaactcgtcctcttccacagccattgctttccccttcctcttcctgctgttaggcccatctccaggattctttctctttgttgcccatgtattaatgggctcatcaagtaacctctcgccagacatgtcgatgcggacagcgtctgttgggatacgcgtaggctacgatagcataaatcaaaaatttctatcgcgtaaaccaagaaccatgcaagtattagatcatagatcgttaccgctcgacgcgctgcgcagcggaagaagacgctgagaagtcgaaagaactctcgcgaagtagcgcgcgtcgatgtagaggaagtagtcgatcgcaccggctcgaccttctcctcctcctgcgttctcctcgccgtactcctacgacgatcagcaccgcaaaccagtggcgcctctaccggtatccacacgtacagggacggaacgccacgcacagatgtgctagcacccgcgcgcggctagggttttgctcggggagggaagtgacggctagggtttctcacgtgatgcaatacctccgccggtcacacccctcacgaatatataggatccatcactcgggcctccaaagcccgtaggactcctattcggatccttatctgcattaagctcatattggatctctatccaatccccttattccagcccattaagcgtgcgaccctgtaggttcatatatactcggctgtaacccgaaaactcattttcggtccacgcgtcaacagcggcccctagcagaacgtattgacccaccaggcatatataaagatcatatcggctgaacctctagtgtatacttgtataaacccctttgcctcacgatatcgattaagctcaaggctagatatgtgccatcctctaatagctcaatcattcactcgaacctgttgatagattatataacttgtgattgactcctcaatcacctttggcatggccatgcacttccataatctacaacatcgaggggcccagagatatctctccataggaggggcaaatcccatcttgattattcatatcccactacatgtttcatagcatacccgaaaactacttttataactatccaattacggagtagcgtttagcagtccctaagtaagctactacgcatgttgggaaccatgataatctcaggtctaaggattcaacaccaacactaaatgagatcactgatgacacaacacatatggctcttgcattgtctcatgttgggtctatccaacaacatgttcaccaacatgtgtccacattattaatttggtatctctataccatgatccatgagacatgatcatcaattaatacatgtgctgatcatataaacatatttgttccacatatgatatttgatcagggatcctttagaaatagtaacaaacaacataaagagtctcatgaaagaatcacatattcattaaccaataaggagttatctatttcaaggaacaatgtcggataaatatgtaaacatagtatgtgatacaatcatctctatgattgcctctagggcatatcactaacagcgtcaatttcggaaatttcgaaccgaaatttcaaaccctgccaccttctcttttcttgttctcttttgttcttttctcgtcctccaagcttgcgcaccatagctaggttgggaggcagtggatggcgcggaatctcgggcggtgtccgaaaggcgctcattcggcggtggagtggccaagcgtagcgaccgccttgacagtatggggaggcggtagagctgcggtggcatcataaagttggcaaaggcgttgggtcttgggaaggtagaggcgatggggtgctcggaggatgatgcacgtgtcaaggacagccggcggagggtggccatggtggcggagtacgtgtggaggccgttctggccgagcgcaacggcgccactagagagaagggagagggcggaggcaaatggagcggctctagtgctattggtgagctcaagaaaggtagaaatggagaggattgtgtggaggatggccaaaggcatgaaatcgaggccgtaggccacggcggttcgatttgggcgtccctctagccacgggaggggaagagagggaaggggaaagagatggctactgacatatggggcccacgtgggttccacactgactcagcatagctgagcatagtcaaagcgtcacatcaaacaaaacagggagccatcctgtcttagggtgaaagttggtgtggttttaaaagttcgagaacggattatacctagtattacggttcagggacagattttgaactcgacgacacccaaagtgatccaaaaaaaaaagaggggttgcgcttaggctttagtataggtaaggtgggctaggcccaccagaaaattagagttcggaaagaatatttcctcaaaagagtattttgtttcatattcgaatttagttgacactgtcataaaaaaataaaattcgagaagacccagcatgatgcaaacttttgaaaaaaaaaataagattgagatttttagtcgttgaatttaatttccaaaatttaggatccccattaaagtggataaaattaatgagtgcctcacacataatttacaatgtataataactctatactgttccttttttcaatcaatcttgagcatatatctcattcttgtgaaacatatatttttttattgtttgttttgaattattaaatattaccgtagcggtagcacgtgcatttagtataatgtgtcaattaatttctaactgtacaaagtttgttagaattattcacatgttctaaggagattcttgaaaggtctccaattagtataataaaagaatgtcatatatatatatatatatactcttaaataaatatattcctagataattgtcaatatgtaatgtattaatttactgccgatataacgcggagacgttaggaattttttttatttatacatttttttataaaaatatttacaaaaataattttttgtttcgaaaatttacaaatctaattgcctgccgccctctagaagggcgatttttaaaaatcgccctctccaagggcggcaagggacctaaatacaaaatttttatttgtgttcaaacccttcccaccggttttaattgcttaaaaactaataatgcttattcgatactccaaatgattttaaatggaaaagtgatatcatcaagatctacaacttttatataaagtttatctccatccaatgtcgtttgaaatgtagatctgagattttttaaaatgtgttttatattttataacgaatatttggacatcttaaatgaaaaagttattaactacaaaattgtagatctccttgagctctacacttttgatataaagttttatttcatctgactttatataatataattttaaattgtaaaatcatagagctaacaagttatgctggaaaatttacatttaggtcccttgccgccctgtggaagggcgatttttaaaaatcgccctcccaaagagcggcaggcgattagatttgtaaattttcaaaacaacaaattatttttgtaaatattttaataaaaaaaagtataaataaaaaaaattcgttagagaacgaccaaataccggaagcattagcccaccatcacatctagcaaccattttcctttttttggtgcagatagagatagtagattatcattaacatggtaattagaatgtaaatgagctatgcttaattacgtctagtgttagtaacaagcagaaatatttaccaataacttgtaatgtatatagtcttttttttatttttcccttgatcgtggacaggtagtcaaaactcagcagacaacagatacgcaataccattatctaaaaaaacagatacgcaatagcttgaagaaagatctgaaatatcgggcaatcttgtatctacagtttgagtcctgtagtattgggaatggaggttaaactctccatcttgtttgcatatcataaaaaagtttaagaaatgagaagatactatgtgatatatcactccataaacatacaaattaaaattcaatttctgcaagttagaaaaaacaaattaaactatagctaattatcgtatatgcagtcatattttttgttacacatgtagaagttaacttatgcaagaaccttgcatgtttgtggagtgaagtattacatattaatctatcttgttgatttttttcaatattttttataatcgtttaaatgacatgcaaacaacgagaggagatgtcccctcgagagtttgatgacatgagtaacaaccgaatatagtttccctgtagtattagaaaacaaaaactggaaggtgaatatgacatgaataaagacatgagtaacaacagaatatagtttccctgtagtattagaaaacaaaaactggaaggtgaatatgacatgaataaaaacagaaagtgtgtgttgtgagtagtgacacagcctgactgacaggtaatatgaaccggtgtgtcatggagttgtgaacagctcatttgatttggcatctgctgatggttgaagggccatgacgatgatatcttctttcaacatagaaatcaggggcaaatatttttgtttagatggctaaacctaaaagaaaagaaaggaggacaagaactgaatgacagggcagatggcttgcatgggtacacaagcccagctgccaccctgcccattctatggtgtaagctgaagctgaacagagtgccaaacacaacaaaaacacaaatttcatctgggcattctatatgtacatcagtagtcattgtatataagcaaaagatgtcttgcataaagggcaacaacgacccattacatacgttgggtgctctcctcataccaaaagaaaccatcacacaaactaaagagattcagcagcactagcattagtaactcacaacatctagcaatattcacataccatcagtaactaaataatacgcaagcataccaattagtttgcacaaaccttaccatggcgcagcgacgacactactgaagcgctgctcggtagacatagatgattgcttaagttggcttgcttctactttgagtcttgaattctccatggcatggctcatctgctgtgaaatagcacggttctttatgcaacggaagagatgggcgtgttgttcaagctggcggacaaccatacttagcacactaatttctgcacagcgttgttgatcatcgatttcttcttgagcaatcttcttctccgaacgtttcatcatatcctgtattttggaccagctgttttttaaactgagcagagtttccaaacgagatcgtaggtgcctgacatcgaagccgtctgcttccaacacagaaatgcacctcatcttatgttcaaatactgcattatcgtcatggacattcagcatgtttatgctttctgctaaattggtgaaagagtacatcaaacccaatgctatcccttcacgaaactccggaggatgctgctgtaactgatgaaaatttggtcgttgtggcactttactaaatacttccattgcctcaatttgtgcccacatcggggaggtcttcacaaacggaagttcaataatagccaaggattctgatggctgatcaaccataatattctcatgcacatgaagaaatttctgcatcaaggggcaggaagagttatgtgttcttgctacatacttggatattggtgtatcctgagtgttgtttgaaacgatcaagctgttaccaagttcagcatcaatacattggctcatatcaaaagaacataactgagttattgtcgaatcatcgatggactggctactttcagcaacacattctggtgactctaccatggctgagctgtgatactgttgtgaaactccagattgttcattaagtgcagactcccacgttaaactatgtgaaaggactgttttaccctcgagtgcagctaaagatatggttgacagtggaccaccaacactggcatgctgagtttcaggaataatactggctaactccaccacatttgctccatgatccacattgtccatgccatcttgtttgttatcctgacaattctcactgactggtgactggttcggcaccccatcatcaaacatagctggagacaaaaaagacaaattctctgttggagtgttcgtcacacactcaactattgctcccaagttttccttgcaaatgaggtcatcatgcctggtagcttgaccactctttgctgaaggaaattgatccattctagtatcatcaggcataaccaaaatgctccgacaaaattcttcaccagagtcttcatccatacttatttcacacccttcagatttggatattttcttctggttttcagttgaagaaacagaagataacaaattcacatcaccagaattatctaatgttgaagttgcatgcagtacaaggttctcatcttggcgaacatcgtttataccactttggctgattttatcaacaatgctactgtctcgtggacctgaatcagtataaggcatcaaaatataggcattagatgactcgtttttcagtaatgactaatgagcacaagtacctttattgtcttcaagtggagttggctgatttttttctgaaggaattgctggaccagcaataacattggtaggcagttcattatgttcatctctaaaaatcagcttggtctctgcaacattttgttagttagcaacttgctttgagttttctgtatcgtggtttagtataaacttacgttcttcagagattgctgcaatgtcgtgggttccctcaattgtttcgtcaactctgtttttcttcatctgcatttgaagtgtaaaaggtaatcaagaaaaaaagagaattcagtgctcagcagtagaaggtttagaagagttaaacagaacctcctgaatgtgaaaagaactgagagtttcaggattcacccctagttcctcaggtgcttgaaaagaaacacattcttttctttttctggacacatcaattccagcaaatgacacaaagttgaagctatttgcagcacttgaaatcagacaacagccttcatcagttgattgcttttcttgatcagtcgatgcctttgatccttcatttctgctgagatctggatgaggtgattgcattactaaaagtggatcctgtgggataggtcttagtttcccaaacaccccaaacagtgaagcttgcagccctgcagtttgcggcacagagggcatgacatccatctgagaagatggtagttcaataggactacctagaataagtgaagaagtatatttcaaatgaccagatcctgtcattgataactgtaaaggaagttttatctgagatgctaatgccagcactgcattttgttgcttcatagtttctttaggtcgtggtactacatctgcagtctccaacaatttatcagagcttggtttatctctgatttcatcactgtcattacatgatgccaagtcagcaggaattggcttttttcgagaggttaattgagaccctctaatgacaagcttctgaaatggaaaaggtatcacattatatagagatgattttaatccaaaaggagatcaaatatggagaaaaataaacagagcaaataccataaaaactgacagtcttttcttaatatgttatttggtctacaatcttgagttaatattatgtaaaaccattatgtaaatcagagaaagagggtagactaactataattaaagtaaatatacatatttcaaatgcatgtctaggtattttgtgtttcatgtgcatcaatatttgcacaggcatacaaataacaatgcatacagaggataacaggattatactgcaaccagtcctgcaaacagtgcacaaacaactacatcttgatgacataactacctacaattgttatacgatgcacataaaagctagaactttaagcattccatcatcatcgaagtaaaacacacagcagaagtatcttttttttttaaaaaaaaagccagagaatatgtacctttgcctttgtatcctttttctttgtcatgcagcgcatccattttcgaccatcccattcaaactgtggtctcagttttgtattttcaactgtcaacttatccacgccatccacattatccatgcccgttgtgtaactcttcagtttaacaacatacatcttgccaaatacaccacttgaagtctccaaaataattccaggccaccagctaccttcatgaaagacctctacatgagaagatggagaaaatctgtattttgagtccatacgaatgattgagcgtgctggccgaatatattcagtatcaacaatctccgtgaccagctccccatcatctccgacgtgtctatactgtactaagaaatttgtagaaccaatcactttcaaaatagtagctggattccaagactggccaaagctttccgcagatctactcacttcaactaggcttccctctctgaatgctggacctccattgtcctgcacataacaaaagcataggaacataggattaagtattgcagcacactgtaacacaaaaggttacctgacctttttctatgataaaaaagtattttttttgtttgtgataattcaactcattcacacaaccatcaccagagttacattaaaataatgaaaatgaattatccacaggaggcatagacaacctattccgcatattgatggtgccaaagctatgcctttacaatgttgtctgtttacctcaaaaaaaaagcttgtttgtttagaaaggctttatgtaacatgtagatgcgctaaattctgtgaaattatccacaaaagttattttaagatcatggaaaaatggtgctcaaacttatacactgatacatgagcaattgcagatctaaaacatcgttgacttgcatatgaaactctcaatcttatagtcctctccaaacccatctcacttgggtctattgagcctaatggctaacaattgtacccattatgattcaaattcctaataatagctgaattagcaaccattttacaaagcaaccatagcgaccttgttgacattagatgttatgcaagattcctcctatgcttccatgtttgattgtcaagacagactcattgacatgtcaatttggcacacagaaacgcatcgaaatattttattttttttaaaaaaagaaaaacaattataaaatactacaaacaaaagaagacgtacatatttatttattatttttttttaccaagaacaaaaaaattgtttactagaactggtttcttttactatatctcatctgattttatttcctaaattataaaatgttacttgattagttgggtaagctaaccatattgtacaattgtaaaattggaacattgtaagtgcaaaaaatagcgtggtatctccttcttgctcccaagtaccaaccacttctacttgaacagcatgacatgtagattgttaagcttttggcgtaataacacaaaacggacataaacattcaaactcttattaaattctgccaccctatctactatcatcgtaaattttgcaagttaccccgtgaacttcttaacatttaaaaaaatatcaaatccaagataaccacacaaaaattagattaagatgaatattccctacagcaaaaagatggggacacattaatacattttatagatggggacacattaatacattttattttatccgtaacaaagcacgggcatttaggaaaagcgcatggcctctccattttagactaaaaattacactataccaccatcatgttaaaaaaaatgagtactgcccaaatctgtaaaagaaaaaaaaatgactagccctgaaacacaagttcgcacagctcagcttattaccacatcagcggccgggacccagctgccgcggcggaacacgcggtgcggccgcagcgccgcctcctcgaactccatcacctcccgcgacgtcgggaacgccaccgtgtacaccctccggcgtgggtcgacggggagcacgtccagcggcagcggcaggccggtgaccacgcccgaccaccacccctcgttgtggaacgcctccaccatgtcgtgcatcgcgaacccaccggcgcccggcgcgcccggcgcccccgccaccggcggcggctgcgggcgcacgtcgcgggcgcgggcctcctcccgcagcgccgcgccgccctcctccagcgtggtgtaggcgacgacgtatccgtcgccacccgggaggtgggcctcgacggtgccctcgtagaaggagccgacgaagcccgggtcgtcgctgccaacctccacctccgcgccgaccgggaacagcagcgcctcatcctcctcctcctccttcacctccttcccgtcaccctcctcctgatccccacgcgccgcagcccgcggccgctttgccagcttcttcgacgggccgcgccccatggcggggggccgacccaccggcgttcgcgtgcggtgtcctcggcttctccggcgagagaaagagcgagagtgtgtgtgtgaagtggggtggggtggcggaggcaacgatggatgaggggattagcggtgggtggagcggcacgaattccgaggtgggtgggtggatcggacggtggaggatggagagagaggaaacgtggagggacgggatgaggtcgcgggggttgtgggtggaggcgggctcgtggcgcgaggcggcggaggccgcgagggccgtggtcgtggactcgcggtcgtggagtgtgaatgtgtgtgatgggacgtgaggtggcagttggtggtaagagcaagtttaatagtatagctaactactagctccaatttaatctatagtcaatgtaatagctcattatacatactatactattaatatctgaatatccggtttcaactatcatacacacaatgcgtcttagagtctgtgctatagctgactacaaatctgtagcccgttgctcttctctcttcttatttatctctttaaaatatatttgtattgctctgagggtggaggaagcgtccaggcgtgcagctgtaaaaaaatattgatagaacggaggaaccgttcgatatttttctttaacgactcatacaatgtgaagttaatattgatagaatattgatatagtaaaaaaattactataaaattaaaactaatgaagataaaatagccatcaaccacgccccgacaacactaatactagaggatgcccgggagaaggctagcaccggaccagccaccgctagaccagtaaaggaactactgatgaggatgcccgaaacccaaccctaacaaccgacacataactacactctatccacatctttggaattgagggagagagggtgagagagaagaatggaaccactctccccctaggccctccgacgtggccaacttgcgtaaactagggcaccgacacaatagaaccggaatctatagcgagcttgcataagaagattaggaggtttcggtaagggggtttcctggatgacgtctccaaggagagaagcgataaaagcaccgccaccgccgtctgtcgaggtctcaaaggagaaccgagataggttttcacccgacaacccactagaggagatgggacggcatgacaacaccctcaagagggaaagtgacactcgaaaacaccgttgttgcgggccaggtcaagaccgggctaggttttcacccgccacttgcctatgcgcatgtgatgcaccatttctccaccaccatcaaacctccgtcatcacatgggcaccactgaaccaacgcccgctgcccgtccagcctttgcgtgctgtcctgcgggcactcccatcacaccatgctgcccttccctgccagcaactccacctatgcgttgagctggcctcagtaaccatcggtcgtgcaccatgccggccttcgtcgtcagccgcacctttatgctgaccgtcgcccttagcctccttgtcgcgactgccgcttagccatcggcgccggcctcccacaccattggtgctattgcggccgccccccgttcagccgccggcctcccttccgacgtcgttcttcccgcaccacaaccggacagatccattgtgtaggtgccggatccgtggcctccaccatcaccctgccgcctccacgtcctcattgctgtctccactctactgtacccagccgccaccgactcggggtaggagggtggtctcctgcgccgtggaggctagatccggcaccgccgtctcgccgtctctatgtacaagtctctatgtacttgaagaggagagaatattaaagatatgtgcaagtctttgtgtactctagaggctagagttttagaattttctaagcatgttactatattttttctttaggacgaaagatcttattaaaatgactaaaatccattttttctacaatgatttaatttttctattttataatcggtgtgtttgactggtattttttagctatagctgcaactacaataattaagaattgttgcaactaatttttaacccctccgtcccaaaaagagtctaatctatgcagcagccgcatcagctatagcttgtatggctacctaacaaaagccaatattagagaatgggggataatttactactccctctgtcccaaaatataagaacctaagattggatgggacagtccagattcgtagtactagaaaatgtcacattcgatagggctcaaatgtcactgtctcaaattttgtgaggctgatatgtgggcccatataacatttgagagtaacaatttggaagagtggcaaatacttctagattctccctcaatccgacagaccggacccagcggccagccacatcgcataatctcgtcgcgcacacgacacacccccgctgcgcacccacccaaggcgaaatttcgccggcgcgcgggccccacgatcatcggcccaactcaggaagcgcaagaagaagcaaccggagagcctcctccggcggccatggccagggccctcctcctccggcgcggccaccccttcctccgccgcctcctgcggcctcccccgcctcccacctcctctgtactggttcgtcgtctccaaccctctcgagtcgccccctccccctcttccccttcctttttttgcagcccccgatcaaaggcgtcgagccgcggggatagcgctctcacaactgcaggacggacagctgggcgcccccatgtcgggcgtgcatgcgcggccattataggctcgtcgttgggggccatggccgcgtggtccggaagttatctcgcgtgcctcgagccatccgaagccaatcgattccttttctttttctttcttttttttttgttgatttcgttgtatccttcttagattttgtggattttcattgttgctgggttagtgggtttacaaaagggggaaatccctttgagttgaaagctgatgatgcattggtaaatatatgggtataacaagtttctgaacctgatgtgatggatactggtgacgatgagcatgcagtgcccactacttgaggtcttttaaggttttgattgtcgttatcccctagaactgcaagcccttggagttgtgtaccatttaccatgttgattaaggcagcacgattaattacctgtttttttatctgcatggattggctataacagcggacaacttaatctagccctgcttgttttctcctagtagaacggtgaaagaattttttatgactcaacacaaaaatcaacattcaggccataattattgccttctgttttgtttttgaaggaatcctgcaatagaaatgtgtcaccaagagttcagttgtggagattctctgcagaaggtgcgtaaatgcctagttctttcactctaatgcagtgacattgtgctaggttgatgatacctccttgctggaaatttttcctcttgtaatacttatgttttccatggtacttctttcttacgacagatttacttttttgtttctggatttgtcgtatggttatatcctgttaatttcgttggaaaatcttcatgggaatctagctggcatgtgtacagcatgcatgggaaagaaatatttgttttatacttatcagttatcataatggaagtgttatacagttttagctaattatcattataggaaaatatttttccaattcaataagaattcatgtgctaacctttgttttttatgtacaacacgaatcgttgttagtggttcccctattctggaaaattttacatgattgcatcttgagtttgtttccagattccagataacttgaaaattctattccaaaataacaataccgatctcatttgtcaagtttattggtgaatttgttcattgtatatatatccagatttaccactgactctatatatggtttattttttagggaaagaccagacaaattcaagtgaagatggttacagtgaggcaaacattaagaagaaggactttgcgctacaacaagctttggaccaaattaagtctgcatttggtgaggagtcaattatgtggctaaatcactcttacggtcctaaagaagttcctgtcatatctactggatcctttgcattggacatggctttaggaattggtgggctcccgaaggtgagttaagggtattaattcttttgtttaataattgttatattctagtatccaggatcactgatgcatgctctatttaggacgagtaaatgactttctactattgaaagtttaatgaaacttattttctattaaaaagagtaaattgaatcagagctccctgaatttgtagacttgtctcacctagctccctgagctgacttttgttttctaggctctttgaacttaaacccatttgcatcactggtcatctattccccgtttgctaacagaataatccgagcctaacagcaaatggatgcaagtttagggaggctagcaagcaaaataaaactgctaggtcaattaacatttaggaagttccaatgcaatttaatcttttaaacattactgacctgtttatcgccatagccagcatgtcagatagagttgccctttttttttctgatagctctattgctccattataactgcttctgtagggtataggcgaacgtgtgtgtactcagggttttctaccctttctttttcttaatcaatgatacgcagctctcctgcatgtttgagaaataaaactgctgtagggtttgttggtatgatttagtaatttcctggaaatctgaaactcacttatgttaagagatgtttgttaaataatgcataaacagaagattagttaaaagcatatgtacattttggttatatcattctacatcgttggttaactgataaaattctaagtgaatttccatttagcaaattatatgatattattcttcataattatcttctgctatttgttcttttgcacttcattgacttttgcatttatcagtagggaagggttgttgaaatttatggtccagaggcatcaggaaaaaccactttagcacttcatatcatagctgaagcacagaagaatggaggtaaataattgtttggggtatacatctgatctcctctgtgaactagtttccatgactaacaatgcaaaaagtgaattaagatgccaatatagtagttttgagttcttaaagcatgattttgttctttatttagatgaagctagtaaaataagtactttatgccaatgatcaagttttcagtgctaacctctatgcctaacaccatgtacttgaaaactataagcaaaacgatggacagcattaataatctaattttgatgggttcaggttgagctgtgaagggaaaaaaagtctaagactgcattagtaatgcaatatcttaataaattaacttacctgtaaatttgtacagtggctgagaaattctttgatttgatttatctgagtcagtcaaccatttcaagtctgtcctggccagtggccttgacaatgagctgtgaaaagtgaaagaaagtgtggactggctatttcagcatgcaaatataggtactttactttgaacaattaacatacaattggtatttccactttgttgtccacaaataggctttagtttcagaagtaaatggtaagaaagttaggagtacaatctctcgctgctagaacaaaatatcatactactcagtggtgtagaccagttttcccgtgaaagcatgctccttcagatttcaatatctatgcaacctgttagtaaaataaatccttttttaaaaaaattgattttgttgtttcaggatattgtgcttttattgatgccgagcatgccctggatccaacattagcagaatctataggtgttaaggcagaacacctgttattatctcaaccagactgtggtgaacaggcccttggtcttgctgatatcttaatccgaagtggctctattgatgttgtggttgtggacagtgtacgtagaaagttagtaccttatgctatattcacgctttgcttttgcctttctgcctcctggctctgaacttctgaaaagatatcgataatattttatcatatatgtgagaattctattttaaaatgaatgctttatatgaattgctccctgagcctgattttaaagatttagtgctccctttttagcatagtcattgttaatctacactctagaatgtactctttttggtcctgcacactgcataatgtaactaacttacatagcagctactccctccgtttcatattatatgtcgttttgacttttttcctaatcaaacttttttaactttgatcaagtttatagaaaaacatagaagca

SEQ ID NO: 5760 - DNA, 656 bp, Oryza sativa
cccaccggtggtggtagggctttcagtcgtgctctacgagatgtccgatggcctgagagattccatagtactctacgctgccggagcagacgacaacgcattggcaaaattatttgccagcggcgttgaagggatctgcccgttcgtggtttgttcacctcccgccctacttgatttcttcatgggcagatttgtggcagcagttcgtcgccagcttctcttctcttcatttatgagtgcttctcctgcatacatgttagtagcatagcatatagtggaagtaattattttatttaggaattatgcattgcaagcatagctagtcttcatatattggataatattgatggtcgaaactggttatcatgagatctaagtacttcgttttgtatacaaaagttcatgattctgctaggattacataaattcatgctagtagactcaagattttatttccatggcgagtttgaagtttgggcatcatgtttcgcgtcgctgcttagttcacacaggtttatactagcagattcaggatttattcccaatggtgagagtatggtctacttcttctgaatcgagggtgttacatcatagccatagagatggtttggcgcacaatgattgtatctatgtgagaccctttggatatggacaat

SEQ ID NO: 5761 - DNA, 8214 bp, Oryza sativa
ctcgtcagtacctataatataaccaccggtacgatgaggaatatgaacccgaaacatgaaagccccacttctcctaccttcgctttttcattcattacacgtaccgtgacggctcacactgtccatacagctcgctgcctgattctgacgctcgcctgaatcacaagcttgggcctgtccggtggggtcgctccttaccggcgaaataaaaagaaacacagggggtgtttagatacaatgaataaagttttggcgtgttacatcatgtattatatagggtgtcgtatggggtatttagacactataaaaaatttaatcacagaatccgtcagtaaatcacaagacgaatttattaagcctaattaatccgtcataagcaaatgtttactgtagcaccatattatcaaatcatggagcaattaggtttaaaatatttgtttcgcaaattagtagcaatttgtgcaattagtcatttttagcccatatttaatatttcttgcaggtgttcaaacgtttaatgtgaaagggtaaaaaattttaggggtgggatctaaacagtcccacagtcaaaaaaatttagtactccctccgtcctaaaataagcgcagccataagtttctgtgtccaactttgatcgtccgtcttatttaaacttttttataattagtattttttatgttattagattctaaaatatggacagtagtttatacgtgactcatgttttttattttttaaatttttttaaataagacgaacgattgaaactgtgcacgaaaacttatgggtaagcttgttttcggacggagggagtatgaaccggtacttctctgttccaacaagcaaaaatctgtcacgcaaacgtgtcgactaggcatttcttgggacctgtaaactctgtttactgtgttcgatcgctttcctatgtaaaatgtcccggattcgaaaatgcccgacaatggctatcaactgctacttccgtccgaaataaatttatttttcacacgtctcatgcataccaatataaaataaaaaaaactaaaatatcatactttatcaaatcacaatgtaactattttttattttatctcattgctacaaaattaatttttcatagcgtcaacctatttttttcttaagtggccatacagaaccactgtcaatgaaaatgtaacaaggggtagggagttacggtccaaggataaaagagccgtcagcaaaaatattcaaattttcacatgcgaactacttgacatatccactgtgaagattaaatttcacaagcggcaggttaagagcaccgcctgcctaaaaaattccttaaaataccctcctctcccttgcggccacacgccctctccttaattattcgctggcggttggcttaacctagccgcttgtgaaaatcgattttcacaagcggtgaaggtccgcctgtaaagatgttgattttcgctggtctttaatcgatggcggggagctgagccgcctgtgaaaacacgttctgaccgcctggaaaaactcatttttctagagtgaatcctcctaatataattatgtccctacatttataaactccggtgtaataattacgttacccaagaaataaacttattttaaataaatgaatggatcttaaaaaacaaacttattatagaacatttttcacttatctcatacatatcaacacaaaataaaaaaaataacattgccatactttatcaattcctcatacaattatttctctttttatctattatttctaatatatttatcttatgattttataaattttgatacagtgattattaaaaggaaaaagtatataataccctctaaactattatggtcttccgaattaccctcctatatcgaatacacgaagttattttagaatatgggaggaggaactgttaaggcttgtagtagctaagctcggtatcgtaacaagctgctcggctcggcttaactcaagcttgttaataaactcattaagagctttggcttattcatgttacctttacgaattttagagttctgacatatacaatttgccgatttatcatttactagtcataaacattattccttctataaaaaatataaagatttaaaaccagattcgtaagtaaaagttatatattttaaaacaaatgtagtagtaaatacgaatacaatagtttacaagtatttaaaggacttattattgactaagaagcataagcataaataaatataccggtctttcatactaccaagcttaacatgttctacacctgtctttaaatattacaagctagaattgaccgatggaatatatcttagtataataaatagtaggatatatctaatccaattctagatttaccatattttgaaacgaaggaagggagtagcttgagctatgctggagtaaaatcccaacacgaaactctcactacacgacgccactacgggttcaagccgatcttaagtcagaaacaaagtgaccttgttccaagccgcagtagcgagcatttctttatatttagaatctgtttggattgctacctaaaattttggtagggtaacaaaccaaacacctctattaaaatactacgtatgctacaaatttggttttgcccataaatttgtctcttataggtatatttttggcttcaatccaaataaacattttcaactctatcctaccaaaattttagtagtaccgaaacttgcccaagatttggcactaccaaaaatttggtagagcattaatccaaacatgccctcaggatgtgtccatttggattggtttggaaacctctccccttcgcacgcaaaacggaatgacgaaataacacatgattaattaagtattagcaagagtttgaaaaataaattgatatgattttttacaacaactttttctaatgtttttattttttaaaaaagacactgtttgtttagtagttcaggatacgtgcgtgtgggcaattagagaatagaggttgggaaccttgagtgaagaacacatcctagggcaaatgaaatggcgaaaccattataaactctccaggtgacatttactcatggtttatatgtcagtcaaatgaccatgaaaaaaattggaaaaaaataagatagattaatatgcgttagatcactctacaaacataacatacaagttaaatttctcacttttatatgttgcaaaaacaaaacaaatttgactctaaatatactttaactatctgtaatttatttttttcttattgcaacttataaaagttgaattttaactttctaaagtgatatatcacatgttaatacaacttcttattttttacaatatttttgtaactattttaagtgtcatgcaaactgaaaagacgtccccctcgagagtttaaaatccactccataatgaaatgccattcaaaattgtctgatggttcgagcagcaaaataagctataaaaaaaatttaacaaggcaacaaaaaaatttataggtaaataattattactagcagtttaaaagtagtagagataaaaatacaatcaccaaaattaaattataaatttctaaaaggaatcaaaccctaaagatgaatctgaacacacatatggctgtgtttagttcgcgccgaaattggaagtttggttgaaaattagaacgatgtaattgaaagtttgtgtgtgtagaacagattgatgtgatgggaaaagttgaaagtttagaaaaaaactttggaactaaacaaggcctatgtcattcatcgctggttttgatttttgattttttattttttgcacagagagagtataagccagcaaatagacttgaaaaccgaatctctgaagaaatctccgaggagtacgtacggcagttcccacgctagttgcattgggaagacgaggaaagccaagcagtggcgtcggcgaggcacctccggaacgtgtccatgctctccggcggcagagctatgcccacctcgatgccgccggcgccggaccggtcctccgccgccgacaccgcgccggtcttcgccacggacacgatctccaccttcgccggcctcccgaacccgaagtcgacgtcgtacacgcggaacctcgtcgacccggccaccgagaacggcgcgtcgtccctgcacgcctccatgacgcgctccgtccacccttcccagtacgcgggctcgccgcgcaccgcctcgtcaatggcgacggccaccgcggcgcaggccgtgaagacgccgcccgcggcgtcggcgagctcctcatgggtgcggcgaactcgtcatgcctgtccggtacgtcgcggatgagcgtgcggtcgattacgggcagctccgggagcttccggtcgccggcgcaggctgcggcccaggtgtggaggaagtgcgtcgagcccaccccgtcgcaggcggagtggtggacgatgacgccgagagcgaggccgcggcgcttgggcggcagcacggtcacctgcagcgcgagcaccgcgccgccctcgggaagctccgggacgagcggcgcgatcttggcgagctccctcggctcgtccgtggcgagctcgtcgacgccgacgccgtcgtgctcggcgacggtgaacgccacgccgtcgccgagctggtagaggagctcgtaccggttggtctcgctgggcgtggggcggatgcggctggcgagcgggtagaaggcgtggatagcccggggcagcgactcctccatccgggacagcacggcgtcgacaccaccgtcgtcgtcgtcgtcgccggggccgagtcggtagaagaagacgcgctcgacgggctgggcgcggagccacatcgcgtccatgaacatgagaggcagggctcgctcgggcagcgcgggctcgccggcgggcggcgccggcgcgacgcgcgtcgtgcggaggacgcggaggccagcggcgtgagcggccggttgcgacgccattgtctcgccgcagaacaggtgtggtttgtgttgctcgtggttagctgcagagcgatggagctttgcttctactcctataatacttgcatctccgcgagtgacttcacttcactggtccatacccgaattacgcccctaagttattatgtgattacgaattaccccttgaactcaaaaataagatatctttcaccttcaactatcaatacaggatgaaaactcccttaaatagctttgagagcggttttggtcctacgtggtagttcagtcaacaattcttttatcaactaatcgatggggcccacccatcagatctctctcctctctctctcccctctcaaacctctctctcgcacgcacggatgccgacgacgaggatgaggcatgtgccggcagtgctgcaccatcccgacggcgctcacatgccgccccattgttgcctcagccacgccgccaccccgccgccatctgcccgccccgagcagccttcgccacctcccgccaccatcttgcccaccctgagctgcctccgtaccccgcccttgcttgccgccatctactgctgtcctcggcgccccaagcggcctccgctactgcccgccaccccgagctgcctccgcccctctgtcgtcctactaccctcgcccaacacaatccaccgctatcctcgatgcccgagcggcctccgccattgccatcgcgccgccacgaactgcctgcacccccgccgctgtcccactgtcctccccagttactgtcctgccgtacatcatagaaaacatgtaaatacactcaaaatttacgaaatatattgagaaatgtaataacacgttacgaaatataaggattgtatttcagtgaaatataatgaaatttacaaaatgtattgagaaatgtaataatacgttacaaaatgtaaatattgtctttcagtggctttcataagaactccaataccagaaaaagaactcccctctacataattgaggaaaagaacaccacaatctacctgatagcttcaggtcatccaaaccaacttcaaaagatgacccagtgaccctctcaatccacaggtacctgtaaataggtacctgtaaacctatagtaaatgaagttcaagcagcagtacataatcgaagtaaccgtaatttttttaatcatgttgttaatcacagaatatgggccagcggcatccacgagcttgaagtgtaactctacaataatcacaagagcaaagaccaattcatagctaatcctgatacaatttcagaaacatgacaaagttatactcctgaggaacctgaccagcaacttgtgatgcaccatttgtttgcaatcgttcaacactaacaaaaaacaaataaagttacaagacaaattgtatttaaaaatcaaagcaagtaattccaaagatatcaatattttgtttcctggtcatttaagaattcatctcaaaccatgaaaaaaaatagacttcaacaattagagcccatttcaaaagaagcggtttcagttctcacaaatataacaagcaatttgttaatcttaatactggtgggctaaccatataaaggctaacatggaaatgaagcacatcagttgaacttcagattcagtagtggtagaaaattggcatatttaggcattgtattataggagtagttttttgagcaaaaagaaactttcacttcatagagcaatatattactaactccacttcatgtagctagaaagtaacagaggagcttgataaaatagatgtgcaacgctgattagaaataacaggatgatgatgatgcttgatgataactcatccagataaagcaatgctatatgcagtggctttttaatattccactccatgattcacatgacctttttatcaataaaagaaggcaaataacagtaataaggtaatactgggaagggcaagtcaccttactttacatttgatagaacggactcagataattcttaatggcacatctgttacatcttgttatgtatggactaccaaatcagttgcagttgaacaataaagggacatatcttaaaataaataaatctcctttttctgtgggttaaaataaataaatctcaaaaggattttatatgcaactaaagattaaacaaatagatatactgcagccgagtccacatgtcccttgaaacactgtccaggattgctgatcgattacgaaatatgaatttatctgcaaacttttgactgcagtagaaagaggagacaaataaatctcagtcaagaaacaaagctattgtgttgggaatatcaagtaaaattggacatgttagcatatctatatcactattaacatactgacgtgactccaatagtcattaaaaagtgaagtatctcatagtaaatctatacactaaaataatagggtgttctaccctgcaaaaatgaaatatttgtttgcactatatgaagtattcgagaccaaggaacaattcaattttagtttacataggcagagcttcaaatcacaacatacagtgaaaaatagagtaaatatgagataataataaggattcaaacagtaacaggagtgcacctcgatcatgcatttcatcaaacagttggtgtgctgcccatgggcacaccaaggaaccaccgtgatagctgatctggaagacctcactgtaatggaagggtaccatccacagcacacagtagctgcagccgctaaaggcctaggtgcagacgttgaggcttgcctgcgcggcttcagcgatggcggcatggaattctacatatctatcgaacccaacttttaaaacaatctatgcacttgtgtaatcacttgaacaccatgtggatcagtttaatgataacaaaatgaaacacattatataatcttatgattataactaactgttaagtttgtattcttcttggtccctgaaagagaaattttcagctcctgcacttgaatcttgcatcatttacataggtaaaccaaattgacagctgcatttataatttcatttaggatttgtcatgtaaattcaatgtaaaagtgaaacaatacctcagaggtactgtcatcgtgtgcaaggatcaaaagcaaaaatgaccaactgataaattatgaaatttgggatctggggcaatgctttttgtagttgattaagtacccagaatcaatgatttacataaaaattgagcttttcattttatataattttcatagcataatcaaacattttatcaattttgttattttcatatctattggaattgcattcta

SEQ ID NO: 5762 - DNA, 3300 bp, Oryza sativa
atgtggaaaagcaaacctgggataatgccggcagatggcaacagctttgctgctgtgttgtaaaatcattcatcgatgagaatactggcacaacagaaagaaggcggggggtgtgcatcaacctccgcggtaggagtcatctctcctcgggcgtgtagataacgaagaagttgcacacgatggagaggaggacggcagggatggaggttgtccggtggcgtggagttgggcagtgggcgtccggctccggggcgtcgagggtgaagacaactaaacatggcgcacggcagggatgcgcacgatgaagacaggcgatgagtgcggcggaggaggcagcgaatgggaaagacctcgcctccggttcagtgcgcgacggcggcggaaggggacgacctcgtgggtagcggtgaactgtggcggcggcggtggatggggaagacctcgtctccggcggcagcggatggggacgacgtcggctccggccgcgactggggacggatggggaagacctcgcctccagcggcggcggatggggacgacgtcgactccagccgcggcggatggggaagctccggcggtggctggggaagacctcgcctctggttcagtgcgcggcggcggcggaaggggacgatgacgcgagaagggttcggcggcgtcgcaggattcgggtgacggcgatctcggcggcgtcgaatggggcgatgcgacgcgatggaacgacgacgcccctcacctcccctgctctgctcacgactcgcgagatggggatcggattcgattccgtcctgactggcgtggttctagggtttcgccggtggtggggggaggggaaaggatgggcggaggggcgcgagcagcggccagcgggacagcgacgacggcggtagggcgatgatggcggcggcgcctgatctggaggaatcggtggcaatggcgatttgtggcggcgtatgtggcagatcggctggtggcgaggttagggtttgggcgccgatgtggagcagctgtcagcagggggagggggatgcgggcgctgggggatggggaggaaggaggattaaggcgacgctaggacgacggatatcggcggcggcggcggttgatacggaggggatcgaggcagtggttgagaggaagacgggagagaggggaacgcttgcgcgtctgcgctctgcaggatcagagcgttgcggaagcgatatgagccattggattagacaatctgacaactcatattccgcatgtatgatagggttggagtaacggccacaactacagaattttaaaagtagtaaagaaaatgtcgatgtccttatatgtcctagccttctttctatccttcattcgatctagcgcatgtgtatgcgtctctcctccctcacgcgcgtgtgtatgcgatttttccttgaagatgccacatgtcctcccctcacgcgcgtgtgtatgcgtctctcctccctccccgtttttctcaacggtggttaagatctaaatcattattttgttattcattttaaataaaagttctatgggtagatcatagccgaatctcccagttacgggtgtcttcatgcaagcctacatgaatgcagagacatgggctaatatatttgtgatcgtctatgaacaactttttataagttgagttgtttgatgattagtctttttttttatatcatgacatttcaatcaattatttaaggtgcacatggactatgatttattgtcaaataaaaaaaatagtgtgagccctatacctgcacgttatacattttattacttcctccgcttttaatatattgacaccgtgaactttttttatatatatttgaccattcatctcattcaatcattttatacaaatatgaaaaaaatagttcatgtatatattaatcacatatattttgttttttaaaatgagactaacggtgaaacatatccatccaaaagtcaaaagtgtcatcccaggcccaccctcctctctcgtgctcgggtctagcccggtcatccaaatcctacatgacgtgaccctatcaaacgggcaaggcccaaatacatcaccttggcgtatgtggacaaataccaaattagggttaattatgcctccgtgtgacaagcttgccgttgcatcgaccagaaattacataagcccgacaggcatgcatgcacgaacttaaaaaatagtagctggattttatgatgagagagactaccccatggtataccgtcaaagcaacgggatacatcgtttatgaccctcacgttaaatcagtttccacgtagtcaagtacaaccatgcaagatgtcagttggtcattaaacaatcccgtcgggacgtgatcccgttgcctagattttctcttttatgattgataaacaacataaaaatattttaaaatcaaatcaaatatatgtgattaatactcctaaatattctctttacaagttaaagaaaattctaaaaaaaggcagacgtaatttaatttatatacggttatatatgtattgtcttttatagcgacttaagttttctccctttttttttatggaacttcaagaaccagctgccttaggtaccataatttgtgaacgtgatctgcagtaggtaattttataaatgacataattaaatttatcatgcaatgctaatggataaattcatgaagaaatcatacttttaaaatccaatagatattattctgttagtatactacccttacatcgcgcgggctatcttcctggttcatttttaaaaatctcaccaaagggatcagtatttcatttgaggtactgttcacctcgatttgcagttgggatttgctatctatcagtggacacgtttcttgcttcaaatcacatgattttcgaccttacgttaaaacaaaggaacggataggatttaaaacgcacaacgaacaaaaattgcacccataaaccttaatcatgtgaactaataaatttgactgggccagcccaattaaagtaaacaagctagtacaaatcagttacgtatcaaattacattgtaaatatgatgtaacaaagaaatgagaggctgcatcaattcacatgaaccgattctttgacctcgattacaattgcaagaaatttcataacattgtcatgttctttattcttgtaacctaagatcaatctcttattctcatatatgaatactgcaaaaaaatgatattaagttctaaattatcaaaataaataaaagcctaaaacacaaaaacatccatcgatacagtttccgaactctaatcatttgaaaatgacaactactccctccgtt

SEQ ID NO: 5763 - DNA, 7832 bp, Oryza sativa
taataaatataaatatttagatataactaaatcacacatgtaactaagttgtaagtgcaatataactacggtgtaactaatgctattttttctgtaagtgcatttaatataaatatataaaaaattatgcatcatgaaatgattatttgccattttcataactgtggcaatgaatctgaattttcagccgtaggaaacaaagcaatggacgagattaatgcaatataacacaaaagacaacaaacttgtacatattgatgggtcatccaaacttcaaaattaactgggtaaacaaatatttgtattgaactgaaacaaatcagaaatatgcttgttaacaccaattgtagtctattgaatttataccatcctatagtagtctgaagaatataattcagacaaacaatacattttcacataacatattgcttccaaaaaaactaatatgccattgaatttagaaaatgtaagaaatttcaaaatcagggttcccaatacacgctaaatggatccattagaacacattcacaacaaaaatatagaaaattacattatataaccaaagttttagatagagttgtaactaaaatgtaaatgcagtataattactataactacatttgaattgtggtgtaagtgaatttaaacctaaattcattactacccatacattagaaatatttgatagctatatacttcacaatgatcaaaaaaataggttggaggataatttgactaggaatacatgtgatttttgaacataagcagaattttgttgctacttgaaaacataatctatttgatagttaaatattaacagtaataaaaatagggtggattatagtttgaccacagaaacatgtgacattatactttacttaaactcacaattaaatcatagtagcgaaaccgtagtctggtcattgggatagaaaagcagatattgagatccttcagtcctttttttttctttttggcagaacacacttaaagatcaaactattccacctgttaccaattatgtactttgtatgtatgtacacattaacaagatatattgatatgtacaagaagtccaaaggacagacaatcaatcacaacaaatttttcaagacctgcattgcaggtgaactattttgtccttcactatgctattatttattgtttcacaaagagaccctctatagttacaaacattattaatagttaaactttagaaaggctgatatatcatattctaggatgttaataaaaaaggaacggatgtagtactttaaataatgggcaaaattggaatgacaattgaaaaaagggaactactacacaattcatttctttcgcaaatgctttagtgctctacacaataaatttcttcttcacaattgtccatgctttactctggctgggatagtggtgcccattcctaaccagttcttacaggaaatagtcccatataaattgttgattgttttattcagacaagtttgtaggtacaacaaggtggcattcaatcatgtttgggtgttagatacttcatacgtattgcggcgtgagtgctaacagaatattacttgaatacaagccaggaagaacacagcttcaggtagaaaagcattgcagcttcattcgtccttccatttgttgcacaccaatagttgcctttctatatttttgtatacctctcatttgctcatttcatttcctttgccttcttatgttgtgcagatagtcaactaaagagtataaactactgcaatcaccttttttcaggaacataactttcatcaaagttattctctcctaggcctaattcagttaggactgacaatttgccaacccatactgtaaaatggtccataaaaagcatttgttgatatagtattttgagcaagtgttgaaagataaggtaatttccctgacaaactgtttgttgacagattaagaacctgcagatttgtgcagttggctagcactatggatgcaagttagaactatagatccagacattcgtcttgcttgtggttaaaaatatgtcgcatagaatctgagatgaatcatacgtaattgttagtaagactgttcatgaaacaagccatcaagcaagaccattttatgtagcatttttaccatcaaattagcatttttgcactatcactgcagcggatttggatttggtaaagaggcatgaagccttgcgagatacaggtgaggagaagacggggttctaacctactttctagtgatgatggaaatactattaaattttattagtagagaagagacagatatatgaatatgaatatggatatggatacagagtatgaagactttgcgtcaatagattcatattgtaaagcagttttgtatactatatggcagattataaacattatatattgtaaggaaatccatgaaaaaaatgttcagtttggtagatcgcaccatgtcaaaagataacattttacattactcttctcttctattttagtttcgttttcatgcgtgctcacactaacaaaaaaaaaaagagatatttttgggacacgcctcttgttttttttgcaggcagagagtaagaacgtccgtatgtaaaaaatagtgtgaaggtgcctagttttttagataatggaatttatatcccggcctttactcaacagagctacagccaattattacaaagtaccactcatacaaagagtgtgaaggtgcctagtagagacccacttatgaaaatccatttttgtaggtggtcctcttaacatgtctgtttgtgaaaataggattattttcagaggcgggcctgttaaaaggtccccatgtaaaaatcctttcacagccccacttcctctccttttattaactcttctctcctttctgtctcctctaccttttctccctctgtccctcgacttctccttctccacctccgcctcctccctcatcccctctcttcttctcttgacggttgtcgttgcgacgggagtagacaaaggggcggcgttgaaatgggagcagcctgccaacagggtgacgccgcgataggagcaaccgacaggcgatgtcactataggggatcaactgcctccggccccacatcgcgccatgccttggctcctctgatctcgcgtcgcgctgcgcctcgactccttctccaatctcatgtcgtgctacacctcggctttttcttcagcaacaacggcgaactcgcgacagctggatccggtggacggccaaatcctatgacggtgaccccgagacgagcaaatccatcagcgactgcgcacagatcgtcgacaacatcccccaccacggtggcagcgggtcttggccacagcagatccattggagttgaggcgcagccaggggcgacgccacgttcagcttgccaagtgcacaggcaccagggaaaaatttagtttttagttattagcatctaatctccaccttttgtgcactccccagaaaaaaatatgtgcaccaccttcagctgcccagcaggctgcaggcagcccatgaaggcccaatttcttacgtgcagcccaaactgtccaagtgcccaacagctacagcccatgcgtaaatgaagtgtgcattctggtccttcgtgctctagattcgcccccgcgcagcgggcttcgggcagtggtgttggaggtgcggcgtgcttcgggcgacatcaaggagctcagggacaacagatccaccggcaacaacaatagaagcggcggatccgctgcctgcgggctgtcgggctccattcgatggtttgcatgttcttgatatgtatgggctagggtttcaagatttttttttcttttttattcagaaaaaatatttacaagcgggtaccatatcatgagaatctgcttttgcgggcagccctcctagagaagctgtttgcgaaaatggtttttacgcgtggctgtgacgcccgtatgagaaaaccgtgatttttatagctagacaactttggccagacgggtagagcacccgtttgcaaaaacgacttttgaccgtttgcaaaaatcaattctgattgtcacttcttttctattcatttgccgtgtttactcgtcaagctttttctagtgaaaaggcgtctatcatagttactagttcaaggatacagattttttttttggaatgcgcacttgattatggaaaatcttaactaattaaaatattcgtaattttccttttgtcacctctctttttcatccgtgttttcatctgtacatcatatcaaccgatttggttagcaatagcgatggaaaaactgcaaaagaaaaaagaaaaagagaaaccatcagcggtcaccgacgccaccaccgccgccggagggagaagagaggcggcggagggagccgctgctgccggatccgcccgcggtcaccaccaccgctgacggatccacccgcgaacgccaccgccgccatcggagggagaagagaggtggcagagggagccgccgctaccggatccgcccgcggtcgccgccaccgccgccgctcgcggggaggggggagagggcacagccgcagccgctcgttgggaaggggaggggggggagggcgccgccgccgctcgcggggtgcaggcaccttgtcgccgtcgctctgccagaaatcgccgccgccatcgccattttagcctaaggggatcgggagagaaaaaaaactaaaactagggttagggtttggtacaagccgttttgacgaattcggaaccgatctgagccgttcatcaaaatgagcgactcggatcaatcccgcatcgagccggcctccatctttgggctgcagcactattgggccgcgcgcagcccatgaagcactagcagcgtccgattgaattgttggaccacattcggtatggttagtctttttttttaaagcaacaagtccactttgcctctctcaaatatatctcctatctaattcatagggaaaaactaaaaataaaaattacccaacaacatacaattacccaacaagagaaagttagtcttttttttaattgctacaaaaccttagttgatgttaaatctggtaaacaagaaatatattgttttcaacatgttgtttattggcagatttatatcaagaataccatattctaaaaggacccatatcacaaattaaattctaaaaatatttattgtgattttagttaaaattattccgttgcaacgcactattgaataataatttattacgagctactatatatttctctctatcatttgtgactttttctagcgagcaaaagtaccaaagcagtgtgaaaataacttcggttaaaaacaaatatttttagttttaatacaccgtagcgaagcacgggtattttgctagtaattataaagtgtctcctagatacactgtagggttacgatcgaaggacaacgttactagagtgtttataagagcgagctatcaaatgagttgccgcattcaggacagtataaacgtcattaaacaaacagcagagaaacccaccgccatgactcgttcaaggatacatttgtttacgaggatatgctttattccattatcttaaaaaaaaagctctatttcttaaagatttgaacctttgtatttcttttaacaaacgaatgtgtagtctaaatttatttattattacctacggagactcttgtactttttttttcaaacaaagagcaaaaatttgccactctaaccctcacttccaaagtgcgaacggtacactgtgtgatgaggacacaactagctcggatataaccgtgagtaccttatgtattaatcaactaaaggtgcatatgttttatattagatttacttgttatatatttggaaaaacgttgctacacaatgagttttgtgtgttttcgtttgcagagttacttgcttgggcgaaagaaaagagaccgaacgtaaggaatgcgtggatgattgaagaagttgattggtgacaaaaccaagaccttttccaagtcttctttcatctcaccacgtcacttttggtccatagaagacaagagataaagtttcgcatgctttggattcggactcgggcttcctgacagcatcaacttcaaacggacttagccgctgatctagaaggaattttggggcccataagtacttgttggaaagcttatgaagtctactttccgatggttttggtcccatgtcaaaattcttactgagctgccaggaatctgcaaaacaaatcatgtacctcatccagtcctaatctgatttgggttttgggccttataattgtgtcgtgggctttagtcccagggggtgcgcgtcctaggctaaccctaggacgtccctaatcatatttattcagtagccgtcatcggttagagtcgggtttttcttagattattatgttaagaacagtttcgtcgctagatcggtttgtagaatcccaaattcgtgtgcttaatcatttatacgcaatttggttgcaatctatcttgttcttgcttgtgttcttcgattcgcatgcagggattagccttcttggcgaggtcaatcaggtttcggcatggttgataaccagaggagacgtggtgctgcgattgcggaactcagtagcgtgttcgttcagaagccagatcgagttgtgtcgccactccgcccaaatcgactgtttgtcaatacctatcggatgatcaggacctaacatcccctcatcagttggtatcagagcgcggttgcccgttaggtaatttatcttccaataaccagaaaattgccacacaaaaatatttattctttacctaaacaatttgagccgttgtgttgttctattagattttgctttgttgaattctagattgcatcgtcgtgtcgagtgctagtttagttttagatttaatttttagatttgagtattgtatctgttcatcacttaggtctaggtctagggttcatcactcaagtcggtgtgagttgtacgtcagttttggtcgagtttttcatctcgtcggttgttgccgggaccttgaaaagttgaatcgtctcgttgtcgggtttccgtttttgtagtttggagatgtttttgtcaagcggttttggagttgctcggttgctaggggtccggttaccgtgcttgtgtatgtcggtgtgcagtaccatgcgcaggtagaaaagagaaagaggaggttttcttttggttgggaatagcagatcggtttatgttggttgaggataaattatctaaattttcatgtgggaccaataggaaaccaagccgagtcacacagtggccaatccctctcatcctcacgttattttccccacataaaggcggacctctgttacatcttggagaatttttttttatgtcggatttgagatatttttgtaaaaaagaaaatgacatgagcaatccatttttgaggtgatccaattttagttttgtactttgctgagtcccaataattttcatatttacatttgagtccctgttcgaggtcagtggttagttactgttgaaaaaaaaaataataataaaagaaaaggcagaaggtgcaaagaaaaaggaagaaaaagccgcaccaagaaaaaaaaaaggcagaaaggtgctaaaaaaggcagcaccaagaaaaaaaaaagaaaaatcattcatcctttgagtatgttttgagagtgcagagttgtgcattgattcatatctagtccttagtattgtcgggtgcttgcttgagctagagttgggtctaggctaggccagcacattgactagtactttgaactattattgaactttgtattttctgattagcacaattgcgctcctttgctactatatattgtgcctcccaagctctacat

SEQ ID NO: 5764 - DNA, 3318 bp, Oryza sativa
agatgatccaggagaagttgacgggcagctaacgaagaagagaattcctgctaaggtgatgtggtatttccctataatactacggctaaggcgtttgttcaggaacaaggggaatgctagaatgatgagatggcacgctgaagagcgttaacaggacgggatgctgagacaccccgccgatggttcgcagtggcgaaatatcgacagaaaatttaaagactttggaaaggacgcacgaaacatacggtttggtttaagtacggatggcatgaatccttttggagagatgagcagcggccatagcacttggcccgttacgatgtgtatctacaacctccccccttggctatgcatgaagaggaagtacataatgatgccgattattattcaaggccccaagcaacctggtaacgacatcgatgtgtacctaagaccactggtcaaagatcttaaactgttgtggaagaaggaaggtgtccccgtgtgggacgaggacaaacaagaggagtttaacctacgagcgctgctgttcgtaaccatcaacgattggcctgcacttagcaacctatccgggcagtccaacaagaggtacaaggcttgcactcgctgtatggatgaaacagaaagtacgtatcttaagcactataggaagattgtgtacatgggtcatcgtcgattccttgcagcaaaccacccggtacggaagaaaggcaagcactttgaacataaggcggaccaccgtacgaagcctaaacatcgcagcgggaaaacagtgtttgctatggttaaagatcttaaagtagtgtttggaaaggggcctggtaaccagcctatagagagcgaagatggtcacgcggcgatgtgcaaaaagaactctatattttgggagttaccctattgggaattcttggacgtccgccacgtaatcgacgtgatgcacctcactaagtacctttgcgtaaaccttcttggcttcctaggtgtatatggaaagtcgaaagatacactggaagcacgtaaggatctgaagcatatggaacaacgcggtgaccttcacccggaaccaaaggagaaaggaagccattacttgagtccagccagctacactcttagcaaggcagagaaggaaagtatgtttgaatgcttggagagcatcaaggtaccgtctggatactccatgaatataaagcgaataataagcacgaaggagaagaagttcacaaatctaaagtctcatgactgtcacgtgttaatgacacagctgctaccagttgtaataggggtatcctcccagacaatgtccgggcaacaataacaaagctatgtgctttcatgaacgcaatttcgcagaaggtcatcgatccgaatagattagaagccctgcagaatgatgtggtgcaatgtcttgtcagctttgagttgatatttccaccttcatttttcaatataatgacgcatctgctttgtcaccttgtcaaagagatcggtattctcagtcctgtgtacctacacaacatgtttcctttcgagaggtacatgggcgttctgaagaagtatgttcgtaaccgtgctcgtccagaggcaagcatcgccaaggggtatggaacagaggaagtcattgaattctgcgtaaaatttatcgaagacctttgcccaatcggggtacctgaatcacgccatgaagggagactacggggaaagggaactctcggaaggaaagcaataatgacggtagacaacaatttattccgtaaagcccatttcacggttctgcaacaatctgcattggtggctccctacatcgaggagcacttggctctagttcgcgccagaaacattggtaagtccgatgcatggattacacggtatcacattgatactttctccgcgtggctgcgacaacatctcatgagtaacgagacgattaaccaacaactggccttcttggcgaggggaccatctggctcgatcgcgacattccagggatatgaaatcaatgggtacacattctacacgagggcccaagacatgaagagcacgaaccagaacagtgatgttcgtatcgatgccataggtcacgatggtacaactggcacgtattacggtgccatcgaggacatatgggaacttgactatggacctctcaaggtccctctgttccggtgccaatgggttaggttgactggtggaggcgtaacgattgatgacagtgggatgacaacggttgaccttaacaaggttggatacttggacgaaccttttatccttgccaatgatgtaacgcaagttttttacgtcaaggacatgtctagcaaaggaaaaaagggcaaagggcctgacgagccgaagcgccaagtggttctcccagcaaaaagaaaaatcgtcggagtagaggacaagactgatgaggattacgatcagtttgatgggcaaccccctttcacggtgacgattgaccctagcatcctcctatcaaatgaagacaccccttactcacgtagcgatcacaaggaaggaacaatagtgaggagaaagtacgtgcggtcaaccgtcaccgccgatgtattgccgtaattgttgtgtacacgatgtaaactattttggatgtattgaatatccatacaaataaattgttgtatggaatatgctaattatgtatgattattagaatttttatcaaattgaaatcgtccatatgctagttatatatgattattagaatttttaaaagttttaaatcatgcacgtggtatttacatatgttaattagaattttcaacaatttattatcatgatatgctaattatatattattattagattttttattaattttaaatcatgcatgtggtatttacatatgttaattagaattttcaacaatttaatatcatgatatgctaattatatatgattattagaatttttattaattttaaatcatgcatgtgctatttacacatgttaattagaatttttaacaatttaatatcatgcatatgctaattatatatgattattagaatttttaacaattttaaatcattcatgtgcttattatatattatccacttattctactacatacaacaataatttttcgaaggttttgtcattaattgttcgactttaaataattttaaataattgtaatgcattatttactattttagaaatacatatgtaatgaagttcaagacacagctgctattatctttagtcccggttcttaaccctaaccgggtttaaaaagaatttggaaatagcgggaaaagatctttagtcccggttggggagaacatccgggagtaaagatat

SEQ ID NO: 5765 - DNA, 10254 bp, Oryza sativa
tttctttagtcctggttgttgttacgaactttacacccggatgttctcaccaaccgggactaaaaatctgggggtatatatattcccggtgctccctcgtcttctccaccaacacttagacgtttttccatcgagatcgatctcggcttctccttcgccaccactgcctagggcaaccccgcgccgacgccgccgtcgtctctcgccgtcgcttggcggtcctcgccgcctccgccacagacgccgccgccacatctcttgggtgagagccgccgctgcctctctctctctctcgatctcgatctctctctccaaacctccgccgcctagctcgttgccgacgccactactacgccgcggtcaaacgccaccgccgacgaccgactttgacgccgccgcccccgcctcgagctcgccacgccgccgcgccacgccgccgggctgctacgccatgccgccgcgacgccacgccgccgccgggcccccacgctaccgccgcggcacgccgccgccgggccggcccacggcaccccgacgccgccgccgcgccgccacgccactgccgcgcgcgcccaacattgccgaacgtgattgaaacgtgaccgaacgcgaacgaatgtgaacgatacgtggacgactgtgaacgaacgcttaacgaacgtgaacgaatgcaaacgaacgtgaacgaaacgttaacgaacgcgaacgagcgtgaacgaaatgcttacgaacgtgaacgaaacgcttatgaacgaacgtgaataaaacgcttacgaacgtgaatgaaacgcttacgaacgcgaatgagcgtgaacgaaacgcttacgaaacgcgaacgaacgtgaacgaaacgcttacgaacgtgaatgcacttgtactaaaagtgtgagaacgaacgcgtttagactaatacattttcctggtaatacatatatgattatatatatgtaacttggcccgtttagactaatacattttcctggtaatgttgcagagaagacgttgtcatcgtccgtcaagccgaagtggtagctagccatcgaaggaattcgcgcaggcaagtgatgcaaagaagtgattgttagagatttaatataagattgttagacttagcatatatgattattacaattttaatataagatttgtagcgatttaatataagtttgttagacttagcatatttgattattacatttttaatataagattagtagcgatttaatataagattgttagagatttaatataagattgttagacttagcatatatatatgattattacaattttaatataagattagtagcgatttaatatgagattagtagagatttaatataagattagtagcgatttaatataagattgttatacttagcatatatatatatatgattattacaattttaatataagattattagagatttaatataagattgttagactaagcatatatatatgattattacaattttaatataagattattagagatttaatataagattagtagagttttaatattacggttagcaaatatgacctatagatctaacaaatattttttgtatgcacacatggctgatcgcgatgaggaacagatactatacgatacaaacgcagagggaagcagccagtactggaacgaagaagaggggaacgaggatccaaaccagtacttgaacgaggaggggaacgtggagagcgatgcggaggggaacgaggagggaaacgatgaggaggagtctactggaagtcatccctctgctggacagaagagggcacacggacaacgaggtgccgcaaagaagatagagggtcggcacatcgtaactgaggtggacgaagacggccgacctagtgccctagcagaagcagccaagaattttgtacaccacagcagttgggttgtgagggacaacgtgcctgtcagcacggtgtactggcgcagaacaagggcacgcagggataatgacagctttgtcccggactcagaaaaagagatgctgtggaccacaatgctcgagacgttcacgctacccgcaggtacgaagaacatagtgaaacagtggactctgaagaaaatagcagaacagttccagagcttcaagggagatctctacaagaaatacatcttgaagggactaacaccgaacttcgacgtattccaaaagctaagggatcattgggacgagttcgttgcttacaagacagggcaacaagggcaagcgatgatggccagaaacaaagaaaatgccgccaagaagaagtaccatcaccacttggggtcaggcggatatagcgtcgcaatgccgaagtgggaggagatggaggcaagtttgattgagaggggtatcgaaccggccaccgctaaatggccggatcgatcgaagttctggtactatgctcacggtggaacgcttaagccagttgatggctcccttgtcttcagtgatcagatacgcgacgctgccagtcgactaacggacgcggtggaagcctcttctcagggcacattccgacccgacagagagaaggaagagctgtcactcgccctacagattcccgagcatccaggacgaacacgagggaaaggcgtgattccgtggaagattggatttaaggaggacatccacacgtataggagtcggatgaggagcaagagagataccgaggcgaagattgcagatcttgagtacagggtatcgagctacgagctcagcatgcaagagaagatggcaaggaaggtggatgaacgtatggccgcacatcggtcccaggatcccagtaggacattcctctagcgatggtcagcccatcaggcaatagtagcagctgcgcctcaacggggtaggtaggatcacagagcatggacgccatgcaaacccaggacgaaaccacctgccccgttgatgagatcacgcagcggacaccatgtgagctgcatattcccttcaagaacttatcaatcaaggtatgctcatagtttgatgatttttgacttgtacattccacaagttgctgcttaggttgattactaatagataacctctcatcacatgaaggtggcgtcgggaatggccatcccaacggacccttccgggacttaccactgcaggccgattccagcaggatactcgagggtcgaagttgagctggtagaagccgcgtacaaggacctcgagttggactacccaggaggagacggtgagacgcatctacgagacacaagacacgccattatactatggtgcaagcggtacatcatcctccctgggcgacaagcggcatctcatgcaccatctcctctggctccgccatctcctcctgcaccatctcctccggttcctccgccacgtcctcctgcaccatctcctccggctcctctgcctcctccgcctcctccacctccaccgtgtctgcctgcaccacccaagacaaggtctcgccaagctccaccgcctgcccgcacaagggcaacgaagaaggcgaaagttgatgccaccaaaaacaaggagccaccgtacgattgtagtcaagaggagcttgatgcttatgtggcaggagaagtgaagaggcaacttgagcctcggagtcctgaaaagaagatacctattgacccgagcgtgaagaactacttcaagggaatgtccgcaacaaacaaggaggccttatagatatcggactatgactgaacacttcagagagcctatcacaagaagtctaaaccagtccctcagcttggagaacaaccaaaccaagaggtcgagccgttggtgaccggcgaagattttggcataacggaattcatttcagacaccggtctaactgtggatcagctgattcgaggcgcaccaatcctgaaggcggaagtggcatacaagtttgaactcggtaaaccgcttgtcaagcctgagcagctgcagtccctaccgacatagatgtacaaattccatgaatggtacatggaaatgagcgccaagggtagagagatgttcggagcgaggatcagaaaccccgacttcttgcaaggagaagatattctctggatccatttcaaggatctcttcgatctgtaccatctggacgccctcgacgtctctcttctgagcgcatggattttgtgagtatctttgagttcgatttgtttcgttcaataattagctcctggcatatatataagcaataataatttcctttcatcgttgtagaatggagattcaaagggcccgacggcggagggtctacgatactgggttcatcgaccctcggaaaatcaacaccaaaatgatcgacaagtaagagaaagacacagaggacaatctcgtccatctcctaacatagcagcatttcaagacgtacatactactgccgtacaacacagagtgagtttttattgtcgttcgaacaaatttcgttcccatacatatagcatgtacattttcatatatatctcatctcatgcatattccagattccactgggtcctgtcattcttcgacttggacgcatgcaaagtcactgtgtacaactcaatgaataaagaggagaagatttttgacaaggtcttccaactgatagacaggtaatataatgccatctattccaaagtcgcggggaatctattgctattatgttgatctcgggtaataattaattaatcatagcttgcaactgcatatgtagggcttgggatcggttccgtcagttggtccgcgggacttagaaagaaaaacttggaaggaggtttcattttccagtgagtacatgcatgatccaaaattatattgaattgaatctctaattacagttaatataaagagtatattaaatctctcatcgtttctcatgtagtgtgcaaagcaggaccagggaactaacttatgcggctactacgtatgcgagtatgcgagtatgcccactgcctatcaaaccaaatatgcacaacacgagagctcgatgtacgtatacataaaccattcaaaatttcattgcgtatcgatttgttaagttgtttattaatttcatatattgatacgtcattattttttcgaatgatagcatattcacatgagggataatctcccacacaaggtttttatcatggctgttcaagaacaactgatgggattcatcaacgaagaagtccttaattccgatggtgaattctactacgacggatcgacaattcataacgtcggtccttcctcttctgacataacgccggcgtcgaagtggtagctatagctactgagcaaatgaattgtactatatatgcatgtatatatatatttatatatgtacacatttactttagtgttaatatatattttggtaacatatatgcacataaaatgttaagtgctttaaattatacatatgtgtgtaatatatgatttatacatatacacatatgcatatatatacatatatatatatatataatcaaccatgcagcaaacagggccatgcaaataaaaaaagtggtgcaccgatctttagtcccggttggtaacacaaccgggactaaagatggttcggccgaccacgtggctgaccgatctttagtcccagttggtaacacgaaccgggactaaagatcgatctttagtcccagttatttcacccgggactaaagatagctatctttagtcccggattcgtagtcccggtttgacaaccgggactacaaacggtttctccaccagtgccatcgtgagccactctgacggtctaaggccatctacaatgggtacccctaggtcgtgtccctagcaccctccatcaatttttccgtctgcgtcgttccctcgctagtccgcgcacaccctagctaggggtcgcgcctctcgcagctttttagccagggacgaagacgagcaacgcattgcagcgaccggttcctatggccaccgtgtctccagcgatagattccccttccacccctctcctctctctctttctctctctcgcccgttcccctctcttgggccctccgccgccacagcaaccgcccgagcagtggcgaggagcgggaggaggcgacggcaagagcggcggcgaggagcgggagtaggcggcggaggtcgagctcggcgtcgtcgacgggctaaggagcaacggaggaggcggaggatggcggaggtcaagctcggcgccgtcgacgggcttgaggtgcccgtgctcgcggccgagcagcacgaggacgacgtcgtggtggtggtcgtcacgctcggggatggcggcgacgagatccggccaccgcgcgccttgcccggcctcctccaccggtgccgtgctcgccaccgccgtccgccacctcgcactcgcagtccgccgcctcacgctcgccgtccgtcgcctcgagctcgcctcgcgctcgccgtccaccgcctcaatgcggcgcggccggcggcgctccatccaccggggggccagatccggccacggcagcgccggatctgccgcctccggggtcgccgccaccaccatcacgggagagagagagggagagagcggcgggagagagagtggcgacggcactctcacgtgcgtgcgatggagaaagagagagagagaaggggaagagaggggtagaataggaaagagaggaataggagagaaagaggcttttttgggttggggctacccagagtcctagacgtggcctgcattgtaaaggtgagtacgcctagagtacctcagttagtgagggtactctaggagtgtctcagattgtggatgccctaaccagtaaaatactccttgtttcttctttcttcctgccttggtgagtgccttcggccgtagagcaaagagcgagctctgttctttcttttttttccctcatatctctctccctacgtcatttttttcttaactactactcactcttctcttttcttctgcagttctactgctgctagcgagctctccttgaactcactggttggagggaagctatttccgatcgagctcgtcggttgtcgggggtgagatatgtgttctggtgaggaaaaggaggccagcttctttattttgtgcttggggtgagcgcggtcgccttctttgagcgtggagcatgtgaggatcatgtagcggtgccgtccaaaggctaagtatgcaggtgtttgcccccattcagtgttgtcagctccgacagtgtccatctccggcaagcaaacaggagccgataaactgatcgacttttgaatgtgttctcatgtctctacatgtgttctccatgccggtcagggtttcatgccctgccgctgctgcgcgaaccccgctttaccgttgtctttgctgccgtcagtgtcgccttttgttgttgaaattataagcacataatgatttaatttattccataaataaatcatgacattgcagatgtaaactagattgaacgcatcattagatctacacatgtaaactaagcagtaaaacatgaacagatcaaatatgcgcaacatgttgaacacgtaccgaggtggcggaaagacaggttgcacggcaggaactactcgcggttgcgagcgtcgacgaaggcgcgaagcacacgagcggagaggaaggcgagccgtcgcggacgaacagggagcagtcgcgcgaagcgcttccaaaaaacctcattgccgccttctcccggtgcaggacgtcgaaggcagaggttccgaaaacctgctctcccgatcgccggtgcacgccggcgagcgggatggagtagtctatgagcgacggcgcagtatagagtaggaggcaaaccctagattgattttgcgtgtgttgcgtgaaggcggcggctcggtttatatagagataggtcgcttgatcagggcgcccgcacgatctccactccgcgtaaccgaaccggataagtcgcgcgtaacttatccggactccacgccgttttcacgcaccggattttttggaatgtttccaaaacaaaacaaatctgaatttcccgcagcaaaacaaaactgcaaaagcttatccggactccactccattttcacgcaccggatttttcggaatgtttccaaaacaaaacaaatccgaatttcccgcagcaaaacaaaactgcaaaaggaggttgcatttgcgcaagggtgaggagacaattttgtggaccatttgacgcgtacgtcgtgcacgcgcgtcgcctgtcctgccaggccaggcgaggcgaggcgaggcgaggcgaggcgagcgagcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgatttttcaaagaattaatcttcgaatgggccttagcccatatattaattccaacaatcccccaccaaatctcaaaatcccactaagatttgcctttttccaatgtacagttaatataccagcggttcgatggagaccgattaaggttgaacatccacctagaactccaagctacacttactcacaacttgaacaatggaatacgtcttgaattgcaagtcttgtgcaagaaagtttcactcagagtcttatctggtactagaccgtctgtagactacccctcgggtggagcgtataagtcatactcctaggtctttagtaagctttctagaagattcacccaaaatctccatagactgcgaccaacagtcaagcttacaaatgtgagttctttcaagaatgctctacaggacagcatcttcgctaattaaagccaacagaactcattaaggcatagccaacctgccttgcagctcacgagagtacatgcatcttcatttagagagggtatagatcggtactctcctctagtttactaatggtttgttcttcccaggttctaattcataggatctccgatcacatagactgggataccaccatagtataactcacatgtgtctcaaacccatctccttcgatgcattatctatcacatttcgtgatagtcccttcgtgaagggatctgcaggtttctagctgtttggatgtaatccaacgttataactccagagtttcttaatttcctgacagacttcaatcatcttttcacatgtctagacgatttcatattatccttaaaactattcacttttacaattaccgtttgattgtcacagttcataaggatagccggcaccggtttttcaacaataggcagatccattaatagatcatgcagccattctgcctcaacagtagcagtatccagtgccgtcagttctgcttccatggttgacatcgtcaaaatggtctgtttgcaagacctccacgaaacagcaccaccacccagtgtgaagacatatccactagtggctttgatctcatccacatcagagatccagtcagaatcattataaccctccagtaccgcaggatacccagtatagtgaagccccaattccatagtacctttcagatagcgcattactcgctcaagcgcacgccagtgatcatctcctggattagaggtaaacggtcaacttgctcacaacaaaggagataacatgcctagttgcactagccaggtacatcagcgagccaatgatttgggagtattccagttgattcctagcaatttttttgttcttacgaagcaacaagctaggatcataaggtgttggagaaggcttactatcaatatagccaaagcgattcaagatcttctccacataatgggactgcaagagtgtaatcccattctcacctctaattagcttaatgtttaagataacatcagctactcccaaatccttcatatcaaaattttgagacaagaatggtttaacctcatttatcacctcaaggtttgtcccaaatatcagtatgtcgtcaacatacaagcatagaataactccctcacccccaccatggcaatagtacacacatttatctgcctcattgactgcaaagcctgcagatgtcaatgttttgtcaaatttctcatgccattgcttaggagcttgtttcaaaccatacaaagacttcaacaatttgcacactttgccttcttgaccttcaactacaaacccatcaggttgatccatatagatctcctcatccagctctccattaagaaaagctgtcttaacgtccatttgatgaacaagaagaccatgtgaggttgctagggaaagtagcacacgaattgtggtcaatctagcaacagg

SEQ ID NO: 5766 - DNA, 4772 bp, Oryza sativa
tttttggcgcgattttttccctattgggctccctcccctcggtgtatttttcatctttttggtatactttttgattttttttaaatttgaaagttttaaaatctgagttgaaagttttcaaatctcgagttgaaagttttcaattctcgagttgaaagttttcaaatttgagttgaaagtttttaaatctcgagttgaaagttttcaaaaattttcttgcaaattgaaaattttcaaagtctgagttgaaagttttcaaaatttgagatcaaagtttaaattttaagtcaaaagttttcaaatgtaactcaaattttttcaatctattagtaaaaaagttatcctaagaaaataaaaaatctattcttaattacagtcattatccttgactaacagagttagttatggtaccgcgtccttccaagaacgtgctccgcgtgcgcgctagttctgctcgcggcgcgtacgcgcgtactaggaacgccccgcttgtataggaacgccccgcttgtacagtacatcagggtaggcgtaagggaccatatgtggaaaccaattttcacatgtaacatatgaaaatgcccccatttacacagtcttaagtgatctccttacgaaatgtttgatttttcaaagcagtcgcttaagatatatagccgcttatgaaaatgatgatatttatgtaatcaagcatattaaactgaccgccttagagaatgtgtttatcgagatggcgctcttaactgtctgtatatgtcctgtcttttcatctacttcgcgaccttcaacaatcatgcctaatcagtgtgtgcttatgcatcatcactgcatttcttggtttcaaagcccaagaaaccaggaagaatctcaagagaaaactaaactaattaaacaagaaactgattaacttgtcatcagacagacagagcgctgctcgctgaaattaaatcaatagtattaagagggggacagtggcagaggccgtatctaccccgggacggcctgcgtcgggaaaggagcacctcctcctcctcatcggcgtcgagcagtcgcccggacagcgaccggaccagaccggaccagggcgccgcggaggcagcaagggaagggaggagagagagggcgcgccgccgtgcgcgccttgccggctggccaccgccgctcactgcagcaggggagggaggagagagaggggatagtggatttaggaagagagagtagagagagattgagaggatagaggggaaagagaggagagtcttataggtggggcccacactactttttttaaaaaaattttgctgactgtactcacgtagaactgaaactaccccgaattaagccggaggttatttgtccgattgtatagttaagggtgtaaaatatccggtattcgagtttagggagttaattcaatcgcccatgatagttcaagggtgtaattcgtaccttttcctagcaaaacacacaacgtttaaccatttgaaaagcgtacgtgcggaacacgatggagaggagttggaaccaaggatttaaatctccggctatagctgccgctattgccggagatagccgctgggagaagcaaccactaagatatgtccaatttggcgctacacattctatggcgctattagctgctcttagctggctatagctgctaaatgggcccttaaatagcggcagctaacttggtgggctgagagcctaaaactaaacaatggggcatatagaaacaattcaaccctaactctatcactctttcacagtcactctgtcgctcaccctctcccctcgaaaaacaggcacagcggctgtgcctggaggcgacggcggcggctgcaacctgcagcagcgacggcgatgaaaacagcagcggctgtgacctgcagctccacatggaggccgcaacggtggcgcccggaggcggcggctgtgcgtatgccagcaccaagcatctgcggcggctgtgatgggtggtagctgcaccaatccctccctccccactcttctctattctccctcaagctgctacggaggcagttgtgccgaagacagtgagggctgctgggcagcacaaatcctctccctattttcgctagtttttctttttcctaacaagagacgtgcaagatttttttgctatgattctctgatattgaatgtggtattgaactattcaatgtaatatcaagtgtcttggctctttaaactgtacaagaattgcaaaatttatgttagtttttgtaaaaccgctaatgagcttagctgcagcaatagccagctatagctggttgttgacagttcgatcagtttcgaccgtcaatattactaaaataggggagaactagtgatgcttgcaatgcataaatatgttagaataataatattccactagtattaggtatacttaccttttgcagagaatgacaataaagtggaggagaatcaacatcaactcagatgataaatcaatcggatgatgtcgagaaccagacttatgtatgaatgggccaagaactcagaaataacacgacacattgggccaaaattcacaagtctacggaggaggacaacaaaggaggccgccagccgaagatgggttggggccgaacccaccgcagctccgtttgatccagggttctcctggacggctgagattgctccccaatgacggttggagggtattaccgactattccaaccgttacaaccgtcattgggaggctataaaaggagcaatcatcctcacttcactcacacacctcaagcaatagctctctcatttatctcaagtttagtttagtagtatctagctggtggaataggaacatagtagaaatcaggagtccggaagccttcggaagagtttgggtatggctctagtagcttttctcttctcttttgtaagccaagccttgtacttttagtagaatactcttctaaatacatttatggtattgaaatacattccgagtatatgagtacctactttacattatgttcatcttatactgaatatacggctagcttatctgggagatgctttggtgcgggtataatgtttgcctatgcaattactctatgtcatgacgatgatattagagtagtatctggtagtttagacgtggtgtctagattacgggatatcattatttggggttatatattgcgaatgagaggtgggctgctgatagtgacagctcagtacgggtattcctccgcgccggtatataatcctaagttaattccctagggaggatactcctccgtatttagccccggttgtatggtcatgacgggctgtcgtaaggaactcggcagtcaggagtggcttctcgaagtaccaggagggcatcggatagagggtattagttagtatatcggttaactagaatgtatgtatactatgtatattagaaatataggaatagattttcttttcttttctttccacttagcttaggtgatatattatgagaatgagtagttaatgcttgtgtgtcactctacccttggattatcttaacccctgcttagaatatgattatcacaagtaatatataaattattagtcaagttctctctacatgatctttccacgggataaaataaatacgatacccttggaatactctcgggtgaaacactacaatggtatatctgtgggcttgcggatgaactctgtaaccataatatatcagaagtacttttgcgccattgctgggaattatatttctagtaatgtcgttaagaaatacgaacaagcatttctggcgccgttgccggaggagattcataatagagactacttgaactaatattttatatttgcctctgtataatcattttcctttgcaggctaaccttggttgttttcacttttgttgtgaaaacagggtagtgcatgactggtttcaacttgccgaaaaacttcaaagaaaatccagaagctttctttcggagcattaggccgtgagtcgctgctccgcagaaaactctaccgatagataaaccagccgtaccaacgccgccgaccttcaagactatggctaataagactctccgcgagttcgctgctccctctgctgacaatgtggccattgggccgcaggtcaacataggggacgtggatttcgacttgaagtccagcctcatcacgattgcgcaggcaaacccgttctgtggtgagcctaatgaggggtccaatgctgatctgcaacagttcctggagatctgtagcacgtacaacatcaagggcgtcaatcccgacaccgtcaggctgcgactgtttccgttctcccttctcgggagagcgaagcagtggttctatgtgatgaggacatcaacaccaacgatacatccacacttccacaattacaacttcatggtcctattacccacgctcgtgcatgtcaactcaactatcaggaacaatggagaggatcaaacggggagaggattcgcgcgggatggattcggactacagcatagcacaaacttctgacggccgccacgacttcctgcgaactccgatttgggcttgtaagtacttcatggaaagctgtcaagtctactttcaaatgaatccagcctcatgtccatatcagttctgggcagccacaatcttcattttactccgagtccttttctgtccacggtgccgcgtcacctctttgggcccaatgggcagtgtattaagttgggtccattagggacacgtcgtagggtgagacaacgaccccagcactcctgtggtcgtcctcttcctct

SEQ ID NO: 5767 - DNA, 712 bp, Oryza sativa
cgtccaggaatcagccgaggtacacaaactgacaattgaatagacaaatccatcataataataacgttacatacttacaaaagaaaagaaaaaaaaaacagcagcggaattaacggtctagcgatggcttcagctccactcccataggcagtcaactggggtataagccaaacgtcttctccttctggatcctttatcttcaactgaggtttgattattattgcaagaatgagcatatgacatactcaacaagccacacagcaaatatgcaagtgcacaaggataccaaaggatggcataatataggctcatttgcaaaagcagcatttagcaaagatttaagataagtaaaacagtagagtaattaattagaaattttaatcaacactgaacagcacacccatgctgtacaggcccaaccatcctgaacaaccatacccggctgtacagatctaactccaaaccaggagctaaacaaattattaccaattataacatccataattattgtgaaaggtgtgagactaatcacgaaaaacattgctcaacccgcctataaccgcgggcacggctattcgaatagttttactctggccagaggtgtaccactgtacccacaagacacgatttcgcacatgttgccatgccccgaaataccaccacggcattgcaaagggggaaaatcgtgacaataccctttgcacaacacaac

SEQ ID NO: 5768 - DNA, 1658 bp, Oryza sativa
  unsure (1)..(1658): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatgaaggatttgtgagtggctgatgttattcttaacattaaactactaagaggagatgagggtgggattacacttgtgcaatctcactatgtggacaaagtcttgagtcgctttggttatagtgactgcaaggcagctcctactccttatgatcccagtgtgctattaaggaaaaaccgaagaatagcaagggatcaattgagatactctaagatcattggttcattgatgtacttagctagtgcaacgaggcctgacatctcatttgctgtgaacaagttgggccggtttgtttcaaatccgggagatgatcattggcatgctcttgaaagagtaatgcgctatctaaaagggataatgagctatgaaattcactacgtcgggtacccaaaagtgctggagggctatagtgagtcaaactggatatttgatgctgatgagataaaggccacaagtgggtatgtgttcacacttggnagggggcgctgtttcctggaagtcttgcaagcagaccatcttaacgaggtcaacaatggaagcagaactcacagctttagatactgccacagttagggccgaatggcttcgtgagctcctgatggacttgccggtggttgaaaaaccagtaccagcaatcctgatgaattgtgataatcaaacagtgattattaaagtgaacagttcgaaggacaacatgaagtcatccaggcatgttaaaagaagactgaagtctgtcagaaagcagaaaaactctggagtgatagcattggactatatccagacgactaaaaatctggcagatcagtttaccaaggggctaccacgtaatgtgatagactatgcatcgagggagatgggcttgagacccacttagagttgcacaatagtggaaacctgtccattgtgatcggagatcccgtgaatttggatggcgaaataaactattgtgtagctgagagaagagaccctaaaatgaacctatcttcatgatgcacttctcttctaatctgtatggtaggatgatatacaccttaaagtgatccgagtggtttttcataaagcagagatgttggcctacagaacatcttagaagaaacacacctatatgaatccgactgctagtcacagtctatgagatctgggtgatctctagatactcatgaaaaggccaggagtatgacttttacgctccaaacagaggggatgcaaacgacagcctagtactagttaagggtttaagtgaaatctgaatcgcacaagattgacaattcaaggcatagtccattgttcagttgtgatctggtatagctcttttcctaggtggaagttcaacctaacagtctccatcgaaacactggtataactaacaggttcagttttgagaacatttcttgtgagccatga

SEQ ID NO: 5769 - DNA, 25757 bp, Oryza sativa
ccttttgttggtgcacctttgtcatcatttgaaaaaaaaaatcgaacttaatttaaacatcctgctgatccttcactttcaccaattatcttgattggccgaggaactggtcttgcacctttccagagcttgaccacacaatcatcccaactctgctatattgtttgtacagcattattgggagctgcactccaagttcatcaatattgtttacatttttgcctgtgcagctaaaaatcttatgttaacatgacatgttcttatacatttataccctttatgcatatttgaagatgtgctacggaaagatactctcctttgacaactgagcaaaatgttggcgtttgcgttctgggaggtgaacagtggcgaagtaatactgatacggggtgctggccacgaaatgtaagaactcgccagcgcctcgatagacaacggtgtggatcttgatggctcaggtcatgctgagtggcatattggcctcacctcacctcttgttcactctaatatgcgtagtcgttcctcgtataattatatttttaattttgtggttaatttgcactaatatgtaaataaattgattgttgatatgactttggatatatttcaacacattcttctagattcatgtaaaaaactgaacttattttaggatggagggtgtatgtcagaatgcacattaatataacataaaagaatcattttttaaattaggcaactaaatagcaccaaatttactgaatacatgagtgacaagacatcatttctattcatccgttttagttttggagactcgcaaccacatcgcttagttacattaattaactcaggtaatcacataaagctaaaatctattggtcagttatgtatagactcaacttgcaactaactaatgagttaattgtatggattagatggctaatcatccggggggttaatttgcagcgcatagggatggggggtgccaggcccaccccggcacccccggtggcttcgccactggaggtggatgatttatttacacttgcaaaaattttggtgggttaggctacaatattgagcttctggcgggttagggcactatatgtgcaaccttgacgctgcactgtgctggttaaggagcagctgagcaggctgtagattaaggagatgtcctctggttctaaatcctcaaacaaataaagattttactgccaaatttgacttgggtcttttattgtaattctataaatttgagctgaccgtgcatgaaatgagaggactgaggggatggaggctgaaggggatcgtggcttccgattgtctctcggctattcatcgcattcattcaattgtgaaagatcgttatgaagttggctgccagattgatgctatcaaggagatcgctgctatgttcctgtcttattcttttaaacatgttgaacgcttgtgtgattcagcggtgcattatctggctcgttaatatgagcacacccgttgtaatttctatcgatttgagatcccgaactgaattcatgggatgatctgtagtgatgctacttaatcagtaaagtggtgtgattgccgaaaaagacgtcctagactatgtttatgtagtcatacctacggcaaggaggatgtgctgccattatttttgacctgctgtgtgtagtgattatgtgttagtgggggctcatatcagtcatgtaggaaaaaaaaggagagtagagtggagagagataggagaagagatgttttttaatgttattttgtatatgactgatatgtgagtcaaacagtcacgtaggcaccatcgtgacttgtcatacatacttgtactccctccatcctaaaatacaagggatttttaatggatgggacattttatagtactatgaatctgacagatttcctatccagatttactatgaaatctctcatccgtccaaaatctcttttattttgggacagagctagtacaagtttgtgggttgtccgtgcactaactaaaatcctaccaccgtaacgttagtacgggcatattactagtcatgattaagtgatcaaggacggctcggtcatgactaatcaaaagagaaagaacaaggagtgaagactcaagatgtgtgaatagtaatgttctttaattaggagatttccttctttcagaattaatacgtctgttccaaaataaatataattattaacgcagccatactttatcaaatccatacactgatgttacctttttgaaacaggatagccaaggataccagccatatttttcttttgcacataataatcatcatgcgctttaactaaattcattatgtgtaaaagagaggtcttctcattctaaacctgcacaataattagaaataagaattaatatgtgcatcaccaattcaaatcgagattgaaaaaataattctattcactaatacacacatgcggctaaaatgaacaggaaggtataggttcttcagaaaaatggtcatcgtatagtctccgatgaccagccagtcgtacccaattaatcatctcatgtccaaacacagacacatcttgctttggttatttaatgttctgatcgtacactatttgaaccatctcaataataaatttatcgttgtcatccgccgaagacttatcatctagtagcatttggaggaagttgcatcgacgactcatttctttgtcttttaacacgatgagggcatgtaaagagaggtgggacggcaacagtgagggatagaggggagggggaaaggagagctgacaggggatggtggggcagattggtgtcggggaggcagatcagcattgatctgggagtgcgtgggagaaaaattaccgtccgggcaaggaggagtgcctggaggacagcgcgatcctcttcagtacgttaatagcggaaaacggaaaactagatattcatgttggtagtttaacagaagggttcacttttactttttggaattcaatttaggctctctcttgaagagatgaatttttccacttccttcaatttaggaaacaaaaacaaaattttggggtgggttattcacattatgttggtgatgctcttagaaagaatgcgaagtacccgctgcctcagctggcatatttttattatgtcccatgaattcaaataagagtgacctcgttgcttgaattgatacgtttatacctgattttcttatctaatatgatgatatttggtgagacgatgtcacgccctgaagtttcccctttccgttgttttaaaaaaattgtttaataaatcgtccgaagaaattgttttaattaacctggagctaaatccctaagtaataaatgcaattaataattggaaatggcattgtgcgatttttcttgggttccacatgtcacaatacactaacaagatttttagtggaattttcagagccttaaaagtaattttaaccaattaaaaatgagcaaatgcaatatttaatcccaggaaaagtctttttcctttttctccatttctttcccttctttttccttgttgggctgtcggcccaacctccctccagtgcgccctccttgctgggccggccccctccttcccttcccctccccgaagtcctccctccctccctctctctctcgggcgccgacaggtgggccccacctgtcggtcgtccctaacctcctgccgcccacgccggcgccccacctccccacgccgccaccgtttcccgccttatccgtgcccccacaccgctcgcaactcgcgcccacgtcgccgcccacctcctccacctctcccgcgcacgcgcgcccgtttagaggccgggattcggtttgaatcccgtctctcctctctctctcttcctccccactcccccacgtcgccggtgcaataggggccatccccggccacgtcctcccctccctcatccataaaagcactctcccgagccccctctctcgtttcccccattcgccgtcccctccagcaccctctaccgccgccgcatcaccacacctgagctccgccgccgcccatctccggccgcgcgccgccgccgctatagccgccgctgcgccacgccaccgccgccgtcgtgctcgccagtgccgctcgctcctcggccgccgcttggttgccgccaatcacccccgaagccccgtttccctcgctcgccggtgagctctccattttcatccatctccggccggccactttggtcatcgcggtcgtcctctccatccctaactcctctcctccccttctctaggtgtcgccgccgcttgtccgaacctcctctcgccgggtcatcgtcgccgccttcgccttccgctccagccgccgtgtcgccggtggggcctccctccccttcctttcctcccccttcccgcaagcgctgagccacgccgctgcttcggccatgcgccgccgcctttcagctgtcgccgccgcttcctgcgccgcgggtcaccgtcgtcggtggccgtgcctcgctgccgcctcgccttggtcggccggtcggccttgaggccaagccgagcctagccggcgcctccctttcccttccccttttttgagccgcagccagtggggcccgcatgtcggcaccccctccctctccccttgtgctgctgacaagcggggcccgcctgtcggcgccgccccccttcgctgacgtcagccctgggtaatattgcgcaataaaattgattaaggatttttctttagtagtaaaaacacagtttatcttctaaaattcataagtaattcatccgagctccgattaagtctattcaagtctcagtaaattcataaaaatccctagaatccattaaaaatggttttgttcactgtttcagtagtcttatagtgtgttttgcttgtgtgctttgtttgtcgcgtagatttcggcagtttcgtcgatccgcggtttctcgaagacgttgctgtggtctcatcagtgcgagagcaaggcaagtcatgcattataattgatcatattgtacccaatttataaatatcccgcatttctattaaatgttgcattcttttacagtgtcatgtgggatgggtcccactacttagccatttattgtttaccttatgccattgataacttgggtatcaaaatgattagacgttcgtttaggaaatgcttagtcatgcttagctcaactagtacagaaatggggatcacattattacatagactttgactattagcatagttttggattggtgccaccgcaatggtgttagttaattaaaatacactgaatggtgggctgtgggtgcatggttttgctagtcgcacccatggcaattaaggactggttcacgggaaaccctgggagacttaccgtgcttaccacaagcgggagtgggtaactgcttgatctgaagtatagctcgaccctttcctaggcaccggtggcgagggtgggcgtgatggagttgggtcggccgcggtgtccggttgtccagctgccggattcaccgcggtgcaagaggggaccgcccactgcccgttgggggtgggggtgaaaccttagtgtggtgtggatggttaggggagggttatgcggagggtcttgtcacgatttccccctttgcagtatcacggtgatacttcggggcatggcgacatgtgtggaatcgtgtcttgtgggtacagttgtacacctctggccagagtaaaactattcgaatagccatacccgcggttatgggcgatcaaccagattcactgtgattagtctcacccgtagtttagtttaatgaactggtgtagtacaggtggttggttgggcttgttgcaatgtggtgtagtgttggacagtgattggttaatattgcttaattaccacaattgttttaccgctttcaactactgctttattgcaaaggaacccctagcctccttcggttatatcctgcatcatacttcctcttctggtatgacttgctgagtacagtgtgtagtactcagtcttgctctcttttcccccacaccagagctgaagatcttcctagtgggagctgtcttgtcgaagttggtttcgtcgctgccgtcaaggattgcctgtggagtggagtcgccccgctacaaaactcaagcttccaagtttagctcgctttatctttttccgctgcatctgtaatcttttatatttttgtaagatgtggatctgtatgtcaacaattgtcgtttgtgtaccctagctggtcctggacaggggtttaattcacattcagcttagaaattctggttcgtgaatttctgggcgtgacaagttggtatcagagccgaccttgaccgtagttcaagccaactggaaaccctaagagctttctgaaccccttttcatctgcatatgctctttgcacttggatttgtttcgggaaaatttggggtttgttctttgatttttgggaaaaatcctggtcgttcattcggatcggatctttaaaattagataagtctagggttttagaaaaattttatttggagtattcgacagtcagtcggggatatatcggatgagatgcattaggtcatgtctatgttcgatggggcaattttatgcacatcattttccatgcatctattttatgcattaatttattgtttagttagttacattagtgtctttatctgggattaggaaaaatgttctatgcataaaaatcatcatgcttggttatttatttgagtcaattgttgttttgtttaaatgtggatttgagcatgcgttgattcctatctcttgtctatcttaggtgtcagacctgtttctcaatcgcaagcgccgctccgagcttcagagtcatcgcccttagctttatcgtcttcttagtctgtttgcttgctagtttccgtattttaggtttgttgcttgtgggttagtcggcggtcgatattatgtgtcagtggtatggctgcctgtcacgcccagaaattcccgaatagaattccaagcagaatgtgcattaaaatccccatctaggacaggccggggtacacaaacgacaaagttgacatacagatccacgtcttacaaacattataaaagtcttacacaaatgcagcggaaaacttacaggataactgaagatgagcattgacagggaatgaagcgggggcaccactccacaggcatcctcgatggcacggacgaagcctactcctcggagaaaccaccatctgacgcatactcacattctggggtttggggaaaatagagcaagactgagtactacccactgtactcagcaagtcataccggaataggggtatgatgcagggaattatcaagggatagctataatggttcatttgcataaagcgggcatttataaacagaagatgaaagcagtaaaacagttgtaataattaatcaatattaatcatccactgtccaacgctataccccgttgcaacaggcctaaccatccacctatactattcaattccattagaataatctagggtgagtctaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgagcagtcccctctcgtgcctaggtgaatccggaagccgcataggccgtcgcaaggcccatccaaactccatcatgcccacccttgcctggatgcgtcggctagaggaaagctacactacaagcccagccgttgcccacgctggcttgtggtaagtacgaggaattcttccagggtttcccgcgaaccggtccttaattactctgggcgcgaccatcaaaaccatgcacccatggcccaccatttaatattaattaattaacaaacaccggagcggtgagcattaaccaacatcaatcctagaatctgatatctatgcatttaatgtagttccccattgtgtgctagttgaactaagcaaagctaagcattccctagtccaatctctagtcatgttatatcccaagctaacaaaggaacatggtacaagatagcatggctatgacagtaggtaaacatcccacggtgatattataaaacaacgtagtatttgaagaaaacaatggagcatttgcaatataggatcaacatgttaaagtgacaagcatgacttgccttgctctgcagctggaggaacttcggcgactatttcaaggtacaccggagcgtcgggagagccgaaatctaagcgacatacaaagcaaacaatacaaacaggctataagactattgaaacagagaacaaaaccatttataatggattctacacatttttcttgatttactgagacttgaatgggcttaaacggagctcggatgaattagatatgaattaaaacacttaaaacagcaggcaaatccttattatgacagccatatcataggcacatgatatcgaccgtcgactaaccctcaagcaaacagacctaaacacacaaactagcagacaaaaactaagcagtcgataaactaagggaaagcgagcctaatgctcggaacggctcctgcggtcggtggagtcgaaggcgtcctcctgctcgtcaccaggtccctctgagcggctcctggagtctggcagatacgtctcgccgctgcacagctccgagccacttgaactgctgctgctgtggtcgcggttgccactgggagtagcaggcaaccaacccccgttgccactggctggacccctgacggctgatgctggagcgaaggagagagcggacgcgggagctgacactggaacaggagctgggactggagctggagctgcaggagctgcaggaactgtgggaactgcgggaactgcgggcggaggtgggttcctgggcacaagctgaatgcgcacgggtgccgtcgtcgacttgcggggcgtgttgcggatccggactcctccgggaatggggagacccttcaactgagcattctccttcttcaggcgtgcgatctcatccttcagagctatgatcctcacgagcttcccatcattcaaggccttagacgccttgcgcagatccgagtgcatcctgtccattaccctcatcacggcacacatatgaccaaaggtggtgtcgttctcgccggctgtcggacgaaaggtactgacgtcatcgccacttgctcgacgagggtgaaaccggtacgccgtgttgcagaagatgtagttgtggcgctcccatagtctggccatcatcaggtatgctgcctcttgacaggcgtgatctgttgtgcctccggatgcctcaaccaccatgttagcgaggtaggtacccacatagccatgaacctccaggcgaacacggtgagggaatgtcacgaccggaaataacccaatgggcgttccttacgtgcatgtattattccttgtcccaggaggcaaggtacaccaaaagttgatacaatacagagtttaacaagcggaagcgtaaatagttaatttattacatgggcggcgaaggcctagcacacatgaagacaaacgaaaaacagcggaagactagggcgacgaccacaggcgcttgatggcaggcacgagctagacaccaaagccttcatcatccaggaactcctcttctgggtttgggaaaaattgagcaagactgagtacaaccaccgtactgaataagacacaccgacaagtgcagaataaatgcaagggagtacaagggagtcataatatagggggttagggtttgcagtaaacagcattaaaagacacttagttgctcaagctatttggtaaacacgatcctagagatatacaagattattaatcaaggccgtgaacccacacgaacctgccttaacccaaggcctacgatgattcagaccgaactggcaacccgaccctgggtcccagctcgtcccaagccaacccaggccaaccattccacattttagttgttaagtaggttttaagaattaaaacactaacttgggtacattgctaggcttgcccataaccgagggcgcggctattcgaatagattatactctgatcaaagatgtacatctttacccacaagacatgtcttcttcacgtgtaaccacgtgccacataccaccacggcatacggacggaagacatgacatagtttccaacccatcctagccatagacaagagtaccgacccaaccccacctacggctggaacctccgagacaggtaggcaggactgagcccctagcagcaggacaccagccctgtgccatgacatctcgactaccgggccgaagctcgtgtagccttcatttgccctagagatgtccatcgactcccgacttcgtccatctccatccgtgtacttttgtttataaccagactgagccacaaactaagccttacccactagacatgtggaagtacggtagtgctttgcaacagaggcccgaagaccggtccttatgtggccaaggtgctactatcaaaaccatgcaccccgagcccagcctaaaaccattttgagggttttgaatagagggggaggtgtgaatccaattccacaataatccaaccattccatagtgtccaggtgatatgaatattcccaaagtctagagttgtaaaatcacctaatgttgcctaattaaacagcgaagcatctacctaaattcatactagtcgtaccatgaatagagtatccactagttggggttttgtttattctagggtgaacaaggtaataataacaataacaataataataaggtcatacaaaggtaaataggcatggctaaataaaacagtgataacgcgggaatttaaataaagcgataatgcaataatttaaatcaaaataattttataaactgggattcaatatgctcaaggatgatgtgacttgccttgctcgatttcccaaacgtcggcttcaacctccacgaagagcggatcttccaaagctgcagcgtctacacgaccaacggaaaggaaaaaggcttttactctagtaaactccatataacaagcaggaacaaagcacaaaaatgggttcttgacttcttaaggaaaaattagagacttgaacggtccaattccgagttcaaatggccaagttatggccatttgaagtttatatgctctttaagtgaatatttgcgaatttctttatttaaattttaatttaaaaaggatttattgcatcagccgaggggagagggcgcacggaccgggtccacgggagtggggcccacgcggcagcctcacggtccatggtggaccgggcgcaccggggctcacaccggccggcgccgtgggccccacgcgtcagccgcacccgagggcgcgggcggctgacggctgggccccacgcggcagccacacggcgcgcccggaggcggccacgacggcgcagtcggcgggaggcggcacccgcgcccctatggtcgccggcggcggccataggcacagcggagcggcggccgagagaggggaagagaaggaggaaaagaggcggcggtccacggcttaccctgggtcgacggcgacgacaaaaaaggcggccggagcggaggaaggcggcggcgcagctcgggtggatggggacgacggcgctccagcggtcggcgagctcggcgagggggtggacggggtcgacggcgctgcggcgaagccggaggaggcgacgccggggcgggagacagtcccagcgagcggaaaaggccggccggaggtcgtcggtgacggaggagagagagggcgacggcgcgagctcgattccggcggggagacagcgcgccaaagggtggaaacaggcgaaggaggcgcggggagggtttaaatagggttggaagggggagagggcggccgggagaggaaggaaaccggccgagaggtccggccgccatcaatggcgccggcgagatttgcggaagcaaatccggccgtttgaatgcgagagagagagggaaaaatggggggaaagggggaggggatcacggggaatatttccccccacttaattgcacgcgggggcggcgggatgcggcggattcggcggcggcggcggtgcttggcgcgggcggggcggcgggagcggcgggaggatggggatgacgggtgggccccacccgtcagcgagggtggcgggcgggcccacccgtcagcggcgcgcgcgcggggagaaggccgagtgggccgcggggagaggagagagagagggggagggagatgggctgaaccggcccaagagagggaaggggacttttagggtttttctttttataaaacctttttaactttgtttatttcttaacaattataatttgtgctctgaaaattccactaaaatttatttacacattttaggcttttaggaaatatacaaaaatcctctaagccttatttgacttttactctgcacattttaatttttggaggctttcacacggattttaattattctaggcataatttaaaggatatattttagggtcgttttgggacatgacagggaactcgccactgagcggcggaacagtcgaatactctggcgcattggggtagtccaccaccagtgtcatgcgagccaactctgccacaaagtcatccatgccttctccgcgatggttgagtgggtgatcggccatctagagaagacaaaggggtaggatcaatgcatgctcaaatccaatttaaatgaaacagtaaaagactcaattaaaataagcgaataagagcggaattttatgcatagatcatttttgcatgaaggcgaataaataagacgaacttacatagcgataaaataatgagaaaattagatacatactaataacaataagagcataaataccttgcaacccatattcctgagttaggacctaatgcattcctcccatcaaatcccgactgactgtcgaataaatcccaagtaattttactaaaaccctagactgacctgatttggcaaatcccacttaaacgggcgaccaaaattttcccttgcaccacaagaacagatcccaattttcccagaacaaatccaattgcaaagaacatatgcaatgaaaaggattcagagggctcttaggtttttctatttggcttgtcctacggtcaaggtcggctctgataccaactttggatgtggtgtagcattgatcagtggagatctaatttactttaattactcaacagttttactgttttgctcaataaaaatgttttacaaccgcctttatgcaaatagccacaaaccgtccttgtgttccccttgcacgtctgcatcgttggtgtggcttgctgagtatggtggttgtactcagtcttgctattatttcccccttttcagaagtgtagtgcttctgagctgaagacgaagttagaagaccgaggctcaagaccccagttgagttttgcctgtggagtggagctgaagccccgctaggatcgccttttccgctgctgctgcttttgtttcggtgtgaggactaagtgcctcttctgtaagcaatttacgctttatttacgtttggaactatttattacttgttgttttgtgtaccctagctggtcctggacagggatttaatacacaaaatagtctggaaatttgggctaaatttctgggcgtgacactgccttaattaggagttgtttgcttcctttttcaatgttttaatcaagattaagataattgcacttaaatttataagaaagattagtttctaagcccctgtttttcttccttttctcatatttctacctatgccccttcagatggtgaagacaaggaatggttcccatgaatccaacaacgccagtggcagcgaagaatttgggaaaaaaaacttgtgataaaagagatgagaaagaaaaacatagaaaattatatgaaaaagattagaaaacttagttaatttaaattaaattaagtaaaacaaattaaatatttttttacaactttaaaatgatggggaatgaaaacatgaataatttgtggtattatttgataatctaatttgattattttgaatttggaaaaaggaaattgtgataaaagagatgagaaagaaaatgaattaaaattattgtaaaagaatagtaaagtaagttaatttaaattaaatatttatttacaatatttatgtggaatgaaaacatgaataatttgtggtattattttataataattatatataactattgttaatattgtttaattggtttgaatttcgtggattaatttttcatgattttgtgcttttcatgtagatggatcggcaatggatgcgcgcggaccgacggtcaaaagagtttattgatggcttgcataattttctgaaagtggcagaagctaacaagaagaataatggttttatccgttgtccatgcactaagtgcaaaaaccagagagagtattccacagttagaactattcgtattcacttgttcgagatgggcttcatgccgagctataatgtttggacctcgcatggggagcaaggggttcaaatggaagaagatgaagtagaagacgagaacattccgcactaggctcagtacggtggatttgaaggaaatacaatgtgcgaggtggaaggggctgacgttgaagatgatcttggtcagatgttgcaggacatcaaggaggactgcgaaagtgaaaaggaggcttagaaattagagcgtatgttagcggatcacaagacgcctttgtacccaggctgtgaacaggggcacaaaaaattgggtacaactctggaattgttgcaatgtaaggccaaaaatggtgtcagtgacaaggcatttggcgagctattgaaactagtgaagaacattcttccagaggaaaacaagttgcccgaaacaacatacgaagcaaagaagatagtctaccctctaggacttgaagttcaaaagattcacgcatgtccgaacaattgtatcctctatcgcggtgaggagtatgagaacctagaagcatgcccagtctataatgcactatgatacaagattagaagagatgatccaggtgatgttgacggactgccttcgaggaagagaattcctgctaaggtgatgtggtatttccctataataccacggctcagacgtttgttcaggaacaaagagcatgcaagattgatgcgatggcacgcagaagaacgtcaacaagatgggatgctgagacaccccgccgatgggtcgcagtgcactacagaatccggagcattcaggacgaatgcgaggaaaaggcctcgtcccttggaaactaggattcaaggaggacagccacacgtacagtagtcggatcaggagcaagagagacacggaggcgaagatcgtagacctggaatacagggttttgttgcacgaggccaggatagaagaggtggtaaggaaggtggacgaacgactggccgcacatcggagccaggaggagcctgtaatggtcagtccctcaggaaatcgcagcagttgcgcctctacgggataggttggatcatagagcatggaagcagcgctaactcaggaagaaaccacctatcccgttgacggaatcaagcattggacatcgtgcgagctgcatattcccttcaggaacttgaccatcaaggtttgctcttgtacttgtatacattccatatgtcgttgcacacatagtttgattactaatttataacctctactgttgacaaggtggcgtcgggcatggccatcccaacggatccgacagggacataccattgcaggccgattccacctgggtactccaaggtcgaaatcgagcaagtggaagccacctaggaggatctcgagttggagatacctggagaggatggggagatgaaactaggagacacaagccatgccatcatactatggtgcaagcgctacatcgtgtttcccgattctcgatcccctcctcctgcaccatcgcctccggctcctccacctcctgcatctcctccggctcctctgactcctccatctcctccgcctcctccgtctccgctgcaccgtcttcgcgtgctcctccgccacctcctccgcctgcaccctccaagactcgccaagctgcaccacctcctccgcaggcaccttcgaagagttggcaagcaacaccacctcctctagcaaagtcaaggtcccgccaacctcctcttgcaaagacgtcaaggccgatgtagaaggccaaagttgaaccacggctgactccctatacgaagccatacttgtgcacagacgaggaggttgacgccgcggtgaaagaggacgtgaggaagcacttcaagcctcggagtcctgaaaagaagattcctatagacccgaagaccaagaagttcttccaaggcagttgtttgcccagatctttcggtaagttaatgataactatgatttgggagacatgttgacgatccgactataaccgtacaagaagttgcgttgcaccttaccgatcgatacacctttccgtgggttgttgatcttgccagtgcagatcaaccttattcctgcaagcaaatcgaagaaacaagcaataacaagataaaagcaatcagatattgcaaataggaattgaacacaaatgataagttggggttacgaagaacaggcagacggacggtctagccgacacgcgtgctgcaagcaagtagcaacggctaaactttaatctaacaaaacccaagaaaccatgaaggggtaccaagctatttatggagatgggaggaccctaggtcgtcctctacctggttgaggcgcaccccacatgggccccacttgggccaggttcccagacgaagttacaagcccataggtattacaagagacgcaacacattgttccttcaattgcacatgactgacaaagaatttggtgatgaggtggatcgtttggaaagaagactccgaaagctttccatcgagtactcatgggctgaaaacggaggtcgtatgtagattcggtggccgtttgaagccagttgtgcagcagggggtcaaatcggattccagcacttggagggcttgaacttgatatcttgttgttcatccatgatgtaagcaatggttgtatccatagtagccatgatcacatcatcctccccttcttcatagaaaaccgtcctcgatttttccatatggtgctcatctcatggtcgatttaaaacaacctgtttcatccaaacaaaacaagacaaactcgaagtaatatgataagaaataacatgtctctctagcttgcaagttttatccacatgtataggaggttctaaatctgaacatatataaactctatgcaccaaatatatttctctatcattatattcaccaaagatatgaaaaatagcattagttggtcatggcaaatcagatttagcaaataatttcgccttcaaactatcgagctcacaaaaatcatcacactgaatatagcccaaagtatttaaagaagatgtcaattcacgttcctctacttcattagcaatgtgaataacatgcttaaaatcatcacataaagaactagtatgagaaatagcatgttcgttcactagttgtggcattgatataagtgaagcattatcacacaacacttctttatcacaaggaacagcaaacaaatcagtttgtgacaaaggaatctcagcagttggttccactaatggttgctccactttagcatgaaaagtggataaattcaatttattaacaacacactcaccttgattaattttagcaccattaagtttacctttgatgccctcttcagatggtggaggtgcctcgactttgagtgtgaacaatgggattggcggttcatccatgcctttgtcctcttttctatcattatgcacttcctgcaaatggttagtaatagaaggcagaaacatagcgtattgctttttcatgtcctcctctatttgactttcagcattgcaagcaagttgtatcaaataagaaagagatgtatatctttgacaatcaagcatgtcctgaatttctttgtaaagcccacgtaaaaacatcaattctgtagcttctttgcattcatctaaaccacaatgtaataaacaagcatgcatatcatgatagtatgaagtagcagttctgttatcttgttttaagcattgcaatttgttgagcaaaatgtcagcacaatacatgtgaacataaacatctctcatatatcgtttcaggtctttccaaggttatggtattttattatgcctacaaagatgtttccaataaaaaaagcatttttaataagaacacgagaggcactgtcacaccttgaagttccctaccttgctttaaattcataaaataaatcatccgaagaaattgttgtattaacctagagctaattccttaattaataaatacaaagaataatcggaaatggtatgtggaatttttcatgggttctacatgtcaaaatatgctaacaggatttttagtggaattttcagagccttagaagtaattttaactaattaaaagctacaaagtgcaatatttaatccctagaaattcctttttttcctttttctttctttttccccctttttccccctcttgggccgccatcccatttcttcctgcgctgccggccaacttctcccttcccctcccgaagtccacccagcctccctctctctctgaggcgctgataggtggggcccacctgtcggcccttcccctacctctagccgccgaaggagcggcctcctcaactgctgcccgcctctcccgcgcgctcccagcctcgtcccccacctcgccgcaccactcgcccatctcccgcaactgctaccccattcccgcccacgcgcgcgcgcccgcaagggcgggattcaatttgaatctcccccgtctctctctctctctccaccccacgtcgccggcggcatttcccctctaaatccaggcagttcccggccatgtccgccctccccgcgcatataaaatgcaaccaagcgtcctcctctcccttttcccatttttgccgcgctctcctacactctctaccaccgccgcgccgtgcaccgctagcgccgccgcccaccgccgcgcaccgccgcctccggccgcgtgctaccacctctatagccgccgccgcgccgcgcaatcaccgccgtcgcgctcaccgagccaacatgcaccttggccactgctcgcttgccgtgcgccgccgccacatcgctctcaccacgcaccgccacccactacttcctccatccgccgctagccgcggtttgctccaccgtcgtgccactccattgccgccgttggccttgcgaggtcgagggctgcatcgtccacccgctcgtctcgccgtccgccacttgccgccgtcattcgtcgtcgcccctttccgcgccggccaaccccacgatgagaactccctctcctccctctttctctctctcccgtgttcactgccgtccactgcgcgcgcgccgtcgccttccgcgccgtccgtcgccgcctcctgtgtcgccagttgccatcgccggcgaccgtgcaccgccgccgcgtcgccatgcttggccggccttctttgaagccgagtgtcacgcccagaaattcacaagtaatttccgaacttatttgtgcataaaatcctcgtccaggaatcagccgaggtacacaaactgacaatttaatatacaaattcatcaaattaactaaaacgataaatacttacttaagaggcacttagtagcggaaaataaaatctagcgaagctctggctccactcccacaggcagctcaactgaagtataagccaaacgtcttctccttcgcaacttgccttcaactgaggtttgattgattattgcaaggtgagcatatgacatactcagcaagccacacagcaaatatgcaagtgcacaagaataccaaaggatggcataatatagggctcatttgcaaaagcagcatttagcaaacatttgagaattgtaaaacagtagagtaattaatcatcaatattaatcaacactgaacagcacacccatgctgcacaggcccaaccatcctgaacaaccatacccggctgcacagatctatctccaaaccaggaatgtaccattccaaactaggagctaaattaattaccatcaattaccacattatttttaatgagtagtgtgggactaatcacgaaagacattgttcgacccgcccataaccgcgggcacggctattcgaatagtttcactctggccagaggtgtaccactgtactcacaagacacaacccaccgtcatgtcaccgtgtccgcgcagacacgtcaccatgacgagtgattatgacaagacccctcgcataactcaatccaaagcagtgcactattcccggatcatagtcacccccttataaacaaggcatggactccccagcgacccccgtgggcttatctccaccacttctcagtctagtgctccgcagggagccttgttatacaaagtgtccagccgttgcccattctggcttgtggttggcacggtaaatgtttcacaaccgaaaatcgtgaaccggtccttaattgtcatgagcactaccatcaaaaccatgtgctcacaacccaccattatcaagttttagttggcacattaattaatcaaccaatcacgattgaccatcgtgagctatcattaaaccatcattaaataatagtgaagcattagttatcccaattgtgtgctaatgtttctaagcatggctaaacaattatgtctaacatctagctgaaccaatatataaagctcaactagtcaaattataataatccaaggtatcaaggaatacagtaatcaatgcaaactggccttaacaacggaataagttcacaccacccggtgacattcgaaaataaatgcacagttgaaataaatagagaatttaaatataggatcaacatgctcaaaggaattgtgtttaggatctgtgtgacttgccttgcaataactggtcttcaaataatcttctcgaacacttccggcgcactcgcgaaccttcgaaacgacggaaacgacaagctaacacgcaaaacaaggaaaaagactaataaaaaccaaataaacaatacatataaagtaaacaaacatgtagatcataattttagatgaattatgagacttgaacggcctcaatctgacttcatatgaatttattacgaattttacaagattaaatctaattaaagcctatttaaaaaggattaaataaatttagttcaatttatggataattttaatatgtagatctttattttatacaacttttgcaacttgaaccacattaaaccgagttacaatgaattagttatgaattcttaaagattaaaccggattaaagcatttatatggattttaattgaattatgacgcaataatgaattatttttgaaaaggaaaaaggggattattgcgtcagcgggtcgggttcaaggtggaccgggtgcacggcggcggttcacggaaatgaacggccggaatcgatctatccaaatcggacggccaagatctaaacggtctacgaccgatctacggcggacggcgtcgatgacgtcagcggtgacgtcatcaccggcgacggctcggacggtgcatgctcgccggagaacgatggcgcggcggcgcaaacagagggcaccaacatgatgcgggcatcgaggcgaaccttaccgaggcacgaacggcggtagacggcaaccggacggcgacggcgacgaggaagaagcggcagcgaccttcggcttgacgacgacggcggggctccggtgatctacagtaacgaaggaggggcggacgaggtcggcgatgacttgacaatcacgacaacggctttcccgagcaacgacgacgactggagcgacggcggtgctcgactaaactcgcgatggcgacggcggcgcacagcttgacgcggaggcggcgctacaagcgacggcgggctaaggcgaaggtggtggcggagagaggaggcaccgggggtccttttataggggctaagcggcggcgacgaaggcccatggcgatcggcgacgagaaggaaagattagggttcagggagagagacgaatccgattcgaggtcgaatccacggatttccaaacgattttagccgacgattcaaaaagagaaaaggtagagtgaatctcggggatcattttccctctatcaatttcaccggatcgagaaagggatgaacgaatttggaagggcggcggcggcccggctcggctagggttcggccgggcaacggcgcgaggaagacgacgagtctgacaggtgggccccacctgtcagtggcgagggcgcgcgcggcagcgggctgacttgggctggggagagagagaaaggttttgggccgactttcggcccaaagccaaaaagaagaattttaaaaactttttcaatttaaattattcatgaaatgcaattccatttattaaaaatacttccttggctcaaataaatcccagaaaaatctaggaactatagaaacaagagaagtatttaacaaaattttatctagcccacttttatattgagatttaacaaattaaaaaaaatcttcttttttaggtttttaagattatttctaataattccttttaaacaacaatttataacttaaggatttttaagcaagcaaaacatttaacataattataattagatcattaattgattaattcattgattaactaattactgaaatattctttgtatcatttaagaattgagctctgaaaaatccgagaaaatttcagagagtatacttaatcacagagaatttaataaaaattaaattcatccatgctttatatttaggaaattttatttcccacatttaacttcacttgtaaattaatgaacatttaatataaattctattaataatttattaaataatttataaatcctaaaacgaaaattcaggctgtgatcggccaagcccgacggctgctccccgcgccgtccgattggcggggaggccgatttgggccgtcggtcctgtggaccggaggtggaccacccgcgtggtcccggtccacgttggaccgggccccttgagccgctgccggttggggcccgcttgccggcacctctcccctccccttgtgtcgctgatccatggggcctgcttgtcggcgctgcttcccctacttgatgatgtcagccctggaacatattgcgcaataaataattaaggcattttcttttatagtaaaaaacacagataatcttctaaaattcataactaattgatccgagttccgtttaagtccattcaactctcagtaaattcataaaaatgcatagaatccattaaaaatggttttgtttcctgtttcagtagacttatagcatgttttgcttgtgtgctttgcttgtcgcttagatttcggctgtttcgtcaatccgcggtttctcgaagacgttgctgaggtcccatcagtgcgagagcaaggcaagtcatgcattacaattgatcatattacacccaatttacaaatgtcccgcatttctattaaatgttgcattattttacaatgtcatgtggtatgggtcctattagtcagccatatattgtttaccttatgccattgataacttgggtattaaaatgtatagatgttggattaggaattgcttagccatgctgtcagggttatggataccacatacctaatagtagttgactaagctcgacggggcccaccatataccaagtcttgtacggaaacataccttgtatatagaaggagttccagataaggaatgacaaatagagttctatatggaaatgacatggactacgcagactgtattcatatttgtctccctagttctacttggacaagggatcatgtatgggtataaatacaagcctcctaggaggagaggagagagaccaatacaagccgcaaagccgatacaagccaacacacaccaccaaatatcgacattagagattagtctagacataccccatcaggtgtctacgaagatcggcaagagggatctagcgctatctctgatctcgacgagttcatactcgaggaggaagactaccatgtcatcgactacaagttggttatctagccgccaagtcgacgacagttagataggttatcccaattattgtactcggtggtatctatatcaatcctatataaacaggatgtagggctattacctgtcagataaggggctcgaacctgtataaaaatccctgtctccatctcttttacctcaatctcgcatataccctggtaccaacgatccccataccatccaaataccgtagtcatgatctcaaatgtcgacaatggcgcgacaggtaggggattttggtgcttcaagatttcgacgagatgggtttaagagatggattctctaacgacaagctactcgacgactccagctgtgggaagatctaatccgaccggagtatgtctcccgacgagatcggaatcatcgtcgtcaacaatttgactatcaagatcgaccaagtttcaagacgtcatcaccgtggaggatatcagtacaatgtggtctaccgtgaggccttgctccggatcgactacctttgaaccgacacccaccaccgaaaatccgacgaactactgtcctcgaacgtcctcgccctcgtcgtcctcggcaacttgagactagtcggcaaaaatcgccgcctcgtgtaggagtcagaaccggagctactagtccaatcctattcggtgtctgtcattgcatgcaggagccggtgaaaaagccgcattgcagtgcatgccatgtatggcatgtgcactttctctgtttccgaggacaacacaaggacaaatcaggagagtttaattactattatttgttggattcatcgctagaagcaaaaaagcaaaccagggaacgtatacaaggcaagtgtgaacactggtaattggtaggttgatttttgaattaatctagtaatttcgtagatacatccggtatgtatctataaaggtacgcaatattttatatacaatttactgtaacaattttcagatcatacaatattatcatatttataatttattatgtttacctagaacatgttttttaaacgatatctatatgtgagcattccctatattaggccaacaacggtttaatactggggctcgctttattttcttctgtataaatcatgcttgtttacggtttacataatacctcatatttaatctgctcattatatcctaataatactagaagattcatgtagttttttgagtacatactcgatattctctactatatatcttgtcatctagaaaatatttttcaggaacgattgagcactcgagtaggatgtggtcgagtacaccgcattatcgagaacgttctcaaagaatgctgagttgtcacacccaacctaccaacgaagactgacgacttatctcatgtatagcgccagctacagctggactatttgagaaaatgttgttaacggataattcctcgcgaacgttgttggcttgatcacccgacatgattgcgagtaaacatccagatgtgctatatgttgggtatgtgagtcatgctagcccatgagatgcacatgtaatcaccaactctagcgcctcttcaggtgatcgagatacgcctac

SEQ ID NO: 5770 - DNA, 575 bp, Oryza sativa
aacgtagcgatcctcgtaccacaacttctaatggtcgaagatacgactatgactggtcttccactggcaacgtagtgatcctcgtaccacaatttctaatggtccagatatgactacgactggtatcccatcagcaacgtagcgatcctcgtaccatgacttcctatggtcgagatatgactacgactggtctttgatcggcaacgtagcgatcctcgcaccacaacttccactggtcgaggtacgactacaactggtctttgactgacaacgtatcgatcctcgtactacgacttctaatggtcgaggtacgactacgactggttttccaccagcagcgtagcggtcctcgtaccacgacttccaaaggtcgagttatgactacgactaatcctcgaccagtagagtagcagtcctcgcaccttaatttcaaacggttgagagactcctactcctggttctcgaaccagtaggccgtagtgatctctcataccatatctcatacctccacttcaagtggtcgagttatgactataactggtcttcgactggcaacgtagcgttcttcgtaccat

SEQ ID NO: 5771 - DNA, 602 bp, Oryza sativa
tgtttccactatgggttgctctaatgtagcacaagtagtggacatagttggcacatcataattatgcataccttgagtagttgtagcaccattatcattacctttttttcttatcttcagaaattataggcacttagtcaattaaacattcctcaagtatgcatgaaactatggataggtctttttgctctccatctttcttctcttcctcctcatcatcttcaacattggaggtgctgatgtagccatcttccgtagcaacgtatgcccgttgactagggcaaaccttctgcatatggccaaatccttggcaatggtggcactgaatgcgtcccgttgaagcgacggatgaggcactcttggcgggtacctgcaaagaacttgtacctaaatctgcaggtcgtggaggaggtggttttggcgctgtagaaactccagacgcaactggttgcttgcacgctggtgggggcgcccagaaagagataggcttgggcagactcgaagatggcgtcgtgcgcggtgtgtacgtgttcgtcttgttcttgacctgttgatcatgcccctgtaattccttctctgcaagcatagcaaactgaaacaac

SEQ ID NO: 5772 - DNA, 4803 bp, Oryza sativa
tggacatgaggtgattaattgggtatgattggctggtcattggagactatacgatgatcatttttctgaagaacctataacttcctgtttattttagacgcatgtattagtgaatagtattattttttcaatcttgatttgaattggtgatgcacatattaattcttatttctaattattgtgcaggtttagaatgagaagacctcttttttacacataatgattattgttaaagtgcatgatgattattatgtgaaaaaataaaaatatggctggtgtccttggactatcatgtttctaaaaggtaacattagtgttacgtatggatttgataaagaatggcaatgttattatttttattttgtattgatatgtgtgagttaaatgaaaaaaaatattccgtaataaatttgtttttagctccatttatttgtctttataaacggttccttttatttatcttcaaatctatagttttgtgatatatcttattaaatatgtatatttttttataatctgaccaaattacttagggcccctttgaatcaaaggatttatgtagcaattttataggattcaaatcctataggaaatttttctatttggccctttgattcaaaggattgaagctttccaaatcctatgaaattcctatggaatgacacattgcatgtggattttggagaaaatttagcaagagctccaacctcttggaaaatttcctttactctatctctctcatccgattcctacgtttttcctgcgctctaatcaaacgaccattcctgtgttttttctatgttttgcaatactctgttttacactttaattcctgtcagaatcatgtgtttttcctattcctctgttttttcaacactgcgatttaaagaggccatatagttttattaaatttactctaacttgttttttcgtgcgggaatacctctggatgactgatgacgtcagatcacctagaattgtcgataattaatgcggtcccttttcccgtcatgatatgtgaatagtgaaatctcaccgttcggtgaaaagaacatcagtacttcctccgtatcgtaataagtttatttttattttatttatttcaaaataagctcattattaaataatcattacatcggagtttataagaatataaataattatattgtgagaagataaaataaacaaatagttgtaataaaatttgataaaatagggaaaaaataaatttgtttttgaactgaggtattaattctggaagaaggaaatctcctaaagaacattagtattcacacatacctttcactccttgttttctctctttcgatgagtcatgaccgacccgtccttgatcacttaatcatgatacggtgaaaaacatactagtccacacgagttcaagggggagttgttgaatgcttctccgtcttaaaataaaatcatcgttaatcctttgtcctaaaaaagaattaactttggaattatcattccttcaaagtttataaaaacagaaaataaatatattgaaactagataaagtaaagaataattgtatttggatttaacaaataaggggtattttagttttttttaattttgtgttgatataattaggatgaataaaaattaagaatattctgagactgagagtatggagtgaaagggtagcttagctatgaacccatgatcactactagtatttggagattttaggagtactgttatacgtacgattcagctgtataacttactagaaaagtgtccgtgtattgcaatggtaaaaaaaaagaaaaaattgaggaaaagttgagaaagataatgtacattgtgtaattaattgaaataccaattttccggaatatttgggtattttttaagtacgtagtagtataattaaattaatttacaagcaaagtaagcgtgagaaaattaaccatgattaataatagtctttgaaaatttcttggaatttctagaacttaattgctaattttgataatacaaacatcatctttatttaaataaatctaaataaaagtccacatttctcttcgggtcattttccgcccattttcttcttcagcccgcaaccgagcggcatgctttcctctcttctcctcccctccacctcggtccgcaagcaagcgtccagcccaacgtacaagtctaattagtcatcccaactcctcctctcactgtcgtgtgggccccaagcaaaattctagcctaagcgttgtgttagacccgctagcccgcgcgcggtccatcaagcgtgcatggcccagctgatgctggcctgacgtgggatcgatctgagccgtttgtttttgatggatggcttagattggttccaaatcaatcaaaaccaccggtacaaaaaaaacctaaccctaattcattttccctctcccacttcccccaccgtcggctgcctctccctgttgcgccgcctcttcccctctgctgctccctctccgctgcttcccctccgcctcctcccaccggcggcgcctcttcgcctctcctgtcctctccctaacggcggcgcagctccccatctcttctcctcccgtgttgccagcacagcgcgatgacgacaagagtacgacgcggtgcggcgacggcgggggtacggtgcagcgagggcagcaatggacgtccctccccctctccttctccctgtcggccttgatggcggggtatggtgcggtgacggcaacaggcgacgacggcggtgatgccgcttcctagcgaagggccggacggacccgcgctgctcccaccggtggcttaatgctccatgaatccagtatgtgattcgaattgaaatttcccgtccgttctcttttggataactgaaggtgactccgcgtgcaagcgccgacggatgaaaacggatgaaaaatttaggtgacgaatgcaaaattaccgattttttaagaagttaagatatacaactagagatatataatcatagaccaataaaaaagaacatgttcatatgtattgcagccgttgctcaattttaattatatgtgagtcggacaattacctggttttagtttgtcaccgtcagcattactaaagctagtcacaagttgagaagaaaacgacaccctgacgagacagcagcaaaatggcgagaaggctacatgtgtcgcgcgcggagagagagttttccgtttttttgcttttgaggagtcaagtgaggaggacgaggattttgatgaggatgagtgatccactctgtttttcctttttggtgccttgatgccaaagggggagaaccacctatcaaaaaaaaaaaactatcccctttcgtgatggctagtcgaaccttgggcttttgtgtcatgtttaaattctttattatgcatgtttatgtcttgttgaactctataggcttgaatgatgttacgtggaattatatcttatccatgcttaaatgtgtgatatatcttgtcatttgcatatgcatgaggttatattgtcatttctaatctattgcatagattgagggggagctctcctattcatttcaagcatatctttaggggagctccaccaaaatcctaatcttttattatttctaattgtgttgtcatcaataatcaaaaagggagagattgaaagtgcatctagtacccctcatttattttggtgttgatgacaacacaattagaagaaaactaatgctttttgttgagatgaatgcaaggataaaaaaggagtggaacttgagtttaaaagcattgtggcatcttttgtggtaatcgtctttctaaaccatgtatatcttgtgttcttgagagtattaggatgccgtactattaagagggataccacatgcatataattggtagaacactagtgctcaaaatcctttacttgaagtgttcttgaatttatcctgttggactatccgattttgatcagactatccgatgctcagactatccgaaatttcatagaactttgatctctgtctttggtctaagtgttggctaaaaagaattggactatccaatgacctagagactccgaaattcaatggaacttgagtctctgtaagatgatgaaattcttgcttcaaaaataacggaatatctgatatgacatcggactctccgattgatcggattgtccgaaattctccagaattttgtcctctgtctcgggcttgcttgggggtcaaaaaaaacattagactatccgatgtcacctcggaaagtccgaggtgggatgaaaagagtctctcctaacggccactttttgggggatttataaatacccccaccttttctagggttacccaactcattcattctcattcactttgggttgagtttggtgctaaggtgctttggatctttgagctctttctccctctttcaaatacctcctcgttctttgtgtggtggatcttgttggttgtggatttggtgtttgaggacctagtgtgtgtttcactcgatcttgagcactagggtttgaccaagagttgtgtggtgtttgttactcttcgaggtcgaggactcctagacggctaggtgtcactcccgagccaccgatctacgtgtggttggcagggagaagtttgcgaaggccggatcttgcctccacaaggaaagagataccccttagtggaaggaggagtgcttagtacaacctctttaggaaagggttagcaaagacctggctcttagtgaactcctcaacggagagtagaatcccctcaaggatttgaactcctggaacaactccgcgaacttcatcgttggtgatctctctatatcctctctt

SEQ ID NO: 5773 - DNA, 3303 bp, Oryza sativa
atatgacaacctcaaacaacattttcaaatactaaatgatttcaactgaaaagtcattaataaccaagtggtataactcatcaagatctataacttttatttgggtcatttcttcatcccagaaagttatttttaacattggtcacaaatgacatatctcttatataggttattaactaccagagagagatgtaattttttggggaccatggttactgtcattttgtcggatgaagaaattatcaaaataaaagttatagatattgatgagttatacaactttgtagttgatgaatttttcagttgaaatcatttagtatttataaatgttgtttgaagttgtcataatttgaaattcaaattcaaattattgaaacaaagtcatatagcaaaatgaccaaaataaaagtgaagaatcaaattatataatatcgacaattgtttacagtgaagaatcaaatattgtatattgctagaaaaatgcccgtgcattgcaacgggtgatgctagttttatacggtttagctaggatgaaattcactttgggaatttgcttggatatttttttaagaaaataatgaactgtaattaggagtccgactttcttctcatgttagcatgcgagtttttttaaagatatttcttatacgacttctttttatatttccaaaagaaaacgaatttaaaatcgactcaaacaaggatatgtatttccaaaaacaaacaaacttaaaaaccgactcaaatacgaatgacgtaccaaaatacaggcaaaaacatctttaatttttataatagtagagatgatgtcaagaaaaagtatggtacaaaattaaatatctacacaaaactgatgtaaaagttttttgaaaacacaaattaatgatctacacaaaatctatcatccatatataatcttagaataaaaaacacaaattaatgatctacacaaaatctatcatccatatataatcttagaaagaagtgccaatttcaagtcggtaaattagaacattaaagttagaagatgagtatgtgttacaatttgctaattatcacattttccgctctcaataagtatagaaaagacatcgtattcaaattgtattaaagactactccctccgtttttaaatatttgacgccattgacttttctaaacatatttggccgtttgttttattcaaaataatttaaataattatgaattcttttcctatcatttgatttattgttaaataaacttttatgtatatgtatagttttacatatttcacaaaagtttttgaataagatgaatggtcaaacatgtactataaagtcaatggtatcagatatttagaaacagagggagtaattagttactccatccgtcccaaaatgtaaaaacctaaaactgaatgagacgttttcgtactataaaatgtttcatctagtaatagattcttatattttgggacggagttactacaagatatatacttcctccattctcgaataaaattaacgtggacactaatctagtttagactttgattgcctggcttttttttctaaagaaaactataaacacttagaaatatgttatagatatgctatattattgatgtctgtaaaagcttcatgaatatgagcatccatttttcatcactcataatataatcatcagaagtaatttatggtcataatcaattataaaaatttttaaataagtgatggggcagcaaaatcaagttgagttaaaaaaaaacattgacaaccatgggccgttggtatggtagggaaacttttcaaccactagggtggataccgggtgaatatctaccccgtttattacatgccacttaaatggttatagaaaaatgttttagaaaaataacaagatagattaatatgaaatataacacttcataaatataccagttcaacttcagtttcgataagtactagttagagtttaatatgttatttttgttataacttgaagtcgaatttgaactgacatattaattttattaattttgttgagtgatacatttcatattaatatatttttaataatcatttagtagtttacatggaaaaccgggtggacgttcatccggtagattgccgtaggtaacatttcggcataatgatcggcgttaactctataagtactactagtcgaagagccgagcagcgtgcccgctgtcacgctgtggcgacgcgcctctgatcatccgacgagagcattcgtcctctgatcggcctctctcgcacattgcttaattagctacaagctacgaggcggcaatggcagcgccacctcacgatcacggcggccgcctccgcgtcctccgaaccgagcacgtcacgccgtcgtcgaccggcgatgacgccgacgcgctctccgaacgtgctctgccgctcaagcccgtcgagcccgtcgagcgactcttcctctaccgcctcgcccccggcgccgccgtccacggcgtcctgtcccacctcgccgactccttgtcccgcgcgctccgcgccttctacccgctcgccggcggcatccgcctcgcgcccgggaagaccgaccggtacgagctgttctaccagcccggcgacgcggtcgccttcaccgtcgccgagcacgacggcgccggcgtcgacgagcttgccacggacgatcccagggaagttgccacgattgcgccgctagtgccggcgctcccgcggggcggcgcggtgctcgccgtgcaggccaccgtgttgttgggcctgcggccggcggcgccgcgcgttctcgccctcggcgtcaccgtgcaccacgccgcctgcgacggcgcgagctcgacgcacttcctccacacctgggcggcttccgcctgcgccgccgccggaaatgtcccgccggagccaccagtcatggaccacagcttcattgttgaccgcaaggacatccacgacttgttcgccgcgcccagggctcagaaagggttcgattcgcccgacgccatggacaggctcgtcgccacgtacgcgctgtcgtcagcgcagctgcagagcatcaaggacgccgtcgccggcgaggcggcacgccgcggcgtcgtcccgccgcctcggtgcacgtccatcgtcgcgacgtacggcgtcatgtggctgtgccacctccgagctacacatggccacaacaacgacggcggccacgacgacggcggcggccgcgcctacttcctcttcgtcaccgaccaccggcggcggatggagggccgcgtcccaagcaggtacttcggcaactgcgtcggcccgtgctacgcctcgatgccca

SEQ ID NO: 5774 - DNA, 2674 bp, Oryza sativa
ccgccgccatcgacgaggcggtgcacggcgagaccggatactgggagaggtacccagagcgcatcgtcgaggccagaagggacggcgcgccgttctcggtggctgggtcgccgaggttccgcgtgtacgacgtcgacttcgggttcgggacgccagcgaaggtggagatcgcgtccgtggcgaagaccggcgcgatgtcggtggcggagggccgtggcggctccggcggcatcgaggtgggcattgctctgccgccggagcacatggggaggttcaggacgtacctcgccgacgtcatcgcaggtgtgatctgatcagcgtgcttgtagcaaaatgacatctccagcagcagcccctactttagagccctaaagatcaaatgggggctgccactaattctttaggacactaaaaatatcattaactctagcagtagctctcatattttagcccctatttctttttctcttttattttagtataaattgtatgtttgtgtctactttaacatcacaataatttaaacacaaataattctagcacatgaaattcaaccatattgaaaattacaattttaaacaccatgattcaaatttgaattcaaaatttttaacatgaaaatgacatgtcctacaagaaagtattgaacacaaccgatagttgacagaaaatgcaacgaaacaaactatcgagcaccatgaagcgcccacaaatgttccagaagatcatctcgaagttgctcatgtgcctgtcggtcttcaatttctttatgtatctgtagaaacttctctaaccaaatttattgcgtcgttggtactcctctttcctcaacacctcactatcccctgatcataatcgaagtctacatcttcatctcgctcactgtcaatgaacatgttgtgcattattacacaagctgtcattaattatgtaccatagggtctcggtatcccaaaatttagcaggacccctcaccattgcaaagcgggcttgtaaaacaccaaatgctctttcaacatccttcctcactccttcttgaacttttgtgtaatggattctcttgttaccctgtggattggaaatggtcttcacaaaagtggcccaggaaaggtatatgccattagcaagatagtaacccatagtgtatttcttaccattcaccataaactctagctctggagctgtccctgaagtaagcctttgaaagagtggtgatctctgtacgacattgatatcattaagagaacttggtaatccaaagaaggaatgccaaatccacaaatctttagatgcaacagcttcaagaatcatggttggcccatccacatgccctgagtattgccctttccaacctgttgggcaattcttccaccttcaatgcatacagtcagtgcaacctagcatccctggaaaccctcttggagtgttcatagccatcaaccttgcagtgtcatcagctgttggtgccctcaagtattggtcagcaaacacatccaccacagccttgacaaagtgtttgaaagcttctatcatggtgttttttgaaattctcacaacttcatcaagactatcggctggaatatcatatgcaagcatgcgaactgcaccatacaccttttgcaatgcagtggcaccaagaagacccaccgcgtttggtctttgcctaaagtagtcatcatgtgcctccacactagccactatgcgcaaaaagagctcccttgacatcctcctgaacctccttctaaataattttgcactatatataggaggatctgcaaaataatcagccactatgcgcaaattgccagcaaatctgtccctgtaaattatctcttgacccatgactgaaccacgatgcttccttttggttctcttatgctctatgtcagtaagaagagcagctgcaatatagtagtcatcgtcgtcagacgcttcctcctgctcccaccattgagcaaggagatcatcatcatcgtagaaatccatataaaataatcactaccatcacaatattgtaaattaataagaaaatttaatttccactatctcaaataacaaaatagacaattatattcataataatacacagtacggagtatatatttaagactcaaagcctataaaaagaagtgctacataagaccttgtttatatgggactacttttaagtccctatcacatcggatgtttggacactaattataaatattaaacgtagaccattaataaaacccatccgtaatcttggactaattcgcgagacgaatctattgagcctaattaattcatgattagcctatatgatgctacagtaaacattctctaattatggattaattaggcttgaaaaatttatctcgcaaattagctttcatttatataattagttttataagtagtctatatttaatactctaaattaatgtctaaatacatagactaaagttatgtccctggatccaaacacctagtgatccatagcaacgacagttcagtgcagtgctagtagtatgtacagtcccacgatccaatgcagtgctactagtacaagcacagtgtttgagattcttctctaccaccgaagaagtctactactcctacagttctaaaaaaaatatataaaaacaaatcaatgtctaacacaaaaagtggtcaagtataatacttctctgct

SEQ ID NO: 5775 - DNA, 2929 bp, Oryza sativa
atggggaattgaggaaggaactccctccttttcaatacctgggtaggggtggtaattgagagggaatttctcctttgctttgcctaaacaaatctcagccatccattttcattaatgacctaatctccaactaaactccctgtcaatttccaccacctctgccaaacaagatattgggaataaaaaccaaattcccatcttaatctcaccatcaattccctcgtgtaaactcccaatcccattccctcaaggtgccaaacaagccgtagggggcagagagcggcgagcatagggcggcgtgtaggctggcttggagcggtggccctccggcagtgcgaaggcggtggccctccatccgttgggccaatggggcagcgtgggggtgggcagccaccggttctcctgccggcgagcggatagtggcatgcgggcggacagcggtagggacgatggccgtgcagcaggaggaccatggtagtgcggggtggtgtgtggacagcaacgtgcggaccgacggcgggaggtcgtgcgacactgtgtggacggcggactcgtgagggcggcggccggaggaccttgcggatgatgggcgacagaggtaggggaaattctcacctttttgtgccaatcttgccggaggtgcaggggaatcgatggccgctggtgccggagcccagatgagatccagcatcgtggtgccgtgcgggaatgtgacgagagcgtgaaagtgaattgtcgtttggcgccagaaaaatatcgatggggctatgctcggagccccaggactaggggcttgggggtggatctgagggccttattattttgggggctaggtttagggtctttactggatctagttttttatgttaaccctcaaaatttatttagggactgggtttaaggtccctgctggagatgctctaaggaccatttttggttcgaagcctgcaaaataaatgtcctaataagttatctgcactctgaatagtattgctaccaaaattcaccgataccacacatagctgggttgccaaaatattttggcattaccaaaatatacttatgctttggtagccaacattttttacatgcatggtacttagcaagcctaaacaatcgtaagtaccaccactggactttattttctctcgtataatctattataataatggaatagctagattaaatcgtcatgtgggctttaagggactactgggtgattaagagatcttattcaccaatctctaccgcccacccacacgcgaaaattggctcgcccgcccgggacaatcggtgttgtagtagtgggatcagctttttgcaggcggccagcccaaccgcctgagggcaaaggcctgcgaaactagtgtatttccgtaggcgggcaaacggccgcgtaaagagcaaatttaaagaccacaaaaaaacccagaaaattcaaacattcctataagagcatattcaaaaacctcctaatccattcacaaattcatcacaatcctcaaatccattcaacaaatttatcacaatctccaaatccattcaacgaactcatcacaatactcaaattcatttaacaaattcattagatatcatcataaagcagaaaattcatcgtcggtcgaagccctgccgcaacctgagagcccccaccctgacctcctgacgccaccgccggtcaaagccgccaccactcactccttccaccggcgtatccaagcgcccgaggacagccgacggcagatccgcgctcccgaggatggccaacggcagatccatgcacccgaggccagcaggaagcgaatcccattgctattgtccaagcaccgtcattgtcatcgtcgcagccagtcgcagccgtcatcttcgccattgctgccgtcgtcgtggccggtggcggatccaagcattgtgccgttgtcgtcattatcggctggaggcaatggtggggggatagggatggaggtggggaaggagtgtgaggtagtgggagtaggtgcagggagagagagagctgagggagaagaggggatggaggagaggagccatgacctaataggatccccatattttacggacggcttgcaaaaatcatatattcggacgtccgttatgaaaataaatgtttttataggcggatctcttaagactccaaacataaaaattgattttgccaggcgaggctaaatctctatttttgtaaacggttataagagagtatttttttctctccacctgagaaaataaaaatatgttggtaaaaattgtttttctagtagtatgtgatttagagaggttatagataaacatgaaaatattaaatatctaaataatacacctcagtagagggagtgtagtaggaatcacaagcaatatcataatggatgacaaataaaagtttttacttcctctgttctagaaactaacaacatagctaatactatatcagacacaatctactgttatgaatctgaacatttttttaaaaaagagacacataaagtagtaataatttcccaacccagtgaggtggtgttttgatccagggacttaactttagtctctatatttagacactaatttagagtattaaatatagactacttataaaactaattacataaatgaaagctaatttgcgagacaaatttttttaagcctaattaatccataattagagaatgtttattgcagcatcacataggctaatcatagattaattaggctcaatagattcgtctcgccaattagtttaaaattatggatgggttttattaatagtctatatttaatatttataattagtatttaaacatttaataaaaaagttttagtcccatctaaacagggcctcagagacccgagaatgaaaaaccattggcacccaaaaccaccagacagccaatttcactaactttgaggtcaaccg

SEQ ID NO: 5776 - DNA, 718 bp, Oryza sativa
cctgcagccctgaaagaggaagtaattccgagatagtggtactgtgggtgttggttgacatctcaaaacctctccatcagcagtaaccgtgtaggtttcaggatcgacatcaattttcggaagtgcatcgtttagcttcatattcagctttgtcaaaccacgaacgcgacctacagcttccaccctctttcccagcttgtactgcactgcaacgccagcttctttagcagcctgccattaattgttgactgagaaatcagtagatgtcgttggtcaatgacagatatcaatatcggaaagataaatccaggttgtattcggtgagacggtgagtccattgatatctataacacatgtccaacactgtggagctaagccctaggcccacatgttagtgacacaccatgccatatttaaaaagtttttaattttccgctattgtttttatgtacaacgaatttctgggttgtgctgggcagctatacaaatgtatactgatatgttagtgaagcattatgcctacttacaaattatacatccattcttttctagatgatgtttaaaacatcagtaaaatctgacacaaattgtgaaatgtttgatcaattcttttctaatcataaattcataaaaactattaaaatataactaaatcaaagattttctatgacaaatctactaatgtcattttcacatatcaaaattttgatatttttga

SEQ ID NO: 5777 - DNA, 586 bp, Oryza sativa
acacacactcaagcttttaaccaagctcttacaagatcttaccaatgcaagtggaatggtgatgtacaccgactcaaccaagcaccccaatagaggttggatatatcgatgcctcggtaaacacttgctgtacggctgcaatcaaatctgtggagctctgggtaggcttaaatatgtagcaaaggaatagcaaatgctcaaatcagagaacgcaaagttgaataattgttcaaagtcaagtaccgtgctagtcctaggctagaacgtactaaagacgcgagcctagacacaaacggtaccacaaaatagcaccagaaacaactcaagcacactctgatgtatgaagttcagctcaaacaaaacaatattttctcttttctttctttcttctttcttcttttctttttttttccttttcttttctgatttttttttgtgcggcttttttttttcttttttttagggactcaaattgatgaaccctaagttcctctcgacactcaaggctgttgttggcccgatcttttggtgagttgtgataactacgatttgggagaaacgttgacgatccgactacaaccgtacg

SEQ ID NO: 5778 - DNA, 744 bp, Oryza sativa
gaaaagttgaaaatttgtgtgtaggaaagttttgatgtgatgaaaaagttaaaaatttaaaggaaaagttgagaactaaatcagaccttagcacactgaagttggtaatttgtcaacaaagcgatgtggcgagacagggagaaaaaaatgggatgcatgcagtgcagcagcatgctggcactagcgagcaaagcagtactgtacttggtgtgtttcctgcaagttttgcaagttgctgctgtgatcagtacactgtgtgcaatattgcagaaaaatgcaggctcgatcactttcggttactaaacagtgcacggttttaggtacatgtcggaaggcatttttactactactacctgtcaatggagaacttaatcttcaagaattattttaaatgaactactactagaaatttgcaacactggatagtagcacatatattttagtgagattttaaatgtactgtattattagtatgcatgttattatggcaatgtttagttcccttcaaacttccaaaaattccgtcacatcaaatgtttggacacatgcatggagcattaaatgtgaacgaaaaaaaacaattgcacaatttgcatgtaaattgcgagacgaatcttttgagccaattacgccatgatttgacaatgtgatgctacattaaacatttgctaatgacggattaattaggcttaataaattcgtctagcagtttacagatagaatctgtaatttattttgttatta

SEQ ID NO: 5779 - DNA, 681 bp, Oryza sativa
gtatataagtttcacgtaattttgaatcgttaatctattacaagatttgttttggtgaggaagaaaaaaaatcgcggcacacacatatgtgtaaggatttgttcccacaacctccattttacggaaataacatattacagagatatttttgaaagttacatacaagttacactatagttagagtgtaattacatgcaagttacagtgtaattacactacgattgtactataattatatctgtcaaatttttggaagaaaatttgtcgacaaaaatatagcaaaatcgcgtttttttaattgaaatctatttcagaatcactttttcgattgataccaacaatcgacgacgaaggcctagcccggcccacagtccggcccgtcatttaagaggatcgcagttcttgagggagggagacaatcccaaaatcgagcaaaccctagccgtcgactcactccccttcctctgcgaccttgttgctgctgtctgctatggcgtaatggcgatgcgctatctggccggcaagttgaggagtactagtagaatgtgttcttttatgatggtataagcatcaaactgcacattaattactagtagtagaatgcatatctcacaaacaattccacagtaggaatttactgaaattccacagtaagtatttactgagaaagaactggagcag

SEQ ID NO: 5780 - DNA, 3669 bp, Oryza sativa
tttttttccaaacagtgtgcacgcctcctaaactgttaaatggtgtcactgctaaaaaaaaaatttcttttgccggctagaattagtctttcctagtggttaggctaatcacctgtgactaaaggtcagagaaactctaaagtcttcacatgcgagacatcaaccgtcatcaataattgatttttgctgaaggctgtgttattggacggccatcgataatcgatatttgtcgacggctatgttaagccggccaccagtgataatcaatttagcggggaaattgaaaatacccacgtgcaatttccctctaaccacttacaaagattagttttgaaaaacaacaatgaaaatgaccacgtgcagctgcctgcattccaaaatcgacattcccaaattccaaatccacataacagagcacaaattccaaaaaattagtcatcacatcccgaatcaaaatccacatcacctctgtcgtcgtcgtggtttgttgggtcgaaagccttgctccctcctggatctgccctccacccgccgtgaatgaggccaccggtgtggtggacgagctcgcacgcccacgcgacttgccgacactgaatccatcacgacgcgactcgtcactggcaaatcttgcgttcagagggatgggagggcacgttgaggtcaacgagggagggaggatggactcggcgaggtagggcgtggccagccaacggcagaaccatcactcttgaggcccgctagagccgtatctgttctctcttgactcgccggcaccggatttgcttcctcgctactctccaccgtcccattccccgagccgctgctgccaagcgtcgctgtcgtccccgccccctttctccctctcgagcgccgctactgccgagcgctgccattgtgccttcccccgctctgctgccaccaagtgttcgccatgccccctcccccactccatcgtcgccgcccctttccctgtgccgctactgctaagcgtagtcgccgccgagctgagctgctacaccccatccatagctacggatctgggagagagatgataaaaggagggagagttgaggcaggggaaaaatgatttgattccaggttggtcaatgtgcacgtcttctaatccttccccatgatttttgcaagtgatgctctcaagaccccgcctaaaaaaatcaatttttactcaaatggccgtattttcgcaagcggtttttaggaccacatgttattgttgcaaggaaagctttttcaaattcaccgatgaaaataaaactcaaatgttatgaaaaaaatatttttctaagtagtgtgttcttttttaaaaaaaaatatgcatggaagttgctttcaaaaatcatagtattaatctattttttttaaaaaaagttaatatttaattaattatgtgctaataagtaacttctttttgcctgcacgagagattagttgccaactcattgagccgaacataacctaattgattacgcattagctattaaatacttaaaaatgagttttttttttcatatttagtgaaactatttgataaaaagtttgttcataagtagcaccgtttagtagtttgttaaaggtgcccgctataatctaaggcgatcgataccactttgtcggagctggttagtggcgcgtgcgatcaaatcattaaaataattaagttatagatattataaaatcggaaaaaaaatatttatttgattttttgaaatgaactttaatacgtacttcctccgtttcacaatgtaagtcattttaacattttctatatttatattgatgttaatgaatctagacatatttatattgatgttaatgaatctagatagatatatatgtctagattcattaacatcaagtgtgcatttagttccaaagtttttttttccaaacttccaactttccatcacatcaaacatttcatacacacacaacttttcagtcacatcttctccaatttcaaccaaattttaaactttgagccaatctaaagacacccaatataaatataggaaatgctaaaatgacttacattgtgaaacggagcgagtactatatatttgcacgatgcacactgttagttcgaaaacgatcgataaaagaggaattagccaagagctaggtgataagaagtcagcctaagcagttttattacatgcatgatgatagtaattaacagtgacaggggaagcgggtggaggagggagggtttagtatcatccataagacgacagcgtaggacaaaaggtagcgagctaggaaaccctaggccaccgccaccgccgccgcctacgaatggcgattccccgagtcgccaccgcgctgctcgccgggaggaggagggcggctgcggacatcgtgttcgccggcgtccgcgtgcaccaccaccaaggggcggcgaggctgctgcagcccggcaacctcgccgccgcccgcctctggccgccgccaaccgccttctcctacggcggcagagtcggctcgctcgggctcggcgccaggcgcgggatgtccggctctagcggcggaggtggtggccggagctcaggaggcggcatccccggaggcgacggcaagcgaagattggaggaatggaccaggtcggtggattcccagcttgaagagatccttaccgaactccaacaactaagtgctgctcaaatgaatgctgtcaaggtctccacttcctctttccaaagccttaagaggtaaaaaaaattccttccttttaatgcttgaccgatcttgtttctttgaggcttaattagttgggatgttcttgatttccgttctgtttttcttcttgttttttcatgttaattagatctatggagcgcactggaaaagtcacaacagctgtaatttcactcagtgttactgcatctgtgtatcttgtgctgttcgcgctctattgtgttggggttaaaatggcctatatcgttgacgccgacgaatttgccaaaaaattcgcacacagtgtcttagatgatgaggaattcaaggcaaagctagatcagacagcagatagacttggtgccatagcagtgtccgctccctttaggaaggctcaggagtggttttttggtaaagacagctcacctcaagatgatttggatttggaggcttcagacacttgggaagactgggcagtttccttttccttctttgctctgtcattgatcagaggaatgccagtttatgagagtgagtgagtcaattttgtccttttcaccgttaatgaagaaaccatgtaaccaaaatgttttttttttaagtacagatgaactgtggatgcgtttataccagcttggagttagacgcaacaaggaaaatgaagaacttctgaacattttggttgcagtagggtaatgaattatgctagtagctttaatatgatattattatttgcatgttaaaatcttatctaattttattgtcaggttgatatcaaagaagaaaaagggtaagcttactacctatgcccttgtcgaagagcaatacagggaatgcattgacgcaggattcaggccgaaaattgttccgatcctcaagaaggtatattttcctttttcctagatcctagtattttataatttaggtgctacattaggggtttataagtatattaatattgtgattaatatttttcag

SEQ ID NO: 5781 - DNA, 21654 bp, Oryza sativa
tcctgcagcccggagttatgtttctgttggagttgacggtgtgcgtggcgcgtttcactagaattgttcccatttgtgttgggtctgaattggaggcagttttgagtggagcttggcgtatgcaagaggtttcgtgtgctgaattacagggaaccaatttgaactccctaggttcagtttttccatgccagatttagggtttatgggattttatagtaatgaaagccactagtttgtgttgtggtgttgaggttttacaagtgcaaggacttccagttttgtcgtgccatattatggtttatgtggttttagtaatggaaaccactagttttttggtgtgttgttgaggttttacacttttactagtgcaaggactttcatctttgtagtggccggtgggttagttctgtggcagattggcatttgctgtgtccttgacatgtgaaaaatctgattttggtttgtgagctgacttttggtctggtgatttggtgtatatgtggaaacttatagaactaggacgtgtatgtaagtgctcgaggtatttgtttatgtggtagttttcgccttcaaagttcaaacgtgactacaagtacttcctccgtttcatattacaagactttctagcattgcccacatttatatagatgttaatgatatgggcaatgctagaaagtcttataatatgaaacggagggagtactttatatactatgtatattgttttgtcttgaagccaatttgttgagaataaaatttaactatttatcttgtcctaaaatttgacgttgcatgtgaactattcaaaatcagacaccagggaatacgacaaactttgcttatctggtaaactttaggtattgggtattagaaggcaggtgttctttttttttcaaaaaaaaaatcatattagggaattagggatcttcttgttggattttatggtttgagcttcgcacaatctgtgtgaatggtttgagcaattcagagttgacgatggtggtctgcactggtccctgtttaccctgaaattttgtctaaaggaattatttttgttgtctgcagagtcaacagctttggggaattccgaatgtacatatggtggacacttgttttggagagctttgaggttgccatgttgctcgacccatggattttggttgtctcaaacctggattttgtttgttttggggcaaactaatgaatcagtacgtttcgtttattttgggaagcaaactggagtaatttatcagtactacctgtatgtatgaactacttgtccgctggagcctggaatatcacatggggtaaacgactttgatttgttagttccattctgtcatcgatcactgttggatcgattggtaaaaggccttattgcagcaaacctagcgtttcagtttgtttgcattctgactgtcactggaatgatcccactgtctcatttatgtttatgttttgttcgtatggcttattaacaaatagacaataatttatgagtaaaacttttatatgtatatcttcagctattgaaaagcaaatgctataaaatgaaccacaaaacaaatttcaaaattaagttttggcttataagcacaagggaaaggatgggacggtcctgaatacctacctgaacgcctgatccacaatgcaatcaaatcagaagacgaaaaccctaaccagttggcgcttaaaagtattcatctatctattacttatattttcaggcttgtaacacatcctacatcatttcagcaacaaaattacagctccagttcagttattctttttcatttatctagggaggatgcagcaatggaactgcaaaatctagggacgaggaaagacgactgcaacttgaaataagagctaaagttgaagctgcaaggtgtaggaaacaacattagttgttcttacccagattactgaattagaaaaaaaaaaggtgtggaatgaccaagaacagccaaagaaacgcatcaagagagagaactttagttcagaatactgatcgagaagcttgcatagaaacgtatttttttcgtcaaactcaatagtaacaaataatttagctagtgttccggagaacttgcaccgaccaattacttaaaacaagcatggctgaatttttttaggtcaaccttacaataacatacaagcataaaatacgttgtccttcggtatcactacaaccacaggcagtttaaaatgacggcaacttggtcttacgtacataagaggtgcttagtttcaacacaaaatacggcacatacacaagcgttggcccttgcatacatatccaccacatcttcggcataaacagaagggggaactgaacaccccagggggtagtgcccaggctagttaggagtacgtggtgaatacttgttttccatctccaagccgacaacataatactccctgagggccttcctgtaactacgagtataccggacacaggagacacctgcaagacccaccccaaggacaacagaccccattatacaccttctgtggaacctgttgtaccttattatctccgctatttccttgctatcaaaacaaaacagagagaacagccatatgttactatcatgcctcaagaccatttgagttggtttaaaacaatgttagttccttcaccttgcagcttccattttagctacttcttcatgtagctgtcgaattgtctcgtccacattcttcacaaccttcatggaagacgcaagctctgtagtacttccattggtgtactttccctagatttaggtgttaaaagaaaacaagctgagatggcaatataatgtagaggtccaaacgaacaattcagagtactgagtaataataagtaaatctgaaaaagaaccagttcacgcttcaaagtattcatcgatagacatcaagtttccacctactatgtgaggttacccttagctgaagggctgagtacgtactaactagcttgtgttcaaggtgcaacaaacaacatgggcaacattagtatagcaccaaccaatacatctttgtgttatcagcaactaaattgcagctctagttcagtgattttttttgttgttgcagtaaatgcctagtgtggaattgtttgcgagatagaaatggtttgcatgatacacattacctttcatctgtatagaacaaagtatcttgaactgacaatggtaataagcaaacagagataactgcacccctaattttcgcaggaacccataccttaagctatagattctaccatcataagtttcttatgttataggatatcctatcagattttttttttgggctagccgccaaggtgaggtcgattcattggcagacgcggaacagatctggacacgaaccgatcttggtcgatcgaaacgaacgatctgggacgagtcgaggggcgagccgacctgggactgggaggcgttggcggagagggatcgagggcgacggagagcggcggcggcgggggcgggggcccgcagcttaccggcgaggtagcgcatcgccatagcagacggagattgatcggcggcggcgggctagggtttgctcaattggggacgaggcgaggcgacgatgcttgatgcttcctcgactcgaggggggttcacttctccgttggatccctttctatttatttattggaattacgggaaggaacacgactgtgggctgggccggtcgtcagaacggatccaatagctccaactccaacacggactagttgaccaacggatcaaaccggtccaactcctaaatttagctttctgtagtgaagttgtggagctgtctaaacctagctccacaactctagttcattttgtgagagagctccacctagctccactcccagttttagtggagctgaaacggtttggttgagctggagctggagttggagctgaagttgtgccaaacatgccccaacattttcttttcatttttcttatattataagtcatttgactttttatttctaaaccaaacatttttcagtttgatcaattttataagaaaaaaaattaacaacatcaaattaggttcattaaatcaacatttaatatattttgataatatatgtttcttttgctttgaaaatgttgcaatatttttgacatttttctaggtcgaacttttttagatttgactaagtctgtagaaaatttagcaatatttatcaatgttatagataaaatatacctaatatttttgtgttaggatctacagggcttaccatatattaagtcttctacggaatccagcctcatatatgaaaggtattccagataagaaaaacatgccgagttctacttgggcacggcaacgactactcggatcatatccatactcgattttcctagttttacttggatatgggacacccagagtataaatacaagaccccaaggaggagaggagacacgctaagacaaatgcgaaggcaagcaacatgtgagagctctacgccactatgctgacagagactaaaccaggtcattccaaatattatactcgtatgatactgatatatgtataaaggtaacaccgacttcaaccaaccacaaagtatggctattacctgtcagttaggggcctaaacatgtataaaaacaatctagcactctcatgctccaccacctgccaacctctattggttgtgctaacccaacaatcgtcggtagcacctcacgtccatggcggtcacgtctccacgcactgcaacagtctccaaccgtcaccgagccgcaccaccacaacgggctcgcctccacacactgtagcggtctccaatcgtcgccagccgggggaatttactatttgccactctctcaaaatgccagtgctcaaatgtcactctcccaaattttcattcccaaatgccacccggacccacatgtcagcctcactcatcatcgggtcccacatcacttttgtttgaatggagagtgaggctgacatgtgggcttgggtggatttgggagagtggcatttgagcactggcattttgagagagtggcaaatagtaaattctcccgtcaccggccgcgcctccacaccgtgctcgccttcccacgccgcgtcggcctcggccgctgccggccgtgccaccttttatatatatatatgcgtctagattcattaacatatatgtaaatgtgggcaacactagaaagtcttataatatgaaacggaggaagtagatagaattatagtacctctgtcatatcaatttgtcgtaccccattaaaatccttgatatgaatggatactcatatactctgtcctggacaagtatatatccagattcataattatgattggtttttttttgaacggaggggtatttaagagagatcaagataaaataacaactcagcacgtataagggatgagaaaaccgttagtggtgtatacatgattaattaatttttaattattataaacttaaaaactgacgtatttaatattgtaaggcaacttctatatataaattattttttaaaatagtttgaaaaacgtgacgacggaaattgagataagatgatacgtgtttacagaactccggtatgtaggagtaatgatgtaactttttgggcgaagtttataatttgatggtattttaattcatcaacatgagcgtggcgcccttgcctgtcgtccataaagttatgtataccatcatcatcataatcaacctgtaagaatagaatagcctcttttcatttttggccgtgtttagttccaaaatttttcttcaaacttttaatttttccatcataaactttcaactttttcgtcacattgttctaattttaaccaaacttttaattttagcatgaactaaacacacccaaaggggtacttagatcagggactaaactttactccatatcacatcactaaaacttacttcctgttacatcaaatatttagatactaatttagagtattaaatatagactaattataaaactaattatacggatgaaggctaatttgcaagtcaatgattagcacatatttactgtagcaatacattatcaaatcatgtattaattagatttaatagattcgtctcataaattactctccatctatataattagtattgtaattaatctatatttaatagtttaaattagtgtcaaatatccgatgtgaccggatccaaacacgaaccccagatgaactaccagtggagtatactgtatgggacagccattttaagctacagtattacatgatactactattactagtacgaccataaatcattatccactgttcgtatctggcattctgcgagtgttttttttaatcctccgtcccaaaataagtgtagttttgcactgtttatgtctcacttttgaccgttcgttttatttaaaaattttttacgattaatatttttattgttattagatgataaaatataaatagtactttatttgtgactaattttaattttctcataaatttttcaaataagatggacggtcaaatgttagacatggattttcaccgctgcacttattttgggacggaggtagtaaaatggagaagtactccaggagtatactccgtacgtggctgccttgtttttccgaatccttgtcaagtcccatctgtaggagtaggatagtggagtactactagtagactcctgtgaacaaaaacagtgtgcagcgcagactgggagcatcccatcgagagagagaggacacgtctcaacggcagaaagcgatgaatatcggatgcagcctgcagagggtacggtacaaacttttatacaccgtctgtcacgttgcatacactactcctttaatttcaaaccacataacaactttgggaagaaggaaccttaaacaatttcttggtacactactaactaaagtatatttaggtgttgtttggatacagagacttaactttagtccctgtatttagacacttatttagagtattaaatatagactacttacaaatctaattacatacttagagtagtaaatgaaagttaatttgtgagacaaattttttaagcctaattaatccataattagagaatgtttactgtagcatcacatagactaatcatggattaattaggctcaataaattcgtctcacgaattagtccaagattatggatgagttttattaatagtctacgtttaatatttataattagtgtccaaacatccgatatgatagggatttaaaagttttagttcatctagacagggtcttactagtactattttaaggattactaccaagtacgtactgtattccttaattgacgatcaagttgttttgttttttgtcagtcgtcaggcagcacacaagcgagaaaggtttgcaaacacccataaaataagaccatggctggctctcccgaagcgagaatagaaagaaaaaaaaaagcagttacgactagtcgtaaatacgtcattcattaactgtttaggagtatactactccagtaattaatagtactccagtagaagtgtagtggtagtggagtagtaactaacagaagagagaggatagctaagctaattaagctagcttaccatgcatggagtctaaccctaatcaccgcgcttagcttaccaacccactctcctcctccactcacagaaactcaaaatctccctcctcccactttgggaaagcaaaggggaaaaccctagccgccgccgccgccgccggccactggccatggcagcagctcgtctggcctccacggtgctcgccgggaggaggagggcggcctccgtcgtcatcgctgccggcccacgctacggcggcggcggcggcggcgtccacgtgcacccgtgggcggccttcccctccccgaccgccaccacgcgccacgccgtcgtcgctgccggcggtggcgtcccctgcctgctcccgagggcggccttcccctccccgacgctgccgcccaagccacgggccttctcctcatcaggcagcctgggtcgccgggatggtggtgcacccagaggcgggagcttcctcggatggaccaaaaccgtcgacttggatctctcccggatcctcaccaacatggagatgctcgtcaagaccaccggctcgcacaaggccctcctcgaagaatacgctcaaacacttgagaagctaaccatgtgagtttgaaatttctcttctttttttttcctcctcaatttgtttgctgtttgttgtttgttggtacaatttaaatttgtagatttgcatctttttttcctcatctcatgttttactcctgatctatacttatttgctccccttttcttttctcctgatagagcggtggagaaaaatgagaggagcaagggcagcctagcaacaacttccttatttctcatggcttcagtggtcactatttcttttggtgtctacttttttggggttttcactgggcgagtagatgttaatgggtttctcaagggtttcatcatcgatttccttgatgatcctaccatttccgtcaaaatgcacgattacgttgatgatttggccggcagtgcagtggagtccattaacccaatcaaaagatttgtccactggttgtctggacaacccaggcctgctcattatcagaagctcaatgaggaagtccttaactattataccgactggtcatctatccttgcatttgccgtcaactccattgccaaatcagaagggggcaaaatatctgaaagtaagttaaaattagtcttaaccagtccataaaaagctcttgtgttaataaccatactatgtgcttaatattttatttgatttttcagaggctttgtggcgctttttgatcaatgtgggggtgcaggaaactaaactgaacaaggcattgctgaaagtactagtgagagagaggtaagtgctcattactattagagtaaatttcactttggtcaacctttttacattggactagagttagacttatattttcacttaacaccatatattgttaccatcatttgcactttggaccgggtttcacaaattacacatagtataataattgtatatctgatctcatttcttttgtgttagaaaacttagaattcaacaatttgtactaacactacagtgttgggtattgtaaaacatataatatcttttctagaaaattagttcttaaactcaatatttctccaattttgtctctagtatgagggttgtgaatgttcatatgtagtagtaatgaagtcccattaatctgataggatatcctataacatgttacaatcgttgttcttgcgctaagcatatttgcatggcaaaaatttccatatcattgtttcttgtaaattgctaagcacctagacaacaactcgtgtaatggtaactataaaaccaggtccaaagtgcaaacaacggtaattatacgtggtgttaagtgaaaacatgagcctagccctagcccaatgtgaaattttggtcaataaagatgatccaaagtgaaatttactcttactatattatattgcttctttttatttttgctgttttgcttatttgtaacatcttatcttatatatgtttgctaggttcattttgagacaagagtacaaaggcgtcatcagttacaagatggtggagaatgaatacaaaaccaatttcaagggcaaaattcaggagaggattcggcctatcctgaaaagtgtaaggccgagtttagatccaaactttttttcaaacttccaacttttccatcacatcaaaactttcctacacacacaaacttccaacttttccgtcgcatcgttccaatttcaaccaaacttccaattttgacgtgaactaaacacaccctaagttcaagttttgttctcccaattcctatggctgcgaaggaactaatacaattgaaatctctgttttgcaggagtttgtgatgccagctgctgcacgtggtccaaaatctaagcccagccattaagatgtaccaaaagaagaatgaggctcatcgtgcacattgggttaagaagttcctagaatagcataactgagatcatctaactatttagctaaccattaaggagaggtgacagtggacaccatattttgtatttaatgatggttaaggtggtagtggacaccatttgtttttttgtaggctaaagctaagtgctgcttaattggtagtggacaccatatgttcttttggtaggatatatttggctatgtgatggttaaggcggtagtgggacaccaaattatgtatatttggctatgtgatggttaagggtggtagtgaacaccatattattgttgcatgatctttaccttatgataaatttcatccttttgcacttgctttacccttgttcatccactggtaatgacagatataaacttggtctagctatttgcacttgtcatttttcttgctgtgaaggatgcaactgatgaataatagtgctgatttgcgatgcgtaagaatggattgtgaattctgatatgtgctctttgtgatccatgtgaacagatttttgttcggcacttgttcttctttttctagctgtcagattgggaaagatggccactttgattttgttttcaaactggatgactatatgtacggtttatgttccacagcttcaaacagtactatcatagccatatgccatttttctgttagttgttagtgaaggatttttgtactgcagctgatggtgtactgaactagtgatgcacaccatgttgcaaactcattcatttttgcaaatctgaggcctactcttacctgtatcttttgacattggctggtaataacagatacatgtgcctgttattatgcttattttgcctgaaaatttgacaatgatgagttctgatgttgattttgcttcctacaacagcgttttcataagagcagatacactcttggcctattcttttgctgtagatgatagttactgataaaaacagattgactactatttttacctttggtattcctgatctgttttgcatcctaatcctaatttatttatttgtcactatttctcctgtagcacatgatggttaagtaatgcacattcttcaaaaaactgaggccatttttgcttttgattagttcttgcaaatctgaaataattttatgttttgcaatttgaggtcagctgaataattataatcagtttccaatcctcactacaacaatggtatgaacaggcgcttctcttctgttgcaaattgatttcttgaatctcaattccatgcctcgtgtggtaaccttaaattccaggcttgaattgatggataaccagaaacaagctgtagctaatttcatgaaggactaggagccctttgattggaccaaacagcttgattagatctgtaaatacagtcaccagaatatctgtaagaaaagcccgctggaaattgttcgataattttttgtacgaatcttgtactaacttgtcttgtattcatattaatcaagtctgtttcttctcttgatcttgaatgttgcctaaatctatgatttggaaatagacatcatattatacccggggtaccaatgttcatcaaatagaacaagaaagctatgaaatttggtgcttgattgcatcgaagctggtcaaagcttcctttctttcaatggttaatttgaagttgaaagtttggattttacgtatgagttattgcagtcttgtctagggttgacattataaaccgcaaaattatcaatactccaaagacagaatattctttggcacgtaatgaatcaatgcaatgcttacaatatttttttctatcagtgcttatgatgatatttaggctgtgtttagatccaaagtttggatccaaacttcaatacttttccattacatcaacctgtcatacatgtttagatccaaaatttgaatccaaacttcagtacttttccatcacatcaacctgtcatacacacacaacttttcagtcacatcatctccaatttcaactaaaatccaaactttggatccaactaaacacagccttaatgtatctcaatgtgcatcatcaatgaccatattttttttcttcaattgtatatatcgacgtgcatcatcaataaccatattttttttcttcaattatatatatcgaagtgccttgcacgtacacgctcactggtatatataatgaagatgatcaagagaggggaatgagctatcaacgaacatacaccggaccgagatgtactaatcttttatcagctagtgttcctgagacctacagccaaccacttgaacatgcatgcataactgtatctttcatctaacccatacaatagcagcaacttaacccagcataaatatgtcatagccacaagctgtttgtgaaaacgacttcatttggtcttacataagagttaattggtctaacataacacggcacaagcacatactgtaagctagagtgtgcgctagctagctcttgcaagcattaccccaaatcacatgccatacgccagagtcaaacattattacatggcaacaaaaggataagtgagctggatccccaacccaggctactcaggcgaagatgttgaatacggcggcatccaaacgatcgggttgtcaaaatgctccttgagggccttcctgtagctacgagtataccaggcacaagcgagacctccaaggccgaacccagcaaacacagacccaattaaacaccgcttgtggagcctgttgtaccttgttgtctcctcgatttccagtctatcgcagagaaaacaaatgtatgttagttactagtatcatgcattgggaccttttgagtttggtttagataaatataagaataaataatgttagttccttcaccttaacttttcaagtttagctatttcttcccgtacccaacccagatcaccatccatattcctcgcaacattctctgtagttgcattgctgcgtcctccctggatttagcagttaaagaaaacaagctgagatggcaatgtccaggtccaaacaaactattcagagtaagagtattagtaagacaggacacaggtacatctaacccttgtaaacaaaccgattcgcgcttcaaagtattcatctagttcgccacattttcatgtgccaactatgtgagctcactcttaactgaagctcttaggactaggtactccctacaagcatcttgcgttttcagcaaccaaatagtagctctagttcaatgacttcttttttcttagtaaatgactagtgtggatttgttggtgagatgtgtggcatcctagtggaaatggttgtgcatgatacacatactatcctttcatctgcatagaagatacttggtcgacaacgctaataagcaagcagagactgcacccctaattttcacaggggatcaagtcttaaagctacagattcttggcatcataagtttgtcccgtcatcatcagaaccaacaggaatgcaaatttgaccgctaaaaatacagtacagcatcatggaagtggtaccttttcagacaaataaagatatgagattttgaaccacccaatctaaactaacatcttttaagaaaattgacagtaagtctcaaaagtggtggatgaggaaaagaaaaaaactaatgaccaacttctacctccaccttaactaccccaggacacatcaagagaagccaataactaaagtatgccacataccgggagctaaatttgaaacgcgcgcaagctcaaagtttggtggttttttccccaaggaaacgaaaggtgggcatgaacacagaacagatctggacacgaatcgacctagcgagcgatgcatactagcagctcaattgcatggagatgcataacattcaacgatcaacacgaacaatttgcgacgagtcgaggggcgaaccgacctgggaggcgttggcggagagggatcgagggcgacggagagcggcggcggcgggggcgggggcccgcagcttaccggcgaggtagcgcatcgccatagtaggcagcagctaggagattgatcggcggcggcggctagggtttgctcaattggggacgaggcgaggcgacgatgcttctcgagaggtttcacttctcgatctctttttattatacaggaaggaagacaactgtgggatgggctgggctgggctgggccagtcgtcggaatggatccaacagctccaaaactcggaataagtcgacattttatccctcatctttacgtaagtgcccctaaaccgcaataccggaaatcttgaccccctaacttggattaaattaggtcccctagcagtatggatagctggtttcgctgacgtggcatcctagtcagcaaggaaaaaataaaaaaacttatagggcacacatgttagtggccatatcctatactttctgtctcttttctctttccctcatcttctccatgccaagacggcgtacccgcagcagcagcacagtgcgggcggctggctgcatgaggagtgcacgtcgaggtcatcgccgtcgttgcttatcgcgcagacttgctgatgtagctgctggaccacggttgactcgctgagttagcaggtgggatccacatatcagcgacttccacctcatagcatccatttttttttacctcctatctatctttcgtttatttaattttcatcctcctctctctctccctcacacacacacacgcacacacacacattccggcaacaacagaggcgacaaacggtggtagtgagctggctccgtgggtggtggcgacagcgaggaggaagggagagtaggctccggagacggcgacagaggcatcatggcagcagcaggtggcaactccggcggcaagagaggttgcaacaatggcgtcgaagcggaaatagcaggtagatgttgcagtgggattgcaggttgaggtagtggcggtcgaagcagcaggcggcgcctgcggcgataaggaagaggaggcaacagaagtagcaatagcagcaggccaactggcaagctccctccccagcgcgcagccagctggtgagctccctccccgtgtgtaaccctctaggagctcattcctacgtgcggctgaccggcgagctcctctactcatgtgtggccgaccggcgagctccctcccccacacgtggcccaccaagagctcctcccctgtgtgctgttggccggcgagctccctccccagcacgcgcccggacggcaagctccttcaccatgtgcggccggccgactcctcctcctggggcgtggcttcccggcgaactccttcccccgtgtgtggcaggcccgtgagctcctctccccgtgcacagtctcccagcaatattctccctggtgtgcggccagccaacaagttccctcactagtgtgcggccagccgacgactcccctcccatgagcggtggcggtgggggaggagggacagcggccggcgacagcggtggtggattggaatgggaaatgcggctaaggcaatgcgatagaggaagcgaaggcgatgcgtggggaacgcgtgcgacggcggtgggccacaccatttttatttttatccttgtcactgacatgtgggtcccacaagcgacaatgcgcctagaaggaggaggccgaggagcccaagctggtcagtgtccttccaaatggcctccattcttcctgattgcgccctttaccatgggagctagatctagtgggtgttgatatgcctcaaaagcatgagaaggaggagggccacgagatcgatgcctcccaccgcccttgttgccgatgtgcactcaggctagatctagcagtgaggagggcctaagcctctagatcccttttttggggacgtactacaccaccaccatgcctgcacagagaagctctctgtggaaaggatgagaggaggggggagaggaaaaaagaggggcgaaggaggagaggcggagaaggagaatggcgaaggctcaaggagagaaagagataggaggggaagggataagactggatggttatccacatatcccgtctccatgagatcctatagagtagtttttatgcatcagaaatgggcctctctaaggcctaactacccaagttacatgatattgcgattattcgtaaaaaaaaaaggtgaaggggggggtgaggggggagggatggtggtgttcaaactcaagttgcttgggcaagagttcgctgcctacacatttagactagttgtttgacactgatatgccatataaacatattgaattataggtttcctgctgtgcatttgaaccggggcgacccgacgaatggaccactagacctatgaactaggagttcgcccggttcgacatccggtctagtttaacccttttttcaaatatgattattaattgctttgtgttctccgggttagaatagtactctatcctaaagaaaaaaaaagttcaattcaatttatctctaataacatatattttatacccctcaatttataaaattaggtgaattgctcttaggtcgaattcatgtggtttttttatcatatgtggcacacgcatggaactcattttggccatgtgttcgtccaattagcaagactacataataaattgaaaataaaatttggccaatcctaagaaaggtatgttttctttgtaatttttgctctaagttagcttacaatgatatgtgtatccaggagaacataaaattgaattgttgtttcaggaattcgccatgaagccttccactgcggcgtaacctgtctactgtctaaacattttgatctggtgatgctactagctagctttttgacgtgtaccagttgaactttggtgatgtttcttagcttcaattataatttgaatctgcagaagagcagctagactcgatctgtcagtgtggccgctataccacgaactgcaactcgatctgttctatggttgtgcatgactttttgtaatgatcgatgttaattaatccgaacccttagcaactcgatctgttctatggttgtgcatgccttttgtaacgatgctaattactccgaacacttttttttttgagaaaattactccgaacacttaatggtgctcaacctgtcctatggctctgtatgcctttgttatgacgtaaagaccgacttaatgatgtactgtatctctatagttcctatatatgctagctacttttgctaacgtaaacatttggataaaattatacaatacaacgaggaatatttccatgccctatatatactcatgtaagcaaatatatatggcaccgttcctgtcaaatttgctaacatacactactacaccaaatattttcctggacactaaatctgtttgtttccaggcgggccataattgacaccgcatggaataatgaggggatcggtaccaggctgtggcccgcacgggaaaacacattatcccgtgcggggcaatttactcaaccgcacgcgaaaatgccgtgcgggcctccttactcgcgcacgcgaaatccacaatcccactccttaactctcccactcctctcctcccactccagtactccactccttctctcctcccggcctctcctctcctcacagcagcgacaacggtggcgccgggagacagcgcgcgcgcggcggcccctccctccctctaccttcggctcccctcccctcccctcccctcccttcccttgcagatccggcagaggggaggcatgggggcggcggatccggcggcgggcgcaggcgaaggcgacagctgcggcggcgggcgtaggcggaggcgacagcggcgacggcacggcccctccctcccctccccttcctcccctcgcaggcggaagggaggcatgggggcggcggtcgatgatggtggtgagcggcgcctccctctctctcccttcggctcccctcccctcccctccctatccttgcagatccggcagaggggagggatgggggcggcggatccggcggcgggcgacgacggtggcgagcggcccctccctccccttgcagatccggcggaggggagggaagggggcggcggatccggcggcaggccacgacggtagcgagcggcccctccctccccttgcagatccgtcagaggggagggatatatgggggcggcgggcgcaggcggaggcaacagtggcggcgacggttgacgacggtggcgcgcggccactccctcccctccccttgcagatccggcggaggggaggggtgtcttcggccggcgacgggagcgggcggcggatccggtgtgggaagcgggcgacggcgacagttagggttttggtttttttctttttttttcaattttttattttcctgtgcgggcgcccgcatgcgagctattttcacagacgcggggttccagacggtcgaaaccaccacacgcgaaaatgagtttccaccgcacgcgaaaatcgtgattgtagtagtgatactgtttttgctgcgttttgaaatactcacttgttaagattatttgcataaaatttttgaaaaagacgaatggtcaaacatgtgtgaaaaagtcaacgacgtcatctattaaaaaacggaggtagtacaatacaacgaggaaaatttccatgccctatatactcgtgtaagcaaatatgccgttcctgtcaaattaattaattaacatactggttttgctgcgttttgaaatatcacttgttaagattatttgctgcgttttgaaatatatttgcaatgttatcgttacctataaatcaataccacatcacaattcacaaacaaaaggggaactgaagcggacaccaccccagcctactcaggcgtacttggtgcatatgggctgatgacctcgaagccggtaacatgctccatgagggccttcctgtagctacgagcataccagacacaagagagacctccaaggccgaccccaactacaatagacgccatgatacaccttctgtggaattccctgttgtaccttatcgcctcctcgatgtcccggctatcaaaacaacacacacacagaaaacaaaatgtatgccactatcatgcgttgcaacctgttttgagctggtttagacaataagatactgctttagttctttcaccttaattcctcaagtttagctacttcttcctcaagtttaattcctcgcaacattcatggaagatgtaacctgatctgtagttgcattgctgcgtcctccctagatttagcagtgaaagaaaacaagctgagatggcaatgtacaggtccaaacaaactatttagagtaaaagaattattactaagacgtacagaacccaggtacatctaaaccttgtaaaaaagaaccggtttgcgcttcaaacatcaaagtattcatctagttttgtgagctcactgtgaacgactgaagctctaagtagtaagtactaggtactcccttcttttatatataaaacaaacgttatctgtatttttaaaaaggaggcagtcctatttgtgtgctccaggtgcaacaaagaacacatttaacaatacaccactacaagcatcttgcgttttcagcaaccaaaatgtatagtgtggaatgattttttttctccgtaaatgcatagtgtggaattgtttgtgagatatgtaggcatactagtggaaatggttgtgcatgatacacatactatcttttcatctacatagaagatacttgatcgacaatgctaataagcaaacagagacaactgacccctaattttcaaaggagatcctgtcttaagctacagattctgggcatcataagttcatcccgacatcgttagaactcagaaccaacaggtggacaataacagttacactctgctaacatgttttagacacggtcttaaaaaaataatgcaaatttgactgctaagggcacccacaatggttatctatagactctctataagagatccatatcagcatatttttctacttggaagatattaaatgaagagagagagagcaaagctatctactaacttaagatagtttatagagaaaaacgagacaatacatgagagagctatagatacccatgtagacatactattgaggtggtttactgagatgtacatgttttatagagagcactttactttaccattgcgggtgctctaaaaacacagtacagcatcatgggagtagtacctttttagacaaataaagatatgagattttgaagcacccaatctaaactaagtaactaacatattttcagaaaatgtctcgataatggtagatgaggaaaaaagaactaatcaccaacatctccctccacctttaattacccccatgatctcgagagaagccaagaactaaagtatgccacataccgtatagggagctcaaagtttggggttttttgaaaacgaaaggtgggcatgaacacagaacagatctggacacgaaatcgacctagcgagcgatgcatactagcagctcaattgcatggagatgcataaaactcatcgatcgacacgaacaatttgcgacgagtcgaggggcgaaccgacctgggaggcgttggcggagagggatcgagggcgacggagagcggcggcgggggcccgcagcttacaggcgaggtagcgcatcgccatagcagacagcagcaaggcgtcggctagggtttgctcaattggggacgtgtcttgcgcggagaaggggcggcggacgcgccggagggaggagcgaatttttcgtttctttttgtttttttcctttttttcgtttctgtttggttggtttttttctccggttttttcgtttctgtttggtttttttcctccggtttttttttcggtttgttttgtttccggtttctcttctactcggttttttttcttttttttttaaagattttataaataccaagtttgtattcgtacgtatagaacgtttgtatatgcgtatacaaactttctatacgtgatatattttctattttttttatttttagtgcgtatacaaactttgtgtgtgtatatttttttatgcattgaaatatattcataaaaatatatatatacacacatatgtatataagtatatacatatgatgtatatatgatgtatatagtacatatgagagaagaggggggtgcggctgaccccccgcgcgcgcagctgatcgcgtatgaaccacccccccttctcattgggttcacttctcaactgtgggctgggctgggccgggccggggcgggccggtgctcagatcaggtctcaaaaggccgaaagcttccttttgttcccgacgctcctggcgctggagatgcaggtgcgttccaagaaaggaaggactcatatatatgtatctgtgcatctctttttttggtggtgttagtgatcaaatctatggtaaaaatcatccataatcagtgcacgatgctagtgtttctttttaattaatttaatttggtcaggaatggctttaattgtttaactgcgagctcgtggcttctgcagcaaaagcgcaagcacgagagtattcatcacacgcttttttttaagaccgtatgtacagtcttaaaaagctatgtaattatcatttattttattgtcacttgatttatcatcaaatattctttaagtatggcataaatatttttatatttgcataaaaattttgaataagacgaatggtcaaacgttattcaaaaag

SEQ ID NO: 5782 - DNA, 6560 bp, Oryza sativa
tcctgcagcccaccagaagtaacgaacacagccttagccatgatactcatgaggagatggagattcaaactcaagttgcttgggcgagagttcgctgtctagacctttagacctgcagctggttgacattgatatggcatataaacatattatattataggtttccggttctgcatttgaagcagacgacataacagttggaccactagacctatgagttaggagagttcgtccggttcaacatccggtctaggttttccaacatccgattctgcagtcaggaattataaggatatcatcgtgataatactggacacaaaatggcacatggtagacgcatgggaggtcttcgtgacagattttacaagtttggtcaatcagtcaatgtgtaaacgctggagaaatcgcgaagaaattcgatcggatgcgcatatggatcggcccgtccaagatcagcgtcggcccaggcggagatcggcctacgcggcagttggcaagcaggcccaacaagcagttggcagcccacagcccacgcggatcgtgtctcggtacagacaggacacgtgtcgatataagattggcgcgcacagggagagtccgattgggattttctggcgtggctacaggtttgatgagggaaagagagtgtctctcttggaaaactttactccctcggttttaatttacttgtccttgtagtaaatctcacactaaattaagactcatgacaaattacattggtagctttgttaattgtattctaattacatttgttaaagcaagcactaaaaaattccttccgagagtactattactaatttggctgcatgaatggatgaaaggtaggaagaaaaggagttcatcttcatgcaaaaaagttgatacgctttgaggagtttagtcaagttatgttccttttgttcttcggatgtcaaaacgacggcaggaggaaggtcagaccatgatttcatcgggttaattagtacactacgattttggggttctcttattttttaacaatgattcgatcatttggtttttcctagtatttatttttttttctgatatacttggtttatatattcgattcaatagaaatcttgtaaaaaaaatgaaacaaaatgcaaagtgtgtatcatagaaagagttggagaaaatttgatccatatagaaaaaaaaaccaataaaaaaaatctcatttccaacaaaagcacaaaccaccttttttttcttagatttgtaacactttgttgtttgggttaagtgtttacccgtgagttggaatggagaaagactaattcgcccttggtctccttcctctttggcgttcccatcctcgtctcaccccgcctctatcctcttcctcttcccaagacgactgtcgacgcccgatggcaccatgcgccggtagtctcaccgctcatgggccagtgaatagcgaccttgccccatctcctatcccgtccctcccccatgcatttggggttcaacacactggcggtacccaatccttccttgcgatacagctcttcacctaggcacattagctacagagtgccttggattcctcgccactattgcactccagcaccagcagcagccacgcccaaaggcccccttcttcctgggctatttcaatggcaccgatatgggtgtggcgcatccgttcctcacttcccctaggatctcctttctatcggcatatctcatcatctcccctcatcccttcctcttctccagcgattgagataacttgctaaatgtgtcgaggaactttcgacatagcagtgccgtggatcaaggcagcctgggcggcgaacttgttgccacggccattgcctcccctcggccggcgagccaaggatggagaccatgggtaaattggtctttcttcgtaagaactcacagctaaatacttaaccgggatgatagctatgacaaaagtgctacgaataaaaaaaaacggtggcatgtgcttctggttaaaagtagaaattttttgggctattttcttataccaacttgttttctatgttacatgtgtatgtgcttgcacaaggtcattgaccagcaaaaacttaacccgttcttcactaaagtttgagcctctattcgtggtttatatattagtcaggccggagaaagaaaatcaataatttatcaaaaagtgaccaaacaggcatcgaccatttccgctttccaattataaattgattgttcaatatcgatacacctttagggctgtgtttagatccaaactttggatctaaactttcaactttttccatcacatcaacctgtcatatagacacaacttttcagtcacatcgtaccaattttaacccaaacttctaattttagaaggaactaaacacagcctaggtcgaaagatgcacaaattttgggaatttgagttggatacgtagaactataacccttgcctgtaacttgacacaaggtaaaagcgtcctttctaaaattttctctccaactaaaagaatattgaaataatgattatattaagttttggcaaattaccaatgaatcgtgacaagttggagtggaagaggcgacattacttactccgacactgcacgaacaaaaccatataaataccagttgtagatgttgatctgtacaaggttcggcccaattacagcccacatcgatagactccataatctgggccttttctaattgtgctgttggggcccttggcaaggccacgagacataataagaggaacaattatattcttttttcagttttgcgagattcaggcttccactgaaacattataccactacaaaggtaacaaatgtctagaagagggaggaggagagacaaaaaaaattgcttatatatatttttacacaaggaacaaatgcttagaaatatataatagacactataaaaattatgttttctgtcgtcacccttttatttctattggcggactaacaaaacaaatgcttgtaaacatatattgcaagatttagagttatgagacgaaaaaaacgattttcactgacggacacataggaggcccgtcataaaaaataattctgtttttgaggcggacctcttaagtttccaccagcgacgctgatgataagtaaagatcaccgcttgcaaaaaaaaaaaaaaattcacgacaccgaccgaccaacagggccgtcgacgacggtgagttatatatttgaatgaaagtatatttcatttaaattagacatataatttttttctccaaaatttagggccccaatctatattttgtcaccatccaccaaaccctccgccctcctcgactccctctcatttcctccctccttacccttaccactagtccccctatgtgcttacctgttaccactccctctacatcctctcttcagcttctccacctccgccgcgccacacggtgctctaggtgacggtgacggcggctgtggcggtaacgaggggcaggtgggaggggatgaggccagtggaaacggcgatggcaagccgcggatctggcagtggcaattcctagacgctgtggatccgacagcggaatgggaggaggctagtggcgacatcggcaaactgcgaatctggcggcaatggtgcttggacgctgtggatccggcaatggaaggggaggaggctaatggcgatggcgacggaaagccaccgatccgttggcggcaatgactggaggccatggatctgttggtggcggtgacctaggggcgcaaatctggtggaggcaacaaatctcatggcatgggcacgggcgggcttcggcgaggctcctatggtggatcctcgtccacgatgctgacaaggagagctcgactatggcagcggcagacagagtggcggcggatgctatttcatttgcatgtgttgttgttttttgcatgctaaaaaatggagtgaaaatagatgtagtgctatctggatgtggatttgaatatggatatgatgtgtgtttgaattgatttgaatttggatccctggatgtcgatttgaaaatgcactagctcctctagatgttgattaattttttttggcaaaaaaacatttttttcttcttagtagtgccacctgcaaaaatccaattttcgcagttgttcctcttaagggtcagcctgcgaaaaatcaattttcacagcgcaccgcaactgccagcaaaaattgttgattttcactgaccttagcttgttggcggttgtgccaaccgcctatgaaaattattgttagtagtgagatatacatcaccacttaataaaaaaacttatgaaaagttctcgaaaaattactattagtagatattggagccatatcttctttctaatttgctctctatcgtttcttttttagcttatggagcgcacataaccaaaatttatattttaaaactcaattttaaagttaattatgatttttttcatcgtagtttattctcaacattaccgtttaagttggtaaggacacataatataaaagctttacttacaaactattattgtttttgtttagtagatattatgggttgtataattaatcagttatagttgaaacgttgggtcttgtgtcataaacttttttagataatgaaaatagattacattttcggcctctatccgtagacacacagccaaaaggttcagaagtaactgatagcttaaacaaactaaaacaaccttcacttaaacatagaaataacccagcctatatagcttaatcattttttaacccctactgctgaccaagcagccaatagggctccgaaacgtgtcctagccggaccaacgggaactggacaagtggcacctagccagcaaaaactgtgcccatacaacttggcacattagattacgcaggtacacaattacatggattagagtaatcgagctctagctagctaggccccggatcgatccatctgctgcctctctgatgatggattaaactatgattaactccctcatgccaactcgatcatcaatgcacgagcttagcttagctagctctctagggtcttaaacttaagcacagccttttaagcctcttttgattattaattatacttaattaggagtactaaactatgtctttgcttaattaattactcctgatcctctcgtctcatgcatggcactgtactatccgtcctctcggcctctcctccgccggcaacccccaccgcgtcaccggccacgtgtcgccaccgcccgccggcgaaccaactagccattctcgatgaccggtggatcggaggtgatgcacatggatgattaatttaacaatgttggaggcttggagagaatagtcattgataactattaaacggcagcgttcggggagattggagattagattgcacatcgttttccgcgtgcacgtttcccaaactattaaacggtgcgttttttgtaaaaaatttctataggaaagttgctttaaaaaatcatattagtccatttttgaaatttgaaataattaatactcaattaatcatgcactaatagctcacctcgttttgcgtatcttcccaatcttctctgtcttccctttctcaaacacagcctaagtggagttaacaagttaagtgtagatttgatgggggattagtttaatttatgcataggccccaatgctaattgcaccttaatccttgtggcataggtaaatgggagtacgagaatacgcatctccagcttttggatatcgttcttaattttcatcagggctatagccatgacccatcatctttaagtttttttttctggcctctcctgtgtacggtcagtgccacttgtcaaatttatttttctcctgccctgtgaaagaggcatgagatctttccacatttcctttttattcttttctctctttacatcagaggaggcaggggcaaagttgtcttttcacgcggtgtgatgtggatagagtaacccataatttacccacagcatcttgctttggtgtgggggctgtcatgctagctgcttcatcttttgaagcaatttggttaggtgtgcgcgatcgatggcctccacaccgcgtataaaattactgttgaatcttgacggggtcttcgcgatattagttattattatgtttcaactttagctggctataatgttctagcatatcttgaatatatttatccggaaactcttgtcgtgccgcggttgaatggttgatatattggtacaatgaatatgatggtaggacaataacacatgggaatcaatactcctggctcaaggaatatcgaaccaccgaaatggtaattaataacactttaatgtatcatattccaacaccataaggaatattacttctaactctataatagctgcaataaccagaatgaacatttcccgaattggcataaatggaaatccagctattagaacaatcatgcaaaattgtaattcagcattatttttgcttggattatattctttgctcgctctcacagtcttactccattcatctcattatccgttttatttgaaaaatttagaaaaaaataagtcacgcataaagtattatttatgttt

SEQ ID NO: 5783 - DNA, 2116 bp, Oryza sativa
gatcaaatgttggatacgaaaatccataactataattaaaatggaacgaaaggagtactaattaaggttggctatgtaccaatttcagatgctttctagattggaggggctatatacatgcatgatgagaatagggcttgttagttgttatatctatcttgaacaattgataaaaagtgtttggagattcgtgacatggccctctttacaagaaaagtggcactagtacaatgcaatgcatataaacctttcaccctctctttagttcatgtgagatgataaacaaatggaaaggggagcctaaccacacctgaaacaatatcttaatatacaagtatctagctaggctataccggctaatagctagccctatatgatcgctttctcaacaagtgtcaagtagtagtgtgttatactaacggtgctgagtttttaaaataacaattgaccattcgttttgattataaataatatactaaattataagtcatattcaaagtttcattataaaacatatcacacaaaataaattatatttctacaattttttagtaggatggatagttaaatgttatatgttaacggtgtcctctctattaaaaaatacaatggcctatagtttgtatcacaatatgccttgttcagaattcagatttactagtgacactgtaacggacaatactaattagattaatccaagtattacagctcgtaattttccatacaactggtcttatattactagggaatataataaattggacatgaagagtctattctattttttaccttattacgcagacttgtgatagtcatccacatgttcatgacagaattttggagtaatgcattatatattctccttgtaaattttacagcaaaaagatgataacataaatgcaaaattgaaaacatgccattgtttgttaaattaaacatgccattaacccccaccatctaccacggttctctgcagcggacatggcatcctagtgttcatccctttttactccctccatcctaaaaaatacaacctcttactataacaaatctagatataagtacgtctagattcgttgtattagaatgtgtcacatcctctgtcaacgcctcaacattcaaatagaaaaaaaaagtttaacaattgaatctgattttttctgatttaaattttgctggaaataaaaatcaatgttatccctttcttgcaacaattataaggagaaacatgtggagcaacaaatggctagacaaatttgtgtgataatctgtaaatactataattatatattttttaatatatacactatagaatcctttcctacagtcctttctttaaagaaaaacatgtggagcctaaatttatctgctttcaaacatgaaactactcatcaaagtgatactacatcagatgcctctggtattatgtttcagtcattcctttcacctcttttaacctcctctgaacaaactcttcttacacatgctaatgataatgaatactggcacaattaatatttccaatgatactgaaatagggaaggctgtctcacacactgatctcacatcacctcactggttgcagtacctagcagggatgcggaaaatggtgtgggtacccacacatgtcaccaaagcaaagccatatgagatactccttccgtccaaaaagaatcaacttatgcccggtttagttcccaaaaactttttcccaaaaacatcacatcgaatctttgtacatatgcatggagtattaaatatagataaattaaaaaactaattgcacagttagaggggaaatcgtgagacgaatcttttgagtctaattagtccatgattagccataagtgctacagtaacctacatttgctaatgacggattaattaggcacaaaagattcgtctcgcggtttccatgcgagttatgaaattagttttttcattcgtgtctgaaaaccccttccgacatccggtcaaacgtctgatgtgacacccaaaaattttcttttcacgaactaaacgggcccttaggatagaatatgatttatcctaagacaacaaatctggacaaaacacttgtctagatttattgtcctagaataggtcacatcttatt

SEQ ID NO: 5784 - DNA, 9886 bp, Oryza sativa
tgcctggattagctaggattaattaggaggacattgcgtagtggcttagctatctctcaaaagcttaattgggagttgtgttcatatcccaattccgttaattaccgaactataataaattgattttactgtctatatatagtatatctatatatcttcttctgagttctgaccatatacaaacctttcatataatatatatgcaagcttttaggccattgtagcacttgcatctatatacttctccgtcctaaaatgtagtcctaaaatataggggattttagccggatgtgacatattctagtactacaaatttgaacaaacagtatattcatatttgtactattagaatatattacatccggttgaaattccttatattttagacggagagagtaaatactaactactatgaaagaagaggaatcaattaatactaaatttttaggcattgcattccattccatttgaaagatagctgcatctgcaagggaaagatgttcataaatgttgtctctcttggatataaagatgcaggggaaagaaccctaccaaccggcagtaaaagtaatgttgctaactgctatacactgtattaatcagattgacaagttgggtgtgtgttcgattcaccaacctgcatccagatagcttaactagatcgatccaaaaccttagatgataagttggtgaggtgttctcctttttggatgcattgcatttacagattgcccaaccaagattcgaattgaaagggctaattcgtgaatattcaccgtggtaagaactggcgcgaacgcccgacacacacttttatcttttctgttttcaccgtgtttttatgtttctggtaattaaatttgttccaagttcgatttggaatcgaaagtttatatgatctatttcaattcaaaatcaaagtttgttatgaataatgtttctctacaaaagcgcgcaataggaccgacgagtacgtacgcgaggaggaccgaatgcgcgatgcgaacattcacaagttagacctatccaacaccaaaatttgtttcataaaatttgtaaaaaaaaattgtttcatttaatttaatataatcactagcagtcgcaggtcaattagggagacatttccatcaactatagtatacgtgcatttgtgttttaatcaagaaaacaaacaattatttagcacaagtggcgtgtgtcatatatatggacaagtacaatggtcctgcttagtttccacacaaaaaattttatatcatgtcacatcaaacatttgaacacctacatgaaatattaaatataggcttaaaaataactaattgcatatattatgactaatttacaagatgaatcttttaagcctaattgctacatgatttgacaatgtggtgctacagtaaaacatttgctaatgatggattaattaggcttaataaattagtctcgtaattagtaaaacttatagattctgtaattagttttttatttggtgcctaaaaaccccatacgacacacacgtaatacccgatgtgacacgccaaaactttacacccaggatctaggccctgtttagttcgcaccaaacttctccccaacttccaacttttcatcacatcacatcacatccaaaactttcctacacacataaactcctaacttttttttttccaaactaccaactttccctaaacttctccccaatttcagaaactaaacacagccctaaacaccctggaatcgaattaggctgtgtttagattgacccaaagtttagaatttagttaaaattagaaacgatgtgactgaaaagttgtgtgtgtatgaaaggtttgatgtgatagaaagttaaaagtttaaaaaaaaactttggaactaaacacacccttaatcagctgaatgtagcacgtaaattccgtagacatctcgggaaaaaaaggccgtacgtgtgtacagttataaggttgtgtgtcaatacttgtttgtcgcccgtacatacggttggatggatcattaatggtttcttagacgcttttggatatgtttgtcgacttgtaataattctacttacagtacgtacttaaaaaggtaaacaatacgtacccattttatctgaaaaaaaaaattctacatccatagtattccttccgttacataaaaaaacaaacttatgactatgaatttgaacgtagaatacatctaggatttacgtctaaatgcatagttagaagtttgtttgttttgtacaggacggaggtagcagttgaaacatctgttgcaattcataagttgattcagaattttcataacgttagtcgcatgatattagccatttcatttaaaaacaaaaatcaaacggttaggacatactcatccaaaaaaaatcaacatagaagaagaatctggacaaaaggatcaaattcccttctaggtaaagtttttttttgggacggagagagtaagttctatctgttgatacactagttgtcgtcttttcgggtggctccttcatccctgtaaaaacatacttttttttagaattatatagtacaacgcatacactcacaacgcacgcgcactcatccctacgaacacagacacgcacgcaaaccctacccctataagcatcttcgaagattgtgccggcaaataatcctggagattgataaagtcaccaaagacgccttgctatcgacgggtatgtcacctaccactgaaagtataaagccgttgaattctaaaaaattcgcttttatagggagtcgaacccggtttagcgagagaagcacgtaaggtaacatgaatcatattagaatttgtgatgggagtgaaggtccaatggaattatgtaatcttttgtttgaacgaagctagctccgttcatgaaaggagaggggttgaggcaaagtgaattaggattgatgaatacgacgagtgacttggtttgaaccactttagcaaatgaatcgggtgtgtttagttcacgttaaaattagaagtttgtttgaaattagaacgatgtgatgaaaaagttggaagttacgtgtgtagaaaagttttaatgtgatgaaaaaaataaaagtttaaagaaatattttgaaactaaacacggcgcaagcggagaaaaatcttgtgaaaaacacggagtactagtctgagtcgtgttggattctgaccatttttggtcagtcaaggcgtatcatgtgtgacactgtaagtcaggccgtccggaacagcaatggaacagttgagctagccgactactactaccgctagtaacagcaactacgagctgtgtttttctcccacttcccaactcactatcttgttttctactccctccgttgtagaaaataaaaaaaaaagacaaaccctgagttttcgtgccaacgtttgactgtccgtcttatatgaaatttttttataattagtattttcattgttgttagatgataaaacatgattaatactttatgtgtgacttatgtttttaatttttttcataatttttcaaataagatggacggtcaaacgttggacatggaaaccaggtttatctttttttaggacggagggagtacgtaacaaagtgtattttcttttaaaaatactatatatataaattacttaaaaaatcatattgataagtttataaattttgtaagttaatatttaactaatacattaatagtgcgggaggtggaaggccccatcatttagctttttttctaataagccgaaagggaataaaaatcaatttatagataaaacttttatatatttgttattggtgacttaaaacctaatgctgaaaaagaaaccacgttgaaaatatctcaaaattaaatttaaaaacttaaaatttgtctttttctttagctgattaggctatcggatgggatccggagactccagaacagcagtaagggtatccacaatgtacttcaaaaccaatccatagccaataaaataatacattcagctatctaaccacattgtgaaagtagttcataggagagaaatagcaaaagtcatccataaacatatgggctgcccatatagaataaaatatgtcatttgtctctatttcctctctcctcctcatactacatagtactacccatatatattgtgaatgttgcaatagttaaagtccacaaatgtgggacatctatatggactactttagctatatacattagtgttgccctaagggcatcacaatgtattctaaaagtggtccataagcaatataatatttgtttcagccacctagcaacattgtggaactagtccatagagaaaaaattatattatttgtctctacctcttctctcattataatactatttgctatccatatacacggtgaatgttataatagttaaagttgttgatataagtagtccagtgtgaccgttgcagccaccatccctggcacgtctccacaacctttgaagttcacccgtgcgtgcaccgcggcgcacacactacaccaccatcccctccccccctaccgcctcgtttcgcacacctctcctcccccccatcccatcatcaattcttcaatcaatcatccctcttctcttctcttcccatttcaattttccttttcccctcataaaatcactctccctcttctctcttcctcttctccccccaaaaacctcgcctccgcccgatcgcctcgccgccttaacccccacccccgatctccttcctcaccgacgacgcgcgccccactccccccacctcaatgcgcgcttcctagggcatatgaccggtactacgacaaccatcacctctcgccgtcaccgtcatcgtcgggatggagctcgccggcagcaacaacaagcgggggagggtgagggggcccaacgacgacgacgacgacgccggggagccggacgccaagcgccatcaccaccagctgctgttgccgtggccgcagcagcagcagcagcagcatccggcgtcgcggatctaccgggtgtcgcgggcctccggcgggaaggaccgccacagcaaggtgtacacggccaagggcatccgcgaccgccgcgtccgcctctccgtctccaccgccatccagttctacgacctccaggatcgtctcgggtatgaccagccgagcaaggccatcgagtggctcattaaggccgccgccgccgccatcgacaagctcccttcgcttgataccgcttccttccccaccaaccccgcctcctccgccgctgttgctgctgctgctgctcctcctcttccccatgccgaacgcgagcagcagcagcagctcaccaagtccggatgcagtagcacgtcggagaccagcaagggctccgtcctctccctctcccgctccgagagccgcgtcaaggccagggagcgcgccagggagcggagcagcgcggccgccgccgcggcatccaaggacgccggggacgacgccgccacccccaccgcgcccaccgccgcgcccgcctcctcgcaggcggcttccttcaccgagctactcaccgggatggccgcagccaacgcctcacccgctgaccacaagcagcagcaggcgtggcagccgatgaccgtcgccgcggccaccgccgactacatcggcttcgccgccgccgccgcgccgcatacgcagccgcggaaatccgccgcgggccatcactccgcgatgccgcacaccttcgcatcacccgctccccacctcgccaacatcacccccatcgccatggcgcccgcgcagcacttcaccctcacacccgccgccgccgagcaccacgcggagatgacgcactactcgttcgaccacttcatgcccgtccacgcggcagcagcggcggcggcggcggcctccaccccggccggcggcgactacaacctcaacttctccatgtcctcgggtcttgtgggtgtccacagtagggggacccttcagtccaattcgcagtctcacctctccagccatcaccaccaccatcaccagcaacagcagcagcagcagcagctgcagaggctgtctgctccgctggatgcgcccaacattccgttcctcttcagcccggccgccgcgcccaccgccgcggacacccagttcgccgccgcattgcagctctgggacgggttccggcacgccgacatcaaggagaagggcaagcactgatcagatcagcagccgcgggcatcgacggcgacgtctcttcttggatggtaaggggccatgaactgatctccactctcccccaattgcttcatgttcagctttgcttgctttttggcagcttgtgccttgggggaatttgtttaagcccccaattgcgaatttgatatggtttaatctccaacttttggtggctctcgaggtggccttgtgtccctcaatcgcacaaaacactcgggctgttcttgagcaattgacgagtgtctaagctttagggggagggagcattcagctcaacccttttacaacaggtgtcgatgcactactcaccgggctgggatcttgcttcttgttctgttcccccccaacaattatttcataggagacaggccaatcgcacggtttctgcttgcccggcattggatttttaatgccttaatttgttgtaaccacaccctccctacgttggggtagtattgctattgcatggatggaagggatgatgcatctgtattgtcaaatgcttgaactgcaaatacagaatggatggagaaaaataccctgtagtctaagctgtttcctagtgttcttttgataggcattggctttgttgagaagtggacgctaacccccaatgtctattgtctttagcaagaactagaaaattttcagaagagctcggagctgaatatgcagctcagcgtagccaaaacaagttcctgttcatgccattttaacaagtagtattttggttgttgtgcttgatgtttgtttctgctttactactagttactagcagttagcacacagagttgtgtgccaccaccaagtcaatgcattcaatgccttgcctgaaggatacaactagaactttttcttggattgcatagttttgtctagctagaaaatgtagcaagctcaaatcacttaggaagaaatacctcctaagcagtacagcttcatgaggtcattttcttttatcaggtcatatctttttctaagatagtttcatttattgttgggagtctagatgtttactgacttagttcgtcaatagtagagatggagaataaggcatgtgcaatatatgtgttgttgaactatcagtgctagactgctagtgatggagttaaggtgctaaagtcttgaggagttatcttaacatcttttcaatgaaaagagaaaactgcgaacgatgcgacttcacaaaaaagaaaagaaaatatcagaggaagctaatccatatgcatctaccgatgttgtaaaaaataagtgcacacgttttagcgctgttgctttaactgtgaagtgtttcctcaaaaaacatctaatggttgacacttaggccgagtatgggacatctatctctgtcaaactcaaaggtgccatggggccaagcaatcaaacatcagtctatatcaaattctaagggcaaaccatacatcaaagcatactattagcgataattgacaaatgactgtgatataagcatgctgttcaagatttggttgccctttaactggatgtgaacttccaaggacccatcagggagcactgaaaatcgtacatattatagtttctgagtagttatattcacttacatatcgcagtatcagtagataattcacaccatgttaagtcatctttacagggacttacatagtatttcatgatcagctctcgtaataacccttaagctagcgctcaatttggaaatttaggctgtgagatctgaatgttcatatagaactattctttcgttgaagtaattttatacatagctagttcccttttttattcaaagttaatagcagaaggaagttcttttcatggtccttcagacttaaaaagggacaaatcatacaaagtacaacagctatgcggttaaaagctgaattgcgtcgttgcagttaacacccagtggttatagttatgttaagatttgtgtaattctcttctggaaaaacatgttcttagatctgggttagcgaaaatcattctcagtagttaatccctcaagtattaatacattatggattatgttgataatcattagatagttgattgtcatggaagacattctcagaatttgcgtcatgttcctaggtgatattctaaaagacttcattgtcaggatcatgtttcctaaattttgccttaatctttatgtaactcagccctttctgttcctcaccaactaacatgtgctacatgtaccttttgtcatatttgataggaaaatgtgagaagtgccactgtgaagtagtatgttgtatcatgaaatggttgagattttcttttgtgtagaagagtgctcaatattatgctttcctttattgatgctttctagcgctaaataaaactaaacccgtatcccgtatgccatattgaattttaagtgcttcgtatttcaggaaagttatctcagctggaatactgtgtacatgactacaaagctgagattttaaacagtatactaccttaagactagtttatcacaaagataagcaccagagtagccaaaaggtgcctttttttattgttttgtagcttagctataactttggtctaactactgcttttccatgtaagttgtatatattaagataagcttgaaatacatcaacatgcttgtgaattgactattgagtttacaaaaaataacttttagtacttagacccagtaatcaaactaatacaataagcctaagttagcacaatcttgttcatgggccattattacaaagcttgaatgaatgtctctagcacttcctaccttttactgcccaagaactgtcatatgtttgacatgatttctttgtttgtcaaataaaatgatttggatccttgcgttatagttgctaggattagaatctgttgtctcaaaggtctttagtacatgtggtttactatgttcttctagagtcctggaatataaatctactcaatagaccaggaaaaaaaagcattatgattaacatcaatccgacaggtgagatgaagctggggttttattgtcttctctgatagaatcattccagaaggatcagttaactcaccaatatagtaggcaacttatgctgctactgtgattaataatatgaaagtgcttcatcaagaaaactagaatgaccaaaaggtgctctgctaaaacagtttggtccagctgtccattttttttaaagcaaaagtttataggctggcctactatatgtctatatctcagcctctgtccatctgtcagcaatgccacactattggagtgacagatctgggaatatatagacacagtattacccattgtttcgtaacatcagtttaaagattgcgcgctaccttttaaggttaagtttagtagaatttgcacatagtttgacaagtaacttgtatttcttctgatggagattttcattctgattatttacaggaagtgaaaacatcaaaacgttgcaagccattcctgtgagcaacatccacagcttgaagctgccataagtgaatgctggatgcattctcggaagtagagcatcaactgcacatctaccttggtcacgggaggacctcatcatcgctattcagatgatcttgtgctttctctgcctgttgttgtattcattttgttgagttgagaatttgggagcattactcgccggagtgccctgaggaggggacgcccttgtaatcctttctgttgtaaactatgtcaatggatgcatgcggctctgg

SEQ ID NO: 5785 - DNA, 1152 bp, Oryza sativa
  unsure (1)..(1152): unsure at all n locations
tcctgcagcccctccaagctaccatttgccatgtactcatacaggataagattgcagtcctgattggagcagaaacgatacggcttgacaatgttccggtgcctgacatttccgagtgtggttatctcagctcgaaagcttctatcgacattggaaccttctccctggcacttcagcttcttcactgaacccttctcccatcaggcatgatagccttatagacagtgccacaagcaccccttccaattacggcactctctgagaagctgtcggtcaccttcataagctcctgaaaggttatccgttccttcaggaagtagtgaggacctgaaaacccagtcttgcgctcttcgttcgatacaagatcaggtatcttggatttcaaggaccagcaaacgactgcgatcaacaccaatgagacaaacgcgataacaatggaggaaatgctgatgatcttctcctgagaagccgcttcttctgcaccgctgcttccctgcttgcataggctgaccctgataatcctgaacatgatttccctttgataccacaaaggccattgtttcccaggaaattgctgctgtccatgtgctggaacagcgtggtgctgggaagcggcccggcaagattgttgtaagaaaggttgcactccagcagactcgagagctctccgaatgaggaagggacttcaccttctagctcattgttgttcaagtaaaggaactccagcatgtgcaagtttcctagttgagtcgggatctcaccagatagcatgttgtaactgacattcacgaatctggagcgcagtgagctggctagctcgaccggcaattggccggacaagcggttgcctcccatctgcagctcggtgagccgggaaaggcctccgaaactgcttggtacggttccattcagactattgtagatagcttcagttgctccaggttcaccagtgtgccaagctcctgaggaatgactccagtgagggagttcttactcagatcaagcctctggagctttgtacaccgcgccagctcccgaggaatcggtccggtgagctggttcgacgatatattgaaggcgannnnnnnnnnnnnnnnnnnnnnnnnnnnnnnnnnnnnnnnnnnnnnnnnnnnnnnnnnnnnnnnnnnnnnn

SEQ ID NO: 5786 - DNA, 389 bp, Oryza sativa
cgaaatttggccccgtttagttcccaaaagtttttcccaaaatcatcacatcgaattcttggatatatgcatggagcattaaatataaattaaaagaaaaactaattacacagttaagggggaaatcgcgagacaaatattttgagcttaatttgttcatgattagccataagtgctacagtaacccacatgtgctaatgatggattaattaggctcaaaagattcgtctcgcggtttccatgcgagttacgaaattagttttttcatttgtgtccgaaaaccccttctgacattcggtcaaacatccgatgtgacacccaaaaaattttatttcacgactaaacatgcccttgtttcataaatttaagttgcttttcatgcatgcaaa

SEQ ID NO: 5787 - DNA, 6704 bp, Oryza sativa
  unsure (1)..(6704): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagcacagcttaaaaagctattagtattttttaattccctccgatcggttattatttgaaatgccctccgatccttaggtttaagcaggtggacgatctgcctatacaaaatgccaagtgggcccatatgtgaaaattcattttcatatatggatggcttaagagatcacatgctccgtttaaatggtgctattacacaaattaatcagtaagtaatgtaaattgatctcgtccatgagcaacatctaattaatcttcaagatcttgatcaaaatttcagtcccggccggcaacataattattttgtgacgtcgcagagatcgatcgatcagattaattgatcatagagacatggctagcagcagctactacctaacatggcacatgcatttgggagggatgtatctatttgtatctgcacatggtgacaaggtgtctgcacagatatgtgatgaaagtaggtgataaacttttgaaataaaatggcacgcttttcaaactgctaaacagtgtgttccgtgcgaaaactttctatatgaaagttgttctaaaatatcatattaatccatttttcaagtttgtaataattaaaacttaattaatcacacgttattaactccacgttttacgtgaaatgcttaatgttcatcttcaggatattcaatcaccaccttaatctgcaaacctttgcgtgacgaactacgctgcatcgtcgtcttccaaaaatgtggcgacacgttttgtttggtacattcgatacgatgatatctgtactatgcgtttttgcacatgagaatactgaaaccctacgaaattcagtgaatgaatgcagatatctgttcagctgatatcgagctgttttatagctgcaaatggctagacagcgaagatatgcgatgccttgtagacaaatttatttggttctccatataggttgatttgatttcgacaggggcccaatttgcaccaaaagtgatcgaagaaggacagattttattttgtcttcttatatactccctccgtccctaaatatttgacgccgttgacttttataattaaacatgtttgaccgttcatcttattcagaaaaatttaagtgattattaattattttcctatcatttgatttattgttaaatatacttttatgtatatatatagttttacatatttcacaaaagtttttgaataaaacgaaatgtaaaacatatttaaaaaaaagttaacggcgtcaaagagagcgagtacaattgttacgatcaagctgcataagaaagaaaccttttgcttttgcttttgcacgatgaaatgatagtcaagatatatagcctctgttgaactctcgagagcccatggatcaaaacttcggttggctcgatagttcagcccaatcggcccattgttgcatgcttccagtttgggccaatttttcatttctgtgtcacaattggaacttccgttttgatatcgctccttaagaaaatactccagagttttgcagaggtccatttgaatcacaaatcagactttctaattagaaattttacagtacttaagaaaatacatgagatacctaaattttacactaaaagatttggtacctcgagatacctagcacgtaaaggtatgaaattttatactttaaaatatggtatttccctgcactttctaaaggatgataaaattacccttctaatcaacttagctcgatcattttctgtaaaaaagttagctttatcattaattatttagctcaacacaacctattgctctccatataaagtatattctctgcgttcaaaaataattaaatgacgttagttttcttttactatttttaggtgcaaatttaatcatgacttttttggaataaactcataaaatctaataatcttatgagattacgaaaatacttgtaagtctatatcttttatgttttcaaactaaaaggatataaaaggatatgttgatagtcaaactttgaaagtttcgcctcaaataaaaaattcaaaaagagttatttttacctggatggagtatactccttccttttttaaaatatatgagattctttgaacacgatgtttgatcatttatcttacttaaaaatttagtacaagcatgaaaaactgaatgcttaaagtgcttttaataataaaataagctatatgaataaccaaacatcgtatcaaaatgtcaacacaacactatatatttaaaaatagaggtagtataacgaaggattaattaaacctcgtcctctgcataataaaaatgtaatataatcattttttttctttcaaaagaacagaggatcttgaaatgctcttttaagaaatggaagaatcccagagtccagatacataaacatttcatttattcacagtatatatgacatcatgcacaaatttgctagatcaatttacacagtacaagcacatccttattcctttgtacatatgtgcaatataccaccaaagcatcatgttcattccatcactctaattaagctagctagtgctgttccagcacacacaaacacacactggatcatgcagattctgaagcttgctttgctcctgcaggtggctggtgctactactccctttggagatctggaccatgcacacctcacatgcattcttccatgttatttctttttttttaaaaaaaaaaacgaaacaaaccggcacttagacagtacgaaatttcattgaatatatatcaggaagaatgattctaagttcaatcttccatgttattgatcttatttatacgcactatgatgatcatgatatgatatgatatgatatgcaggctaactaacctcttgttgattgagcatttgaccacctaaatttaatcaacctgcacggtggcgacgcggcgccgatcgcagcagcggcgacaccagctggtgggcggcactcgccggcggcgacggcgcgtagcaccaccggccggagtcgccgccgtgcagctggtcgtcgacgacggtgacgaagaagaagcttctcagagtgacctgcctgctgcttgccttgttcctgtactccactatggccttgtacaccaatggtatcagcccttccatttcttaatcaattaacaatctaataatatatatacccttggatagcttaatcagcaacactgacactgcaagtgagtgagcgaagcttgagctaagctagagcagcaagtgagcctgaaggatgctataaaaaggaggcagttcgagctgaagaaaacgaagggcattttctacctttttttctacctgcaaaaacgtaaacgtctcaccaaatccaccaagtctgaatttttctttcttcttcttttcaagtggcattcggtggaaccgatcagtgcggcatgcttatctgaatacacattttttcagctctgatcatgtgtcacattttgcatcacaggtgatgaggtgatcaaatcacgatggtttgatgtggaattgtggagtggagggaaggaggcgtgagctgaaaatctctgaattattttgcaggtggcgggtgactttcagcaggcaacaccactacaggaaaattgtaaatgtgacgacgatgagctaagctattatccatggagaacttgcgattcaagatgaatcatgaatgtcagattttgcatgttagtggagaagattctgtgctatgcattctgctgatggattaattcccgatcgacattgaattgaagagcttctgctggaagataattttgctcttttttcagttttttggagacttgttcagaggatagttattcttcagaaccgtgcattatattaattctagttttataggcatgtttagtggaatgatttatgtagataacatgtgcctggaatttgcctggcacactggtcttgtccttgatacttaataaactaatcaaagcacagaactctgttcttatgaatttgaaatgtaaaactgaggcaatgaacagggatgaataatttggtgattgcccttgagtcgatcaaatgacaccgacaactctgccgtgaaacacttgacaattggaatttgatggctttacacttttaatgcatgccttccattactcaaaagacaaaggttagctatagctgcagcttaattggggacactgtccactgaggtgtcctctttgatgtgttcatctcaccaaatttcagtagccaagaagccaaaaccactacctctctgcatatgtcttgacatctttatctcctgctgttatgagcagtgataattggtttggatatctttgtctcaaacttaatggagaagacttattagtgctacttaattggaattatttaatagaagcaacgcagctgtacatgcaagatgctgctgcatggttgtaagttgcaagtacatctgcagcacaacgactgcatacctgcagcaacagaatgaatacaacaagtgcaaagatactgtcaaagtttcagttcaggtgctgggtacatatcacacgaccagaaactgattcagaacgttcttaaggtagcttaatcttgcagcaacaatgccaagttaagggaccaattgcatggtaatgaggggcttaacattaaaggaaaaattgaaaaataccatcgcaaatattcacgagttgtgaaattccaatcgtttgttaattagaatgacatgttgatgacacaaaaaaatgtattttttttaaaactccgtggttttgagataatactaagaaaattggccctaacattaattgtacatgaacagtcttgggtgcaaaagcagactgaggtgagaaccggaattcagaattgagatgggccgtggatgccatctggcccaaattgaaagactaggcccaactcgtattgtgagaatgtgggcctcaagttcgtaatggactgcatctgatcggaataattaaattccgaaatattagcactgtgcttgactgaaatgttttagttaccagttgatgattaatagcccgtttacttggtcatttcgggccaaatcgttgcacaagaattatagtgtgacagatttccttattatgtccaaaactcactctcggggaatcaatcaatcattaaccttactagttgaaatcccgcgcattgctgcgggattttatatcaatactttgaagaaatgaaaataccatataaaaagagagagaatgatatgatggttgatacttacaaatattgagcaaacacttgtaagtaaaacttcaaccgaaccaatatagtcgaaaaataaaatagggcatgcaacattaggaactgaattgcagcgtcttcgttattcttcaaaagaaatagtcatctagttatttaatcctaaaaaatgttgcatatttactgtgaatcatgagttcagaggatggtggaaggtatttgtggtctgttatgaatgttgaagggatgttaattaagaggctcatgaagggatgctaagaggctcgttaaagctccttgtggcctaattaattgtgttagttttcctgtaatttctcaagcagaaacggaaaggagaggaaatggacaggggcaaggtgatgtgatggcaatatatgccatcaataatcaatcctatggtgagaaaagaaatcgatgacgtggtttcttctaagcacagttaatggtcttaactttctagaaaagaagggattactaaactacaaccaaaaccaattaatgaattagggcttgttaggtcgagtgtcaactttatcacatttgtaccagacaagtttgatcaaccgagctaggctaaccttttgtccttttggtacatactttaactgtggcatgccacatcaacgacggattcccttctctctgtcacaagttgctacaagtgtggctaataaattttagccacaaaatatatgacatgcatataccacgcattgcaaaaaataattggttatagtactaaggaggaacttagcatccaaaaataatatagaagaaatagattagataatctaaatccataaggattcaaactttaggcaacacatcgctcctagtagcaccctgccagctgagctaactgccgttctcttaaatttggttggactactgaggagaaacttaatgcctaaaaatgatagaaaagaaataggtgagataatctgggtccatgaggattcggacccgaactagcatgtctctcttggtagcacccatacattgcaaaagaaataatgtggaaaaatgtggatatcatctaaccagccatacccttaatcaatggtggttctagagattttgagggtggtcttgaatcaccctccaattttggtataaaagtacccccatcattcatccaacgaaaattgtgataaaatagacataattttgacattatacaatttcaaactatggaataggatatcacccaactaaaattctgaagccaccattgcctttgttaccgaacaatgcatatgcaacaa

SEQ ID NO: 5788 - DNA, 1132 bp, Oryza sativa
cgtgatccatgtacagtagtagtatagcaagctagccaggtacgtatacgtacgattttgctctagttaacttgtacacatggtcaatccagtacggcagtacccacgtacaacaaccggtagtacatgtatacactgtcaacataatatacagtaagctggtgatttttttgattgacaaacaaaatacccatactttgctatcagctagctatgggtaaaagaaattatattgtaatattttttatcaaatattttatccgtcctaaagtataagggattttgatcggatgtgatatatcatagtactacaaatctgaacatttccttttcaaatttgtagtattaggatgtgtcgcatccaatcaatttttttttatattttggagcggagggatatgttaatagcacttgtttggttctttaagtatatgatattcacttcctcaaattgaatattagactatttcataatatctggatatataagttgtaaaaacaacaaaagcaatagtgggatgggaggttcactcccatcatcattatagccttttattaaaggtgtatagattttttacatgtgctttgttttttaaggcattctccccctgttgacataagaagtcttaagcttgctagctgttagccatgatcatatccaggcacatttgaaatgtatgaatttttacataccaacataaaaatgttttaaaaagtggcaaaataaagtagactaatactactccctccgccccataatataagggattttgagtttttgcttgcaccgtttgaccactcgtcttattcagaaaattttggaattattatttacttttttgtgacttactttattatcaaagtactttaagcgtaactttttattttttatatttgcatgttttttttaataagacgagtggtcaaatagaataagcaaaaaaattaaaatcccttatattatgggacggagggagtagtacactaacaacagtttgagaacagtatgcatgttcccttcattgtctagctagactacctgatctttgcatgcatgcgtacgtatcaattgattactgatcaaagggaagctagctaggtactagtactagtcggaagcatgcccaaatca

SEQ ID NO: 5789 - DNA, 1286 bp, Oryza sativa
actacagaaaaattgcatattgtcagtccataggctcataggacgtcttgtaagagctcaaaatatatgcatcatcaccaagttttcagccacttataccagaaataattttcggcgcattaatttactaccagttggacaacattatatgctaaccagttgcttgttttcttgtttggcaggctagtgtcttcaattcttttttaccagctgagtataaactagcaagggagcatccacaacttaactgagatcttagttgaggaacctctaggttatgtgttattgttgtgctccaagaagctgtggatataatctaacctcagtttgaacaagaaatctgtcgttctgaccaagattaaccatcggttaaaggatctgaagtagtccagttaacttcagtgactaccctgcagtggaggaagatatttcagagtttggagtgttccctttatgaaacactccaaataggcagagataggttcagttcatcagtccacaaagatctactttactaccctgataaagttcagtagcaacacactgcattgtacatacttaaacagtatatatattgagctcataataaatataacaaattaatctactgattttttttcttgctcttaatttcttgactacagtgatttttcctctctttgaccttgccaacttactgtaaaacaaaataaatggaaataaatcacagtaccttggaaaaattatcatctttatcatgtatggacaagcaagccctgcagtcggcagccaaaagtcgatgccttgaccatctttttccagctaccactgttggttttgacttggtgtcctgcaaactctgcaagcaagtcaggtcagcaaggcacacgaaattaggtattccagcaagccagccaatgataaaagtgatgagctgatccatgcatccttcctgccatggctcaaccaaagtaaggttgaaatgcactaatacctgctttttatcagaacgcagcagcaacaagcaagtgagcaacaaagaactgctcacccaaagtccacatgtaacatagcagctttcacaaagctttggagatccaacacatgtgtgaactttgatttggtaagataaaagaccatgaaggtttgcatatgttttctgcacatgctgtgcaagtactgaaataaccagaaggtaatgtaagccaagccaagtccagcataacgttcggtaagttcagcaaatgggctggcagaagcagacaaccaacagccactagaaacaagttgaatttacatctctcaag

SEQ ID NO: 5790 - DNA, 755 bp, Oryza sativa
taattgagtgatcggtatcgattattaaacactgcaatagattaggtaattccgttcattatataaagcaatacgtattgccttaataataagaaaatgttagggtcggttatctctctctctctctctctaataaaacactctctaaatagtacaacattacacatgttctcaggcaactctagtactagtgttttcgtcaagttcggtccacggaggctgactaaaattttggcccacgaaaagtaattctcaatcccacctttccccgggcatgcagcaacaaatatgatttttgagtattcgactttcttttgagggttaattcaatcctgccattaaaatttgctaatccattacaaaattgctaatttgacaaaatgttattactattcgcgatatctcaacaacaatgacatacaacggtgctggctccggagacctctcgtcgcagatgggaggtggtggacgatgacagcaacggctctcctcccgccgtagataggaagaggtcgaagacaacggtggctcctgagccctcttgttgtggatgtgaggaggttgacaatatatggtgatggcaacggcggtggctctcgagccctcctaccacggataggaggtggtcaacaatgatggtggtgaaaacggtgacttccgagctctcccgtcgtggatggggggagatcaatgacggatgcagcaacggtggtggctcttaagctctcttgctctagcttgcttgagctcgttgt

SEQ ID NO: 5791 - DNA, 23167 bp, Oryza sativa
cattctccggctatcacaacacaacaaaatagtacagagaatcaaaccatgtgttactattatatactatgcgtttagatctttccatttggatgtagaggccagtttaatccattagtagaaaagaaaaaagacctttcgagttggttaaataattaagaacagagagttagttccttcaccttgcaacttcaagcttagctacttctacaagtagcagccgtatttcctcatcgacattcttcccagccttcaaggaggatgtgatccctgtggttccggtcctgccaactccctagattttaaagaaagcaagctgagatgacaatataggtccaaataaactattcagaggaccgagtactccatccgcctcaaaatataagtatttttagaataatgccaagtcaaactttttgaattttgactattaatatgtaaatttgatgttactaagtttatcattaaacaaataatcataatatgcaacttttttaaaaaaacatatattgttggtcaatgtagtatctcaaagaccgtgtcgagatctaaaaatgcttatattttgggacggagagtagttactagagcaggtacaatagcaggctataagccagctataaacatattttaaagagataaaggaagagagagaagagcagcgggctacagatctgtagctagctgcagcacggactccaagacgtaatgtgtgtataacaggtgggactaggtattaatagtatagtaagcaactattgtaagaattggctattacattagctatagatgatttggagctagtagtgggctatactattaaacttgctcctagtaaatgcctacaactgtaccataatttcttcacaggaaatcaattgggatggttgggaaccaaactcctccgcacggaaaacggagcaatccattagcacgtgattagttaagtattagctttttttaaaaaaaatagagcaatatgattctttttaaacaactttcgtatagaaactttttttgtaaaaaacgcatcaaaataacagtttgaaaagcatgcgcgcagaaaacgagaggatggagctgggaaaaggggaaacgaaccgagcctaagcaggccaaacaggtggacaggaaggaataatttaaactattcaggtggacaggaataatttcttcaaactattcagagtactccctgtcataagattattatgtgaacgcccgaaatgcatctatccttttaattactcaatgaatggaaatttgaatccattccgtcaatgcatgcaattttcaagcatccaacctaaatttgttcttagaacatcgacagtaagtttcgaaaacatatctaatccctgtaaaagaaccagtttgcgcttcaaagtattcgtctagtttaccaggaatttccatgtgccaaccatgtaagctagacgtcctagctaaagctctcggtatactaggtactatttatattttgagcggtgttttaaacagcgagctaagacatttagaggttagccttctcaaaagctatagcggctaaattttacatgagaacaaacagctatagacggagatagcggtagctattgcaagagatttaaaaccctgattttgaggcttgtgttccaggtgcaacgacaaacaagtgatgcatatgtaacaatgccacaacacgcatatttgcatttttagcaaccaaatggcaactcaagttcagtgattctttttcagtaaatgcctaccgtggaatagtttaggcatgcatactagtggcaatatgtggctactatcctttcatctgcgtagaagattaaaaacttcttgatcgcccatgtcgataagcaaacagattgccctaattttcacaggaaatgcataaaagctagattctgtgcatgaaaagattgttccatcatcatcagaaccaacagatggacactaacagttaatccctgctataggaacatgttttgtacacagttaaaaaaaaagaagcaattttcatgggtaaatcagtctccgatctgaacttttattttcggtagaaaatctaaaagttttggaagtctcagtaaagaaaaaaaaaactaaatcaccaacgtaccccaagctccctccaccttaccccaatggttcgtctaaaatttctcaacgaactgatcaagattcaagataccccaagaaaacaagctaaagtagaatgaacacagagccaaatttggaattgaagacacaactaagcttaaagtttgttgtttttttttcttttcccctaagaaaacgaaaggtgtgcgtcgatccagcttggaatctgggcacagtacgtggaggtcgattgattcgtcggcaaacacggtatatagaacatgaagggatcgatggatctattcgtggatcgaaaggaattaacgaactgatcacctgggtggcgttggcggagagggatcgagaggcggcaaccgcaggacgacgaagcgcggcgactacagggcggagatagcgcgtcgccatagcagcagcagcagcaaagctaggtcgaggtctcgaggaggaggagaagattggaagcttaatagtggtaatcctcttattggaacacgcagcgtactgcgaagtagatgggcctatccgataaaccctagtaaatcctgaacggtttccgggccagttattatgcgatacctacctggctttctgattgcctttgtcctacgtggacatataaatgatgcttggatacatggctttacagtaagaaaatactacctccatattttaatttatgacgccgttgactttttctccaacgtttgactattcatcctattcaaaaaatttatgtaattattatttattttattgtgacttgatttgtcatctaatattttttaagcatgacataaatattttcatatttgcacaaaaattttgaataaaacgaatggtcaaacattggtcgaaaagtcaacggggcatcatacattaaaatatggagggagtatcttttttttaaaaaaaaaaaccggcgagacccatatatatcaatggcgacgcgatttctcgccgggaagctcctcgccgccgctctccgccggaggactgcggtctccaaatccgccgccgccccctcctcctcaggtatgtagacaacagatcaatggcacaaccaaattaattacgagatttaatcttcatcgatgtccgtaatctagctgttgttagttaagttaatttcctgcttgagctcggaggctacaattaagttaattgtctcctactttgcatacctgcttatgtgagcatgaattttaatgtgatttttttcccctccctctgtctgcttacatgatcataaaattaaggacctcaaggagtatgagtatcacgtacaacattatttaacaattccatgtgtacagtgtacttacttgcatatgtatcgatctcagcttgtttttttttctctatgtataactgttcctataaattttagggaggatgcacattcagcaatggaagaactaaagagactgcatcttccatgaatgtggacgagggaatgcgtatgctacgtacatgaagaattagctaaaattgaagctacaaggtgaagtaactaacattgctcttattcttgtaaatcgtatttaaacgaactcaaaaggtcccactcaatgcatgattagtagcatacatacaaatgttctctctgttgttttgacagcaaggaaatagccgagataataatgtacaacaggttccaaagaaagtgtgtaatgggatcagttgttcttgggatgggccttgcaggtgtctgtcacgagcaaggattatgtggagaagaatcggggtgaatgggaatagattggattatagtagatgaaataacaacaaacggtgctgaacctaaacggcgcgacgctctccgtcgcattgagaaggcaggccgatgggcactgagataaatcttgatctaatgcctaattgacctatgatagtatccctccttatatagatggaggactacttaatctaatcctaacaaaccttatctaatcctaacaaatcctaatcctatccaatgagcctaggacgtccggcccaaagcccatgacagtgtctcttgtgtctggtatactcataatcacaggaaggccgtcagggaggtgttcagggagctggagccggagctgaagcacgagatcttgggaaagtattcatcaccaagtaactagccatgtgtccagttcagttctccttcccttgcaatgtgctacttactaatcaatggcaatgactctggtgtatgcaaatgttacctcatgtttgatgaaagattacacatctgtgactgtttagcttattgataagtatccagatctcaaggtaatttacgatatccaacaagagtgcagcatagtactcaaaattggcttcctcacatcaggtcaggagacctgaacggcaacatttcaagcatgatgatgatataataacgcttaagttatagaatatttgtagcagatacatagttaaggacgccagtttttgtatggcctaaattatatagctagttcagaggtccaccatctcctctcctatacagccctttaaacaaaataagcctctactagtttttgcatgtcagtagaagtctcatcatgcccacgcaagaagatatatagcttctttcgcctggttagtcttgccaatacactgacttagacaaacctaccagccagatgtatctgtcaaataagtaggctaacggttattattctatataactcatataaatgttaagctgccaattgttgcagatactagtagaagagagtccaaggaaaataaataatttacctcttgctcatcatatccacttcaatctacttctgcagcagtgcttgtgctcacaacctaattcagaagaaaaaggaacggtttaaaacagatcaaaatcagttatctacaatttacttcccatgaattcaatttgatctgacttcaatctaactggagtacttttgtaccagagctgctgctacagtttttctaacatgtcaaaccaatcctctgccattactacccccatgaactcagcattgtctgcttctaccatgtaacaattaatggttcaggagggttatttacaagaaacagcttgtcataatattctcaagattttgatatcagttgtactatcctcttgaaaaaagcagaacagaaaataaatgctaattactattaacagcaacaaggaactctaatgtcatacagtacaagtggttcagtcaggttaatgaaaacaacaatcaaggatgtttggaggaaatggcaagagggaagtggaacttttacatgatgatcacaatcaccaggcatcaaactgatgtaaatccagagttagttgagaaaagaacacaaggtagacatgctctccagagcaaggagctgagtggaatttctaacgtagccaccggtgatgctgttattttcaagagtatctacgaaaaaaatcacaccttcgacaaattaaaaggtggagcattttaaacgcatgttgttgatacctgcgaaatgtaatccttaagcttcccactgatggactcatccaatgctctctctgcaagctcatacatcatagaatggccttctggcccactaagcttctccttcagtaggtacctagatcaaagaaggggtaaatcaaagagaactcttccctacaaattaccaatttcagataacacaagaaatgaccaccaacctttgctgcacaaggagttcaagtgcctgcttgttgttaccaagaacagggtggttttcatcgctctcatttaaacccagccgtctcaattgatgccagagatcctctgaaatgtgattggcaaacttcagaaatataatcgtcggtgaacttttcctgactgacatactgataaaacggaaaccattaccttcagaaatttttccaccggacagatgaacaatgctaatgacaacaaaagcgaagccagacacatgggcagcctccttatgctcgacgtacttgctgtacacctcagggtctaacttactgaccaggacgtagctcttcgcatccacattaactaaaacgaattccaattcgctagtcattttatcaaattcctcaaggagggaataagagcagaaggtaagttaccctgctgctgggacgggcggccagagcgggtggacggggcgcgtgtcctctggagctccctcatctcgtagccaaatgtggcggcgagcctgtccccggcctccttgatgacgagtgccgggagcacgcgctggcggtagttcttggtaacgatctgcgtgagctcctcccgcttgatggggcagccggcggtctggtgcgtcttgaagagcacgtggcgcatcacctccgctacaagcttgtccttctcctgcagccgcagtggcgcaggacgggctggtcaattcgtcaaacacctcgcgtgcgcggagcctagtcgcgagacaagcgggaggaggacggagggggcggagagagagagaggagtagtacctccgtggagatgtcgatctgcgcgtagtcgtcgctgacggtcgccatccgaaccaacaagggaaggaacaggcgggggaagagaagaggaagaggaagcttctccctaggtcaggaatggaggattgggtgaggaatcggcggtgaggttggtggagagtggggcggcggaaggaggaggacgcgtcggccgatctggttgcagcggtcggcggcggcggcgcacggggggacgaggggagaagggcggcggcggaggggttgcgtgcaggttgaggagggagggagacggcggagttcgcgcgcaaaagctggcttttggcgccaccagttttagctgaatactttatgggcctaaagaggcccaaatcatgaagcctctgtcgctccccccggcccactatcataacaaaataaatttataaatttttacaaaacttattctaatatagttttttttaaaaaaattaaaaatttatttcctccgtctcaaaatataagcatttctagttattaatctgggcaaatagttattcagatttgtagctaaaagttattatattataagtgagataataatagtaatacagagtacttgtgttgtggatgataagacaaaatccaatatatattacctaataagtggaacggtttattagaaaatactttctcaattctaaaatataaggcacaaccacctttaacccaaagaccaaaaaataattattatcatcttatagtttggatcatcctaataaatactattatacatgcatccaatagaattagagaatgtgagaataaatgatttaaaaaggtaagaatttaatggagaaaatgtcatagttaatttcatgtatatatgcatgtcttatattatgaaacatctttaaaaagtggttgtgccttatattacgtaatggagggagtaaaaattacttcataagtcaaacttttatatatttgttcgtagcgacttaaatgttaacgctaaaagtaaattatattaaaaatatcttaaaatcaacttcaaaatcagagtaaaaatttaaatgttggcttttgctttgatttattaggccagtcaatggggctccgttcacaaatcaccaaacgcaaacgccatcgattttataaacttgatctgatatgaaatcagtgatcaaagtttcaaaagtttatctaaattttaccttaataaacttaaatatttatgactacatgtttgtgcgtgatcggaccaaatccacactccttcgttcatttgcaacgaatcagtcatcaaaacgctaaataaacaggcctcgtgtcgtgtcacacgccgccggtcttttctccgccgccgtcgccgtcgccgccgtggtggtggcggcgcttggcccagaacctgaggcggagctcccttccctcgagcatcttctccacctcctcgatggggaggcccttggtctccggcacgcagacgagcacgaacgcgagtgccgccacggacagcccgccgaagatgaggaacgtccacgccgccccgatggcgtccgtcagcgacaggaacgactgcgccaccgccaggttcgacacccagttcgccgtcgccgccgcgccgccgcacacgccgcggtgccgcagcgggtagacctccgagttcacgatccacggcaccgtccccatccccggcgagaaggcggcgatgtacagcgccagccccgccatcgccagccacccgtacctgctcgggcacccccgcgtgtaccactccctcccctcgccgcggcacgcgtcgcgagccgtggcgttcgacgccgccgccgccgccgccaggcacgccccggcgcgcagcttgtcgccgccgcccgccgcgcagaacccacaccccgccgacgccgccgctgccttgagacacctcgtgcagtcccagaacgacgacgacgagcgggaggagtagtccgggcatgtgagcgcgccgccgtggaagtgggcggtctcggcggcgccgacgggcggggagtgggaggtggcctcgtggaacacggcggagaggagggcgagggagaggatgacgccggcgaggctgatgacgagcagcttgcgccgcccggtgcggtcgatgaagtagatgctgacgagggagccggcggcgttgaggccggcggtgacgagggacagcgcgagcgccgtctggttggaggcgaacccggcgagctgcacgatggtggggctgtagtacatcaccgtgttgatccccaccagctgctggaacacctgcagcccgacgccggcgaccagcccccgccgcaccgtcgccgtcgtcatcagcagcgccaccaggctcgtcttctccgacgagctcctctcccgcgcctccgcctccaccgactccttcaactcctccttctccctctccacctcctccgccgagtatatcttcctcaagatcgcctctgcttcctcctccctcccctgatctcaaccacaaaaagttttttaaaaaaaggcaggaattaacgaagaagaaataatggcgggaacgaactaaatttgttattaggatgattttaccgtcattgggtagatactatatgcatttcatattataagcttttctaaattattcttttaggctaggtttaagaggagggaaaaaatacgtaaaacgagatgaggccattatcccataattaattgaatagaaattattttaaactttaaaaatggattaataagattttctttaagcaaatttcatatatacttttcttttttgcaaaaaatacaccgtgtaattgggaagcgtgcgcgcagaaaacgaaacaaactctctttcttcctccagctgctgaacgtagccttagatttgattaagtttataaaaaaaatatagtaatattttaacacaaaacaaaaaaaactaggttagatgtaatgaaactaatttagtgctataataattgttatatttttctataaatgtaatcaaagtttaaaaattttggaaaataaaaatcaaaacgacttataatatgatgaaatagaggtgcaaccatattttctgatatctctcgatattttcagtattacgaggtagttctgctcaactaaatttgcattacaagttttgataagagaacatctcaaatgctgtaaaatttatcttgttactatacctttcggtagagccatctcggcgactcggggaggaagagcatgaggaagaactggacgacggcggggatggcggcgacgccgagcatccaccgccacgtcccgggggccttggtgaaggcgaggttgatgaggtacgacaagaactgcccgccggtgatgaggaggccgttggtgctcaccagcgcgccgcgtatcctcgccggcgacgcctccgagatgtacagcggcgacgtcatggacgccgtcccgacgccgagcccgacgaacacccgccccaccaccagctgcgccggccccgtcgccgacgccatcaccgccgcgccggcgaagaagagcgcgtcggccaccaggatcgacgtccggcggccgtaccggtcgttcgcccacccgccgatcgccgccccgatgatcgcgccggccaccgccatgctcacgatcatctcctgcagtcgtcaccaccaacccagcaaaataaattttcagaaattcatcatgtgtttgtgttcttgctgagaatttcaagaacgtgtcgagaaatttggttgcgacctgaagccatgtgttcttgtcaactgaagggaaatcgtcacggatgtaaagcagagctcctgaaatcacacctgcagaaacacgcaacaccacagtggcaagatcacttcgctagctagctaagcaggatactgtaatttaattacttttactacttcaaatcttcagatattcagttaaatccaactaattaatcaacggaatctgatcacttcaattcttccaactaactggtgtctccagaaatctcatgacatgaacaaaaaagaaagcctcttttatctgaaattttcaagaacttgctactgacactgacaagaacctcaattgggcatttcagacacacaaaacctgacactaataatcagtggaacttgatcactttatctcttccaactaactggtgtctccaaaaagctcatgacataaaacacacacacagaaagcatcttttatctgaaatttccaagaagtagcatgacactgacaagatcacaagaacctgaataattgtgaatttcagccacagaaaacctgaaactgatcaccaatcaagagtatattaccggtgtcgtagccgaagaggaggccaccgatgccggcggagaaggcgagcctaaggacataagggttcctccatgagagggagaagcactctctgaaggttgagccatcgaactcatgaacacctccctccatggctatctctctaatctaatctctccccccttatcctttgcatcccaatgcttagaaatgaggagcacaagttggcctctgactagtataagtatatctgcaattctgcatagaggtgtagtactagcagtagcagagtcccccactgcattgtctgcttgtgtcatatggtcacagatgacaaagagaaagagactgattgatcgaaaaggagaagattccggattatgggattggcgtgatctcgccttgtcagtgtttactttgactccaatgacttgtggtcgtggtgatcctctctgatggtgacaacgaagacgatttttagtaggataataacaggcattatttggtccgtaattttttttttgtccctgttgactgatgttcattttcaagtcaagcttcagtgactgaactgtggaaatggattttaatctgtcaagtcatatttgtttttttacttgtagaggttaaattcaaacttgtatgttcgtgaagtgatattagtatgacatatcaatcttatcaattttttttctattttttctataattgtttaaatgacatgtaagaaatgaaggggcatcccctcaaatgtgaactctgtaactgaaaactggtttgtttgtgcaggtgtcagcggatggataagtgggatgaagttgttttctatccatttccttatgccaaatttgatgtgcctccaagtagcaaatgtgaattgcgtgatcgaaatgatgaaagaaactctgtaccgaactgtgtttgttcatgtgcatgttccctgcattattttctgtcgctgctgtttgttgtttgcctacagttttaacattgactacagggccgagtggtcaaactttatcaaatttggacgagtttaaaatggattggtcgaatctttagggcagtgtatgattaaactttcttttgactcatttgatctagatggcgcctatcttttcatcttagtggatgggagttcaagataccaaagcgcgagtgagacagctacgtgaatgcatgtcactgcctatcaattccttcctcatcatggtcgatgcgaaattccgtgcaaatggaaatccaaatcatctccaaagttgggcagatctttcaagcatttctggagcatacttaaaatgtgtttacgtatgtgccactttagtactttagataccttaatttctttataataaacaaaacaaatggctagtactcatgctggtggataaggcaaacatcttaaggtgggaaaaacaaaactaatgcaattaaatcagacaaaactggtagcatgggagatatggtgcgaacgaaacggacatgttgcatttgctaaccaagataaataacgagatcaagctgtggagcatgtgtggagaaaaaaaaacatcacgaaaatatccgcttagcatatctgggtggagctgctccaattttcttcttccttctttttcttcattcagtttttgcctttttttttccttattctcctctgtcttccttccttctttcaccgtttcagcgaagctgtcaatatttgctcccctgcttaatataacaccagtttagcttggcttcggtttaaaaaacaaacaaaacgaatggcgcaagttaggctacagagtatacatagcaggaaggcaccataattgtgatgctttcaagagttcagataggaagaatgaaattttgtcaccgtcatacgatttcaagttaaattttggatcaaatcatagagaaatcacttagagatggtgagatgggcatatctccagatggctgcttattatttgtccacactctctgatagctttagtttgcttaacttagctttctgctcttgcagttgaatcacacattcttggcacacctggaaaacggccggagaaccctgaactctcgagccatctaactgcttctagtgtattgtaaaatgcctggcatttttagtttaattactccctctattttatattatgaaaatgtttttgatttattacatgtcaaatttctctaagtttgactaagtttataaaaaaatgtagcaaagtagcaaacaccaaatcagttttattaaattcaccactgaagatgcattttatagtgtatcttttatgttaaattgttattatatttttctataaattttatcgaacttagagaattttgacttcgaattataatatgggatggaaggagtacatcaataaacaaaaaaggattaaacttctgttcatggaaaacaatctaggagcaattaatggctaatacttgtggtactgaggatcatctcaggtttggatagagcttcttatggtcaagtacatatcaacttttttttctccctttttagagcagcacttgatctggcacgatgtactcaatagctaagctagcatgtgcatacaggactagagaatgctactagagtactagatggcaaaaggagacacaagaatgaaagcacaaccgttggatataggagtaatccaatccaagggcccagattaattcatttttgccattttcttctaggcaagaacagataggagtatttcacagtcagctttcatctctgtcctgtactgtcctggcatggtgtgtgtgcagtgtcgccaagtgttgggtgctggtggccgcttgtctcctaccaccacaatgtttcagactttcaggatggtccaaaattagctcacagaacatcaacatataatcttttgatattatgtccaatcaacagcatgaaagaaaggaactttaacctctacaatacctgcatgccatgtgcacttgaaatcctgaagtatgggcaccagtgtgttccatactgttctcttacttcctcattcctaaaatataagtatttttaagtttggcacgggtattaagaaagtatgtgagaatgattgaagaaggggtgtgattggttaaaaagagaaagtaggtgaaaaagaatggttgtgattagttgagaggagaaggtaggtagaaaaatagctttattttagaacaaagtactgtgtagaaatagctatatttttggacgaatgtagtatctctcttctgaagtctgaacaatccatatcattcttggaatcttctgatccatctatccaacctagcacacaagctggaagagattaggtttgtactttaagtggtctatccttttttttttaattgatcacctggaagagattactagtataactgtcctgatttgatgacacaagcatgttgaaagatttgggagatgttagcctaggaagttgtggtcaaagtgtcacacaatctggtaagttaaaatatggatcggagcaaccctaggtgaatgcatgggtcggtcacatcaccatactttgttgcttgattttttttaacgactctcacggtgcgaagttttattgatagaacaggaaaaaattacaagattacaactttagagggtcgtaaccaggaaaaagaaaaaatataccaccacccacacaccgacaacgcctaacacaagtccgggagaaggctagcaccggaccagtcgccgttaagcgtgaccgaccgccgctagactaacaaaggaatacaaacgagatcgccacacagcaagagggtgccaaaacgacgtcttcaagaagagaagcgacggaaaaccgccgcgccgtctgtcaaggctcaaaggagccaggactgggctttcgccggcaaccacccttgagaggcgagacagcacgtcaacgtcctcaggaggaggaattaaccatcgttgtcggtccggccaaggctgggttgggttttcacctgccgctcaccacatgcgaaaccatggctgacacactgatgctccaccaccaatcaacctctgctgacatgtgggacccctgcaccagcgccctctgccggctggccttcgtacgccaaaaaccatgccacacccacctgcagctcctccactcaccaagggaagctttggatgctagtttccggccactgatgattaaactagttaatcatgcaatcatgcatagggcaatcactgcctaatattttataaagactgtctgctctatgttaataataaattgctgatacaatacgcacagatactgtattttgcatggactggcctatcaagaaagttaattttttgcttaagcgttgtagatacgcaacctggtaccatcaaaagcgtaaaaaaacgaccaattaagtactgtatttcaatgacctaatcgcccttatattttctttctttctttgagataaggatgatctaattatttagctactaggacatgaacacctacctagcctgctaagagcccattgtagcttttgggccgaaaggacagtccacagcctaatagtagcctatttcagtacagccaactgtttccaaccgtttgaacattccagcccatcatgggctttgcaaatgttctctcctctcgtgtcaattaacttgacagtagtagtttcttcatcagttcaggcatctacgactgcaattaattaattagatgtggttttggaaacagaaagtacacaacagtagaaagcatactgtacttgatcatatactctctccattctaaaataaacacatctaatacaggatgtaccacgtcccatactgtgttagtttattttgagactgagggagaagctgggagaggcaatcaaaatgagcagttgattatttttttaaatttattgtgaaggacgttgattaattaagatttggcactgaagtgaaaagtgcatatacgtacacatgaatgcatgtactatatagatgatgaagagagaacggcatgcatgtgaaacgccaacgactttcagttaaagaaaggtaacaagtaccttaagttgggtgcctgcatctgcatgcagctggtagtgttgatcgatgatatgatcatggcatgcatatggccgatggatggtcctaaattgtgtgtcttcgttaatttctttgaccactttaatttgagagattatgcatatatattaatattcctctgatatttgcatatggtggtggtgatccaggaggtaaaattaatataattaacattcattcatattttttcttctcctcatcacgcagtgtgcatgcatgcatacccctctctctctctcagagaggaaattagaaatgcatgataattaaccatgcatgtatatattcctagataccagtagttctagtatattttgggtatgtttggggagctttaaattctgagaaacagctatttagtagccagcttctgataatctaaaaaagctctgaaacccagcttctccagcttctggcttcttagttcatttttcagaatctgtaactacaaattctcaggatctgtggactgtttgaggcagcttcctacagaagcagcttttgggaaaagctgcagttgagacaagctccccaaacagggcatttgtatctcttgtaccgattttagatagcttattaattagcttctttttgaaagattcccaagtgaaggagtgagactggttacacgtaagcatttacgtcatgcatggtggatcgatatggtgctacgattcacagagagattgatcagtaggactggaactggaaggggagtggtgcaacttttaattaattagccatagatggtcccggctggccgagtgatcgatcatccatcttgctgctgatacgcacactacacattgtgtaattcgtagtgacatatgggtctcgtcccattctaaattgcttcattttacaacagagagagtaaaaaaaagttaaatgacttataatataaaatagaggtagtatctgatagcaatagtcaatcagttggcgtcacgtaattaacaatgtaacatatgtatacaaatgatcgatccaaccatatatatgagatctctaaaatgcatttaattatatgtgcgtacatacaaatatagacgcctaagaaagagagaagaagctatagcttaattactcccttccttcgacccaaaatataagagacttttagatgtactccctccgtcccataatatagaggattttgggtggatgtgacacattctagtacaataaatctggacaaaccgtctgtccagattcattgtactaggattataggacagagtgagtatatcgacacagaattcagatccatagtattagaaattatcgcggtctgtattagttattagttgcgtttatatactttggtgtgacacgtgctttgccaggtcatcactggtcaggatactgcaagcctagctaagctactagtagctactgtgtactagctagctagtagcaaacgccatggccatggcacaggatggatcgatggatggatggatatagagggttggtgttgcctcgccatggcgatttggcagccaagttgcccgccctattcccggaaactgatgtatgactcttttgcatccaccttgctcatccatcgatcacatacgcaatgcaacgcaacacaagctttaaataattttctctatctctctctctttctttctctcagatcatgtatatatgcaattctagctagctcttttgcctgcattgcatgcagtgactgacccagccacttaaaagcactgtagaaccagcagctagcagctgctgctgctttcgccattacatacgtatacgtatacgttgcttttgactgtcactagctctgccctgaccgaccatgacgacggccaacaacaatcatctgttaattgtttgcaatgtgtgtgtgtgtgtgtgtgtgtttgtcgatcgatgatgaaccaaggacgacactgcagctttaatttgttcatcaaacggtcatgccacatgaaagaatctcgcaaccaactctcatcagctcaaagaaagaaagtaagaaacggccatcagttagtttgaacgaatagtactatagcgtatacatcgctacgtgcctcatgctgtacgttcaaaagaagccaaacttttgcttctttgcttttttattttttttgtttaaaagaagccaaactttagactgtgtaatgctagctagctactgtatgactgtatctctcttttctcttttttgatcgatcagagtgaagacacattgatcgatcggcaccttttaaacaaactcaagttttggaaaagctagccaagaacaacgtacacaccatgcaattaattaaaagcactgcatttccattgcatttcaaactcatcgtcgaccaacaagtagcttaaaattaattaacacaccgcatgctcttcgctaattaaccaaccgattcaacagcacaccacaccacaccaacctaggtaattaagctaagctagatcgcgatagatcactctgttaattaattatatctacaaactcctccttgagatagattaaaatcttgattaattaattaagcatcacacattaatcaatgcaaggtagggatcgatggatggatcagagccagagggcgccggcctgcttgaggagggggacgagggtgccattgatgtggcacgccatcaccttctcgacgccgccgaggagcctgccgccgacgaacacgacgggcaccggcggctggcccggcgggaggagctgcgacagcgcggcctggatgtcggcggcggcggcgagctggtcgagctcgtagacggcggggccgacgccgaggccgaggaggaggcgcttgacgacgtggcacatgcagcacccgctcgcgctgaacaccaccaccgcgttcccgctcgccatcctcgccaccctctcgtacaccgacatcatcgccgccgccgcctcctcctcctccaccgccgccgtctccaccacctgcatcctcatcctctcctcctcttcttcaaatggcacgattgcaatgtaacacaaacacacaatggcaatgagaggaggaagaagaaggtggatgatatatagatggagaattggtgtggtgcgaggggggtcaaaggagtggcgacatggaaggcttttttggtagtggatggtcgcgagctcggcgaacacacgctctgacatggccactgcctagctgagctgagctgagctacccagtacactcctttcttcctttccttccaccacgatacggttaccagagagagatgcaaggtgtagtaagcaaaagcaagggaggaggttaaagtgactagtgttgcttactagaaagctggtggctttttgataggggaaaaagattagtaaaagaaatagaggagctctctggaatggaatgaagagaaatggagctagctagctagtacatgttgcatgttaaaacagtttcccagaagtaattaaccatccagtgaaacatatatatatatagcaccacatacatgaggtaatatatgaactatgttcattttcaagagatcttctagataatgcagctacaaaccgttcagatattctcgcacaaaatctggagagagattttatcgtactcgagaggtacaaaattgtaagtatactccctccgtactcataaagaaaatcgtttaggataatatttaagtcaaaccttgagaatataaatcatgaataatttttaaattgttgaatttgaaaatataaaaaatatatgaatagatttgtcttgaaaaatactttcataaaagtatacatatatcacttttcaataaatatttttatagaaacaaaaagtcaaagttgtgttttggagaccgtgtcactgtccaaaacgattccctttatgagtacgaagggagtatatatttcgctgtccagtgtggtgcatgcatagattttacattgctagaaaaatttaatgtggtacatttgataccctgcatgacagaaattatggttaattaattatccgattcttttaaagattcctatcagctgaatattctaattaactaactccccaaaataggggcgatgtgcatgcttttttcgtttctagaagaatatatattcatgatggttgtatgtatacataatgctccatgtgttttgagtgatattgccactagtacagtacggggtatactgtacagtataggagcagtagtatactactctactagtatagctgtacttggagacggctggaggaggcgacatcacgtacggacggccactgtgtgaagcgccgacagcccgacagcataacggcggggccctctccgtctcatctccgccgtcgtttgactcccccgggcccaccaacgcaacctccctcccggggggcaggtgggccccggtgatgacctcctagtcgatggatcatggatcgtcgacacgttacatcacgcgtaaccgtctgatcgtaccgcgtactactacccttcttgccatgcgttccaacctcatcggacggatgggagcatgcatagatgcatgcaggtaaatgcatgtctcgttttgcttttttttttcacaataaaagcaaacaataaaggaactaaagaatactccattcatcctaaaatataagagatttggttggatgggacacatcttaatccagattcatagaactaggatgtgtcacatcgacacatccaacctaaattcctggtattttgggaccgagggagtatattaaagatgatcagtgatttattataggacaaaatagtttttttcctaagtatagaactggatacatagagagagagttatatatgtccgtatgccttggacgatcgacacacatattataactggcggaacaaattacgatatcgttgtattgagcttaattcagaaagcggcccttattagatcaaatattattttgattttcgaaaattttagctcgaggttttaaaccttttctacctgcaagttaatttcgtcttaaaatctaaaaatattgtacttagatcaggatttttcaatcgaatctatgaatgtttctagcctaactcattagttttcaattgatgcaagatcgacttgcagaacaccatggagtgggagagtgtggatctcacgcatgtggctcaatctgataaaaaaacgatgaggcacaccacaaaataagcatttcatcacatggaaggaagaagggacactggcgggaggatgaagaaagagaggccaggtttcctggagcggtgcatatgcttattttgcgggcatagacaaaaaaaaatggaaaaccaaactgtcaaggaaattggaggaaaaaagatcgagtagcggataaggtgttcaccggattcttattctagtgagcgttcgccagttaggttttctgtggttccgactacttatataacgcgattgagcatgcgattttaagctggttttaattcacagtgaaaaagaaacacacaattttaaactagatctaattcatagtgaaaaataaatgcagaatgccggaatggccgaatgggtgatgagcggtaaaaaggtgaaagaatgagctaggtgagagagaaagggagggagtgagaagggtagcatcggagagtgtgatgcaaaaatgcggtcaaaggagggaggagaaatgggctgatctgatctgatatcgcgaggttgtgcttttcttgctttttgctgcattcatgcatggctgtctgcacgggatgttgcgcaggcagctgttatacgtacactcttctgattcctctagctatattaatagcttcttttaatttactgtcaattgattaactataccttaatttgatgagagtaaatttcacgaaattatatgtactcagatcgatctatcgtaaaactataatttttaatgaagtgtgtatcataaaaatttagcaactactccctccgtttcacaatgtaagtcattctaacattttccacattcatattgatgttaatgaatctagacatatatatttagatttattaacatcaatatgaatgttggaaatctagattcattaacatcaatatgaatgtggaaaatactagaatgatttacattgtgaaacagaggaagtaattttttttcacgaaactacgtatttaatccatcgtatcaccaaattttagatttaatatcaattttattataaaaatgtagctttacataaatgccttaaatctatagttttacttgttataaattctattttaaatctgtagttttgtactcctacatacttaactttgtattttacgatagtttgacagttttatatatactcttatcttaagctagtatacctacagtacaaagagatgcataactgcaagtgtataagagatcgagcaacgactggaacagggaagctagctgctgctgcaggtctcaaattacttcttacttttgtcgatggatcgatctgcatgcgcgagcggccgatgctatctctctcaaagctagctttaaaaggcgatcgatcgatccgtgccggcctgaccatgcaagcacgcgagcctgacttccctgactgactgacactgcatgcccaagctatagctacctcacctcgatcacctgcatatatatgaatatggatgctccctcttttctaaaacataaacatttcttaattagacattaatttcaaatgttttggagtggaatctaggcaattttaaaaattttaaaaaccaatcattgagttgacgagaacggaattcttttcctcgatagatcgaattaagtgcttatattttaggatggagtggtatatatgccgcattctctgtagcttaattctagagcgagagtggtgtagaggtttctgtttgacgccttgtgcttgtactcctctgtggagtttgcattgttgcacccaatgcaactgcatgcaaagtactcctttccaatttccacgacgactactacactacagtactgctactgtgcctacacaacacagtgtacaaacacaaacacagagaaaagctatagcaggcgtagtacgtcctgtccaggtgccaacatcaacatgcatgaaccaacatgcattgcatgcttgtcatctacactgtactgatggtgtactcttctatactaccttcgtcctatattacttgtcttttttagtttttgtttgtcaatgtttgatcattcgtcttatttaaaaaaatttaaaattattatttattttgtttgtcatttgctttattatcaaaagtactttacatatgacttatctttttttatatttgcactaatttttcaaataaaatgaatggtcaa

SEQ ID NO: 5792 - DNA, 356 bp, Oryza sativa
caggctgcggatgttttccagcgtggggatcagggaatcgaggtcgtggccgtcgatcggaccgatgtagttgaagccgaagttctcgaacatggtggccggcaccaccatgcccttggcatgctgctccagccgcttggccagctccagcagcggaggcacctgcttgagcacattcttgccgacattgcgggccgctgcgtagaactgaccgctcatgagctgcgccagatagcggttcagcgcccccaccggcgggctgatgctcatgtcgttgtcgttcaggatgaccagcaggttgccatccagcacccctgcgttgttcatggcctcgaacgccatgcccgcagtcatcg

SEQ ID NO: 5793 - DNA, 650 bp, Oryza sativa
caatttgagaccaggtgatccttccatatcagttttgctaacccacttctctgagttagttacattgtcttttagctttacaacactatcagagctcttaggaacaaggcccatgaaataattgataatctgcacacagagtatgtatgagaaaagagaacacttaaatcaatggcagaagagggaaaattagatgagcactaaacagcatacctcttgaacaaaacggttgagataaacaatctaacttctgaaagctgcgctgatagactatagtcatacccactatagtcttcgtcatcaacattgtatgaactaaagtcaatctgcacaaagaattaaaatgttgtttgttttctttcaagccagaagtagatagaaaatgtaagcataagcagttattcctcaacaaaaatgcataagcagttacagcatacaactagggagtccattgagttaatcaaatggtagtacctcccaaaagaacttcctcctggattagcatatcacaaacccaaaagtagggatgattgcaagaaagactgtcatcgcttattttaaggtttccaagtgcagcctctatactgaacgacgatgtgaacaccttaaaatgccaagatagtcatgtattaggaaaatcaaatcaagat

SEQ ID NO: 5794 - DNA, 682 bp, Oryza sativa
agctatgctcattcttaaccatttaaccattattcagattgacggctacaaaacagcggctctggtatgactagatcactagagctatgaatctgtctttaccacatcttttgtcaaaacgtcagcttcaaggactaaataattttacaaaatgaacaaccaaggtcaaagcaataagtattttcagaattttccaactgatggatatgctctttgctttagtgaaaaaaaaatattttcatcaaccatgcataagtacaaacatagttgatgtagtcgtcactatacctgctagtggtaccagaattgtaaccagtcatgtatgaaataaaaagcttctgcagatgtaagtacaaaagctctctcggtttatgatcaatcaaagagactccaacaactccaagttcaacaataagttccaatagtccagcacctgtatctgtatcattttgcataactggcgaggcttggtgatcacccagatcagatctgtaccctccctcttgtcttcttgggtaatcagcaaacttcaaaatcttaacatcagcagtctcaactatactgagcttgaggtgatgttctctaaaaccagcggaacattcatcagggttttccaggtcaacacactgaaagaaagtaacatctccttgctggatgctaacatcaaaagttgtatgtccat

SEQ ID NO: 5795 - DNA, 657 bp, Oryza sativa
tccatatcgaggatcatcaagagcaggcacaacatgtggtgtctcggagaagtttgacaatgcacattcagatataatttcatattctcgattggataacgctgctttcagaacatccacctaagagacattggacatgaaaatggatttcccaatgacacaaaaagacaaatgataaattgttgcttactgtactgaatctaaccagggagctttcattaaaaatgcacttagagaaaatgatctaccttaattgaagcctccaccgctggtaactgatgcatcaggtcacgtaatgatctatggatctcgaaggagagaccttccacatcttgaattatagtttcaccacacaccatattcataccaatagttagatttatgtcctttacctgcaaaggtaagtatgtaaccacagttataaaacaatttgaaggtccatggcagaaagttccatttctccaaggaaaacaatactaagaaatataagttattttctccccacaagtgctcctatgtttcaagttgggttaatttccaaattccaatgcctccaaaattaacaaagctctcatgtccactggctgaaaattatgcaggaaaataacaatatactttcttgtccaaaaaatatatgttctcaacagatataaggaa

SEQ ID NO: 5796 - DNA, 729 bp, Oryza sativa
cgaacaatttttcaatgctaacatcttgaaagctgcccttgaaggaatgggtctctgatgggaatgcaacttcaggaaagctggaaagtgcggcagaaccctgcaaacagactaaattacctggatagcaataggatataacaaaattgaacatatgaaaaaggaccaaaaagtaccgatgcacggtatatagcaccctgcaagcggttctgccatatccttcgtgcttcctcattgtcaaacaacataatcaaagcgccagtgtcttcaagaatctgtacaaaataaagttaattggaagtttagaactatcaactatgtcacagggattcatgttccatatctacattagcccacacttgcttactgtgtcaattctggcttgccattactgacggagtaaattatgatacaacatgactgattgtagtctaataaaagaagtaatttacagaatataatgaactcagctacttgaccgttccttgggattaacttggccagaatcatgaagtgccaggatattctgcacaccacttgtagctccataggaacctgatggacttgtttattacgtaagctgtgattcaacacaaaagattaaagtcaaaataatatatccccctgcataaaactagcataaagattataagccatttacaaggttagatcaaagctattctcatcaccatagatgaaaatgcaataaattattgtagggctgcagga

SEQ ID NO: 5797 - DNA, 19569 bp, Oryza sativa
tttcccttatttgtttttaagaaattgtattatagatatgtaaaatttgcgaaatggtgcacagagtaatagagttgccacttaagtatgttgaacaccctgttctgctgaaacttacagctattcctgaaaatgatgctctaaaaatacctctacctcaaaatagtttcctttcaccgtcaattgtgttatgtaaatcctcgcaaaaaaatattgttatggatatatcagaatgagggtgcttggtagggaggagaaaaagatatgtaagagacattaagggaagacgagacctaaaagaactttatatcccatgtttcgttattcttagtctggccagcagcctttttaaggctggcttctacctcttaacaacttttaagcagtagattgtgcttcttatctctagtacaaattccttctagttgtctacaatgcaactcctaaatgtttatatctaacagtagcctttatgctacatcacttctgtctttctttttgccatgtgagtggcatttccgccttattgagtggctgcagcacatgatagtgcgaattaggccagcccataacagttccgactaggcctgtagcctccacccacgacagatgtatttgtttttcttgataaacagttgcatagtaggttctgcaagtatgctgcagtagaaaatgatggttaacattatgtgctagccttctgataactgtttcaaggagcgatagtttttgtttcatagtactggttttacttcagtcaatgaatattgttgatgctatacacttaatttgagcattcaattgtccagatggccctttacctagcagaggctagcagatattttgcatgcacagatttatttcgggaaccttcaaagtatgcatggtcagattactatgaagatcattttatcgtacaaaatcagaaggttgctttggtaacaaacaaacgagtgatactgcttcaggtgaggcctctttctgtctgattctcatagtaaactgcttctatttattttactaaatcccagtgttctttttgtgtagtgcgtggatctagataaaatggataagaagccttcgaaaatactttgggacgttccttgggaagatgtgcttgcattggagctggcaaaagctgggtatcaaaggccttctcacgtaatcatacatctgaagaattttaggagatctgaaaactttgtaaggcttataaagtgcaacgttgatgaggagcatgaacctcaggctcttctactttgttcttcaattcgaaagatgtggagatctcaccaggcagatatgaaagttgtacccttgaaggtcctctctctctctcacacacacacacacacgcacgtgcgcgcgcttttgcaaaaaaacaaaaaacaaaaacaactgaactcatacttctgatccaaaccaaaataggttcctgggggccagcacgatgtatatttcgcatttgatgaagatatgagggagttccacagttttgctaggcctttgctaagcccaaggggagcagcaagtaatgttgaggagcgactcattaacgatacagttaacttccagaacatgtggagcagtgaacaagaaattcgaagcagatgcaaactactttcaaagcaggtaaattagctacttttaccttatgattaaaagataatcttcctgatcttttgttcttctatattcatgatatgtgttgtttaaaataaaccgtggttttggttccaggttgcagatgatggaagggtgtttagtatctggaggcctctctgccctagtgggtatgaaatgttgaaatgagacttatgtccctctaatttacctgtttttatgctttccttcgaataaagttatcctattttgatgattgctgcaaatatttaacaacttaattttaggtatgtctcaatcggagatattgctcatgttggcattcatccaccacatgttgctgctgtctacaaaaatgtgggtggaaatttcgctctgccacttggctatgacctggtcagtgtttaatgagatattttctcccttgttactttatttaattttgagcttccgctaaaaatatatttctaaacaaagaaaaatatactctctctgtttataatatatgacgccattaaccttttgagatccagtcgtcttaactaaaaagtatttaattatcatttattttattgtaacttgatttatcgtcaaatcaaaaaaaataaacaagacaaattgtcaaacgtttgtgttaacgacgtcatatattttaaaaagggagctattataatgttatatggtctcttttatttaattacatatagattttctagagttgggatgtgcacttctgttcattgttttcctggcataataggtttggagaaactgtggtgaggattacaggaatcctgtatcaatatggtttccacggccacctgaaggatacgtagctctcggatgcgtggctgtatctgcttttgaggagccccctctcgactctgccttctgtgttagtgagagatttgcggaagatgcagtatacgaggagcaaattgtatgggcttcgtcagatgcctacccatggggatgctatgtttaccaagttcagagcaagtcactgcaattcatggcgatgcggcggccaaaagaagagtgtgagctaaaacctaagaaggtatcagagtcttatgcccagcaagcattggagaggtcctgagatgagaggcaaacatgccatgcattagtgtagacactagacacatgtaaagtgatgtacataacataggtgcgtatacatgcgtgtaagaaaggagtcaggagcaggacagatccagcattttcgtgcaagatgtgtccgaaatgagagtttcaggtttacatttgctcccatttgtaatccatcattctgcttctacctttgtcagacccttggggtcaaagcttgtacgtcgagcacttgtaccaaacaatccgtctgcttgtcaaccagcagaaaaggggttgtaaattttgtacatgtaaaatcggttgtacttttattcagcactaaataaaaagcatgtaagcggttgggcgcatagcctggttctgcagcactgaataaatgtcattctggttgttttcttaaggaaccgtccgcactaatgaaattgtaaaattggtacatgttttttttttcttaaggcttgttcctacggtatgtgctcccttcttttccaatacataactttcgaagattccagctagttttatattgctcgttcatcactaggatgaaggaaagtggaagggtaaagaaagacacgagctgggagctgcagaccatggtggtcaatcaagaggggtagggtttttagctccttgtatttactagttagtaagattaactaacagattaactaactgattggagtgagaagctttttcattgacttacttggactgacatattttttcgttgaatgaatagatgagttgtcttttcttttatttgtgttcagtttagtctgactgaggccgtgtttagctccttttcaaaaaaaaattttgaagtatacggacatacatttaaagtattaaatatagactaataacaaaataaattacagattttgtatgtaaactacgagacaaatctattaagcctaattaatttgtcattagcaaatgtttactatagcatcgtcttattaaatcatggcgtaattaggcacaaaatattcgtctttgtcggagatatgggcccggggtatgcgaagtgagggaaagttacctttccatctagccgcgtggctctacagcctggccctactcccgcacatcgtgagtcacagaagcggccggggggccttggggtgccacgtcgtgcccctcgggctctcccgctaccttgccctgaggccctcgcccagctgccatgtggcggggggagtgagtgggaagggggcccaggctgaacagccatcaatgcgcagcgccccaactgtccctcaccgcatttaatgcggtaagggcagacgtgcagtgctgcctagctgacccacgtcaatcggacgtgaccagtctgtgaccggcctgttaccggtcacatccgattgaacgggcagccgttcaagggtctcacgacctcccgctatcgagggacttccctcgacagtctcgtaatttacatataaactgtgtagttggattttttttgtctataattaatacttcatgcatatgtctaatcatttgatgtgatagaatttttgaaagtttgaatggaacaaacacagcctgaatgaaagaattgtttcgcatttcaaagtcggtagttgagtactaagtggactcgcatttatgaaacatcatcgatctccacaactgaaaaccagttcgtctaggcacttcagaaaatctttatttttttgcggggcacttcagaaaatcttggccgggcaaaattcagctccacctgtctcttacaagcagatgggttgtttcaatgtgttctggaacagtttggtactacaagaaaatggtagattccatcacatgccatgttaccatgttgctctcccctggaccaagctagattttttttaagcaaaacctcacctggataagcacgcacacgccgtctgatcttgacagccaagtgttcctatctgtagtttatccatccatccatcattcaccgtcgttccctaacttgcagtcttgcacccctagctacgtggatggattaggaattaacatttcaggatcagatagatcgatccgctgatccactcctggaagacgcatccatcgatcgatcacacatatcatcgtctcgctgtttcgatggatcgatccatgcgtctccgtagccggcaaccggccggtggtccacttactatggaggagagggagatgaagccaagaacaccaaaggccaaagatggcgatatatactcgcggtcccgtgaaggccaaggctacttccctgaaactgaaagccgaccggtgctctgcatctgtacgcattgctgcgtatgaatacttcatacagaaggaggaaatatcaaataatatagggtattgcgagagagatatttctgaaaaaaaaaaggcaagaggagctgaggatggaaggcctttttcttgggacagctggacggttcaggttccgacggttttttttcctatgatttataagttgttgtccaaatttgaattttaaattttaattttgaagttggttttgatatttctttaacgtagggtttttttagcattagcttttaatattatctaagaacaagtatatataagttttatttataaattattttctattattaataaaccgttacagtttataatcaatcgtaggtaatcaatgggtccttatcctattggaaggtctaatttgcagcacctgaacttttagagtaaaaaaaatctgagctcaagttcctgttctttacttcgatatcaaatacgttggcaacagtagagttcacgttgcagaagactatctataccgttgttgataatttttcttttaaaaatttgacagacgtaattataatataatcgttgtataattataatataatttgcatataacaatgtaacttttaaaattctctccgtaacacgctatttcctcgaaatagaggtagtttgaccgaatgctatcacatatgcatgcgttgtgattttttttccttcctcacatgcacgaatcttgaaataaatctaacggttcaaatctatatgaaagttacattgtactcccttcgtcccataatataagggattttgagtttttgtttgcaacgtttgaccactcgtcttattcaatttttttgaaattattatttattttatttgtgatttactttattatttacagtactttaagcacaacttttcgttttttatatttacaaaaaaaatttgaataagacgagtggtcaaacgttacaattaaaaactcaaaatcccttatattgtgggacggaaaaactcaaaatcccttatattgtgggacggaggaagtagttacatgcaaattataatgcaattacactacattgttataaatatataattacatatgtcaaatttttgtgagaaaatttattgataaatacttcctccgttttataatgtaagtcgttctagcattacctacattcatatacaacatctatatatgggcaatgctagaataacttacattataaaatggagggaatatgtagcaaaattgctccgaattatctatttatctgtcacgcacaaaagcatatgcttgacgaatttgtgggcgagcgagcattgatcgattttcttctcttcaatttattctcaacaggcacaacaacaaaccatcacggcatcacgacacgacacaagaggaaagggacgagagaaaccaaaccaaaccaataggcactaggcaaacacatcacacatggcaacaaaagtagccagagcgtgcaaaggagagccacaaacttggaaggaggagggacccaaaaagcaaaaaggtcaccacctgcgctgtgcctgtgcgcggtagaagaagcagccaagaaaaagcgcacggctgggtcccgtcccgtgaacgtggggcggagactatgatgctggggacgagacggataagcgcggcacgccgtccacgcgtttcacttggtgcctacacgcggccgcgtcaccaccacctcaccttgctacaccattctcctctacttgtctatctatgggtgtgtttaatccacgctaaaattaaaagtttgattgaaattgaaacgatgtgatggaaaagttaaaatttatgtgtaggaaaatttttatgtgatggaaaagttaaaagtttgaagaaaaagtttggaactaaacaaggctatgtacagtcgatttagctaattaaaccatgcgttgcatgtttactaccataccactccgtatgttaacacgcgtgaggtgacgctgctccacataggatatgtcagtaatttatcccgtttgattgtcatgcaggcaaaggagaatcgtacgtattgaaagttgaccgtgcgttaagcacgagattcgcaagtgacggaatatataattagcgttagcgatatacggagtactatactactactacagtactccctctgttttataatgttaaaatgctaacatcatctatacgaacatagataatgctagaaagttttatattatgaaatggaggaagtaggacgttacactaccaagtacgacagatcgatgtgtggttaaccgacaggagcgtgcgtgattctcatgggtggatgccgatcgatccgtgtacgacggctgattcgcccatctcgacgagaaatgcagacaccgcagtgagtcacccaagtttggattttagccgacaagtcgcaaaccctccacaccgaccacgcaccaaacaccaactaccccggaagatgataccaccacagtaaattaaattcctcgcatttttactgcatttttgtccaactccaaattccgacggaccaaacccagcaacaagcggagaccacacaaatttcttgtggagtctcgatctagaaaacgctactagcacacacatgtcatgtcaccaacatcagccatggcccaccagcagcctcacaagcgcactgtcctccatggcaatgcttgccacgtcagcacctcacgttggtccatcctcgctgacgtgccgtccacatatccgttccgtttacacgccccgtttcacccgtaagacttatccgttctcccttctctctcttcgcagccaagtgtaaaagcgtacgcgtacgtgtactgaatcttcttccactgcacccctttgatttgaccgctacgttgtcgccgtctcacccagctcgatccatctggctaactacgtggattagtagagattatcgccttagtttgattctataattacccacctatctagaagtagcttgtaattgaacaggtgtcacttgacagtactcagtacaacagagcaatggaagcgtatacaacactcaacgatcagctgcttgtgcctgctcaaaacgacgaaaaattaattgaaatctttattactttttagttccaaaaataatggataaggccattgctgctgatctaatcctcccccataatctccaaccaggaagcatgcacactagagagaaaaaaatatatacaaaaatcacatgcatactgatgcaatgctactacttgctttacttgtgagagtgccagaggaggaaagattattagtttagctttacaatcctaatcagcattgatcacttggttaagtgacgataagcacgtcgccatcacacgcatagttgagatttcctctatatatacccgcagcgactcttccctcccaaattcatttcattctcttcaaatccaagcaagaaagaaatcaaagcttctcttcttgaattcaattcaattcaattcctcatctccgatcgaatcaatcttggttagttgttaagcacctcttatctacttaattatcttcctctccggagaagctcgagctcgagatcaagtccatggcgttgacgctgcgttcatccacgtcgttcctgtcgccgctcgacccgtcctccaagcgcgaggacgcgccgccgtgctgcgtcgtccccatgccggcgccggggagcggcggcaggctgcggctcgccagggcggcgccggtggagcacgcgacgatggaggagatggcgtcaccggaggcggcgacgctgctgcaccacgggggcgggggcgggcaggggcagcggcgggggaaggggacggcggtgtacgtgatgctgccgctggagacggtgggggcgggggggaaggtggcgcgggcgcgggcgctggcggcgagcctggcggcgctgcggagcggcggggtggagggggtgatggtggacgtgtggtggggggtggtggagcgggaggggccccggcggtacgactgggagggctacggcgagctcgtccgcatggtggagcgcgccggcctccgcctccagatggtcatgtccttccaccagtgcggcggcaacgtcggcgactcctgcaagtaagcctacccaacctcacctcctaaactaatttcctccattttttttgttcttaatttcttggactcggagtgttataaaaatagatgtacaacggagacatgaattttacgtggaaaactctttcggtaaaaaaaccataggtgccgaccggcaatgtttaccgtagagtcgttgattataaacgtagaggaagaacaatgagaacttcacaccttctcgtacaacttacaaaagtatatatagaaaataaaagaaagacactgagtcctactagaaaactaatcagaatatactgtgggcttaaaatttggatcacgtatttaacctagagtgctctgcaactgcaactgttgttctctgttctagccaatccatgatccatctggttagcttaaaaaaaatgtttcagattgtattgtatttgcttagcttaagggaaagcttatttgattaggaaaaactttttagtttggttctattctatgttctatatatagccaaatgatctgcttatcttgaggaaatggttcagattttatttgattagaaaaaaaatgttttattttaggggtttttcattctttgttggtctcttgcacgcaaagaatatacgtgtatttttctgaagcaataagcaatcaaaattatccaagtaggaagggggaaaaagcgtaaaagcgatagctaaagaacacaacagatacgaagctgtcacaggagttggaagaaggaaaaggatcaaaagattcctcccaactgcaaccgggctactgctaaccaacaaacacctgcttttgccaccactaattaattccaaaatcaactcaacaaagagatcaaaatcgagttctaacagttcatatgatttctgtgacagtttcattggattaattatgattagtgttttatggtttatgctcatatgtgattttgctgatgttgatgcagtatcccgttgccgggatgggtgttggaggagatgaagtcgaacccggacatcgtgtacacggacaggtcgggtcgtcggaatccggagtacatctcgctcggctgcgacacgctgccggtgctcaagggcaggacgcccatccaggtctactccgactacatgcgcagcttccgcgacacattctgcggctacctcggcaacaccatcgtggtaattacattgtggtaattacattgtaattacactacaactatactatagttgcatttgaaattgttttgtcaaaaaaaaaaacttgcgacagttttttttagcgatttcgaattggtaatatgattaaccattaaccctgcatcgatctccatccacatccttgcttaatcgatccaagcaatttgtttgatcttgatttcgttgtgaaaaattgcaggagatccaagtaggattggggccttgtggtgagctgaggtatccttcgtatcctgaggccaatggaacatggcgtttccctggcatcggcgagttccaatgctatgacaaggtactctttctttacgttaacctatcaaattatcggtgaaatgtgatttgtgattggaattaccaaattattttttcgcgaacgcgcaaaagtattatcaaattatgggtgaaatgtgatttgtgagtgggattaacggtgaatggtttggttgattggtgtgcagtacatgagggcgtcgctgcagcaggcggcggcggcggcggggcacgaggagtgggggaggggcgggccgcacgacgccggcgagtacaagcagttcccggaggagacggggttcttccggcgagacggcacgtggtgcaccgagtacggcgacttcttcctcgggtggtactccgggatgctgctggagcacggcgaccgcgtcctggccgccgccgaggccgtcttccgcggcaccggcgccgcgctctcggccaaggtcgccggcatccactggcactaccggacgcggtcgcacgccgcggagctcacggcggggtactacaacacgcggcgccgcgacgggtacgcgcccgtcgcggcgatgctggcgcggcgcggcgcggtgctcaacttcacgtgcatggagatgcgggacgagcagcagccggagcacgccgggtgctcgccggagcagctggtgcggcaggtgcggtccgcggcgcgcgcggcgcgcgtggggctcgccggcgagaacgcgctggagcggtacgacgaggcggcgttcgcgcaggtggtggccaccgcggcgagcgccgggctgggcgcgttcacgtacctgcgcatgaacaagaagctgttcgacggcgacaactggcgccagttcgtgtcgttcgtcagggccatggccgacggcggcgagcgggcggcgctgcccagctgcgacaccgagcagtcggacctctacgtcgggttcctcgagaagagggcggcgccggaggccgaggcggccgccgccgccgccgtcgtgtagtatggaggcgagcttcgtggcgccgccattattgtgtataggtacggtgctacgtgcaccgggaaagggaagtgtatatatgattatgcggggagtctgcaggttgcagagttttatagtcagcaactgagcaggcatcatgtctagttcatatttaggccatataagttttttttgtcatatttcaaagcactgtactccaatttggcagctttttatgtgtaaactgcccaccatgtaataagctttgttagctgagaataattttgcaactttgcaaggaaatagctcgtttgcagcagcaaacaatttgggttctatttgttcaaagtagcagataataaggtaaggattgggccgacgtttttgaacttttgtgtttgaactttatgcaggtttatgttggatacattgggccggcagacggcgaccaaatcaaacctgcggatttttttcttcttttccctgaaaaatcaacctttcacgcgtactttacagagtcaaactacgacatatataagcaggacgcaacagccaaaacctgcatccggacttttcaaatctaaggacaagagagaagaaaaggagaacgaaaagaaagaaagaaagaaagaaacacatatgctacaatctcattaacccgtgcatattgcactgagcataatatggtcttgatcaaggaacaatgtgaccaaggtacaaatcacattccaaagggcgtgaacaatgtaatgagcaacaatacatgcaacatgttagctctatttatgaaatggagccctttcaacagtgaaatttacatcatgataatttatacggggactagtgatataatcatagacgcggtggagaataccaggatcgtgtcatagagaaaagggcttcgcatacacatcgaatggctcgtttgcagttagctgtggatcctgcagattagagaaaagcagttagtattgttgacaatctgaaaagggaatggaaattgtatacaaccaaaagaacatgttctgtgtgtttttgtattgtacccacggaaataggatttaaataatcactagatagagaggaatatgtcaaactccagaatttacctgcttcaagccgccactactaacgctgcctcctgtaagaagcattgtgattagcgatgttacagcaccacctccgctgcccattgaatcacctgtactgcgtattgtcgaacgcatggaggtcaggatactcccataggtggtgccctgcccacgctcaattgcttggataaagcaaaatgtcatagcgccagttgaagtgatctttgacaaagcctgattggaacaagtgcaaatgaatcaaatgttaatacctataaattgggttaaacagaatagaacacaactgaccaatagaacagtaacagaacaggcatgatctgcaatcagagtccttgccaaagctatcttttaagcatatattaacttcgaagagaataaggaatgacagcctaggatgctaacagagaaggaatgaattcaaaaatttactgaagtatctgcagatgtctgatcatcgtcacaaccactaaatgaaatacactcgccgccactagtgcccttccagacaccagatcgaggtcgatgatcttcccatacatattgcccactcctgtaccaaagaagaccagggatattagctgaacatatttccatcataagatctacagatctatgtttgtaaagtaaacactacaaccaaggaatccaaaacaaaaccaactgaataaaacagcatagtctctaaacagcacattcctgtcctaggataaacaacattttgatggacatactatgggcaaattagcagtaagttgtgaaaataaacggatggtgaacagtaccacaccaaaactgtttccaacaaatgacagtcccaagagggtaactacttgtattgacataattgactaagaaacatagttcactggctctaccctcaaattacattccagtaaaaatatttgagcaggatgacagaatataatcatcatgagacaaaaaaaataattgaatgctgtcctcaaactgcatttcaatagaatatttgagcaagctccaaaatcatatcatcatcagctgaaacataatcagacaaacatggcattcaaatcaaattggttcagaagtaaatagcatctttcttgcaaacatagtttgtagtgaagataggataataagattgccattaggttaagtccatgtacttatcattcaagtgccaaaaaaaaaagagcttgcacaagataagcgaacctgttcattctgcagaggaaaggcaaatcaagtgcagtcccactgtgacaagcatctatcagtgcatgaagtttaactccaggagtaagtggtctgacaagagcagtatttatttcatcatccacaatcattccctgtgtctcaaaatccaatgggcagagggtttcatccattccatcaacttcatctccgctgtagtttctttgttgtgctccgtgaccagaataatggaataccaatgagtctccaggctggcaaccttgtacaagccaatacatggccatccttatgttgtgctttgttggaatcttgtaagggtcagtttgttcttctgcaagacaagaaataaaccaatagtattgggttatgatcagtttcaacagatcatcagaaaacaaatttcatataccagaaagataatataagacaaaaaaatactttgcccttttcctgtcttaaatgttttcagtctagcatttgcatcctactagattccatttagttagtaaaaccataatttgcgaaaacatgagcccatgactcacaacaacattagcttatatcagccctaaagagtgtgatggatcaaaccaaaccagctttatcttcaaattgaaaccatacgtagtttattgaggcaggaataaatttaaattacattttgatatcgccaacgaaaaaaatacagttctcaattcctcatcatttgcccctgcctattcatcgcaacagtaaaataaaaagcgagcagaaaattcatcaaaatgcaaagccacccacagctccttgattcgatcataccctagccctgaaattcgctccagaacaatctcttcacacgcaggccactattggtggggtgggggatcaatcaaaccccgaaattgaggatacccgaaccagaattcaaccaatagggaggtaatatcgggtagttaccggtgagcatgatgatggagtcgtcggggaagtggaagcgcgtcgtgaggaggtggcgcatgcacttggcgtcgttgatgcaacccttgagctcgtggcgcgagaacttgtaggagatcccgcagatcacggcgcgcttccgcccgtgcgcgggcgggggaggcggcccccaccccggcgcctggtgctggggcgccaccgcccccggccccgcggcgccgcgggcggggtcgccgtgggccggtggcggcgcggcggcggcgacgtaggtgacggccccgcagatggcgcagcggatgcagggcgccccgtgcggcagctgcagcggcgtccggcagcccgagcagtcgatcagcatcatcatctctccgccgccgcggggtcgccgccgccggcgaggaggggggaggcgaatcggcgggtggatttggttggcaacgatttcttcgttggctcggctcggctcgtggtggagtcgttgagacgcgtcgtgtatttgcgagcccgcaagacgcggcaggtgaagccttcttcgggaaggacgcggcatcctaccgtcgatcgagtcatcgacggctctgattgaactgtaccaaagctgtcgctgatgatacagatcgcttacgtaaatttttgaacgcggcatttgactcctgacggacggctgagtaatccggtatcatcgccgtttctcatctctgatttttctaattgttacttagctgagcagcatttggtttgaatttgtaatgccaatttattcttggagtaatcactattcggttcagtttgtatgctttaattaaacagcaagcagcatcgtatgctatgaattgtgctttgggtgcgccaataatttccttcaagatgcaaatgcttgttgatcaatccacaattatttggtagctcgtgtttccagtccccacaaatgataatggattttggcatatattcctatacctactaatggtaatagtataatccaatgtgcagttacacatcaaccacgaaaacaacaggaggcattccattcattcaaggtcatggttatctttatgcgttcaggtacaaagtagtacagacaatggcgggggcggcatgcggttcctccaaccagcacggccggcaccgtggaatatgtaggttctatacatgcttaaagccaagagacaaaaggcaacagagattttgtctcctgatgttgggggtgtgtacatcatcgtatctctaaacataggatgagtattacactgaagaagagaaaaaaaagaaagcacgagaaccctactgacctcgatcagttgccttcgacaacaggaagctctctctctctgcgcaggagttctgctgcgtcgcaaaagacaccacaaaagatgtatggagggaatggcggaaaactctggttccgaagctctgctgcaacggcagtcactcagggtatcgccacggcccgatggggtggagcaacttccccctgtagggaagcggaaggttgtgtcgggcgaattggtaacaacgcgatgacatcgcgaagcagcttcgtgccaaccttatgttggctttccttctcacactactgacaacggtagatcattgccattatttggcatgcgcttttgtgcagccttcacagcagccaccctggctgcattggctgctttatttgctgaagcaacggccctgttcaccttatcgtcgactcttgggacgtcataggccctctctgcagctcttctcgcctcctgatagtgcaacataatcagaacttagagagtagaattgtactaagcaaaaatggccagagaaactttctgacagctaatggcgtaatagtgttcaggaacattacctgcactgcattgaggaccttggaatggttcacagctataggggacccagggataatgttttgggtgctcaaggtgtcaagaactccattttgccaatggcctgcttgtgtctctccattcctgaaagtatacatgcctaatccttgccttctaccctcatgccaagctccctcgtatctgtgaccattggcaaaactgtagactccgaagccatgcattctatcagcaaagtactccccagcataggtatcgccattccttgacacaagttaacaaaatgttagttcaaaggtcaacccaataaacttgtacaggatgctgcatcgtataaatagatatatagagcactagtgaatcaggctaaactgcaacaatgcatctatggcctatgggctatgtggaaatctaaacatacagcttttattaaaatgaatccgtagagaagaacaaagtttcacacgggaaactgtaaacaagggaaagataaggaaatatacaaacagatagtggtgctcaaatatgtagtagactggtacaactaacatacatcacacacaatatatcatgctatctcataaactttgcaaaaaaaaaaatgaatacaccatcaagttttaatttggtagatggaagtgaaaagactaggtatagtatatatatggatttttaatattcgtccctgacacaggacaacaaagtaggatttccaaatccaaacagcccgtcatgacatgacactgtcaacgatgactaatatagctcgtaaccaatcagacataaatcaataagcattacggacataaatctagataactaataacagagaatggatggccaaatcccgcacggttaaacgatgcagcataaataaaagagaacatcaatcatattagtattagcgataccaaaagactgcttgcattagatatttagattgaagctacaactaagaatgaaccaacaattaccctaatcaacaaatacagaatgatccccaacaacgagaaacagatttagctttagaagagctatatgccagaagctaaaccaacagaggagaggaccctgttttccatttcagattatcactaattcactacttggatacacatgggattatggtaggaagtcaaacaatcaagacagatataatacaacagagagatgagagatatatggctggaaagaaccaaaaatggaaactaatggaataagcaaaatgcaatggatcaaattagacatccagtattccacatgtgaaataactagtgctcagcttgaccagtgcaaatttgcacgagatcagcttctaacagcatatcaacaatccaggaagaaatggaacaggaggacagctaagcatgctcacaaaacacagctagactagcataaacaggcaaatcatcacttgttttaactttaaaaacgtcttctagaagaatataggcatgcattaagtgtaaaaaaaagcttgctttctgataagtgataacaaaaaatgatgtgtattagtagactgaggtggtaaaagtatcagttttccctacagctctaacttttatctctatagttggtaatctgctctgcttcaccaaattgatttcctacctaatgatataggctgagaacataaaggaacaccttatattctgattcatgagcagggcagagggtaaaaaaatacagggtcgttggaggctataccctagtgataattacaactttttcagaatctaccataaatggcaaaagtaaattccaagttggatctttcagaagaaggtaccactaccagcccaacatttcatctctcccttgtaaacaataagctaatggaagtcattccctttgatcaaatgaagcattcacatttaatacattatctactagggttaggaaaagctctaaaattcagtgcatataaagcaacatagtagacaactacatagataatagagaatctaacgttctgctcaacttcacaagatctaaaatttaagcaacacctaacttactggtataagcagataaggttcgaagataaaactgtgttataagttataaccaattacaagatacttgtttggatacacaaatccacaaggatgggaataatttagcaatcgctggtgcaaaacaccaaaaccatgctaatttcactcttatcatatactgtggttaaacaatcatgcatttgcctaatttgacattaccactaaacattttgcaacatccatatctatttgactgaccaatgatggatcataaacatgctcttaactagttgcaacagctaatttcacaacaatgacaaattctctagcaggcagcagcaaatgaaatatataagttcagtcccacacctgaaatggtagtggccaagtccatgcttgacacccctcttgaattccccaatgtagcggctgccatcctcgcaggtgtgcacgccatacccatggctctgcccattggaccattctccggcgtacacatccccggtgtagaacctgtatacgccgtgcccgtgcctaagcccttgccggtactggcccctgtaccggcttcccctggcccaggtctcgacgccatagccgtcgtacttgccgtcgatccagtccccctcgtacctgccactcatgtagtagtagtagacgccgctgccggtgcagcggccgcggttgaactggccctcgtagacatcgccgttgctgtagacctggacgaaatggccggtggtgggggcggaggcggaggcggagggcgaggagccgatggaccagaggatgggggatcggcgcgggcggcggacgggagggggaaggggagcgggaaggggaggcgcgggagggagaggcagaggaggaggaggagcgcgcatgagaaggcggcggcggagaggaagtcggcgaggaaggagcgcgggaggatggccggggatggggagaggaa

SEQ ID NO: 5798 - DNA, 19347 bp, Oryza sativa
  unsure (1)..(19347): unsure at all n locations
acggggaggtggtggtggtggtgcatctaattgggatcaattcggccgggattgggggttgcttcgccggcgagggagaaggcgacatggggtgggggtgcgtggcgaggcggaggcgtgggtgggggtgggggcagccgcctcgcgcttttctctcttttctgcaccgatttttccgggtctctctctctctctctctttttttctttttttttcctctcttgtttgttctcctcctccctgagttcccgctggttctttttcccctcttgttcgatgttttttaaacgaatttattcaaattcaattctcctctgaaaactacgaattgattgtgattttttccccctttgttctagcttttaacataattcaaattgaatttgaatttgaatttcccacaacaagttgattctgtttaaacctgtgatagaaaatgattattttaccctaaaaaagaaaatgattatttaaattggaacaatcatttgtgtagagtagcactatacgacatgtcgtcttcttgaagttatttaaataagggtgactaggaaaattaaatgtttttttcttgtttaaatgtctttgtcttgctccacttgtagttgtagttgtcgcccttagctctaatttaatgtcatttgttgtttttgctgattaatgagcaaatttattattttgctcgtgtagttttatagctttaacgttcataagcattaaaataggatcaaatgaagatataactaagttaactagtaatttatttacttttgcttgcataaacaaggtaatataaccttgagagagagaccaaatgcttggagtcaataaacattgaaagatgagagaggtgggtatataggataataaactaaacatactacccatgctactctattaaaatatgacgaagctataaaccaacacatccaacactgcaaaaaaaaatgtaacgtcaacatatatcaaaatttggcgttttaacaaggttgattttggcaacatatcgaacagtcctgaaatatgtacattttttttataatcaaaaggaacgaccaagaggataaggcacacactagcaatcttgggcgcccaccattccacagttagtaatagtatgttttaacactctaataatggcactcagcagctaacaaagtattgttagaactttttttttctttttgcttgtggtttatagatacataagcagtgcatgaagagtggtgtgcggagaggaccagcacaaggatcggaagtagacgaggacgacgacaggcagctacaagttgcaagcagccgcctcccctcctatttccgtgtgcttcgcttgcggctctgcttaccttggatctgtctgtctaatctctctctctctctctctctctctctctctctctctctctgtgcagcaacaaggaaaaccaaggactaatggccagagttagaattagaccctagaaaagtgggtccttgaccacttttcccaagtagttgatcctcatcattttgatctagaccttgttcaattccaaaaaaaggtctttcaaagttctacaaggcacaataaaatttcgcagaaaactgatcgaattgtatcatacaaatatccacatgttcttcccaaggatattcttgggcattctctcactctcaaatgattgtgttgctgaccgcgatctaaataatctacagacaatttgggtgaaaattcggtgcacactgccatactgggagcgtcaccacgtcaaaacaaaggacatggcgcatgtatgcacgcatgaaatgtgtaatctcgtcgtcggctcgacagagacgcagggggggaaaaacgccgcgagatgctgataagtcgattcagatcggcatgcttatccacatgaccacaacaacgacatgatcctacgtgtgtttaatgattaatgattaatattcaagctttcagggtgtcaggaatcagaatattttagttacagtatattccagtgctaacaaaagaaggcaccatatagcagtatgactaaaactaaggtggtaataataacccagaaaaatcgaagaacaagttgatggcaacacgtgtgaaacaaaaggcacgggaacaaatagtagacaaatgtagatgccatggttatgaaaatatactggatgaataaaagaatgcccagtagacaaaactttgagaaaaaaaaggttgcaagaagaagcaacccaagaagcgatcaatcattaagcaaataccgaataattttttgcttactagtgtcacgatgttacccagtgagagtaaagtccgaagtctggggggaaaatccatataatataacccgaaaagcatgcggattaacataatttgatacagtgagacaacctaggatcacagaattaacagtacaaaaacagatacagttgctcggcaattacagcgagattcaagctcacatgttctcacatcaacagaccgcaataatttcgggccacaatgttctctccctaaaaactaggtaaaaacaagcagcagcttaccgtacaagtttgtcatgactgcttgtgaagtttgaagccaaaaacttttggaacatactgctgagatggcttttgtggcttcaagtgtggatatgtcatcaggaagagatgtgggaatgttgtcccaaagtacgctccgtcaatgtcttagcaaagtaaaggagatacaagtgcaagaaaaatagtaacacaatattcatgatagcacaaaatcaatgtttgtttacccatggttatgttccaaacaaatctaatcaaattgtatgagtcgcataaaaaaaataaaggaaaaccatgtttgaatgagaatcctctacacagagccccttttcaagtgctgcctaaaaaccaacctataacttggagaaactgagagtggtgaaatccattacaggtggcataaaaactcagtagtttgattttttaaaggatgtgttttagagagcagcacaaatgggtcatgtattcataattctgcctatgttcgtgttgtgctttgctttagctgttgcgaataataagtctgattctgcttaggaaatcacaatttctaatttatgccctatcagatatcacctcgtttttaactccatatatgagtacaatttattaagaaaaaaagcagttcatataaaacacatctaagacaaacaatcaaaaggatactgccttggtacttggatcttggataatgtaaatcttcacattttggacagtatatcttcactgtgctagacctaggaatatctgattgccctgcaggaagacagggttggccacaacagtatacccgggggcatcttccaaagtcatagttcttgaacttctccaactgcagaaggcaaaagcagaataatttagtattcaagtagtcaaggaagcaagcatagcctatcaaatatggtcaaactgctagcagattaccattgcagccagacccttgctggttaagatatatcttgcatgaattaatccatacagcatctctgcagatgactcaattaattcattttgctcctcagtgaacacatcacctgtatacaaatggtctgacttagaaggtgtatgtgtatacaatacatgtttcagactttgaactgtggaatgtttataaataggttattggaaatggctcctttagaaaatgagattgatgaacataaaaaagtatgttaggatacaaagtggtatgaaaaatataggttgcagctagtgacattcataaatggtatatgaacagtgtattttactgcaaataatgaattagtagctttcttaagagaaaaataatctcaccattagaagactcgatgtctaagataagatcaagtgcatagtcataatatggcacctgattgctcagaccacaaaggttgaaatcatcctgtatataatcatcatcgatctcacagaagaactcattgccgcgcaaactgcagaaccatgaaatccaagatgtgtcctctccctcagaaccactgacatctgaatcttcactgtcagtttcaaattcttctgctgcacccaaaagaaaaaagggattagaggcacctaatgatgattaaaaaattacatattaataattgcagttactgcagtaaagcaatagtcacaagtaataccctgccaaacaatattatgaatttcaagtgtataataaaagcaagcagttttcttacagattgaaaaaccacaaacattcatatcgatgcacagagaaattaaagaaacattcatatcactgcacaaacattcatatcactgtaaaactaagttcagtgtagtttgatataacatccccaagagtttctatggtttccaagtcaaagtaacctcctaccccctccttcataactcattaaagaaggtgttgttggagtactaagatgctagtcctaggttcaatcttctgcttgctggtgctctacttatctattgtgcaatctatcctcttcttttggtgctattatgatgtaccagtttctgttcacatcaaccacacaataggtgtgttaccgccctggttgcatatcaagcgaaattgacaaacaaaatggtcaaagtgaagcagcatgttcagtgagtcatcagtggaggcactggaatagttcccttttcaattcaaacaaaaagagagtcttcctgtgtgatcagatcatgacggctctacacgtgcaaacatcggtcaaactggaatgtatgacacaaatggaaacaaaagagttgagatcaatcaatgctgcctataccccaactccccaagtgctatgccatcacatttggttcctcccggttcttattatggaaactgatcactcaaaaactacaattaattaccgctgcccactggctacagatataactgtaagcttgcaattatgccccttttttggttcaacatgagctgtgaaatgtataaagacattatcagttggtcgaggacattgatgcccagaccgcccaagttcaagtcctcatcgaagcgaattcaggtgcctatttcttcttaaataaaaaaggcacctagttccccctaggttggtcaagtttttgagaacatgcttatagcacggcagcaagtcctccagttgtgaagttgtcaaccagggtttcaaccctggttctcacaaacaaaaggaccctcggtgtgtggtccctaaagtatgggttaagatacggcttgtggcaatggagcccttgtacaagcaagagccggctttcagggccttttcttcgaccttaagtgtaatgccttcgggatgtctctccccttgggtcgagtttttatcatttgtcactacacagctgaaagttatttcaacactgtatatattacagctaatgacatgcccaaaattccaatagagtaattgacatctgaaagcaaaataaatgttctacagagacaaaaaccaataaagtaaggaagcaaatggaggatttttcatgccaaacgagttcctcataaagcagtaacctatcaaggcactaatataacatcatgacatcatgttaatgcttttagcaattgctctttgccttcaatatcatgttagtctcacagatagagaaattcttcagatctccactggccccaaagacaaacaaacaatacaatatgactgaaactattcaagacattgggtcatctcatatagaaggtccttcaattggacatgttagttttctcttctgagatttgttagggctacatatggatgccgttgccagttcagtcctatgttacagtacatcaacatataaagggggctgctaaacattcgataaattcaatattatcctgttaagacgactgtatgcaaaatggcattcacgcgtctcaaactcttcgctacctctttaactcatcgcattaattgccactgcaacaaaaatacattgctctaattgtgtctcatgcatacctaattaaacagccactgccatggtagaataactaccagtccaaaattccattccatgtggccagttaccctaatgcctcgcaaaaaccaacttgcctaagaattctatatcataaggtgccctaacccatacttgcctacgtttattgtagcttctgtcatctgattctttcaccattgcatgctttgactgcattaagaccctactttgaccggcttctcataaacttccagtgcacgtttatttatttagtaattgttactgcttctagaaccagcatctaaaaagaaggtcgccacatacaaggaacaggtgccccaaccttgtaccgcttagccgtacaagtggtcgattataccgcataagcgtctgactatgccgcataagtgctacaatatggggtgaccgcacaaaactacataccgctttttaaaacattgtttagaactaaccgatgtttcgtgaacatatttaagtcataacatcaattaatgcagtacgtgggatggtattcacgtgaagttcaaacagaaatgtagaacttcgcttacttcagctccagttaatgcggtgaacatccagactcttacatcccatttcatccatcggagaaagtatacagaagcctacgttatcacgacagcgcaccaaatttcaccctaagattctacccgagaaacaaacagaagctgcatcatcatctaaccaaagcaggcaaagacctgaggcaatgtagcaccagacgccaccaaccccaaccaccgtcaaaacaaacagcacacaacccctcgcgcggaacaaacaaaccaccagatccttaccaccatcggagaccttcccggccttgccgagcggcgcgggcagcttcccccctgcggcggcgaggcggtccctctccttggccaccgccgcccccctggatgtggacggggacgacctgtccaggtgcttctcgagcacgtccttgatgcgcttccggtccatctccgccgccgcgccgccgaacccccgatccctgtacgcgccgctcataccctacctacggcggcgcgcccctgccacagcctccgctctctcgcaaccccctgagggcgagccggcgagggcggcgctcgcgggcggggctagggtttggcgcaggatcgaggtgaagagatcggagtggtgacgaggcggggaagaggaggacagcgagagcgagagagggagcccgtgtgcgtgcgtgaggtgggtgggcggccgctgtaattacgaaaagagcccgggggtttcccgcaaaaatgacgccccaactcggcgcagatatttttaaccccgcctctttctgtcgtggaggccgggggtgttttcgggatttcctcccggtcggtgtcggctgctcctgctgggctcaggttaggcccacatactttgcttcatgggccaagaaagcccaactaccatgcattttttttaccttttcccccttttttaactttccgcaacactctacgagaagccatcatcatggttaaaacaaaaaagagacagtactatacagaacaacacaaagggtggttccagatagacagaagattttccactcatgtttggaaaactaggtaaatactgtatatctctacggggacaaggataagatgttatagttggcaaagacctgaaaactgcaaacccaaacatacaaatgttacattccgaatctaatcaacaacactaaaacaacaacgctaatatcctgtgcgacgacatcatcaatgaagttatacgcttccaagctgctgcgcaattatattccttgtatgataatagcacctgcgaatgttctgcctctttcactcataaatcaactccttttgtttttgttaactgtacaccggtaacagaaacacgatcatgtgacgagatcatcaacctcagaattgaatacaaaactgggaaatgtggttgttatgtccctgaaaaatgcaagcaacaatgtttagaaatgatgttatctgcagcatgtcaaatgttcatggaaagtgcaagaatgtttgtaagtagtctagcaatctaccacactgaaaccaaatatctacagagatttacatagttgatctctttttgcaagttttagatgactgaaatagaaatataggtcaaacaatttattactgcgataaataaatgtctcatggcaactatatagcactatttaacatgagtcacatttagaagttgatgaattatgcataccttacccaatttacgccccacccaaccctcctctaattccacacatgcctagattgtgaaagttctttgtctatcttatctttttttagctagcataggctaaagtctttggtaatcggagtggcaccaataatttctatagtattggagataaacatagcagcagtaaaacacatacatatttctattttctgtcatactcgcttgaggaacgaaagagtcatagatcgcgaaagttcatttgtctatcttatcttagatggcacagacctcagtcaagctttggaaattagaatgacaccattaacttctttgaatatgggagataaagatagtagcagtaaaccgcttccatataagtattctctgcaatactcacttgaggtgtgagtgtcgtagcttacaaaagttcagtctatcttatcttttcttagatggcataggcctaagctttggaaattggaacagcaccactaatttcttagagcatggaagataaacatagtagcagtaaaatgtgtccatatttctattctctgttatactcacttgaggtacggaagagtcattatcttcaataaagagggattccttgagacaaaattctcccactctgttctatctattctcccatcctgattagtatcagcatctgaaaacgtctgccattaaccacataagtcattgtaagtcttaactctgtcataagacaccagaattacgtacattttaactacatttttttaatcaaatgtccaaaccttgtcaaggattgtctcaataatctcatcagataatctcatttctgattcacctagaagagcaatcaacatctgttttacctgtacaagagaataagaatagaaattttagttaccaacgaacaataggatgtatgttaaagcatgtcgtaaatatgttacttcagaggtaaagaagtttgcttacaaaccactggattaccaccaatacatatctttggcataaccattttattaaattccgaatcagaaaacagttggcatatgcagaatcataggcccagaaatagtaagacattacctcctttcgttcaataaacccagtgttgtccatatcatatagcttgaaggaaactgtccaaggggtcaatcatttaggaagtgaaattatggtatcaacgaagttgagataaaacagaatggcaataacttacaatcaattttctcttccattgggatgtttggatgaaatacatttaaagctcgaacaaagtcaccaaagtcgatgaccccccttttcttcacatcaaaaaggtcaaatatctgcaaggtccattctgtgtaaatttcaagtgatagaataaggttgtgcctgaaagcactcagaatatttactaacagaacctaagtgagaatggttgataaggagatggatacccgattagcgaaaagattttccttccttttgtttttaaacaatgcaagttggaactcttcctgcatagcaaaatgatgtcaggtattaattataataatttcatcggaatcgcaaaataactttcgacatatttttttggacaaatctgtcagttttggggtcgtacgatgtgctctgagattcgtgctaggaagggggaaaaaattccgcatgctgtagctgctgggtatcgaaccccaggcgcaaggatatcatgcgtgcgcacttccccactgagctatggtgtatttacataccacttacaccctagttatattgtaattacatgctggttacgttgcaattgtaggaataagtcttggctggttggtcttggtcttgtggtgccttttttcctgtttttcagctttctaggacagcatctctactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggatatggcttttgtgtttagtgaatgaagaaaaccaaaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacacagcagccccccggaggtgcgccatgtccgacgctcggtctcagcgttcggtcgcctcgagcactcggcgtcagcaggacgccgagctcgccgcagcaaaagagcgcaggcgagcaacggctcagaccgctgcagcagcagcgagggcggccagactggcggcagcggagttggcagcagccagggcggaggcggaggcggaggcggcggaagatgcggcacgtgcggcggaggtagaggttgagaccttgcgcagcagcatcaacggctccatcgccggcgacatcaccgctgacagggagcttgaggagctggcaagaggaagggcacgggagcgagcagagcggtgggcagcagcccacctccacggcggcggcggcggcccaagggaccgcgcgcccgccgacgggaacccagacgggcgcgggcgtgccggcggcagcccggagcccgcacgcggccctcgcaggcggcacggctccctctcccctgaccggcgccatggtcaccacggcgtccagacggtggtcagggattttggtcccggcggtgggtggcctaccctcaccaaaaccaactacatcgagtgggccgcggtgatgagggtgaggctccaggtgcggcacatgtgggaggcagtccggtacggtgacgtcgactacgacgaggatcggcgggcactggatgccctcatcgctgcagttccgcccgagatgcagttctcgctttcccagaaacggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcaaaaaatggtgcagtacggcgacgacacctacgacgaggagagagctgtcgagaagctcttccgctgcgtccctgagaagtacaggcagatcgctcgctcgattgaatctctgctggacctctccacgatgtcgatcgaggaggcgttaggtcgcctcaaggtcgtcgatggtgatgagccacggcctctctcggggcccatcaccatcggcgggaagctccatctcactcgggagcagtgggaggcctctcagggtgacgggaggaagggggagtcatcttccccgacaggcggccgtaagccgcgcaaggcgcggggaggtgtccagctacggtgggcgcgaagacgtgccgagggtggcgcccgcagaggcgcccagggcgttgccaccggcaaccacaagccggcacgagacgacacctgccgcaactgtggcaagcttggccattgggccaaagactgtcgacagccacgacgcggccaggcccacgtcgcacgggtggaggaggaagagtcggctctgctcctagctcacgcaagcatcgagctacctccagcggcaccggccgcagcggctttcctccaccttgatgagccgaaggtactcgtctccctctgcgacggctccagcaacgacaaggctgatgggtggtacctcgacaccggcgccacccatcacatgaccggccgacgggagttcttcaccgagttcgactccagcgtccgaggcaccgtcaagttcggggacgcctccggcgtggagatcaagggtgttggctccgtcaccttcaccgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggcactaatcgactctacatcctcagcgcgcaagtcgcacatccagtttgcctcgccgctcgtcgggacgacgaggcgtggcagtggcacgagcgcttcgggcacctccactttgaggccctgaagcagctcagtgccaaggagatggtgcgaggcatgccgtgccttgaccacgtggagcagctctgcgacgtctgcgtggtgacaaagcagcggcggctcccctttccccagcagacgagcttccgagccaaggagcggctcgggctcgtgcacggggacttgtgtggcccagtgacaccggccacaccaggaggacgacgttatttcctgctgctcgtcgacgacctctcccgctacatgtgggtgatggtcctcggcagcaagggagaggctgcggacgccatcaggcatgcgcaggctgcagcagaggcggagtgcggccgcaagctgcgcgtgctgcgcaccgacaacggcggcgaattcacggcggctgaattcgcgtcgtactgcgctgatgagggcattcagcgccactacaccgcgccgtacagcccacagcagaacggcgtcgtcgagcggcgcaaccagacggttgtggggatggctcgggccctcctcaagcagagggggatgccggccatcttctggggggaggcggtggtgacggccgcctacatcctcaaccgctcgcctaccaaggccctcgatggcaggacaccgtacgaggcttggcatgggcgcaagccggcggtctcccacctgcgggtcttcggctgcctcgcgttcgccaaggagcttggccacatcggcaagctcgacgacaggagcaccccaggggtgttcatcggctacgcggagggctcgaaggcctaccgcatcctcgacccggagacacagcgtgtgcgcattacgcgcgatgttgtgttcgacgaagggcgagggtgggtatgggacaaggcggtggatgatggttcgactccgacgtacgacgacttcaccatcgagtacgtccacttcgagggagctgggggagtaggcagctcttcttcaccgagcgtgtctaccccagtccccgagcctccaccgactccaacaccaacacaccctcgggccacgacttcgactacgacgagctcgtcgtcgacaccaccccagccggtgtccccacacgctccagcaccaacagccactcctccgggcacgtctactccgacgccagctcgtgttgagcgcagcccggtggagttcgttactccgctctcccacgacggggagcgcatcgacgcgtaccatgacggcgagcagctacggtaccgtacgatggaggatcttctcggcgaccagccggtgccgggactggtgcctcgcaacctggaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactccttcttgcgctggctgctcaggaaggctggggcgtccatcacatggacgtcaagtcggcgtttctaaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttagtgatcaccggcaccaaggatgcagaggtcgcggcgttcaaggaggagatgaaggccaccttccagatgagtgatctggggcctctctccttctacctggggatcgaagtgcaccaggacaactccgggatcacgcttcgacagaccgcctacgccaagcgcgtcgttgagctggctgggctcaccgattgcaacccagctctcactccgatggaggagagactgaagctgagccgcgacagcacagcggaggaggtggatgctacacagtaccgacgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccgaggtgtcctggcaaggcacacttcgtcgggtacagcgacagcgaccacgccggcgacatcgacaccagcaagagcacgagcgggattctcttcttcctcggcgagtgcctcgttagctggcagtcaatcaagcagcaggtggtggccctgtccagctgcgaggccgagtacatggcggcatccgccgcttcgacccaggcgctctggcttgctcgactgcttagtgatctcctcggcagagatactggagcggtggagctcagggtggatagcaagtccgctctggccctggcaaaaaaccccgtttttcacgaacggagcaagcacatccgagtgaggtaccatttcatccgaagctacttggaggaagggagcatcaaggcgagctacatcaacaccaaggaccagcttgcggatttgctcaccaaaccccttgggaggatcaagttccttgagctttgctcccggatcgggatggctcaactctcccacaagacggcgcacaagacttagggggagaatgtaggaataagtcttggctggttggtcttggtcttgtggtgccttttttcctgtttttcagctttctaggacagcatctctactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggatatggcttttgtgtttagtgaatgaagaaaaccagaaaattgccccatctcgagtgccatcctcttctcaatgagagtaaccattgaaattctaacagcaattacactattattgtgttgtagttacggcatatttttggggggattttatgtcgaacgttagataggtagtccctaatttcataccgtgaatttagctactgatgacgtcaagattatagttcatgagaactagcagatgtgcatgaacctgtatggcttctcagatagcagttaatgaacttcttcgccacgcaagacgcaacaagaagatgcaaaaaacaaaagtgaagatgcaagagaaacgcattatgtctagctttatagcacggcaaatcaatattgacaaggcaggaagaaagtgactcaaactttgaactatcattgtgttgttatactgtgatagtagccagatggtttatatcaggaacaagttttttcctattaaactttgaggaaaaaaatcacattttgatacacagaaaattcaacaatttagaaggcaaacacataatacaatgagcggtacaagaggaataaaggatcggggtgtgtacaacaaagattcatgctcacttcaaagatgaatgaatagaactgccagcatagcaaaacgattcacagaaaatggcatccaccacataatttgtgcagctgaaacctgaaagacggaacagtgagaaaggcgtgggggtcttctggctagcaccacaagttgtgggctagccgacccaggttcgagcctcactcccctcttaataaattccgatatgagagcacctcctctcatatccagcgaaagacggaacagtacatggagatatattcaaatgtggcaaggtttaattttgtcattccacaacaagctacaaaagcagatagtaaatgtatcaggatgctcataatcacacatgacatgatgccaatatggtgatgaaagacggaacagtagatatattcgaatgcggcaaggtctaattttgtaattccacaacaagctataaaagcagattagtaaatgtatcaggatgctcataatcacacatgccatgatgccaatatggtgagatacccccaagaaacagttagatgttcaccttattgatgagcccatcgtcgatcacagaaccactaatgctcttgaacagctcgaacaaagcctccacctcacttacgctaactacacatccaaaacaactaactcagaatttccagtacgcccatcgattgcataaatcagatgaactacttgatgaaatgaaatgaaatacagtactgtagagtactcctcaagtggcaagtacagcaacaacaactcacaggcggtctcggaggcgaggccgacggggtcctcgtaccccgggcgcggacgcctcgccgtcgactggaagcaccccatccccacgcgcaccccgcccagacccgacccaccggagtagccgagcacacacaccccctctaccgccgccgcggccgatctcgcatcacccacccctccacctacccttacacacccaccaccacacgccggcgcactcccccggcggcgcgcgcgcggcggcggcggcggatcggagcgcggagcacgggaggaggtcggggttgggggcgggggggtttggtgcgcgacgcgtcggggtcggaggggtgtcgagacgagacgggctatgcctcctcctagtcctactacctacgcgataggtgggccccgagtccgttgcgcctcgctttcccccgacttcttttgggaaagaagacccgcaccgcgcccacgtgcgcgcggcccttgcggacttgcggcccatggattggaagaagcgaagaagggaggacctcgtcgtcgtcgtccattcccattttggtcagctgggaatattcgcagatttttttttccgaacgcgcaaaacaattaagtcaatatattaaaaaaaaatatttgtttacataacgcaatcagacagactggcttatgccaagaaaaagaagaaaagacaaaaaaaaaccaagaaaaagaaaatgactattacgacggctaagcgcaactccaatcagcgagaaggggcagagccacacggaatattagcagatcatacgatttcgcaaagaaattgcaagccaacttgcgctaatcttacctctcggtcacatgcaacaattccagcactaatgtgtcatggtttacctcagccacgcgcaataattagagtaatctaatagtactactaccacagtagtgaaccacgaccaggcagattgtttatgtcacatcgaagaaattcaacattgttccaaatcttcgatggaagattctcgagcggatgcttcgaattgatagtagtcccatggtttgcttggctcataatcatcttttttttttgaacgactgctcataaccatttgaaatccctacgaaactagcaagaaaaccaagttaaccaacgtctttgctaacgattactagctaaaactgattaatcaattaatttatcgtgcagcccatggtttgcactttagaaaaccggcccagcatctttggaaaagaaaagcccagctccatgtttctggacaccgccctcttctgagcgtgggcctccatataatacgtacatggagccacgtggcaacccggagcgacgaaacggccacgtcgtattcacaggacacgccacctaatccacgggccccactcctaccccgcccgccgattagctgagctgacgcgtggggcccacgtgacaagcgacggcactcgtgggggccacgtgtcgcgcacctcgccgtcgccgtcgctgcttcgcttcggcttcaagtccgaccaagagaccctcgtcgctttccggtgacggcgacgaagagaatttcatatccctccacctcgccgcctcccttcttcggatttggtctggtttggttggaggttagctcgcctctgattgggttggttgggtggtcggcttcggtctcgaaccgcggcgacttctcctctttgggtttgggtttcgagggggccaatggaggagaggtacgaggcgttgaaggagctcggggccggcaacttcggggtggccaggctggtcagggacaagaggagcaaggagctcgtcgccgtcaagtacatcgagaggggcaagaaggtctgatgctgcctctgtctctgtcttctcttctctccttttgtgatttatttcgcagtttcttgcgtcggactgattgataatttgatggtgtgtgcgagttgatgttttcagcaactcgttgttccagatgcatgacgagtcttagcttttagtttgattgattgatgatgcatggatggttggtttgctctgtgtgcagattgatgaaaatgtgcagagggagatcatcaatcataggtcgctccggcatcccaatatcattcggtttaaggaggtaattcagattttcttttcactcatcagttcgttcggcagcttcactgattatcagtcagtcaaacagtcaaactagatggagctgatctccactgctactgtagaaagtaaaatgataaggttttgggtttatacatctatcaagcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5799 - DNA, 1385 bp, Oryza sativa
  unsure (1)..(1385): unsure at all n locations
attgaattacatttcgcgtttggcaccttaatagcactctgataattgttctgttatgtctatcaaatgcacaaatgttcatggcattctaaactagaaccaatcccgttatcacttgttggttattactgtccccagcatggtactgtgacctaatggacaaaacattacaattattctggctcattgtcagcaatttggttggtgcacttggttccaggcttcggcaaactttgctgtaacttgtaggtgattctattttgaatgtcgtctccgttgtccaaaaatgcgaaaacaggatgtccacgtgcaaacatacgagaagcttaaaagacccgagtagatacatttcaatctttggaaacactctgttcaaatatatagattccattccttcccataaccatcgaaaaggccatcgagtccatggactttgtgttacaggcatcgataatcagtattgcaggtctagagatgctgacctcttcataacatcatgcgtcctatgatactgtcataggaagattaaaggaaaagtgcccacattaccatgttatcaatgattactcatttttatactatcataaaaaacttgaaggttatttttttctgttcacaattcaaaacctatttgcagcacacgaattccatttggattcagcttcggtaaatatttcacttgctacgaggttgttgaacatcgtctgaaggagaaacacataagctttacatagctatctacttgtggccacgtttatgatgttgtatttccatatggaatgattattgtggctcacttaattttgttgttggtacacctttattctatatgcttaaaatacttaactcttgttgaagtcatctattcttgcacgaagaaaatatntgcctgtcataaacttggctttccttcccagattaaagttggtgaaagacagccactggtgaatatatggtagcactacggatctattcagaagattgtattgcatctggtgttcagcaacaaagtgctcgtacctgtgctgctgctggagaccaatcttcacaaaacataagaaaggtggaatggaatgaaatgttcttctttaaagttgaaagcgaggtgtgtaaattggaaatatactaaaataatatgctgcacttactttacatggtatttgttctcgtgatatggctactgcctgatctccattctgttatttaaaccttttcaggataattatgttctggaatttgttgttcttgatgctggtggaggttgtagttttgatgtgcaacacatttacttttctttattttcttgaaaacactggaggactgcgcttcctttcattaagaagaagaagaatacaaaacatttacttttcttttctttattttct

SEQ ID NO: 5800 - DNA, 1033 bp, Oryza sativa
  unsure (1)..(1033): unsure at all n locations
ggagtggacagtttggattgctcaaagaactatcacctcttggcgacatggttcacttcgattttttgaattcatcatctccttctcttgtgcactgcttcattcttaannntttcttttatctcttcaggatgggctgttgatatttctgcctatgatgacgatggaaaatgcacacatattcttctttgctcaaacccatcctcatatcaggctgttccaccaaaggtaactgcatgttaatctgccccttcatatcacaagtgtaagtcagttgacatcatcatgctgcaccaacaggttatctatgtacgcccatacataacattcacaaacagggctggacaagatttttacataaaacttagtgctgaagatgagccaaaggtgctacatgcacatgactggagggtttcttttatgcactcagaaggaggaactgaaaaattgcaggtatggcgtcactcttaatgataggtctagctacgtacttgtatgaatgaaattttcatgaagccattgttcagaactacacaactgtcattacttgctccagccaaatctttttcttaccatgtaatatatttggtgatagtgttctatatgttctctggatttttaggcaatattttagttagtaggtcttttctacattctgtatgttgtacattttagttagcacactattttgtttatttctcagcttagatttggttatgcaaaccactgttatttgaaaatgtgtggctgtatggtcagtatggagtattatcactttaaaacagaaacaatataaactatgcatggtttactcaaggacagacttgcaatggattgatgcccctgtgtctcccactctctttgatctcaaacttttcattctcattagtttggtatgcaaaacatcatttatgttgaaaagaagatagcatgcaaatatcaagatgagtgcctgcaaaactcaggaaaaaggagggtaattgtcctcttgttaggaacttaggatactatacatgcgctctagtatcaacaa

SEQ ID NO: 5801 - DNA, 22972 bp, Oryza sativa
  unsure (1)..(22972): unsure at all n locations
taaacatatatttatccacaaggaatttctatctgtacaccatgtggaagccagagaaagatatgcggaaaatacacaccttgctttctttgtttcatgaaccaccaccttgtatgcatacttccaccaagaccttgggtcagatttgactggcaaagatggccggtagtgagcatattgagacgttgattaaaagaagaaaaanatcagccatcttcaagacgtccctgtagccatcctgatataaagaacaaggcgtacacattcaacagtgccattggcacagagggagagagagagagggagagtcagaccttagacaaagacaaagtaacgtcatccaaatcaacagctgcattttgcaaagcctgtccgggtttctttgcttcatcaagttgtatcttcgtatatttggctttgccagagataggtcgtaaaatgtaagtgtgtgtttttgaaggaggattagaactgtcctgctttctgaactcaaaaatctgaaatacaatttatgaagcagcaagaatttgtcaagtggaaaaaattattggatgtaaacagtgatattggcatgacccagcttacgaaacctcactgcaacccagtgtcaggaaatctaggcacagtttatggctgttcagttagttaatgaaaaatggacgactgtatatgtgcagaagtatacagtaatgatcgatggtatgttttgttattaacaccgccaaagtgccaaaattatggatggggaacaagaggtgagattaagagatagggatgaaaatttgcttagtcctctcaaagataacatttcctttatataagacctccctaacaatctcagttgggtaactaatagattagatgtacagctaaagctaattatgattgttgcagctaacttgccaacttcctgaacaagctaggtgacatcctgctgtatgcctgccttcttgaatcacttaaatggtcccatgcaacaggacaggcagtcatggcctcgtgcataatatatatgctcaaacatcaatttttttattagcaattgactacagatggaaattacctgactccattctgaaggtaatagatcttcccaggacttatccacactccaaggactgctatcagaatcaaaatacaatgccaggctctcaagttcgactgactgcaaaccatttgcaaataaactataaaaaatcaagatccattggtatgaaaattatgaaagattgtcacaagganaagaaaatggacaagtacattacgccaaagattcttaatcaaaatacattcgcatcaactagagatgtttcttgtgttccctactgttctagagttcaaccttctgtttcttgaatatcataaaatacatcatatgcgctttagctgttcgatacaactatacatccatagtgctctcctccatcactctagaatttgcatcaacaaagttcactactaggctgcggatggctttgtgtcatgataatagtgtgttttggcacctattgttgtccaaattaagatttgtattccttaaacgaaggatatttgaattgcacgccccttttttgagaacggaatgtgtcttatcgaccaaatggcattgaaattggtgtccatgccctaactttactttccagaaggtttagtagtgagttgcatagagataccggtatccaaaaagtaaccagagctattaaggattatcaaattagtgagcaccaaaacaatataccttcttaactcggtccaaatccccgcctgtggcaaaagtctcctttccacgatcatccacagtaaatgctgaaagctttgagagtgccaaacctgctgcaaaagggtggcctggattgctatagagaacaagttattatcattctatatgcatttttaaggagaaattcagtaaacgggatttaagtacctctctgtgtcctcatatctgatatgaatattgctaattgacaacttaatatttccaattacagtgctaatgaaagacccaagccatgacgaattcttcaagaacaaaagtgccagtaagaaataaatgaagtgttccaaaaataatgaatgttaaacacacaacatcaatcgaaacaaaggtagccagattgactatctggccaactaggtgatccattatcatcagtacataaacacatcagcgaaaaactaaaagggctaaataccagttcagatttcagctgttgttggctctccaataacttcatttccatttcctgagtgaataaccacagatcatcaatgcatatggcactggcattgtttccataactcactttaaaaggtcacaaagtaattaccctgactctacttctttttgcctcttgaacggcatcctcactgcaaccttcaacttgtgttgctggttcagctaatataaatattcgatcaagataaaccaaaactggctcttgaccaagcctgctccacgggacctaataatcattcacacattcattctttagctcagcacttcatatcttaaggcaaaagtaaatgcactgagctgaagcaattacagcaaaccttgagcttcactgaaccaagaaaaccagctttcaccctcacaggtaactttaatgaattgagagcctcaggcttcaactgcatgttcgtgagttctacatcacctgaaatagtatttcaaaaaaatgtaatagcattaagcagcaaaaatggatatatttcattgataaacagggtcaatagctagcaaaaggaaaaacaagtgggtttacaagttccttctggtatttgaccaagttctaggaacaacacattgtgttctactctaaatataataaatgcatgccattgtctgttctgcaacgaatacatgccactatttagatgaaacagcttaatatcatagaatattctataggtggcctgaggagttcccagcccatccgtccatgatgccacatgatggaattgccatctgatgcctactgtcatatgcttctcgtgataaatagcatcgtgcaagttgaacaaaatcctgtgcatactttcatgaactattgaaatccattccatatacaatgtgaatttacctacaatcgtcgtaacatgcaaaccacggatacattcgtttgatttgtctatgcaatcactcaaacaacaatttccctcaaaacatcttgatgctcttactgccaaccatcaacacatgttttggttgattggcaccatggaaagcatatacctagtatatgtatgaatagaccatccaactttacaattcttcacagaactggtaacagagaaggaccaacttcatatactttatgcgctcaagctacaggatctacaagtgaacaccaccctactcttgttttcttgcatctttatctagtttatccgaaaggaatggtcgtctagacagtcagaccaagaaaatcatacatagtgatagtactactactattccaatgatcaccttgcatatttttagccatacaccacattccaggcttccaggccataactgtcagtgataagcagaagtaaattgtccaaaccgataaattccctaaattctgaattacagttgcaactctgagcgctatgctcttgtagtgtcgagtaacagcatcaagatgtgtctgttagccagagaattcaagcggtttctggatttcacctagaggacatactggtggcatgtctaacatttgccctcaatcttcttacatggctgcagctcttgaatggtattcgtccatgttaaacatcccagataaccgtgacatctccacccttctctgacaaacagcttcctaattcaatactctgagcacctattaacactccacgatttgacagcaaccacaactcacactctcacagtcgccaaaaagcacttgtatgaactgctgaggtgctgataccagcacagcttgacaagatactttcgatctgcaaagcacttcccagtcactgctccgcattatcgacattgtcactgcttgtaccaacacttgcattcacgaagtttatgttccaattgtggtccacgcatcaatgccagtcagtttagttcagaaaaccaatgcgtacacacaccgatggtccaatcctacattgctaccaacgaaatcagcttccacatgaagcagcatcttatgcagacgccagccatttccgatggcacaaacgaatccaacaatcacaaactacacactcagattgaacttcctaaaactcccaaaccatacgaaatcgctgctccatagcgattcgctacctaccactgtttctgctgcaaccgccactactcagaaaacaaagcagagccgcagcaaaagtagagagtagccgactaaagccgcacgaactaatcatcatcgacggaagcagagcgagaggaggatagggaaaggggggggggagtgcgaatgaggtcgtcacctctccacacgctgatcttgagggcctccttgctgagcccccggacatagttgccgaggtacttctgcagcaggaaggcgacctggtcctccaacatctccgccgccgccgccgccgccggcgatcggcgccgcccgccgacgccgcgagagcgaagaggcgagcagagattggggcgagatgcctcgcgcctcctcctcccgaccttccctccgcgcgcgagagatgagagaatcaatcgagggcactggactagaactcagtggaagcaggcagtccaccacgggtagtttctgtgtcgaggtaggaaaggagatcgctagaaggaggaggagaagaagaaggcgcgaaaattacggagatgccctcgcggtcgcggctgggatgagacgggtggcgtggcgtcgggcgatgtacgtggtgcgtgctggttagttaccggctcggtctgagtcgtgtggtagtgtccagagaaaatacacctggatttgttaattagtaaattaaataattaattgcttaattgcgatcaaaccgaagggcgagaagtaattagaaccttttttaatcgcgcaagctggatggatggtcgagcaaagtcataatcacggtagcaagtgactaccaaaccagcttattgtcgttgatgaaagattaggaaaaaggaaagggaagagaaaagaagaacgcggcgtggcacgcaaagtgcttaaccaaagcaggcaaatgtcgacgggggatgtggacgacgctgacgccggatgcctcgtgtgcggggcgcgcgtgacgactcgagcgagcacgcaaagctacctctgcggcgttgtgctgccggcgtggccacgcagcccaaggcgcagccaacgacgacgcgttcgtcgcatcgcccccggcacgagcgcgacacctgcccctctctctgccaccgcacctgccaatacgtgagccgcccgtggataggggcaaccgaaacaggataacaactgaggctgggtttaggttacacgctaaaattgaaagtttgaagaaattaaaacgatgtgacggaaaagttgaaagtttgtctgtatgaaagttcgatatgatgaaaaaaattgaaagtttgaagaaaaaagttagaatctaaactaggcctcaaagggtattttcctcgtcatccactctttcgggcgtgtttgtactttggaggagtataatgtacgtgtgtatatttataaggtgagcgtgtacgtgttacatacgtttgcgtttataatgtgtttcaaaaaaaaaaaagccgcaatgctacacacacagcacatcggtacatcacaggagtatgcaagtaacattggttagactgaatgactgagtgccaactactgtcagtcggtcagatgctatactgatgctaatgcaaaaggatcaatcaaaggaaaagaggaggaacaaaagtcacctcgaagaacaactcctttggatgccggtacgctagcttggaagctcgatggcattggccaaggctgtcttcttttcgagcttattcctttcttctaccacactctgctagttacttacaagaatggtgatctgttctgatgggaaattcccgctttaccagcccatctggaaagaagcccgtcaagagcatttctgctcttccattttggagtcagcccagcccgttaagagtaagctacactagcatttggcccacgtatcattctactgtcatgaccgactaggcctaaaaattaagcccactagaactgttcggagttcggcccaaaaatcacccttatacataaaaatggtttattctctgggatcaaatgctttcggtcattggatttggagatttggagtttttcaaatgaaacggaaaaaaatgctttggtcattggattggcactaccaacgtccagccaatgaggtcattaggcaaatgtcagtgtttatcttgcctttgatcctatagaaaccaaaaacggatgatgacaccatttctagaacatgtctttttttttaagtacgtgtttgaccattcgtcttattcaaaaaatttaaataattatttattcttttcatatcatttgattcattattaaataaattttcatgtacacatatatttttacatatttcataattttttttataagacgaacggtcaaacatgtgctaaaaagtcaacggtgtcaaacattttaaaacagagggagtatttgtcaagcttgctttctcttccaagccactcgtattgccatgcgattgcaaaaactttattccttctgcggttctgcctattatctttatcgtatatgccaacctttttttcttctttcctccccagaacgcctatctcatttgactagtttgcacctgacaactacctcattccccatcagacaacaagacatatagacccatacaaagttgcaaactataattcagatacggcaagtagcaacagaacaagatgagacaacagcgttacggttagaatatcacacaggtggcaaattggcactgatccatctgaaatgtgacgcccattttctgtgtgcaaacatgctcgaataggagtgtgtgcaccttgtttatggtagccaagatcgagagagaagcaaaagcatccatccctctatttatctgtatgtcagagctaagctcaaataatttctcctgcctctgatgaattttcaggcatttataaacagacaaaaatggtaacatcattcaacactcatggatcttcatgctcttagaaaaagataataatacctctaattctcagacgtgatgcacgtgatcacctgtttacatgcatcttgatgatgcggattaccagtccaatgtaatcaaacaggcgtgtttaattttgtgtagtacgggagatcaatcaattcaagattgacatgcaacatgcatggatcgagatcgcagtggcggtaatcaatgggttgattgggttgggtacatatctgtcctactggttgggagaatacggattacagtacgtccttggtgtatgttcagaaagaaattggagtactggtggtagtaattaagaggagcactgtatgagaatggagtacagataagtataattaactggtagagagtaaagaaagattgttgggcacatgatccttgcctgcccaagaaccgaaagcatgaaagaggcggcagaaaagattcagagaagtggatatcccctgaaagaagcctccagataaaatagccttattccaagcaaaactgatcaggtgacctcccctgaaagaagcctccagataaaatagccttttgagaaagcttagccagcaaaaagtaaacgatcagttactagtgttaatcaactgcaatgatcagtgctttgcctaccttggcctacaaatcaaagtactccatccgtccaaataaaaagacaaaccctagattttcgtgtccaaatttgactgtccgtcttgtataaatttttttataattcgtattttcattattgttagatgataaaacataattaatattttatgcgtgacttatctttctatatttttttcatattttttttaaataagacggacggtaaaatgttggacacgaaaatcagagttgtcttttttttttttggacagagagagtatctatctaggttagcatgctctgagctggactcaagtagtgtagtcaagtagtcgtatctgtcaagctgtgtgcagaaagccaagccaatcttcaccctgatcaagtgatgcacacaggtgaaaactcaaccttgtcgattatcttgatgcccattataaaagctgacttgtcctagagtgattatgaatggcctgaagcgataacgtacaccagttaatgtgtgctagtaaaggttttgttggattaattgccgatcgatcgattggtgattataaattcagaactgcagttaacagcaagcagggttgcatcgatcgattgccttatcatctcgcaaagcgatatgcatgatcgatccatcgatctactttggatttcacgctaatgtacatgcatgcatgtggacagacacacatgacatacagagtacagtttggcacctttcgtcgctgccggatcgaattgatgaactaacaaacattccggacagagtagaagagaaggaacaaatcaaaatcgatcgaagctgcgtacgcaagcgccgatgatcgagtgagtgacaaggatggcaaaccagactcagcagatgatggttgagatcagcctcgatgatctatctatctatctatctgctcgtgcactgcgctacaggccagcagctaaaattcgacacgaaacttagggggtgtttagatggggctaaaactttttagcccatgtcacatcggatgtttggacgctaatttagagtattaaacatagactaataaaaaaactaatttcataaataagagctaatccgcgagacgaattttttaagcctaattaatctataattataaaaagtttactgtagcatcacattgtcaaaatcatgacataattagactcaaaagattcgtctcgtgaattagtccaaggatatggaatgtgttttgtaattagtgtatgtttaatactccaattagtatccaaacacccgatgtgacatggacttggaataagtcactggaaaccaaacaaggcccttatcgatcgagagctagctagctagatagcgtcgacctgatcgatcgtggtatatactctctccattctaaaatattcaacgccgttaattttttaaaaaatgtgcggccgttcatattttttgaaaaaatttaagtaattattaattttttttctatcatttgattattgataaatatatttttatgtatacatatagttttacatattttacagaatttttttaataaaacaaactattaaatatatttaaaagtcagcggcgttaaatatttaaggaacgagagagtatcatcttgatcgactgaatcatccttaacgctaaaaagacgtctacgactgaactcgagatgggcgagatcggtgcatctggttgcattggatggatagatcactcgattgatgtagttgagaggaaaaggcgatcgagatcgatgcaagatcgtccacgtagccgtcgaacatgtcctgtcaggttaggaccaagctgacctggcagccactagcctcgagtctgcatgcacacgcatcaccaatgtgtctaacaaactatacgaagcaagatgagccctagcgaaaaaagtagtacatccattctaaaataattataaatatagattgtttagtatatatttaaaaagaaaaactacgataactcttattaaatagtgtgtagataaaaggctcccatcggatggcttaataagccaaagaaaaagccaaattttgagattgattttgaaatattttcaacgtagtttctttatcaacattgtcttttaaatcaccaagaatacatttataaaaattttatctacaaatttatttttatttcgtaataagccgttttggcttattgggaaataagccaaacgatgggaaccaaaattgagatgaaagttgagagtaacatagaaaaaaaaaattaagtatattatggatgctctaagtttattgcaggatgcacatgacgggacatggcactacgtagggactgcttagcacaactccagctgtacctcagctaaacagtttcagctccacctaaaatgagagcgaaggtgggttgagctctctcacaaaatgaacaagaggtagagttgggtttaggcagctccactccatgtctaactcctggagataaatttagaagttacggctcgactgatcattgtagctactagatgggctggcgatttgggcccacgagctagctagtctccttgacccacctgtcagatgccacccagcagcaaggaacaaagttgcagcaaatcgagcgctcgatcgtggcagatcgaactttggcatatatacacgtaggagtagtttatatgtacccagtcgtgatggatatcgagtcgtttaaattgatttcttccatgtgtgtttgggcttcttaacttcttttgcgtgctgtatagtatattgcattatgatcgagtacaagtacacgtactcctacactgtgccggacgcaagtttgctcgttgttgagtgtgtgcaccgatcttgatcaatgatactctgcttagccactattactacacgtgtattaagtctagaataaattggtctcgcttgtacacacttgaaacattataaacatgctactatgtttttttataagcatatttgaatataatttaatagtatgtatgtttggtgttgaaaatattactatatttttttataagcatgattgaactttaaataattttaactttagaaaggttaaattatcctacgatataaaacggagctgtatacactaacttctttgcaaactgaacaataaaccaaaataccactgcatgcatgcatgtgtgcatttcattgtggactgctcctttcacggtgcatataccgtgtcctcctgcagcagctgatggagatggatatcaacggacacgtctggagtagcaattaactcctcctgtgactttttcagaagatgtagctcatgacacaagtacgtaccgtgttgacaaaccatacaagaaaatcggagttttttttttttgtctctctacacgccgtgctggtcggtcgacctgttctccacccgccagcaattaacctgcactcgatacaaccaacatgggccacgaattgaacactaccgtctaccgtacccctccgattttttatagaaaagggccttaattttttttacattcgatttacttcaagaatcaatataaatataaaaatataaatcacgtataaagcatctttaatagtagtaaatcaaataactgcagaataaatatttttaagtaagacgaatgtttaaagatatgttaataagtaaattaactgtgttttcttaaaaaaggaggaaaaatagagagcattgttcgctccccactctattgctgaaatgaactggcatttcattactgaaatacaactggtagagtaaggttttgtctctacgcatcacactggtgtgacggtgtcatcgcaccgcgatgcaccgaacaaaaaacaactgctacagcagtgttatgcagtatactaaaaatcagagatattggtatttagcagcagcatcaaacatgtggctgctatctatacgtagtatcagtctgtttagcgttgcttgatgtatccttggttagtacgcaaccaacaagtacacgaggaaaaaaaagaaacttgacaagggcagggcatgcaaccaatatccgtaccaattccagtacatccctggaaattcagaattcaggcggttccgtttcaagctgacgcttcaattcagacttgagacgcaacatttttcttctcttcaaaaaaatcttcagagaagcaacaataccacacctacaacatttctaccacctactccacagtgcacagtcttggtgggcccaattctggacagcggggcccatctctactacgactgggcccacgtgttaggaactcccaacgattatctctcaggaactggaattaatcacgaattgcgcatacaagatttctcaaccccgaaggatcgagccgccgccgcctacgcgcgcatattccagttcttagcccccatctccttgttcttcgtttgcgtttatattacatagtttcggctgatctctctctctcagacagctcatgccagctggttgtttactggacccattggtcacccttgtagcgtggattgggcctccttgctcttggcccaagctggactggtacttgcttcttcttggtcttgaagtctggttttcctccttgttcctgggcatctgcttccttgtcgtcaggctccagcacctcttcctcttctgctccttcttgtatcatctcttctgtatcttctcttgctcttggtggagatggaggcctgacaccacggcccaacaaagcctcctccactcctccgctattgattcgctgctgcgttttgcatcgcgacgcgcgcccatccggccgcccggcgaacaaccgacagcgccgccgcgacccactcccggccgctcgatcgcgatcggacggccgcgcgcgccctcacgtgatccccgcgcatctcccgccactacgcccccctcgcctttaactgcaaatcgccaaccgcgctggtgtctggtggtacacatctcgcagcactttttactgcagcaactgtacaacggaccaaatcacacaacacaacgcagtaaaaagaagaaaaaaattgcactctagatcgatagcgatccagtgtcagtgactgtgattaaccctctgaaatagtatatgatcttgactaataatgatacaaccgagcagaaagatgccaattatcatttggtcttgactaatatgatctgataacagagagatcgaattgattaagcaatgcaaaaaaaaaaaaagaaactaatactaataaaactttacaatttttcattcattgttcagagtttggctttcaatggccatgcatgtcccgaggaggaggggagcaaaaaaaaaaaaaaaaaaggcgaggcatttctgtaccaatcgttttcttttttttcacgagatgaagacctgcacggtgccggtgaccgcgccgcggcacgtggggcaggcggcggcgatggcggtggagacggcgggctcgcacgcctcgcacacgcagaggtggcggcaggggaggaggacgacggaggacggcctcgcccggcacgtccggcacggccgcgacggcggcggcggcggggtcacctcctccactctgtccgggtcgacgaaccccgactcggcgtcgtccgcggcggcggcgttggggttgatgttgtcgtcgtcctccggcgacttgctgcccctcgcctgcgccgcggccgccgccgcctgctggagctgcgcgtggagcgccgcggcggtggactggtcggcgagcgccttcgcctgccacgccgccgcctccgcccgcagccgcgcgacgcgctcctccagctcggcgccgcgccgcgccgcattcgaggcctccgcctccttctccctcatccggcgcgccgccgccgcctccgccgcgccgagcagcgaccggtagtgccgccgcctcacctcgcccagcgcgcggcgcagcctctccgtctgcaacaagcaaaagcgacgccaccaccatcatcagaaaacacatcgccgaacaccaccagcggcaagcaacgaatcaaaacgatcgacatcgacgatcctcacatgatcctggaacatacgcgccatctcgttcttgcaccggtcgaactgcgtggcgagctcgtcggagaggagagacgacgcggaggaggtggtcgtcgtcgacacgtgctccgacccgccgtcgtcgaagtcgaggcggagccccgtcgacgccggcggccgcttgttgtgcagctgcgccaggctcaccaccttgtgcccctgcgcctgcgcctgcggctgcagcgacaacatctgcggcggcggcgcagcaaccatggccgccgccgcatccgcctctcgcggccgcttcctcgagttgcccccatctgcaaaaaacaccatccatctcaatctaatccaagaaccggggaaaaaacacgcagatcaagaatcaaaggcgatcagttacctccatctccatgcgagaagtccaagaagaggggaggctgctgatgctgctggtagtgatactccatgcccgccggcctggtggtctccggcgagacgacgacgcctctgctcaagaaatccaaaccaagaacaccagaatcaatcaccccatccatcgtaactcttccccgatcaagagcagcgacggtgagtacctggcgaggaagagaggaggaggctgatgctgctgctggtggtgatggtggtggtggtaatgcgcctgaactgccattggtccgcggcaattgcaagcaaggtgggggaagaaaaagaaggggggaaggaagaggaggaatgaatcgaggcgcgcgccaagtgtgtgaggaggcaccccgggggcggtggtggtaggagagagttgcgggcagcgcgagcgaactggtcctctcctcctctcctctcctctcctctcttcttttaatcacggcttcatctctctctcgctgtttcttttctctctcacggtctcacctcacacgcatcgcctggcatcgcgcatgcagacgcagcagcagagagaacacgaggaggcggtgacccgctgttgctgctgatcgactaggacgtatttattcctccctcctccccgaattggagatccattacgattgattcgcatttgcgttacgtgaaaacaaaactggagtttttgaatctacgcatttaaattgcaccgtgttcacactttttttccccgtatggctagacaaggaagtaattaacccatgttctttttagcgtatattcaccgaattattgaaatgagatctaggttttaaaaaacaatcctattaaattgcttagacctttcatattactccctccgatttttaatatattgcgccgttgattttctaagatatgtttcaccattctcttatttaaaaaatgtaattaccatttattttattatgacttgatttattctcaaatgttctctaagcgtgacttattttttttatatttgcataaaaaattaaataagacaaatgattaaacatttgtcaaaaagtcaacaacatcatataatgtattaaaaaatggaggtagtatttattaagtttattttttaatttatctctataattaaattgataatttaaatgaaacggggccttaatgtgctgatgatttgtattgttggtgagtataattagccttttcctttttgatagattttttcctttccgtggagctaactacaataattggtgacgatatactactaattttatcatggggaaaacgggcacgaaaaacgctttgtttttttttttttgcaaacggtgggctttgggttggtgttgtgacttgtgacatactatcagatcatgtcacggaactatcttgagatttctttcccttttgtaatcaaatctctttctgtgaacgatgatgaaagctgttgaaataccccaagctctcttgattgcggaataaatctgcaagatatccaaaagttcattgcaacctccaagggctctaaaatgtctggcgtgcatttatcaatttcgcgcatggcaaccaataaaacaaggttaaagaaagtgccattgccagctatatattgcgaattaatattctgatattttttaaaagcatgacatgtttttcttgtttcagagtccaaaatattctagccataaagttcgttacgaactgtttgtgcacccagctgcatatgccctggctctccgaatttgagcggcaatagctatggctttctttcaccgataatcacgatctgaaaatttcataaatattggaccattctatgattcttttattattttctcctaatcctacggttccagaaaacaatcataatcctgtcaccttctcgtatgcatgaaaatgtttaattccagccgtgcaatcaaaattcacacttttcacattgccatgtcagcgtggtgccgttttgtacgctccaaacacattcgtgatgtctgaatttttgaatggtgaatgtgttgtcacttagcatcttgtgttcttggcagagcgaataggtcagtgtccgtgttcagtttcagacgagcagattggtagattttgagttttagacggacagattagccggctttaaacagggtcgtcctcacgtttatattcagagtcctgactagataaacgaggcctgaaagtctgaaacacatgcgacgtagctttcgttgctttggtcaagcacaaagccatggtttgatggtttccatcgtcaagatcgattgttacccactagcatgtccagtagtaccactatgatttgaactgctgacagcttgctcattttcgtagcaaatgtcttgtttttctttctaatttcaaggtatagctagacgggcgtcttctgaataaatacagactacagaaaagcttgcgcctgagaattttactcctatacaagttcagagccgacaaattaatccgagctaatagtatactatagatataagtacttatataggactatgctagacgtttttattgtaaccttggggaagtagatggaaataaaatattctatccgttttgaaatgtttgacactgttaaccttttacactttttagcatttgtttgaccgttcgttttatttaaattttttgtgaaatatataaaattatatgcctatataaaaatatattcaacaatgaatcaaatgataggaaaagaattaataattacttaaattttttaaataagatgaacggagggagtactaagttagcttttgtttgtttttgttttgtttggtcaagctgtaggttaactaggggctgcacagcaccaaggaaaaatgaggtggtagtggctgcgttaccattcaagacgaggcgatgggaaagagacgttgcattgcatactcgcagtcgcatgcacacgcacgactgactgccgccccgcactgtggtctggcctggttgactcgccgaacaaaattacaaaaaaacctgaaagaaatcaaagcagaaaccgcggatgcgtccgtttggcggaagcgatgatgccgatacgatgcgattgcaacgccaccaacacggcaacggcgataggaaaggcaccgcagcagcagctgcagcctgcagcgcgacgcgtcgtgtgcgttgcgttgccagtgccagtgccaccggggcacgcgtaccaaaccgtgcagttatggcggttatcatgtaagataatgtttctgaaaccaccatatatatcatgatagtcgtcaaactacaaggttgaatgtggccctaactttagacacatgcatggagcattaaacatggacggaaaaaaattacatagtttgcatgtaaattgcgagacgaatcttttgatcataattacgttatgatttgacaatgtggtgattaattaagtttaatagattcatctcgtagtttacaggcggaatctataatttgttttgttattagtctacgtttaatatttcaaatatgtgtttgtactaatttttttttatcaaaatcaactaaacacggcctctattccaaatggtttggtaaacatggttctgcactcgcgtggcgtccaccgtccagcggcgtaggctgaacgcgaagggcacgaccgacagacagacacggcgccggatgccgatgcgcggcgtcgacggcgacggcggcgacgacacggccgcgtttcgtggacggcggggcgctcttcttttttttacctatggtctcgagctctgcatctgcacggagcactgtgctgtgctgtccgtacgatgttcttggcaggtctctctcctcctcgatcgaaatggcagcaggcctccgctccgctgatgttaaaatttgtggacacatctctcatgttttcacgcgaaaaaggttgcgagagacagtgcaatccaaccccatttattactgctttcttcttctgttcatcgggtattggagttactagcagtctagcactactctgcgttgcggatttaccggtagtaaaaaaaggacaagcatatgctttcccgaaagcaaagccacgctgatgcatagtaggaggaggaggagttacgccaatggcagtcaaaccaaacgtcgtcatctttctcatgctgataggagtacgagtgctccttttttttcttttgtttttcatttgtttatatcgatctagaagtataagctcagtgcatcgagcagtgctgcaagcagaaacctgagattaataaattagcaacaacagcagcagcagcgatgctccactccactccaacaacaaaaatgaacggcttagctaagctctattacgagtagctaattaaccccggttgttagtgcatctaccactaattgacctgttaccacttaccactaccctaccctatggcatgcattgcaattcgcaagcaccataattaagcatcatatcggggaaaggggtaaatgcaatagaaacggaagaattgagtatgaagtgcattgatgcgtaccatgcatgcacacgatgcatgatatgatttccctttgcaagtgtaacaagcaagcagcgaatcaatggcccggagaggtactatgacagtgaagaaaaggcaccaacatgcaacatgcctgcactgatgcacttcctagctcatcttggaattcgcatgcatccatgcatgttgcttgctaaatcagcaggaattaatacttcaaccactatggaggatcgatctatcggtcgtagcactgccgaaaggagctacatgagaatagaccttttttttttttttttgacacagctcgcttcagctgcatcttttttaaagctgaagctcagacaaacagttttagactctgtttagatgagactaaaactttgaagtccctatcacatcggatgtttggacactaattagaaatattaaacgtagactattaataaaacccatccataatcttagactaattcgcgagacaaatatattaagtctaattaatccatgattaacctatgtgatgctacagtaaacattctctaattatagattaattaggcttaaaaaatttgtctcgcaaattagatttcgtttatgtaattagtttggtatgtagtatatatttaatactctaaattagtgtctaaatacagatactaaagttaagtctctggatctaaacaccaccttaccttcacctaaaatatagtagcggaactaggtgaagctcttacaaaataaattacagatgtggagcagagtttaggctgctaaatttaggagttgaaactctacttaaatagaccctaaccctagttaggagtaatttaattacttactaacacacgatgcgtaatcgctagggaggtcggcaggcaacagcagctgtggcatatgcatgaaaggtgcttgccaattgccatgcgtaatgggatgcaatggatggatggaccctcacgccgacggtggccgacgtgtgtgttatcgatccacatcgtgatcgtgatcccaagtcttcaacagccggcgtacgtccgtacgagttgcctgcgctacatgaaatgcaggttcaggtagctaatcaaacttcttcactgcaaaagaaaaaatgaattaccccctccctccgttcaaaaaaaatctaatcctagttacgaacctaaacatatactccctatgttcttaaaaaaaaccaattcctgactataaatctggatgaggaattgattctttttgggatggagggagtacatatctagacttgtagttagggtttatctttttttttttacagtctagtacttcctaactcgatccctctccaaatgttcacgtgcatgcatatagtctgaattgtatatatttagaacatgttctttttaagctattttactagattattgaaacatattatttgcggatcatgacctagaaaaagctagtaatatgaagttgttgctttttgtctttgagcaattatcgggtcttaagataaatttccataaaattgaattatattgctttggtgaagcgaaagattttgaaaacgaatacatggaactctttggttgttccactggtcaatttccatttcggtatctgggtatccctattcattacaggagattaagaaatgccgattggaaggaggttgtagaacgctttgaaaagcgtctaatcagttggaaaggaaaactcctatctaccggaggacggctaacattgattaattcggtgctaagtagcctcccgttgtatatgatgtccttctttgccataccaagagggatacttacaaagcttgactactttcgctccaggttttaatggcaaagtgatggtcaaaaaaaagtatcgtcttgctaaatggaacatactgtgccgccccaaggaacaagggggattaggaattcatgatttggaaattaagaatatggctctacttagtaagtggttattcaagttgctctccacggaaggggtttagcaacagttgatgcgtaataagtatctcggtgataaacctcttcctcaagctcaatggaaggcaggggactcacacttttggtctacctcatgaaggtgaaatgggactttctccgttttggatcctttataattaaagatggctcccaaattaggttttgggaagacaaatggttgggcaattcaaccttgaaagaacattatccttgcctttacaacatagttaggcataagcacgctacagttgcacaagtcttcgaaaacatcctccatctttttcatggcgaagagaccttataggatcaaaactagcagcgtggaataatttattaccgcgcatcactggttttcatttaactcaggagcaagatgagtttcattggaacttaacctcaaatggggagttctcggtgaagtctcattatctagctctaattcacagcaatgttcccaacattaataaccgtctttggaaattaaagatacccctaaaagttaagattttctttggtacttgcgccgtggagtggtgttaacgaaggacaatttgataaaaaggaaatggcaaggcaataagaactgttgtttttgttgcaatgacgagacaattagacatcttttcttcgaatgccattttgccctttctgtttggtccatcatctaaacaacatctggacttcctccaccatattgtgtagcgcatatgtttgggagctggcttgatggaattcataataatttgaaatcacatgttctgttaggagcagctgctacttgttggtcgctttggctatgcaagaataatgtgatttttgataaaaaaaagtcatatcttcaatttgcaggttttatattctcttatccattggcttcgtacatgggctatcctacagaagcttggttcgcgggatatggtagttgtggcatgtcaacattcggagaaggtggtcaaggagttttttacccagagatatgggtggtgatctagtcttagaattggtggtccttaaaactctgtgcttttggaggagatgaccaaggagttgttcatgagtggcaatttagtcgttagattgatggtcctcaatactccatgtcattcttttttcctttcgagtgtggttttgtttgttcactgtgtgcatcttagttatgtagaggccggaagtgtgctcaggataattgtatcaccttgatgtaattgactgagttcaataaaagctttcattatcttaaaaaaaaatatttgctttatgttttaagaaacatgtttctcttttagctatgcactcaacttaggggtttaattgaaaagttgatgggtctccacgctatggatcaaatagagacatgtaccatgaatattatagtagttagaaattcaacaattatcatattataaaacctagcaattcgctcaagattatgataaaattcgaaatggtggatatagcaataaaatcattttcatgctcacattattttcactatttttctttatttttgtcggttactattttcacactgggtcggtaaaagttagaaacgaaacgttgggtcagggattttccgtgaccacattctcctccataatgcacggggccagcctcgttttgttttctggccctctttacatttcaacttttttttaacttttaactttttcgtcctattgaacttttttagggcatcatcaatgtatatagggcaagtaatttatatagatgggacccacataaatagactttaactatagcaatctctacaatgtatatagatacaaagtagcattaggagatgagagagagatagagatagatagtattatttattccatatgggtagtccataagcttatggatacctttttattattttctcaatatggactagttgcacaatggtaataggtagctgaatgaatataatattgcttatggactacttttatttcacattgtggatgcccttatatacataaacttccaactttttcgttacatcgttttcatattgttttggttacatagttttaatttctttaaacttttaattttggcgtggaactagacagttgcgttgttttcttttctgttgcgttgcatctccagtgatctgtgcgtctgtgtgggggcaacgtgatgttactactgttgctgtaagagtcaggagtggaagctgtcgagtcatcgagatacgcgaaaagaaaggaggaaagctagcaatagcatagcagctcggtccacgaccacaaggcaaactgcaaagcaagcacccaggcaggcaggaaaaccaaaaccaaaaccgaaagggattggatttcattcactgatgattcc

SEQ ID NO: 5802 - DNA, 1036 bp, Oryza sativa
tgagtccaccccgggcctctacataaaatgcacacagcgaaaaaaccggacctaagaacacttcctcatcacaaaacacagaaactagtggctatcaatccgtagactagatcgccacccatgctcctgggtaaaaaactcctatgccacctggtccaaacgttacgataccacctgatctttagaggtttggcggatcaaacgacgatggatgcagtaacatgaaagaagaaatgcgtgttttgttactagtagtgcaataataacaagaaaaatatatactatatgggtaaaaagaagagcactgcgtgggtgagtgcgtgaggtttatagtgctcgtgatctgaatatctgatccgatgctgctagctgctgctggtcgattgcaactataacgaccatttgaggtggggcggctcagctcagctcgctgctgcgccagaatttacgctactcctcctactacctgctctctatatacaacctacgagtatgactatgactcacccatccactctaccgatcgatgcatctatgcgaagattgaacagccacagtgctcgccaccatcgacgctgatatcgattccatgcatcttcccgtccaaagattgaacaaccacaccgcatctatgcgatgctagtacagtactacgcagagatttggttcttaactatcattgccacaattcacttcagacattgtagtttacatattgtaagctatacttgtagctaaaaagctaggcaaatgatcgtgtatatgacatgtgggacaaggtactaagaaagtatcgtaatcacaactataacaatcaatctaacacaaggttaagaattagtgatactccaatgtgtattgtgataagttaaagcattgaaccaaacgctctccgcatgcaccaaagcaacactagtacattgaaatgaaagaaagagtgtactgctggtgacgcagagctgccgacgagatctgaagctctgaattgatatctctctgaatctctggaaattggtgatcactgctcaccgtccta

SEQ ID NO: 5803 - DNA, 2956 bp, Oryza sativa
aggaactagctattgggctgtcgacaggttttgaggcccaaaactcattttttgcacctcacgatctgcaatcaatgggtcacagcaaaataaaattgtctaaataagaatctttataacaacatgttttttcctgtcgatccaggcattgtaacagaaacaaaaatgtctaaataagaatctttataacaacatttttttttctgtcgatccagacagcgtaacaaaaacaaaaaatcgagaaaacatggggtcggagaattaaacttcgacccccagcctccaggttgctatgccgccgtccacgagtgatgtcaccttcatcgttcgcctacgggccagatcaggtgggctgtagtaggagcactatttttcaggcccatggaaaagtggccaaaaggcccatctctcgctccctacaaagcggcccacctatctgtggcgcactcgtcttccaccttgagtcgcgtaaaagaaaaagaaaaatctcccgtctcgttctcgtcgtctcctccgctccgctcgttgcgccgccgccaagacgagcaggggagggccgggcggcgatctccatccggcgagcagcggaggggaggggatcctggtgcgtcctctttctgattcatctctctctcccaccccaccgggacctggctggaacttgcttgcgttcgtgaaccctactagcttctcttctagatctcctcctcaatttgatagccttaaacatcttaattcaagcaataacagtttgtttgttcacccaaaatgtcccaagtactactgcctgacatcatctgttggctatgtgtgttatgggaggaggcagaagtctgccacaccttgttatgttgttttcgtttttcttgtggagtttactatgtagtaagttaattgcaagatatcattcatcatcatataacatccaagtagaataacagatggatgccgcagctcttcagtatgagaaccagaagctggtgcagcaattggaggcacagaagtccaaaatgcgtgcattggaaggcaagttcaaggagctgagggatgagcaatgttcttacgacaatacattgatttgtttgaataaaatgtggaatcaggttcattcatctgtctttcatactgatgtaaattctattcgatgcatttttttttccagttcaatatgtttctgatgcacttctgtgaattatagctgattgatgatttagtgctgcttggggttcgagctggtggggatttaaacggtttgcaagcgcttgatcatgaagagatgtcagaaggttggctacttggctacttgttttactttgctctctgaggtttgtttttctttcagtactgtcattgactattctttctctattccgcagaatctcttgagtcatgtccttctgaggagatatttctcttcagactcttgaattccaggaatttcagaaataatgatgacagtagcctgtcaaaattagttgaggaagctcttgccttgcgctattcaacaacagttactctgatgaagtccctgcaagaggcttttgctgtacagcaggctagaagtgaatctttatcattagctttaaatggacagaactccagtgaaggtaaagatgaaagcaatatttgtgcccttcttttttttttttggtctaacattgcaactctattatttaatcaaataaatttatttccttcagacgttattgtggcccttgaaaaccataatgattacttgaaagaagtggttgacaatttacgtcaagctgtgtctatcatcaacaggaagcacgaaaagtatctggatgagattgaggctttcaaaaacaatcaatcaagagaactacatgaagtaaagtgtctttcaggtgttaaagaatgccacttcttcccccatttgtgttggtttgtttaaaattttgctgcattgcatttatgttgatctattcacagtttttggctgttgtctcatgtactaaatgtaaatcagttctactaaatttaaaaacaccattttttaaaatagcttgattgcataaaattgtattttggcacataccctgactttgcattttggattggattactcttgcacaccaaaacaacctgtaatgcacattcatatgttgtattttaggtgagctagaggaaagcatggcagagcttgaggaaagccgtcgaaagttggctgttctccagttgcaaacgggtggaggctcactgatgaacacatctgctcctaacggtgtgaacggtagtgtttcaactgataaatcttcagacaagggtatgggctggcgagatctgaaagatgctgttgaggaggctaaggtactgtgataagacattattattattattattttcttttcaagttttcatggatgctttgaaggctgaagagtgttattttctcacttcttatcttattgttgtttttttttctttcttttcctgctaatttctcctatggagatcagactcttgctgcaaaccgcctatttgaactccatgagactcaagaggataatctgatactatccaagcagttggaagatattcaggttcatacctttttaatttttctgatttgagttcgctttcttatttctttttaatttgcgcttctttgctatgtgggcaggatcaattaaaagatgagaactatattgttacatcaaaaccatatacgattctcagtgaccagttacaccatctgaatgctgagatagagcgatacagggggttagttgaagtgctacaggtatgctgcttttcctcaggtgggctgttttacaatgggaatggtggttggaccaaaccctggcccccccccccccccccccccccgagttagaatgaaaaggaccagctcatgcaaaaggaagaagaaatgcttgcaaaggcagaatcagtggacgctgttcaacaatccattaccacttacaaggccaaa

SEQ ID NO: 5804 - DNA, 3892 bp, Oryza sativa
  unsure (1)..(3892): unsure at all n locations
gaggaagctgactatttaagaactctgctagctaagaaggtatttctttgatttgggtaaccatatctttctgttttctgtgatggtctccaatctgcatctattacggtggtttggaattttcttaggcttctgtaaattttgttctaccttctaaaaacatcatttatatctcttccttgcaatttcatgcacttgttcagttgccatcgattcattatgttgcattcccccgtttcagctcatgggacatttttccataaattcaccatttaaattcaaggaacaagtgcatttatattcactctgatggtctccacagaactgtccatggctatattcaaaacagtatttttcacactaaaactggcatacatacttgttccatttttctcttcaaggttgatgatcattttacacaatcagaatgaacttaatgctccagggtaccttcttgtcaccaggtgctagcatggtcatgcataaatgattttaggtccctttgaattcatttacttcatgatattgattctgtaaatattcatggcaaaactttgttttttgttttgtttttttttttttggggggggggggggggtatgtgtgtgtgtggatgctcttatgcatagttgtggacttggtgtttaatgttcaaatacattgttttttcagtagtctttacctgattaggcctccatgtgttgcgttcttcttgtgataatagctatctgaacctctaatacaattaaaacatctgattgaagtgtctggagttttcagattgatgaacaaaaggagatatctgatagatacaacacacaagtcaccgagatcaaatccctcaaagcattggtaaagtatcctgatcttcaccttttcttctagggcactgatttgcaacaatcgaatggtcagccaacagataatgatatttaggtttcatcattcagaaatgaaggcagacctctctattaactggtggatagcctgatacatgagagcttataattcttggaattgggtatcctaggtcctaaaactattgttcaaattttagcctaaaattagattagccactttattttagcctacaaactccatattctgcagaaatccatgagttcgagcattcccaaacaggcccttaactgctattactgttaaataattgaaaatttaattgtcattcacagtgtgcataaatctgagcatcatttgtgggtaaaagatgttttggaacaaaaatgcaattaacagggcttctagttctgtcattcatttttctccatataatttcaacagattgagacactggaccaggaaaagcaggagttacaatttatagtggatatgctcggtaaagaatgttctgagtcgaggtataatttgtttgctagtaccttttctgctgatttatgattgttatgggttgtattgttctcaaaagtggtgaaccctcatcatctattcttaaaaattctttatcagtaatacacaaaagactcgtgtataattgcattaagattgggaaacgaaatttcagtacacttggtctagatgcacaaccacatcagacccaaaaagaatacgaaaagaaaaggataaacagacactcacgcaactgaatcatgcgacctattcatttaatatttaagcatgttcaaaaaaacagatatggttctaagatagtataggtaaaaacatatcttgttaggaaattttcagctttcatctatttgacatgcatattacatatggtagatccttccagtttgtttcttaccatactctgttgtgcactagggcaatttcagagattgaagaatcagaaaaccgagctcgcaagcaagctgaatatttgagaaaatgtttagaagagcataatcttgaacttcgagtaaaagcagcaaatgaagcggaaactgcatgccaacaaaggctttcaattgctgaagcagaactggaagacttaagggccaaagtggatgcatcggaaaggttagtattggtgaaaattttgttttctcaacccctccgtgcaaaattgtctccagtttattgggacttgccttttcaaaataattctccattgagggaatttatagtgtagttgtattctctaaccctgctatccataccaagtaccctatttaacaaggggttaatcagactctagaaaccgggggaacttctatacacgaatctggacatagcctctgtccagattatgaacgttgctttttttctgggatgaagggagtaaaaaataatatgtgctggcttgggggctctaaactgtcctggatgaaaattgtagttgaccagctctcaattctagcccccattttccccaccacacaagcgcacaccaactcccaaaacaaaaaagatccctaaacattactttgatcttttgtctcccttgttctgtgagcatagactatgtggacaactatattgaaatgagtagttataatttgatatagctcaacaatcttcaattagtttcctgcattgaatccttttcatcacacgcattctgttttgccagagatgttatgaaactcaaggagtcaataagaattaaagaagctgaagtagatggccatatttctgaaattgaggtaggcgcggttttctcttcttatcagcagtcctttttgtgtgtgaaataaaagcatatgatattgtcattgcagacaattggtcaagcatatgaagacatgcaaacccaaaatcagcaccttcttcaacaggttgctgatagagatgattttaacataaaggtatttagatatccatcaatcttgttgcttgcctttgtagagttcctggtagtctgtagcaccttacacggctagtaggtgcagggatttatagactgttctagattctagaaccaaagctaatctgctcttttttccccaatcacaagttggttcctgtcctaacatggttctcatctaacagctagtatcagatagtgtaaagatgaagcaagcctatggttcccttcttgctgaaaagaatatgctacagaagcaacttcagcatgtcaacagttcactggagtcatctaaactaaaaatcaccagtggtgaagagcaggtagccttttatttatgcctaaagtcgttctttctgcgtaaggcccttggagatattgttaaaacaagtgttgatttacaagaaataaattgaagatgtatcggattacttgcatcttatactattaactgttacagatgaagacctatgtagcacaagctatgaaatcttcttcagagaataggcatcttgcaattagccttgaaaggactatgctggaggtatcagatgcagagaaggagctcaagtggcttcggtccgctactggatctgctgagaaagaatatgagataaatcagaaaaaaatagctgagctaaaaatggagctagagcgtgagaggttaggctgctctgaactccaggattggtcatgctatgctgccatcaccatcatgtgttcattacattttttttggttaattcagaaatgagaggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5805 - DNA, 1012 bp, Oryza sativa
agggcgccagccatgctggcgccgccccagggaggagggcgccagccatgctggcgccgccgcctctattcctgtttctctgtatggagttgcaacggtgttatttttattttattctttcggatgttttttcacactcaggatcacgatacaaccaaccacaaaaaaaatttaaactcgaactaccacttagctaagtctgaaaatatctagcataccacttagtctactttgcaccttcactaaaattagaccataactcctttagtaaaaccctttgatcagcatgttaaacataatgcactctaccactatatgaaattacttaatctaattcaaaatataaccacatgaaatgacatatataagttaaatagtacatagagatgcaatttttttatttttatttcattttttgatatttttttcacacttaggagaacataggaaccaaccgtataaaaaataaactcaaacggacaaaatatgtgacatgtagaattttccaaaactctaccgaaacggacaaaatatgccatctattaaaataggcgtaactttctcatacggactcggaatcagacaaataatatatgcacggacatctacagaaaatgttacatccgattctccccgctttgccgggttcggcgatattaaaacctccaaattccgcttgcaagattgtgttttcgaggagagaagtttttcggtggagctttggaaaattccacatgccacatatttcgtccgtttgagtttattttttacgtggttggttcctgtgaattcctaagtgtgtaaaaaatatcaacaaaataaaataaaaataaaaaagttgcacatctctctcctctgcactagttcggagagaggagaggagaggaaaaattctacatgtcacatattacgtccatttgagttcaatttttctatagttggttcttgtgtgtccctaagcatgaaaaaaatatcaaacaaataaaacaaaaataaaaaatttcgggggggg

SEQ ID NO: 5806 - DNA, 10877 bp, Oryza sativa
  unsure (1)..(10877): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcaggtttctcgtcccagttcaaatgacatcgagaaaataatactctatatcccataacccgcacaacatgtagagctttgatgccaaataaattgaccatataaacaaggagaaaaaaaaatactgaacttgttaatcgagagaacacaagatccatccaaggagaaaagatcacgaagtatgtactattcagtcaaaagctaaaccacatggcggattcaaagaaagatcatttgtgtgcactactgaacaagaaaaattcagaaaacagtgagcctatcaacttctgaactgggaaatttagtctcacaagatactgacatatctacttaaatctcagaagctactagtaacgagaacatcgaaatttatctccccgagcaccaaaagccaaaaagtaaagagaactactacatgtgacttatcactaaatctgaaaatgcatgtaaaattcagagcgagaacctatacatatgaatcttgccggtaaaaaatgggaggaaaatagttcaagatccacagaaaagcagcggcaccagaaacttccggtgctgcccaacagcaaactgaaccagaaggggtataacccgcacgatactttaattttgtgctcttatttaaattttgtacacattccaaatgacatttcacaaatgttatctacttaaaatacataatattctatgcatgatattacctcatttcttttaatttgccaacaatataactctagacgacgataagagcatgacatatctataaatgacactctgggtttgatattacctgtaaaaatagggccacaaacgatatatcgtataatgaactagaaacccaaaacaaaaatttgcagagtatatgaaaaaaaaagatagatatatgccccaatcagaaatcaggtgacagagatcttaaaaaaatagatatatggaaaaaaagcacatatactgagatttttactcgtggagctgacaggtgagagagaccagaaattagttagtatgactaaccaccaatcataaatcaacaatcccagctcacttgatctgttcctctcaattgaatcaagaatccttactaatcccgaaattaccaatcataaatcataattcatgctcctttgcaagtagctcaatattttgaaaataagttcacgacagcatgcacttgcaagatggaagaaatataatatgcaatattgctttccaaaaataataaacaaaaaggttgagcagatgtctacctgctttccttagagacgaacatgcaacccaaatcagaaaacttaaaaaacccccccaaaaaaatcaaatcagacagtagcaacaacctccactgccgtcatctatactctagcacaaatcaccaaccaaaaatccaagaatccaatatcacaaatcacaaatcaccatccaaatccttgttaattatcttgcaggcatgcagcccctgctcacctccccacctcgccgcatcaaagtcgcacagacgtggccggccatcggtaggatttactgctacctacttttaagaagtataaggtgtattttgatctattaggatgtctcgatacagtagcattttctacattcgaaaaaaaaatctcatcttaagacacgatgtgatctattttgatacaacagaaagcctttctccagtccagaccttcggtcagtctagattctaggcctaggacaaaacctcaaaatgttgtctatgctacctatgaagacaactccgacgaaccttcaatctcagacttcgatatcaatgttatcgagcttgatgttggctttgttattgccatagaataagacgagtttgaaattgacaaagaattgcttatgagagaactaagactccccaaaaatagaactaaaactaaaagatatctagaagaggttgacaaatcattcagaatgaagataagagaagtttggcataacgaaatgagagaacagaggaggaatattttcttctttgactagtatgagaatagccagattatatattttgaagaattttttaagacccagaagaaaggaaaaggggtatgcaatgaagagagaaaacaagaacatgacaagtcagtaattaaggtcttttcagattatgggtcaaccagtaaaacttatattacttattctccttttaaacttattcaacaatctcaggatatcagaggaaaaaattgtcttccagaaagcacttatgagaaatccacagagaataatttcctagaatatttagtagaacaacagaaaactcaagatctatcccctgaacaacaagattccaaaacaattcctatggaacccattattctaagaagccatgaagatccttcttcccactctcaatttgaggtatctagacctcaatctgaaacctatcttttgccttattcttatcctattacaactatacttattccaactgccaacaacgaacagcaaaagggcaattttatcaccactcctaaagataaggtagccaaatcctttgatattcccaacaattttcctaatactaatgaccagatgtctaattccttgacaaaaatccaagcgtcatcttacgataaattgacgctccaaaaagaagtttctaccttttataacaaaatcgactcttcggtaaacagagacctcgagagttatattaccagagtcatcaatacctctttctacaacataatcgatgatcctaaaggtattaccagatcaaaatttagattgttccataatgttctcttctccaagatctatatccaacctaaccaaataaaacactttgttaccattctcgaaccaaaaactcctttgaaagaaaatctcagaatcaaatctcggctgaagccttctgcacaaataatgaaatcctagtccataagcaagatctttttggaagcatatttgttatttctgatacaaatcaatttggcacttttaatcctgaggaagaaaggaccaaaagaaaacttaagattaatgacctcttccaagaacaaaattatactaaaaaggaattaagagacctaaagggtaaatttcgaagtctagaattacaaaataatagttgcatgggccaagatgaagaggttgtcaactccatcaacagttatgttaagcagaaatggtatgcagaagtaaggtacaaattcaatgatggattccaattcagctataagactttaattgattcaggagctgatgtgaactgcattcgtgaaggtattgtcccattcaaatactttgaaaaatcctcccataaaatccatgctgcagatggaaatttactaaaagtcaattacaaaatcccttctattcatgtttgcataaatggagtctgcattaaaacttcctttttgcttataaaagatctaaagcaaggagatattttgggaacgccattcttatccttaataaaaccctttattgttactgaaaaaggtatccagttagaatcagagataaaaatgtgaagttaaaattttcttctaaacccgagcaaaccatgttaaactatttaaaggagattatcacacaaaaagagcaatttgtgagtgacatatcttctgaaataaaaaatgctaggatttcccaaaccttaattatccaaggtttcaagaaaaaattatactattagaaaaaaggtttataaaagatatatgttctgatttcccatcagctttttggcataggaaaaagcatgttgtaggtcttccttatatctctaattttaatgaagataagattcccactaaagcaaggcccattcagatgaatagttgacttttagaaatttgcaagcaagaaataaaaaacctgctagataaaggattaataaggaaaagttcctcttcttggagttgtgcagctttctttgtagaaaatgctgctgaaaaagaacgaggagttcctcggctagttatcaattagaaacctctcaataaagttctacaatggataaggtatccaataccttataagcatgacttaatacgaaggattcagggttcaaagatatattctaaatttgatatgaagtctgggttttggcaaatccaaataaaagaagaggatagatataaaactgcctttactactccttttggtcattatgagtggaaagtaatgccgtttggtttaaaaaaaatgctccttctgaattctcggttataaaattcaatatgatcaagttcaaccagtagcaagagtaatagaatttgcagaaaaatttccagatgagataaaagataaaacagagttgcaaagatttctagggtgtttaaactatgtctccaatttttataaagatcttgcaaaaagacagaaagattttaaccgagaggttaaagaaaaagcctccagcttggacagctaaacatactcaagctgttaagaagatcaaaagtaaggtcaaaaccttgccctatctttatatcctagatcaagttgccttcaaaattatcgaatcagatgcctcatattatggttatggaggaattcttaaacaaaaaaaggattccagagagcagttggtcaggttcacctctgggacctagaatgaggctcaaaaaaattattcaaccatcaaaaaagaaatattggccatagtaaaggtcatatcaaaattccaaggagaattattgaatcaaagattcttgctgcgtatagattgcaaggcagcaaaagatgtcctccaaaaggatgtggagaacttagtctccaaacaaatttttgccagatggcaagcaatattatcatgctttgactttgaaatagaacatatcaagggagaattaaactccctaccagatttcttatctcgtgaatttttacagggctatggcacctaaaagggacttatcagcccaagggagaactacagaaagttcaccaaataagcataaatataatgaactaggaaatatcattcctagaacccctacagttcgagaaaagtattggaataattcatcttatatcctcaatatagaggaagtaattctgccattagaatttggagactctgatctcaatattatcaagattatgggaaagtatttcccacaacactaatattttatccctgaatatccacggaaagatcaaaattattatgagactattatgcgagacaagaagtgcacagatattccatacaaggaatggtgatgaattgggattcacaaaattattgatccaaaaaattataagtatcgatgattgggataaatcatcaaattcttatgtagccaggaatatatattctacatcctgtgcaaataaaagatatactattgggattatcagaggcctgagaaagagtactcctcatacaaaattcccagatgaagcattcatggtttattcgcttcaaagaaggatgtgaggagataccactgtggtttttcagcaaatggtggctgaaagcaggggccattcctggaatcctaccacaagaaatcatcaaagttattacacaagaatcaaaaaaggatctcaaggaatatcctttttttcttatgcaattttgtgccgaaacacggatgccttggatactaaagtgggatctcaatattcaaagaatggagttcccagcaaccttaaagcgaaactattatgcaagatggtgggataagtttgcaatcacaccagtaattgaagaagaaagtttcgagccaaaaacaagaaatctcatgtggctcaattaaaagaagatataacaagagaattattaaaggcaagacccgagttgacaaagggagaattgcaacttcaagtatatgaaaccatgtttaaaagattggaagaatcaccaaaatctagttccacatgcagaagtctagacgaagatatggtacaatacagccaaattaagccatcttcgccaatacctccttattactcaattaagcaagataatgattcagatgaaggaacatcagatttcaatccaacgcacatttagtcaaggtatgacgacagatcttgtcaccaagataatgaataaagatcctgtcatccccgacaaagatcactattcaagataaggaatctacactattctagataagataagcctatagtcaaaaggcgatattatgacatctttattgaaggtcaaaagcgtcatcaccaaagattctctccatgaagtctaaagggatatcataaactctttgaagtcaagaagagatatcatgaagattctctaccgagtgctatataaggggctcaccatcgcattccacaagcatcgcattattcacaagaacaacaaccacaacacatctcactcaaccattcctctcgcctctccaccagccatcacactccactccactccatctaagtgtttgtactatagtataacctaaataaaagactcatgagagtctaagtgtgagagtctatgtaagagtccttgtgagagtcctgtacctgtataattacgaacgtgttgtaccaagtccttggtgtaatcttcagaaggatctaccttcaacttatcaaggtatatgaatgaacacctggaccgttctatataaacctactatgttctaagtatctaatttacattatatcttgtacataattcatatttacagcttgtctttatttcctgtactgcatttatgtttgcataataataataataataataataataataataataataataataataataataataataataataataataataataataataataataataaattcaacaacctggattaccatccaattgccacataccaatctcacatccaagattgcatatagatactgcattccttatatatatatatatatatatatatatatatatatatatatatatatatatatatatatatatatatatatatatatatatatatatggaatttatttttgaagtggttttggaaatgattggaatttacaggtgaatctacaggatactgctgttatttcatgtgaccggtcagaccgggctgtgtatgccggtcaaaccggcgcaacccgcggactgaccggctgaccctgtgtcagtttcggtttcggattgtttgtttggatatccgtgattgtttcatgattatggcttctagatggatactatatgtatgtaatactattgtttgctactaatgagtcaagttggagatagcttggtctcggaatatggtttctttgtttatttcatgtgtaggtgtctcgatgcctcgggagagtatttgcagtgatggaccgggagtcggcttggggataagacgacgtccgtggtggtcagagatcatgcgggatacctaggctagagttgatgcacgtggttgatggagattccatatggcatacgatggagttattgtgtgcgtatgggatgcggagtcgaatttggaaggagtccaaatttggtatgattggttatgtaaaggttgtgtcttgtactagagggtttcctaaggtgtttaggactcttagtatgagtttggtttgtggctttatactgccgacctcatgtataaatagagggggagcgtgaggcttccctgtatcgcttttgagagcaattgagttgagttttgagttagggtttcgagtttagtcgagatttttgtaaggagtgctgttggtgcactttgtaaacacagagagaatcaataaagtcgtcatctactttaagaattcttcgatttgtgtttcaccgggtttcggcggtctaaccggtaactcatcggcggtcagaccggcgacaagtcggcggtcagaccggcgggagcacggcggtcagactggcggcatccactcggtcagaccggcagttcaatctcggtcagactgacttccgtcgatttcgagggtaacttttatttctgctaaaagttttttggtttttgggtataccaaccattcaccccccctctgcttggcttagttcttgtgtttcgatcttacaagtggtattagagccttgtttttttctttggatttttatcgatctagagtttttgccatggctactcctattaggttttcaactaagcctcatgttttcgatggaacggatttttctcattggtgtagtaggatgcaatcttacattatggctgaagattatgatatttggagaaaagtttctcatccttatgtgattcctgaagctattaatactactgctgaaaaaactgcttttgaacaaaattgcaaagctcgcaacattcttttgagtggtatttctcgttcggattatgatcgtgttgcgcattttcgaactgctcatgaaatttggaatgctttgagtaactttcatcaaggaacaaataacattaaagaacttcatcgtgatattttcaaaaaggagtatattaaatttgagatgaaacctggagaagctttggatgactatctttctaggtttaataaaattttgagtgatcttagatctgttgattcttcttatgatgctaattatccacaatctgagatttctcgtcactttttgaatggtcttgatatgtctatttaggagatgaaagttacatctattcaggagtctgttaacatgtctactttgactttggattcactttacacaaaattgaaaacacatgagatgaacgttctttctcgtaaaggtgattctaagtcgagtgctttggtttcttcttcttcctctttggatgttgatgcttcttcatctaagtcttcttttcttgctgtttttaatgccacatccgatgatcaactcggacagattgaggaggaggatttggctttggttgctaacagaattgctcgagctatgaataatgctaggaacaggaaaagaggtgatctaaatcgttgctttgaatgtggttcaattgatcatcttcgtttgcattgtcctaagtttgggagaggcaaaagagaagacaaagatggtgagaagaccaacaacaacaagccgaagggtacatcccaagggaggaagttcaaggagaatcttaggagggtttttgatcaagtctacgccgcatttgagccatcaagcgatgtagatggtgagagtggagatgatgataagggaaagaacatctccggtgtttacgtcatggtgcgtggtgaatcggacatagagtatgaagatcatgaggtaagtacttttgaagaagctattaatattttgagtgcaaaaaatatgaagtgtgagaagatgtatagaaaacaggaatttatcattgaatctcttaattctgaaattgctaggttaaaatctcttattcctaatgatgatgattgcaaaaattgtgtggttttagtgaatgagatttcgaaaattagagatgttaatgttgcacatgatttgaaaaacaaatcttctcttgcttgtagttttgctttgcacacacgcactttggatgagttgtttttactaaaaagttgttgcaaaaatatcaaattgcttttcatgctagtttgatgtttaacatgatttctctaaaaagttaaaacaacctcatgatgttttggattgctcaacatgtaatttgaataagatgaaactaaaagatgctttaggtcgtgtggacatggaagatgttgtgaaaaacaatgaagtgcttttttgcctcaaaagttgtaaaaaccaaggggtcatggtagaatgggaaaaatgtgcttatttgggaaaaaaaggtttcttatttgaaaaattctttgctaatattttctgatggtaaaaagaacctcaacatgattttggatcaatcaaaggttagcacacataatcgtggtttaggttttaattcttatgcacataattctagatatcctcctgttgtgttaggtgttggtgcaaaaaggggtgagattttggttaaacctgatgctaataaaactgtgtttaaatctgctggtatcatgtctaccttgagtgcatcctcttcaaaatccaatgttgtccatgcaaaacctcctattgttgcttgtgttgctaaatcttctaatgctaccaatgtgtctaatcattgtgaaaaatatacttgttctttttgtggcaaagatggacatattgttggtttttgtttcagattagctcataaacagaaaaaggagagagagagagagattacttttgcaaaatcaaagtggcaaaaatctggttttccctcgaggaaaccggtcagaccgcagtgggtcccgcggtcagaccggcgatcggtcagaccggctaatgtgcctcggtcagaccggacaccggttagaccggcggtgaagcctcggtcagatcggcccccagtcagaccggctgcacaccctctgtcagaccggcctcgaagaaatttttctgaaaattctcgaattgattttgcacgtggatatatgcctattggatcttctggtcgtgtgtctcagtactggattcctaaatttttattatcagctaacccctgtactgaggcttcgacttctgcttgtgtgttggctttggtggcaaggaaggagaacgtgtggatcgtggattccggttgttcgcggcatatgaccggtgataaaaattggttctcctctctcaaaaaggcatccaagactggatcgattatctttggtgatgcttctacaagtgccggtctcgttacaggtttgggtaaggtaaataaaaatttgaattgaagaatgtagttttgtttgaggacctaaaggaccatttgccttcgggttccccaaatggt

SEQ ID NO: 5807 - DNA, 498 bp, Oryza sativa
ctgaccggcgcgcgggttctcggcccggccaacgagaagatcccggcccgcgacctggcgctggaagacggcgaacgggtcgaggtgctcggcctggtcttcgagatcttccacgtgcccggccataccctcggccatatcgcctactaccacccggcggagacgccgctgctgttctgcggcgacaccctgttcgccgccggctgcggccgtctcttcgaaggcaccccggcgcagatgcatcattccctggcgcgactggccgcgctgccggccaacacccgggtctactgcacccacgagtacacgctgagcaacctgcgcttcgcgctggcggtggagccgacaacgcggcgctgcgggaacgcttcgaggaagcgacccggttgcgcgaacgggatcgcatcaccctgccgtcggaaatctcgctggaattgtcgaccaatccatttcttcgcgtttcggccaattctgttaaaaaaaaagccgaccagcgga

SEQ ID NO: 5808 - DNA, 17989 bp, Oryza sativa
  unsure (1)..(17989): unsure at all n locations
aacttcatctatgaaagtcctgccgcatgattgaagaaagaaataccagtttcacctatcccttgccatctggaaccacatcatagatccttagccattccacagggtccagggcctcatcttgatacttcacacagttgcaacatcaaacccacccccctacaaatcatctaggctgtgtcatatggttgtcttgattgcaggaccagaatgagagttcttcatttttttcctcgaaaaagcaagagaaatgtgtttcatttcattaaggggaagaaaaataaagaacaaaaatacaaagtaggagaaccagagtactctcaccgaaaaaacacacccacacaccccagccaatactggcaagcgctagctgcctaggtttgctgctccattaagaaacttttggagggcaaatgcccctgctaaacaccaaaggttaccctcattctctaccacctgcaagaccgccgcaattctaggattggcgccattgaaaacacagtcatttgtagcttggctccactacctcaaaaaacaaatagttgaaggttgaggcactgcatcagatatcccttgcttcaagaatagtgccgtccacacttggcaagaaaagacacaagaaatcaaaatgtgtttgacggattcttcactttaatcacaaaggggacatgccgcggggtactgcaatccgcgcttagcaagttggttggctgtctaacatctattattgacggccaaccagatgaagaacttacagcgaagaggagcccaactcttccaaatgtgattccaaggagcaaacttgatcgatcccaggaaataagcttcataggtagatttgcaagaatacatcccatcagccgttagcttccaaacatgttgatcttgtacaccttgtagcagaaccacctcttataccaaaacccaaatggtcatgtactcgtaaagaacctgaatagatagctccccatgtatgtcagccaccgatctgttgttctccaaagcctgcgccgcagtacgttgcttccttgcctcttagagatcaaggcaaagagattaggggccagttttgctattgttttcccttgcagctacctatcgctccaaaatttggtattttcttcattccataatagtttgaccacccacttggaaaaaaaattggccgtctgaaggcccttaaaagaataacctacccaagggctaaccaaatcaattttttgaaacccttaccaacttattccttatgcttattccatcttttctaaggtaaaggtaccaaaggcttcataagacaaagggcgacccccacgatccaaaaagatcaaccattttcttcattaatggtttctcttcccttccataagaagccgcgatgccttttatctatagccttgaccacccacttaaagatccaacgccatcattgcataaaagccgagaggaccaccattactggtataagccagcacgccctattcattaaagaggctttccaacatggtaaattatctgccactttgtccacaaggggcaacaattctgtcttggttggtttacatattctaagaggaagtccgagataagagcaagggaagctcatcactttacaagacaactcattagaaatcacttccagatcatcttccaagcagtgaataggaatgcaagagctcttcatcatattggttcttagtccagaaatctgaccaaaaactccaaaatctgcttgataagagataggtccccacttgtaggacacaagaacatgaccacatcagccgcatacagagaaacccggtgtgttgtttgcgtgacagcaagaggctccaggagatatccatgatccgcagactgccacaactgagttcagtatgtccataaccaagataaaaaaaagaaaaagaaaaaagagttcttcactttgacgaatagtgtcccatgttcattccataaattgcatttttatctccgattttgtatattctgttccttgaaatagaattaactagttcatttcagcttatattacataacgataattgtttgctctagaattagttaaatgtttaggagttttgcctcttcttatttttaacatgctagtaatatgcggtggtggtactagtttgttctactcctgtgtgatatttttcacctatcatataccttgttaatatattcagcatggtggcgaaggtcgcctgtatgaaagatatgcaaaatcaattgagcctatcttgagtgaagatataaggtaagttttgctccactctagagttattctattgtggtttactgtttataattgcattaaacctaattattgcagatttgtgcattttgacttccatcaaatctgggggcatattcactttgaacgccttttttcaccggtttgaccaattggaggatatttttagaaaccttaggtttgtggctaaaaaatcaaagtcctcctggtttaataattaataattttggattaaacccttttaccttaacattggtccttggccggcttttaaaccccttgttggatcttcgcctcttcaattatttttttattcaaattatttaaaattttattggctggaaatggaatttttttattaccttttaccttttcaatcttaatatctttgcatttattataagattgtgggggtgattttacacattcaaaaaatgccatttgatttggtagagtatatgttagcatgagttttcttctacagaatttttctctgtttaacatttctgcaagtgtgagtatctgcattttctatttgaaaaatcagtgcatttcatgtagagaataatgtagctgatttactattcagttccttcttttgccaaactactatagcatatatgcagtaatgtgctttcgtttaataacccttgtttcgtttaatatttctttcattataacttataattattggtagtagggactagcatacatgcattgaaaagcgtacacatattttgctatatgcttcctagttttggccctgttcctgtcaaagggaaagcaaatttatcgtacattagtcaaactattttgcttctttttctatgttcttatgttgccatctctacatggcgagaaaaaaaaaacatttcacatctacctttcccacacaacaagaaaacaaatggcaaaatggtagctgcatctgacacttttggtcacatatgttatataaaacctcctagctgaaatttggtgaggaatttggattaaaacccaaggaatgtcccaaaagaatccctttcatccaaactcatattatttctttgttctcatagtctttttaattgtatggcataggtacttccttttaaatagtaaaggtgagaaaatggaagagcagaccggaaccgttagaacaaattgtgtcgattgtctggatcgtactaatgtaactcaggtacatacttccaaggacagctttttcatgatattttgaaatgtaattctagatactaacaaaataattgctgatgtggtaactatcgctttaatttttttttgaaagaatgggatgtactttagtacagtattgtaatctaagtgcagttttcaaaagatacagaacatcacataatcgctcctaggttcttctagatagtgtttagtttggacgaggccctcaccctgaatttggttggtaggacgaagtggaatgagccgggacgagttcatccaacatgatagaatattcgaccaagatgcaaaacggtgttgtaccagaaattttgctagatgagctcttcccacctcgcacgtgatagcttttgctatgtctggtcgctgcgtggatatcagccggtgagagaaaagcgatggtgcatgcatgactctggtctatgaggagacgttgaagctagtgaagaggatgccgcacgctgcgccagatggggagaggccgtagtgccctgtcctagagttggacaaggaggccgacgtcattgcgtgtgccagaggtggaggcagctagaacaatggagcagtctggggaggcgaaatcatccaactgccttaaaggtgatatgatagacttctgaccgcgtgggggaagggcgcaaggcatcattcatccaaccaacacagaaaatagagaggaggcgatcctagaagaagcactctgccatggatgagatttttcgatgtggctgccttgaatgagattgatgtgtttgccatgtagagaagtagaggaaaaatgcggggagaatggaaagttgaaaatagaacataattctcacctcctaaagagaaggttttcttaaccaatcctgttccaatttaatttcttcaatcaaacaatgggattgatggggttatatgcattggctcatggaggtcataaaacttggttatgtacctaggggtggttctagacattagttatgcactgccatggtgtcaaaccttcacggggtgaatttaatactaggcccaataatagtggctcttgtagcccggactgtggttttggtgcgattagtcccacatatagagtttaggtaggtacaaactgagggatttctgaccatagtatcttcgtttaacacttctacacaacgtgaggagtttagtcgatatggactttggttggtagtagagcataaaccttcgttacacaagaatgtgcgagcagatcaccacattctagattgatcttgtcattggacattcaaaaaataaatgatatgttgtttcatccttgtcattggataacttcagtttggatccatttgagagaagggttgttggcagtactaggtcacccacattccttgtaaatgtatagccatgcaccatgtccagacaataggttaaatagtccacattgaagtctaaacatagagtaactagacatgcataatataaacataaagtgtgaatagacgaggtaccaacagataacaaatagtaaactagaaagaaataataagatcacatcagaattttaccggattgaagggataggagttttattccatcggggagaaaaaatcatcgaagtggtacaaatttggagtgttagcattccggcctatagtatttttctggtctctgagatttctttccttgtcaactatcttttcctagctgtttccaccctctcgagaagaggggcgagtgaagtgagagtggagccccctatttatattagaagtgccttgggcatatgggtttcatctccaccaggcatggaggaatgaagtggcatgaggcatttctcccacactgcatggagcatacaaggaggtggagtagcagctaaggcatcttgtggggctagccaacttatgtcggtgtgggatcgactgggctacggagtgaccggctgggctgtaagcttgggctggccaggctgcatgcttggtttgggaccggccggactgcatcccttggttggctaggctggttgggccgttgcatacgttgcctggcattgttcttgcattttttttgaacttcctgattttgcttgaatatgttgatgcacttattaccggcttaccgccaaaaacttgttgacacaccaaaactcgtggatacattaaggttagtgccaaaataaatacagcatttatcaatacctcatttattcataagtatttaaggagtacaaaatatcacttttagcattttacgggcgtcaacaatgctccatgtggaactaatctcaccaaaccacaccatgggttacatcactagcaagtagcaactactgggctagaatattacattcaaagtatttgtagttgtgtggggatccttatgtctttctcgagcaattactttgtttctttggccttctccatttttttaatgtgtatgtaactacaatagtctccttaatacacaaaacagagcatgatcgggagaaaaatattggaaagccaactgcaaaaaatcagtgttcttggtgacaacaatacaatcagcgattatccggcatttgatgcagattacaaagtttgtaagtgttgcatatgatattcactaaacatgtttgttagtatgtcccccacatttgtctcacaatgttgctggtcctaaacaattgctgacttctttttcagtgtgggccaaccatggcgatgcaataagcactcagtactctggaactcctgccttgaagggagactttgtgcggtaatttgtgttttcaagtttttgtgaattctcttatttagccccttttcctttgcacaatttggacctactaatttcagaaaaagaagtaatgatttgattgcaaccataagcacgtttaagctgagttgctaatgtttccttatgaagcaaaggttttgtaacttgtaagatcctttaacacctagcctgctaaacattttctctagtttcatgttgtgaatctcctcaatagttaaacctttataatggcaacttttaaactgatttatttcttgctcgctgtgaaaagttatcttctcgtcaccatcagaaaaattacttgttggattatgtttagttgcttacttcccagtatcaggactgagctgacacctaagatgttgacacagttctaatgcatgagagtgcagtattataattaaattactgacaaactacatgatcacataaggtgcaaaataatactatcgttctgccaatggcattgccacatgttttcactttttcctctattaatccgctgtctatgatctatttcttcttttggttgttggatctttagaaacaaataatgattaattagttatttgttgttcttaacctaactatatcttatttatttattaggtacggaaagcgaactacacagggaattttaaatgatctgtggaatgcaatggctagatattacctgaacaactttgcagatggtactaaacaggtatgttgcttacttggtctcaccattgatgggctggagtgagttggattttgctattttaggtttgctattttatccaagacatcatggacgagtgaagaaaagatcccttacgttggtaatgatggatcaaggcatagtgataactcattatttgtttattgtcttgtataggatgccatggatcttcttcaaggacatcacatatcctcagttagtcgggatatgccaactccaaccaaaggacttatagagaatcacgcggttggttattttctttctattacttgagatttttttttacagatgaataatccttaagttgcataccgtgaattgcatttattgttcttactcttggttctgaattctcatgcttaaaaggattgcaatttacaatgaatttctatgcataattttgatgtttccatctacttactaggataagttgacagcggtgatgctatgatccataccaaggttttgaataccagtctttctggaaaaccactatatccattttttttaattcacaaaccatttaccagccgtaaccgaccatgaaccagtttttgatggaaaattttgtattaaaacttatggcatggataatgcgtgcttttttttaatgacttagtatttatcacacttaatgctgcaaaaaatatacagctcataatgttctgaccggaaataccagtaactggtttggagctcctggccggtaaccagcagtgtaattacctgcgaagatttccacccctgatgtattccctcaatttagttctttcgtgttgatagagttacatgggcatttgaatgtcgttatgcatatcttagtggagatatttgttgaatagtcccacattggttgtggaaggacctaagatataagtgggggagcccctcacctcaatggctagcttttggggtgggaaaggccctttacggtcttacaattggtatcagagcctggctaggttaacatctctggcccgatggacacagtatgtgaaggtttgatggaccgtgggtgcctgcggggcccgtatacctaatggaccgtgggcctgttctgtggggtctatacacggtgaaaggctgagggacttaagatataagtgggggagcccctcacctcaatggctagcttttggggtgggaaaggccctttacgatcctacaatatttttccatatttaaattaggatattttagtggagaacttacttgagttttcatttgcagtccttccgccttgcttttgctctgcttttggctgccgtgatattcttgataatgtcactgagaagaggtactatttcatcctaccgaaatggcaatgatttaagttaatttatgcagattagaggcactcaactgttgtaaacttgacgagttgtttgcagccaacatattactatgtggaaacaaatacataaccaagtcactaggccaaattcactccaacaagtttaatttgatccttcttcatgctttgtcatactaacttgattcatttccttgcagcacgtaatgatgttttccatttggtgctgtcactactatggtctggtttttgctttggcatcacgcgttatgtcaaagctaacggacggaagttcacgaaccgtcctcgctttcacctatcgcgccattgatgcgaacaaaagggattatatacacactcatggtcgactcacctttctgggcatgcatgtgtgctctcagttttgtatcaagtttaactttccctctttgtaagattttgcacatgttctgaccatcacggctttatattttcttgttgaatgggaacatcaggaattgatttgttctattgcatttatttatttatttatttatttatataaacgttttgcagaaaatgttgcaaagatgtatatgatgatcaaaattgcaaatggtttagggtttcatatattttgggcatcacggcttctattcaatccacacgtagaaacaagactgcagttgtctagcattgtgtatgttaagggtatatatgagatagtttgtatgaaaagtattaaagtaactttctatcactagtgtatataattgatatgccatttaggattaaactccaggaaaagttaaattcccaatttctcctccctgtatattgatattgtaccggagcaagagcaagggagtaaaatcctaaaaatcctagctagccgccgccggctcaacgtctagcaaccctcagttcagatccagctccaattgtccaccatggctcgttgtcacccacgtccgtccgctgctgcttgccatcccccactgcatgaaatttagtgtatgacgcaagacacaaaaggctcaaaagctaagttactttgaaataaaagataatcataagtttgttcatatccattccttggccataaggcatctcaatttatagtacattcagtatctacccttggttccacacgagagctagcttaaaagcagaggaaaacagagaagcgacaaaatgaaatgtaaacagtggttcctgacaacgagcaagctcccagatgcaaaactaatatgcctcgtctattaccagtcgtccgatcttcataatccgctcctgaattgtttccttatcctcttctcttcaattggcttaagcatcctcagagattcataaattcagaacatattcagtccatttctcatctccagattccgacattaccttcccctcgagacaatccttgtcctcaaggattgaaaggtagaaacatacttcggatcacagtggtatcttcccagggtggttcagccggtgataaatttaccaaagattcaaccattgagtcacagcttctccccttctagcaccatcctcctttgcaatacaacaactggttcagttttgatccagccgtctggtctaacagatagcagattggccattggaactgcatgagctcccaagtgttttttcagttggctgacatgaaaaataggatgtatattggagccctttgaagttggagtctctaagcagcctgtccaatcttcctagtaattgtgaaagggccataaaattttaatctcagcttaagagagcccctgataccaaatgatgtacgcctgtagggctgcaattttaggtaggcaaaatttggtataaaacatttaaaaaaattgcaattagctatgggacatcacaaagacatcaatttgccaaggacactctaaaagtgtggtaattttctgtagtatagtggacgcattaaaatatagtatccaccaatttgatgagagagaaaccatataaaatgacaaatttccctttatcttctcccttctctcggtcttcttctgactctcactcgcagtgagctccaccggcttgcccatggtagatagttgctcagcatggtcatgcaacatgtcgaggccaccgctaccggacgccgaacaccataggcgaccgcggaggcggcgcagctgccggagccacttgcactcgcaccaccgtgggggccgtgccccggccagacgaccacgtgagggatgccagtgccgtcgtgttctccatcaggtaccgcctcgccctcaagcaccgcctcccaccgcagttgacgatgcgacgggtttcctccactggattagggaacacaccttggacaatgctgatggctggctcaccgaggctgctgacttcggccgcgtgttcgtcaccggtgactcggacggcagcaccatagcgcaccacctcaccatgcacgccggcttggcgatgcccaatctcactggcgcctgtggcatgatgtgcaaccgcgccatcgactgcaccgagcggttgttcacaatggacaagccaatggagctcactgcgagtgagcgtcggaagaagactatgagaagggagaagaagataagggcaaaactgccattttatgtgatttatctctcatcagttgggtggatattatatattacaccaaatttgctccaagacactcaaatgcgtaattagctgtgggacaccacaaagaaattttcttgaggacactctaaaaatatcgtaatttgatgcaagacactagactcattaaaatatattaaacccacccaattgaatgggtgtacctatataatgctttgaatagggtcatctcgatagttgtatgatatgtggtatattaccactcagccaacgccgaccataaataccaatgttggggctcttggaaggtcatatttctcatataggactcaaagacattgattcactctttctgtctaacaatttgtttcatggaggtgacctgtattgaatctcgaaaaaaattttggaaatacactctttttttaataatttgtgtttatatatctacattggagagtttagcagaaatatatctaatccgcggttcggaaacacgggaccgcaaagcaagtgcggcgtggacatgcaggaacggcggctgcttcggtgccgcgcagcggaaacgcggaataggcccgatcctgcagagcagaagagcgggaccgtatcgttcccgcggccctatcctgtggcaacgtggcggagagtgggaccgatttgctcccacggaaccgtggtgcgctaccgacgcggttctgcatcccggatatgcggcaccgatctggtcccgtcgtgaggcaccgctccctttcccgcataaccatcatgcgggaccgtgaatcaatctctacgcaattggccggcaggtcgtcggtcccgcggcatagtagtgcgggaacgcaccagcacgagcggcattgcgttctggattagaggtcacaaccgtaaaaaaaagcaacttactttgttgatgtgattaggcttttttttttactcttctgcttccggattaatctccaacaactaataagaaaatattatactggctaatgaacctccgttggtaacttaatttgttgatgtgattaaccctgtttgattcagcttaaaattattataatctggattattatgagtaagccgaaacaaaccagtagattattataatctataagccagattagtataatctaataatctcctatggaggagctttttctagattattgagtggctaaagacccactacccttagatgtctctagtaatctagagaaacaaacaactcgcaacttattctatatcagcttattataatccagcttagagtaatctgatttaataatctggattacaataatcttaagttgaaacaaacagagcctaagcttagtttaatattttgtttccggatttatctccaacaagcaatgaaaaaaaatttgtgagctaattaacgatgccggccaaagcggcgctgctcttccgaggtgcggagcagcgggaccggaaagatggcgcgcattcgggacgctgaaccgcgtcggtggcgcaccacggttccgcgggagcgaggctatcccgcacgacgccgctctctaccacgctgccgcaggacagggccgccggagcaatgtggttccgctcttctgctccacgggaccgaggctattccgcgttttcactccgcggcaccgaagcatccgccgttcccgcatgtccatgtcgcgcttgctttgtggtcccgcgtttccaatctgcaaattaggtatatttgtgctaaaccctcccatacaggtatataaacacaaatttttaaaaagaagaatatttttccaaatttttttcgttgaatctcagctgcatattcattgatttgaaatacttcctgaaatatacagctagtgaatatcttgtcaccatcaattatgatacccattggcatcccatgtagtttgtggatgttatatatccatataaagatatccaccacctgctccactgaataatgatgaaacaaggccaaaaagtgagcatacttagtcaatctgttaaccaccaccgatatcacatcctttcctctggattttggtagcctataatgaaattcatggtaatgtgtgaccaagccatgtcaactatatcaaaaggattgaggagtcctggaatatgaacttgtgttcttctttagtcgcttggcatacgatattccctaaccattttgtcagcatccctcttgagaccaggctagtaaaaaaacattttgattctatggcaagtggccctcattccataatggccccaaaggaggagtggtatgcccttagtagttggtttaagatgttttacctgcatatatccttcctttatacttcagcagtccaccttccattttatagttcctatcagtatcgagctcacaccaccattcctacagctcgagtgcgtgctcgtccaaagaggatgtgccgagtgaaggacatgcagaatcttatggccaagtgtcaatgcatgaggatcaaggcttgacgttttgtcccgactccgagctgtacttgtaaaaagatcagttgatgcaggcctacaaccttctcagggatcaagtgttcgctcatacgcgagcatacgacccggagctgcttgctaaaataggtatgaatgttgattctgctactgtgtggaaagcaatatgttgggatgatttcgcgctagtagatgactctggttcacgttttcttaccgtacgatttctctgtatgttgcgatacgtgtgggaaggtattacgttccgattcttcgggacggaatactatctcacacgaaaggatcttagtactcatatgggattcaacataagatgttttgttgatttggagtcagtgactccagatttcaatagaaacaacttctggcaacatattacatgagactttctatgtagaagcgtggatattggatttgttaattagctcggttcgtaagacatcaaagaagaaaaggttctcttcatgtctagtgagtttgatttttctatttggtaacaatgcgtgttatctggccatggattagaacaagtcaaatttaaaacagtagatgtagttgaacatgatttttgaggagtctatgatgtaacaggtagaaagaaattcaatttcacttagcaagacgattgtggtgatataagagagggtggaacactgttgcaggtgcaatcaagaggaagaagttacagggatagcgggagtctcttgttgtggtgatcctggtgaaggcttgtcgggccaactcagcatgagcggtggaagaaccaactcaagttctggcacacggaggttcgagcaaataacaaattcatgttggcgtggcatattcgctaaggaggagtttgttagagttcgcatagtgagagggagcggctgccaacggcgttcgatcgatagttgttataactctaatacgctgtaaatgctggatgggaagaagcactccagggatgtaggcttcggttaaatctcgttaacaaatatcgtacttcaatgcgatcatcgtgtttgaattacctatgacgtttctttcgtgtttggttttcgatagtgatttcggaccagttttataacaaatggaattaatattattgcatcattgaatcctaaagtaaattagaatttaggccatattttattacccaaatttagttttggagcatattcactttggtctgcactagcacgagtcatgtggcaaatgaattacatcttctcattactacactaacatgggatacccttctctatcaactcatcaattttgctatcacatcactcgtcctactacttaattatatgagaatgccctaatacaacgattggaagtttggaaatcaagaactgctcatagggatgctttcacagcaatgggaagctagaatcgagaaaaaaaaaactctttacaggacgtaacgtgaccatatctgtgtttagcatacagcatttgacatgttaattaacttgttgatgtgtcagaaatgctgttgaagtagcagcaaatgcaggattactcccaggaagagatcagtcagtttggtcattctcttctgcacaccaagatcaaattagcttgcacgtgcggcgccgtcttttcccagatatggacaataacctccaaggtgttttatgttcagttagcctaacaggtctgcgaggaaacttctgatctctggtccccatcagatattgcctggacttgtgcagcgtactgcagattccagagaacctcttcgatcgaaggcctggctgaagattcaactgataaacatttgacagtaatggaaatcaccatcgacaaagaatcttgcgaagaggtgctcagcacaaccggatcaagaacttgctcgcgctcttcctgttttgatattgacagaacctgcagatacaggtaaaattttgattgttctggtatgatcagagcatatgagtcatgtagggttttagagagctaaggatcctatcagttgaagttttatcatgccaaattaatccggatattaaaatttgtagttcttactctgcaagcaacattgctcctaatatttgtgcatgtaatgctctttgttgggctaatgcagggaagcagaagtgcttgaaacatacatttcatactcagaacttattagtgtgtggtgtcataattcagcttatgatatcatggattgcagagcacaatgaggacgaaagttatacggtcatacccaaccaacaaaatatctgtattgagttgatagatagcttaatacaacatgaaattagcccagtccagacagcgctcgagctatgtatcaccgtgatattgatcgaagtatcattattataactatcatctggatatttgattaattatctttacgcaaaagacaaaatggaacataccagctcacttagcacagagagatctttcctatgacgttttggccccataagtacttcaagtaaaatacctccaaaagaaagcacatcatcctccaaattttccctaaaaacataaattatattagactttcagcatgtctgatcatttattagttgtatgcaactttgtgtaagaaatactttgctacaagttctgcaggtacttacaattctccaccattgtcttctacacatctctgcccttctcctgctgcctgtaaagtgtaaaccaataggaataagggcattaaaataaagaatggtctataattgagactcctttaaatacaggggaagaggagtaggatcattctatgatatggcaaaccaacctcatgtttgtatatctcctccgtaattatggatagcccatagtcactcagttttgccacaaggtgttcatcaagtaaaatactagaaggctttaaccggttatataaggaaccaggaattattccagtatgtaagaaatgcacagccttagcaatgttcatcagcacttggagcctctcacaccagttcagagtcttctctggactagagcctaccacagcaaaggcattcacgaaccacaagttacaaattcgattgctatcacttcgtacgactttaattcctcattttatttttagttccttaccagaaagatatgaaggaaacgttccactaggtacatattcatagacaaggaaaacccttttcacacttgattcatcaacttcgccatcaatacagtgccccaagaggcaaaccaaatttgggtgacgaagcttcgccagtagatctaatcgaagttttagattccttattgagtatcgttggtgcaatgccaaacatcttatggcaatcagggttccattctctagttttcccttgtacagctgaaaacaaaggaaaggagtaaggaaaatgccacattaaaatagtatgaggaaaaattgtcagaaactatctagcttgcagagctaataaaatggagtaattataatactgttaacaggttaaaagcagtacaattattatctcatgtatacggtaaattcctaactaaatcggagtatcagacagatgttgaagatggcaacagacctttccaattgacccctcgcctaaaaatgccgacctctcaaagctttttgttgcttccttgagctcttccaaagaaaatgctcgatacatgggcattatttgtgtccctaattttacagcttgagatatgtaccctgcaatgaagtgagggagaggagaatttcaataggaggaaatacaattatctcttgtttattattcagggaaataaattttggagttcattccaataccatcatctaccattaggatagtctacatgtatgatgtatctatctgtgactatgacaaacaatcggctggatggatctcaaaacatgggatgcagtgatgcacacatgatccacatctagcacatcattccatatatcataagaaactaggcatttactagcaaaatttcttcagaagaagacttacttgcatttactagcagttcagttgacattcctgatgtcgaattatcttgcatttgcttttgaagtaactgttgttctgctaaaactctctgacagcttcttctgtttgaagccattaatataagagaaagcacaagcacaataaacaccaccccaacaacagtgaccacaagtccaacatccttgtttgatcctctccccttgtgaggttgttgacaatacttagtttcatgctggtgttcagggtcgtcactgaagcaattaccatcaaacttaactaccctgttattgacattaacattaagacagacaggcaggtcacctgtgagttggtttgtagacaaatccacaaagccaagggtactgctgcatgttaaactagtagaaaatgatccactgagcatattcgcagctaggttgagatagctgatgcttggaagagcgaagagcttttcaggaggcttccccacgagaaagttgaatgagagatcgaggtgctgaagtcggttcaactgaccaaactgctcagggatttcgcccttgagtgagtttttgctgagtaggattgttaccaatgctgtaggcagctctgggagctccccatccaactcattgtccctcaagtccagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5809 - DNA, 11663 bp, Oryza sativa
  unsure (1)..(11663): unsure at all n locations
aaccagtcaagacatgtgatgcccataatatactggaacaatagtaacagatgaatacctgaataatgttatcgtgctcttaaaataaccaataacagtccaggtgtcaggattttcctagtaaggataagcctattgtaatcatagaatacaaacacatgcacattaaactaacatccttaaaaaactaattgggatttgtgggccatggaaccaacatccttcagcatctaaaactgttaaatagccatggtccgatgatcatatcatatcgcatatagcaagacaaaaagagcatatgagacaagaagccaaacaagtatgacaaaaagggccagggaaggtaccctgccatgtatcctttttatcacaatagatagatagggaaatcaaaccggataactataaatgtcaaataaacaagaaagctattacataagaatgcacaataatataatgtgaaaagaaaatccataacctgattttaatactcatcacatgatcctgaccttgcatcataaaaaatgtacacagttttctatcaatcatgccaacagtgcctaggactcacattttctttttttctacaaaatgctattccatgatttcatataattatgcactgacaagtcaatattcataccctaaaattaaaatgcaaaacgctcctcacacacccgcaccacgacgcaaaaccgagaaattttggcaagcagtacgttcagcgcctcaagatcgatccatcacggtctcactgtcaaatcatgcgccccanaatttgtataaacaattcaaattgccgtaggaaacgaagcacacaaagagggataagatcctgacgcacctaacactccggcagcggtaggggtcggaggagagtggaatggatacggaccaccggcggttggggatcggaagaggggggaatgaatggattggagaaggggaatcgcctcggagaagtggagaagggatggaactagcggtagtgagatgaacgcgggagagggaagggccacactagaagcggggcgatggtggccatttttggtgggtagcaacaatgtcggaggcctggctgataaaatcctcacgttctagtacttttcctttttttttttgattatttttcttatggatgcgactacagggagcgcatgcactcggttgtgctaaccagcgaccatgctttttaccaaaaatagtgcagtgtgtaatcaacttgttacccttcttactaaaagtagtagcacctgccacttgcatcctcattacccatctaaatttcaaataattttttctcttaaattacttatctgatctacgacccgattacatcgtttcgttgcaattatatctgtacatcaagatcttacatgattatattatgatgaaaaaaatatttatgcttgtaaatcactttaattatatactaagttacttttatcatatatatatatataagagttggattttttgcacgcaagttcacatgtacccacaaggctagtatattaggtgctaacaaaatgtaacatacatgttatactatattttttacaagtgtaaaatacctggtttatataatttttgaatttcttatgcaaaacttgtttatgtagtttaccttgtttatataaattatctggtttatgtagttttgatggtaggatatatataattttggaaatatcatttttgcaaaatgacaattgggggatatagtaaatatatggttttttcatttggactaaatatcatgttataaacaaaataggggttaaaaaaatccaatgcactagatatataaatgtaatatatgatattatggaaaaattatttggtaaaaaatgcaacatacatggtatacatatagtgaacccacctaatcctaattatcttttctccctatagtaagcattcatttcgttaaggttagctacattttgcagcaggaatcttggaacacatcaacagtgtagattgtaggtacatatgaacccgagtgcgaatctgcattatacacacacacaccagcaaaatgcccatgcgttgcattgggtgaagcaaaaaaaagaaaaagtagtaatgggtgtgtgggaggagtgtaaagccaccaaggttaattgagctcctcatagtcaaatcgaatattcccggtgcaagaatgctctaaatccacttacatggattattataagaaatcaattaataccactataaaatctctataatataaaaaaataaatttttttgccggtactttagtacgtcatccgtgtatgagtcggtttttaacttcgtttacttttggaaatacattttcgtatttgagttagtttttaagtttgttcgtttttggaaacatagaaggagtcgtataagaaatctctttaaaaaaactcgcatgctagcttgagatgatcggactcctaattgcagcttatgactttctaaaaatatatatatctaagcaaatttaaatagtgaattcacattaattaaacagtataacaataataagattaaaataactctcatccattgcaatgcacggggatttttatagtgaatactaaaatttgaaaccataaaaagtatttatttttatcatgagtcagttgcaatgtacggttatttttttgtcattgatattgataaacacttttttatatcataaagagtacccatagtagaagaaatatttttagctagctatcagatcaagctcactgcactccagtagcagaatcgttttcactaaaaaaaaacagaaggaaatcgtacgataaatagaaaaaaaaagtgacgtggttaggtgtcctacggcgaatgagaaattgacgcggaaaacaatcttgatgcaaacacaattaattttgttggtgattacgtgtttttcttgaaaaaaaaagcatgcgattgttttttatattttaaaaagtaaatcattttgttggtgattacgttgttttttattttatttttaaatagtaaaatagcatctatttttatctgatctctggtacacgtgagtccaaactttataattcagtgtttataacgacgtgcaagcctcatatttaagcaggtgcttgagtgcttctcaagctgtggggaagttattcgtgttacagtaccacgatgctacagtctcggttgctacagtaccgtgcagtactgtgctggctggtgctcctctgttatgtgggctggctgttgggttgagactgctgggccggccttatactgctttggttgggctgcttgctagctttctgttttttcttttctcttttatttgtgggtgtaagagatctccatcacgcttacggattgtggattagcgacaaaatattgtgtgggcccatgcttaacgacggacgaatgattaaccggaagctttacttatttttttaattaggtactgcggactctaatatgtcgtgttttgttgatgacgaaaaaaaaagatgtttaattttcaaattaaaattgattcattataagatttctgaatcataaaatatctgttgaagaaagcggtgttaaacgtttgatttttcagtgcatggtccgtgctagtggcagagagaaaaaaattgggattaaatagaatttgagatgtgagaggcaaaatagacttattctgagtaataattagtgttcaatttttttaaacggtagtgcagcatatgagaggccggcccgtactcagtgcaaaaggttaggcatatgagaggccggcccatactcagtgcaacggtagtgcagcatatgagaggccagcccatactcagtgaaaaaggttaggcataggaataagtttaccggaggtccctcaacttaacagcgagattttctgaggtcccttaaccacaaaaccagaaatctccacccctaaactatacaaaaccgttcactcaagctccctaggcagtatatatgggtggtttcgctgacgtggcatcctagtcagcaaaaataattaaaaaaatacgtggggcccacatgtcagccctgcatattttttttggcaaaatttgctacaggacatctaaaaaacgtgtaattagttagaagataccgcaagaatgtttatttgttgtagggcattgtaaaaaactggtaattagctgatgggcaccaacaagattattttattatatttggaggaatatgagagagaaacaagcattaaataccagtttacccttgcctcaaattagttagtcttcactaatcacatattctcatcgccaagcaaagagcaagagagaggaggctctctcgagcgcagcagcagagtcgtgtcgtttcctccgagggcagcagcagtcgccgctgccatcgccgctttctcgagcgcagccatcgccgctccctttgcgctgtcgttaccgcgcaccggaccacgtgcaccctctgcgccgtcgtcgccgctccctttctccgcgcataggaaccatcgtcgcagctcccattttccggaagaagcaaccgccgccgctgtcgtttcctttctccgcgtgcagcagctgtgccgccgccaccaccgctccctccctccgcaagttgccgctgcgccgccatgtgaccgtgcgaggcgtggcgtcggcgccggcgggcggaggcggctgttcagtgcgttccggcggctgcgggtgcggtggctagtggcgctgtaccgccgctcgctgcggcggctgcgcgcgtactacaccaaggcggtccaagacctcctcgagggcgcgacggtcatgagcacgctgcactcgtaggctgccacagactgctcgttcggcgccgctttcacgccggtggtcgtcgtgaaacaataacaccagtggttgctcctcctccttcgcttgcaggacatgaagccatggagtagtagcaccggtgacggcaggtgagcgagcgccacgacgataggcgaagcggcggcgagcaaggttgaaggcagcggttgagaacagagagagagagagagaaagaatgagagagggagaaaaggataaggaagaaacaaaaaagaaaaagaaaaaaaatcaaaaggtactccctcgtctcataatataagagattttgagtttgtatttatattgtctgaccacttgtcttatttaaaaaatttgtgcaaatataaaaaacgaaaagttgtacttaaagtattttggataataaagtaagtcaaaaaaataataattttaattttttttaataagacgagtggtcaaacaatgcaagcaaaaactcaaaatcccttatattataggacaaagggagtagaaccgtacttacacagctgtttctctctctaatttttttagatataataaaataattccgcgggtgtccagcagctaattaccaattttttgcagtccctacagcaaaaacgcgttattgcgatgtcttctagctaattacacgttttttgaatgtactgttagcaaattttgcctattttttttcttctctgttcttcctcttctgttctcttttctctcttctctcttctctcttgacttcttgggtgagggaggccggcggcgggcagcgagcggcagcggttggcggtggcaggtggagtggcgggtggtttcgccggcgtcatctcttgctggctcccaatacgtgccgcgacctggagccccgcgcgcgtggcggcggtgctcgagcaggccaccgcgggtgacctgctgaccatcgcgctcgacggcgccggtgagcgcgtccagaacgtcgacaacgtgcgccacatcatcttcgggcggcatgaacggccggagtcggaagccggaagccgagattacatgacttttatagctaagaaaacaaacttcggtcacatcgtacgggcacgcagcacgcgatcaacttaatttggcagccactagctggccgcatgcacgaagctaactgccacacaactcatgcaacacattcatgtattgactagctctaactaatcagctaactaagctatgcatgcacaccactaacagttttgtggttaggtggtgctgaggcgctgagcgcgctctactacgaccagctcaagctccagcagtggcaatggcggaggagacgagggcggcgggtgggacgcgtatgggaatggcgtgatgaggtcatcggcagcggggtcggcgcagaagcaggcgaaggaggatgcggaagcaggcgaaggaggagagcttaagcatgcaggatgctcagagccgcctcctccggcgagctcacctttgccaaatcctgcacgccacacgtcgtctcttcctggaaagaacgaaccagcggtgtggacgtcgtcttgtccacggtggtggcgtgctgctccttgacgacggacaggaggaactccacggcgccgggcgcgccctggacgcaccgctggacgggagcaaggtcggaagaactccacgtacgcgaacgggagcaaggtcgccgcccgcctcacccgccttctccgccgttctcctcgccgccccggtgcgctcgtctgccgtgggcccgcagccgctccgcccaccggccgccggcttagatccctcactgaagaagaagaaagaagaagagaagagagaagagaaaagaggagaaggggaagaaatgtgcagctgacatatcggcttcacgtatatattttttttcctgactatatgccacgtcagtgaaaccacccatatatacctcacgtatatatatattttttcctgactaggatgccacgtaagtgaaaccacctataaattcggccggcttagatccctcactgaagaagaagaaagaagaagagaagagagaagagaaaagaggagaaggggaagaaatgtgcagctgacatatcggcttcacgtatatattttttttcctgactatatgccacgtcagtgaaaccacccatatatacctcacgtatatatatattttttcctgactaggatgccacgtaagtgaaaccacctataaatgtaaaaagttagggtggtgggaatcgaacccagctggccaaagcaaagtttcactccgctaaccaagttggcaagctgctagttgtgttcaataattcaatcaattaatacatattctatatcaatcgtgattttgaagtagattgaaaatggtccgactcgactattgagccgattaaaaatgattttagcaacgtttgaacaggatgacggacggaaaaaaaatccggaaaccttacgtattttttattaggggtgtgtgtgtctatatatatatatatatatatatatatatatatatacatacatgtatatatatatatatatatatatatatatatatatatatacatatatatatatatatatgtatatatatatatatatacatatatatatacatatatatatacatatatatatatatatatattgtcagggttacggataaggtataccctctatccttagacgtacgatgagtattgatacggtatacccacgcgtatacggatagttccagtatatgttaaggaaatctatcacgtgatagaaacagaatccacggatgtaaggagtcctactcgggcaagaccgggtctttaccatatcgtgagaggtccgatatctccgagttctacttggagatcaactaacccgcggtataaaagggaccccctgggcaggacctagggcatcgaatctcaccgcaaacacatccaccacagctacgaagccggagcgcataggagccaagtcgccgggagatctagtcgaaccaactcgactactctctcgtcggtaccatcgagttctgttattccctttgtattatgtgatttccatcatataatcccataccaactggattagggctattacctatcaaggggcctgaaccagtataatcattgctttctgtttgcttgatgccgtactacgtagatcctcgttccaacggaccccaggtctacgggtatcctccgttgacagtggcgcgccaggtagggcgacttggtgctcaaggttctactactatgacttcaagcctcttcgacgacagcgtcgaccccggcatcaaccaaggagcctcaacttcaacgatgctggtgtggactcaagtcggcgaaatcgtcttcccggtctacaccacgatgccgatctcgaatggcccagcaattaccaggagcgagaatggcgtggttacgaccccggtcgactccacgtcgaaagatcctcctgcagaagcggagaacggaacatcgacaacatttgagcccgagaaggatcctaacacggccaaatcttgtctccccgacgagaagcacgagccgacaaggataacttccgaggcgacaaggacctggtgtcctatccacaagaccaaaaggcacaccttgcaagcttgctcggtttttcccgacgtacaagctgaaatccgtgcctgcaaataacgtggaattcaacgtacttcccccactcgtgatgtctattgtcccattcacaaggcaaagactcacgacctctcgagctacaaggtccttctcagtgccatgaggacgtcgcctcctaaggtctagcagtcacaaatctcccctagagatgcggacaaggagcgaggagtggcgactatttcagatcgattcgtcggggtaatcgatatcgacccccacgagccgtcttcctacatttggttgaagaccaggcctcatcatcaacaagtacagcacgcaacgtgtacgctattgatgggaccagcacatctacaggcggcaacacggaagcggaggatcaattggctacgcaggcccaacatatcagaaccatcaatgcaatactgagggaaaccccttatgatcccgtcttgaacgctgatcttgatcagtggatgaaacgactacgggaatcagtggccaacctcagtaacgcgttcgaggaagccgctgccagggcaccaccagaacaaccgccgacaggcggcgctaatggggaacagcctgaacagcggacgccacctcgtccagccccccctctgcctcgcggcactagtgatctccgcgaccatctgaatggccgccgagaagcgcgacgtactcaagataacgaaaatcgttcccgacatcgcgtctcttcgcgacatcgcgagaacgaagagcaaggaaggcatccgagcgagaaccgagaccgtgatgatcgccacaaccgtcgcgaacgcactaatcgcgagcaacagatgccgggcgataccagtcgaggacgacgccgtaatgacgacgacgatggagatcagcgccgggacaacaacggtgggcgatgacaaggttctcaagaacctgagcgtcatcctcgtaatcgcactccgaagccgagtgactcgtcatcatcctcgtcatcttcatcatcttcatcatcgaacaggcatccacgacgagcacatgatcaccgacaacccaccgcccctagcggcgggtgcagagctttcactcgttttctgcgagaggttagatggcctgagaaatttcgactaggaacaatagagaaatacgacagaagcaccgaccctgaggagtttcttcaggtctattccacagtactctatgctgccggagtagacgacaacgcattggcaaattatttgccggcggcgttgaagggatctacacgttcatggctggttcacctcccaccctacttgatttcttcatggacagatctgtggcagcagttcgttgctaacttccaaggaacatacaagcgccacgcgatcgaagacgacctacacgcgttgaagcagaatccgggcgaatcattgagggactatattcggcgctttaatgagtgcagaaatacgatccccgagatcaccgatgcttccgtaatccgcgctttcaagtctgatgttcgagatcgctacactacccaggagttggcgacaagatggatcacgactgctcgtaagttattcgagattgtcgatcaatgcactcacgcggacgacgccctgagacgcaagaacgacaagccgaagacagggggagagaagaaaccagccaaggatgcacctgaggcaagcaagaggaagagtcgcaggagtaggaaaaggaaagctcaaacagaggtcctcacagcagaatatgctgacccacccaagcacctagacccacaaggtgacgacacgaagcaaatatggtgcccgatacacgagtcggacaagcactctctcgagacttgtttcgtcttcaaaaaggcactcacgaagcaactggcgttggagaagtgatgaggacacaactaactcggatataaccatggctactttatgtattaatcaaccaaaagtgcatatgttctatattagatttaccttgctaagttctcaaatggagaaagcggagcaatggcagtaccatgaattatttgaaacaaagtttgtggttaaggatagagcatgtcgtactataatcgatagtgagagttgcaataacttggtgagttcagatttggttgagaaacttgagttgcctacacaaccgcatcctcatccatattacatcaaatggttcaactcttgtggtaagttcaaggtaaatagaattgtgagaataaacttttcgattggaaattaccatgatactgccaattttgatcttgtccctatgcaagcatgttctttgttgttaggtcaaccatgggtatatgataataatggatcgcataattttgttgctaatacatacacatttaaacataatggtcggaaaatgaaattggtacctatgagttttactgaaattttcgaagataatcttgaaaggatgaagaatggaatcgaggaaattttcaaagatagtattgaaaggacgaaaaatagaatcgatgagattttcagagataccaggaaagatactattatgatgccttcaactaagtctaagttattacaaaatgaacgtaatgttgtgcctattgttttggatactaatattttgcaggcatctgagaataaacaaggtaatgggaaagagaagaaagacgaagaggaaaaagacctatctttagctccatgcatgcttgaagaatgtttaattaaccaagcacctataatttctgaagatgagaaaaaaggtaatgataatggtgctacagctacttaaggtatgcatatttatgaggtgccaactatgtccactacttatgctacattagagcaacccacggtggaaacaattgttgaaatacctttgtcacaaaacaatttccttgatgtttcttgtgataaagaagtgttgtgcgatgcttcacttatatccatgccacaactagtgaatgaacatgttagttctatagtagagccaccatgtgttcagtttaaacatgttattcacattgctagtgagaatgaagagcttaaattgctatcttctttaaatacttggggttatattccatttgatgatatttgtccactcaactgtctaaagaagaaattatttgctagatttgaattgccatgtccttctgatgtgatttttcatattattggcaattatgatagtaaaggagaatataatgtgcatcgagtatatatttgttcgaatttgactatacctccttttcatgatgaaatgtattatctagaggaccgcatgcatataagtaattctctatctagttcctctagtt

SEQ ID NO: 5810 - DNA, 1150 bp, Oryza sativa
gttgtacacgttttggattcggattcgggcctcctgatagcatcaacttcaaacggatctagccgctgatctagaaggaatttagaggcccatgagcacttgttggaaagattatgaagtctactttcatatggttttggtcccatgtcaaaattcctaccgagctgccgacaatcagcaaaacaagacacatatctcatctagtccgaatctgattttgagttttgggccttgtaattgtgtcgtgggcttagcccaaggggtgtgcgccctagggcaaccctaggacgtccctaagcacatttattccgcacgggttctcatcgacggaggcaactccattaacctactcttcaccagcaccttggacgcgatggggaccccacgaagtgagttgacgcccactgatcaacccttccacggaattactcctcactcatcgtccaagccactgggcaagattacgctacctgtgacttttggccaagcaaacaacttccgaacggagcagatcacctttgatgtcgctgagtttgacacaacatataatgccatcatcgggaggactgcactcgcgaagttcatggccgcatctcactatgcgtatcaagtgctcaagatgcctgggccgaagagaacaatcactattcaggaaaacgcgaagctggcggtgcagtgcgacaaatggagcctcgacatggtcgagcatgctcccaacccgcccgccatagctgagccacccaagaaagtgaacaaaaccaacaagacgtcgaagccagacagcgcaatcaagatcgttctgctctccagtgccaaccccgataagactgttaagatcggggcgtcactggatgagaaataggaactcgcgctcatcaccttcctccgcgacaatgcagacgtgtttgcttggcagctgtccgacatgccgggggtccccagggaggtgattgagcacaaactcatggtgcgaccccgatgccaagctagtaaaggaaaaactgcggagattcgcatcagatcggaaatgagccatatgagaagagctcgacaagcttctcaaagctggtttcatccgagaagtcctccacccagagtggctagccaatccaatcatggtgcgtaaggccaacgagaagtgggggctgca

SEQ ID NO: 5811 - DNA, 9793 bp, Oryza sativa
ccgtttgggctgataaccgcgggaaataccttccagcgcacggtccaaggggcacttaatgaccaacttggacacaatgtcgaggcctacgttgacgacattgttgtgaagacaaagacaagcgactcattgattgatgacctccaggaaacgttcgacaacctctgacaatatcgcctcatgctcaacccggagaagtgcatgttcggaggaccatcgggcaagctcctcggattcctcgtctccggaagagggatcgaagcaaatcccgagaagatcaaggcaatcgagaacataaagtcgcccacaagactcaaggaagtccagaagctaactggatgcatggcggcactgagcagattcgtcgctaggatgggagagcgaggacaacctttcttcgctctgctgaagaaacaagacaaatttgtgtggacacaggaagccgaagacgtgttcatcgcgctcaaatgctacctgtcaaatccccctgtacttgttgctccccaacctaatgaagaattattcctctatattgtcgccacaccatattctgtgagtaccgtcattgttgtcaagagagagaaggtgcaaagaccagtttactatgtcagcgaagctctccacgacgcaaagacaagatactcacagattcaaaagctgctttatgcagtaatcatgacatcaagaaagctacgccactacttccaagcccacagagtcacagttgtttcctccttccccctcggagaagtcgtgagaaacagagacgtcgtcggctgcattgcaaaatgggtagtcgagctaagccaatttgacgttcactttgtgccacgaacaactattaagtcccaggtcctcgccgatttcgtagctgactggactatgctcgacaacaggtcagacagtcagaccgacagcgagacatggacaatggcgttcgatggcgcattcaatagccaaggagcagggacagggttcatcttgacatcaccttcgggagatcagttcaagcatgcaattcacctcaacttcagggcgaccaacaacacagccgagtacgaaggactactcatcgggataagagcagcagccgcactaggagtcaagcgattaatcgtgaaaggggattcagaactagtcgcgaaccaggtgcacaaagactacaagtgctctagccccgagttatccaagtacctcgcagaagtcaggaagctagagaaaaggtttgatgggatcgaggtccggcacgtatatcgcaaggacaacattgaaccaaacgacctagcacggcgtgcgtctagacgagagccactcgaacctggtacttttctggacgtcttgacaaagccatcagtgaaaaagcaaatgacgaagatagcacagttgtccccgacattagctcgggggctataggggcagaacacgtcattgccgacatcgagaccacagaggactggcggaccccgctcatcaagttcctgagtaccgacgagttgcccgaggacgatgcagaggccgagaaaataacccgacaagccaagatctattgtatgatcggcaacgatctgtacaaaaaggtgccaaaaggggtacttctcaaatgcatctcgttcgatgacggcaaacatctcctcctcaacatacataaagggatgtgcgggtcacacgccgccggtcggacgttggtaggaaaagctttccgacaaggttttttctggccaaccgcgcgtaaagacgcttgcgacatggttcagcggtgtgaagcctttcaatttcatagcaaacacacaagactaccggcacaagcgctccagactatccctcttacatggccgttcttgtgttgggggctcgacatactcggaccattcccacgaggacagggcggctacaagttccttttcgtggcgatcgacaagttcaccaagtggattgaagcgatgcccacgggggaaatcaaggctgacgacgccatcaagtttatcaaaggatattctgcagatacagattgcctcaccgcatcataatagacaatggctcccagttcatcaatgccgacttccaggattactgcattggattgggagtcaagatttgttttgcctcggtttctcaccctcagagcaatggacaggtcaaaagggcaaacagcatagtactacaagggatcaagacccgagtctacgacagattcatgtcacacgacaagaagtgggtcgaagaactcccctctgatctatgggccgtgcgcaccacaccgacaacgttcaataaggagacacccttcttcctcgtgtatggctcataggctatgctccccacggagctacggcatcagagcacacgagtacagaagtactctgacgaggaacaggagaagcagcgaagtgacgatgtgaatctactcgaggaacatcgagaaagagttgttgtcagagcagccagctaccagcaggcccttcgccgataccatgagaagcgcatcagagcacgcacacttttgatcgacgattacgtcctccgacgggttcaaagccaagcagggcgtaacaagctctcacccaagtgggaaggaccatacacgatcacgcaattctttgcggccaggtgcattcaagattgcagacaacgatggtcgcgagttagcaaattcatggaacattgatcaattacgaaaattttatgtataaatcaatagtatccatacttgtaagacatcttacgatttcaataaagattgatttcaggtaaagactacagtctaagtgttccttcccggcgatcccttaccacgacgacacctagagttgaaacctatcctcatgtccctttacgccatcctgacaaggcctctgaggaacctaagggaacttcggctggggacgcctagagcggataaggccttgtcggatcatgtagagacaaacgaccatgtaagttctggtcatgtaagagttctcgccgtgcgtattaaccaagccgtgtaatcggaaattgagttttccaacttcacggctgggggctagggtcagcgctttttcaaccaaggcaagtcaagagtccaagagccttatcctctgagaataattctccgacgacaaggctaggggctaggaagagtgtatggctcaagtgactgatcgaagtcgcaaagtgagaaaacgctcatacacaacatacccagagtaagaaaacttagttagatagattccttttctatttcacaagtgtttcttgcaagtcatagatactccaaaatatattacatgtttctttgagatattttttacaggatacaaaaactaccaggacggccaacgccaatccacggaccgaaataccttctcggtaagcggcgccatcgactgctcaagaccatcaatctccgtgggagtcctccgagaacgtgagaacccttcgtgaaggaactcgaggtgctgctgcgggcggtgatctcggatgcaggccagcacatgtcctctggtgtactggctcgatcgacgacactcctgctttagggcctcgtcgatacgtttgccgatcccttcgagctgtgcacaagccccattcaaccatgagatatatccggctgccgactcctcgagatctctgcgaggaactcggagctccttgcagaccctcgccatcgccgtacagcagctcttgaggtacgagttgaaccatacctcgcgacctcgaagagtttccacagcctgatccttcttcacctcgatcatggtgttttcgagtttggccatctcgagcttcgtcctccaatattggattcgacaaactcggtcagccatcgtgttctcaaaatctgcctgggacgaaaaagactaagtcaagctactcttctctttcgaggacacagctaattaagtcaatccgaatacaaggagtgaaagagactaagacgcaaacctagggacgtcatcgccatattcgcctccgcggacgggctttgactgacctcttcccgcggcacaaacggctcgagtgcaagcgccggaacgaccaccggcatattaggctgcccgcgctgctggacatcctcaatatcgatatctctacaacgacaacaaagtactcggaatcacatgctaagaaaacgagggaaacgactgttcagataagagcagtttgcatccaacaaaggttttacagcatgaggattaagggtataggggaaaacaaatatcttactcttcaaaaagggggaggacggactcccccaagtcatcgacttcctccaccacacccttgcgcgcgtcatcggcggccccctgatccaaagccttcttaaggtctagatcagggtgtgccagcctcacgcatgcgaggacatggcacgccccggtgtagatcctattggacgtctcctccccaatcctggccgcatgcttggaggtgatctcctccatcgccgtagccagttccgcgagtgaggacgtcagcgagaactcgtcagggttcgccgggatggtagtcgtgacaccacactcgccggcgagttggtgcaggccggtgtgcgatatccgcagcgagcctcggatccttgacaggttgttctcgagctccgacatccggtgctcaagtccttgccgctgcctctcgttgccgaccaccagctccctcatctttaggaggttctcgcgggcctccgccaggtcgcgagccagttggtcggcacgctggtttgccgacgacgccaccaccctggcctcctcaatctcacgacctacgccgcgagcgccggcctggaggatatgctccatctccacttggagctccccccaggtgaggtcatcggtggatgggccccgagtaggcatgaggctgatgatggggttactcggtgccgcctcccggtccttagtagcgaccacgacatctgtcgaggtcgccgcaggggacgcgctggaggcagcatcggtcccaccttgcgtcgccttcgcccgcgccgtcctacgaagattttcctctctttcataaagctaagcgatcaagactccgtgaatgaaaagacttcaaaaacgtctacttacttctcgccgatcgtcacaagcctttgccttcgatgagccagaggagacgcgtctgagtcctaagtaagatgagatggtgtcaggtcaagttattccgactacgcgttaaaaaacaagagagaggcttaccgccgggtttggcgctttccgatgggtcccgagtacagaggagaatttactccccttcttcggaatgttgctgccactcgtggtagcagcggcagcagcagcaacatcggacgcctccttggcgacgccctccttcaatgacgccgccgcctgatgatccacgagcggtccgatgacgtccgtcagagggagagcctacataacgtgaaatcacgacgcgatctcgaggagaaagatgtaaaggagtcattgagtacactcacattgatcgcagcagtgcgttcggccgggcccctctcgcaaagggggatcgggatgtcgctcgcctctgagggggcactaatcatcacctggccgacgcggcgtcccacggtgtcactgtccagacctataaatcgagaacaagaactcgataagtcaggagaaacagacgcactcggagtaaagtttgaaatacaagaaaaaataccccgaggagaaacccgggtcatgtcttctggcccagagtaatcaaaggccggatgggcgcgagcctgcagcggttggatccgcctacctacaaagtcggcagcgacttcgtaccccgacaacccccgttttcagaggtcatcgatgatgtcgatgaaagactggagggagggagttagggcgggtttggcggtccactctgggattttgtctggctgttcttcaggaacaacaaggacggggtctgaattttctatctgaagataaaaccatctcgcctgccacttgctacgagaagaggggcattggaagggtatgtaacgtgacttcaggcgatcccgaagtcggaatccaacgcatccggataccctgttgggttccatccaacgcaacttgtagtaaaagcggaagagatcaaggaagggctctaccccaatgtaggcctcacaaagatgagcaaagatgctaagaaatgcgatggaattcgggttcaagtgaagcaaagaaagaccatagaagttcaagacaataagaagaaactcggaaggcagaggaagaaaaccgcaagaaatgtaatcttcgaccacaaccatgcggcccaagacgggttcgggtttaatacctcctgtctccctctacatggtcccgcgaccagggagggcaccgtcgtcctgcaacttcttcatggacgcggtggttgaggtggacttgtcaagatccatcgccgccggaggatcgccggagaacaagagggaagaagcaagctagggttttctttgcggagagcggagaagacgaagggcgctagaaggctgaagagttttttggtgaacggacttcaaatgggtttccaaaatccctttaaataagtgcactaccgacggtgcgtattccgaggaaaggagagagattgccgccggaaaattctgggtccattgcgcgcggtagttttcatacttcaatttaaattcactcataactgttgaacttcatgcgacgttgtcgatgactctttgcctctacggttctcatgccgggatcgaccagatgagaatgacaacgattccgacatcagaagttccgatcgattacatgagttcatttaagcagaagtcaggggctactgtcaaggttacggataaggtataccctctatccttggacgtacgatgagtactgatatggtatacccatgcgtatacggatagttctggtatacgtttaggaaatctatcatgtaatagaaatagaatccacggatgtaaggagtcctactcgggcaagaccgggtctttaccatatcgtgagaggtccgatatctccgagtcctacttggagatcaactgacccctagtataaaatggaccccctgggcaggacctagggcatcgaatctcaccgcgaacacattcaccacagcctacgaagtcggagcgcacaggagccaagtcgccgggagatctagtcgaaccaatttgactacggtctcgtcggtaccatcaagttttgttattccctttataatttgtgatttccattatataatcccataccaactggattagggctattacctatcaaggggcctgaaccagtataatccttgctttctgtttgcttgatgtcgtactacgtagatcctcgttccaacggaccccaataccctctatatctggtctagggtatcccccgtcgacatatatatatatatatatgggagcgtatcctatgcacacaggccctcgcgtatatacaccgtgtacaccaactaaaaattatcacaaacaattctaggaaaattcatacatgtactttcaatagtattacatctacgtgcaaagtcgcatcttcaaattcattctacatagagaataacaaaaaagataaaattctgacaaaattgcaaccttaaaactgtcagattttttgtttttttttgttacggctaaaatataatgaatttgacgttaagattttaaccctaggtgtaatacaattgaaagtatgtgtatgattttttctagattttttggtgacattttttagttggtgtgtacgtgtgtacacgtgagggcctgtgtacataggatatgttgcctatatatatagtagctctattatatacccctcccttagaataactattctacaccccctccctaccagtccagcctagcccacacctccttccctccccacgggcctccctgcctcctccccgcgcgcgcctccctccctcctggtgaccccgcgcacgcctccctcccccttttttctctctctcggtgctactcttttttttctcccttctcttccggctactcctcccaatctccctcctcattttttttcttttttttctctccctcctcttcccggctcctcctcctaatctctccatccggtttcttttttctaaaaaaaagaaaaataaattaagagaatttaaaacttgaaaccatgatctcatggttcacggaaaactcccctaaccaattcaccttatgacactaagtgattacaggttatcgtttgtttgctttatatgtttgttcgaatcagttatatttactatagaaatcgaagcttcttactttaatttggaactagcattatcgcagaagtgcttaacatggtacgttactgcgaaatgtataagtcgttactatgaaatttataggtcgttactgcacgttttgcagtaacatcatgatgaaattacagtaatagagaacatatgatagtaaaggtactactacagtaccactgcttgtgcatagctaaatttttaaatctcaatcttgtgcaaaacacaagtgctaaaaaatacttctctttgtccatacaaagatacatagtagcaagcttagtacaagtaaacttttagaattctaatctttaaacaataatatctctcacatcacatattattttttagaactgttttcaccataattctttaaaacaatgttacaacgagacaataatcctgttactacacgatgatcgagacaataatgcttttataacgttgttactacggaaagtagttgtgttactgcacattgatcatcgcgttactacgccgttctaaagagacgagaacttaaaaaaagtaaatctcaatctttagagagcaatatctcccacgttatatagaatttttctaatcggtctgcaccatgatgttcataaaaaaatgtatccatcatgactatttttcgatgttgttactgcaagaaagttgtcatgttactgcacaatgaccgttatgttactgcggaattcctgcgagacgtgaacaacgaagtggtgggcgggggagggagtcaatgggcgggtttgaccgaggtctgaccggcgggagggggttttgaccagcctttgactgatatgggagaggggatttgggccctaggaagggtggggaggtgggattggcccatgggaggggggtgtagaatagattcactatatatatatatagacacatatatatatatatactattaaactaggtataatatattgtagagtacaaactaataaattaggcaaggaagatgaattgggacctcatggttccaggaaatcaagatttgagtacgtgcatatacccactgaaatgcatattttggaaaaatacccatttctagttgggtacacacctgtctaaatgcgcgtgataaaaattgatttttcagataacatatagcttaggtaaatttaattttgaccacgtctaaattaaagtatacaatagagccgtagaacttatgtttaagtactacagattatgtattctatatctactttagttaatgtattgacatgtatctgtatatatagcatctcccacacatgcaaaactagcgcttcacttatcagtataacatagtttgaaaaatcctttcgttatatatataaccgtggctaattaagtatgcgacaaatatactggatttttcatattttggtccttttgaaaaacttatttcgcaagtagatctctagaaaaacttatcccaaaaatggtcctttttgaggcgccagagtggctggcgccgtcgttcaataggacggcgccagcctctttggcgccgtcccaccgccgacgtggcggggcgatgctgaggtggctaggggga

SEQ ID NO: 5812 - DNA, 5777 bp, Oryza sativa
cccctagccacctcagcatcgccccgccacgtcggcggtgggacggcgccaaagaggctggcgccgtcctattgaacgacggcgccagccactctggcgcctcaaaaaggaccatttttgggataagtttttctagagatctacttgcgaaataagtttttcaaaaggacaaaaatgtgaaaaatccagtaagccagcatgcaggtcaccagcggcgtcgtgatccatcggcaacttgatcggcatcgatggcgcgcggcgattagatctatgtccacagccacgttgcagcgactcgatcggtgtccacggcgcaggcgctcagccgatcggcaaagccgaaggtgacgaccaatccattggctcgctgaaatcatatggtaaaggcaaaaagcggcgctggagacatcacagcactgcttacagcatcgacaacagcatcgtccaccgtacatcaatagcatcgttctgggggtaggtactcccgttttgattttcttttctggaaaaataattcccaaaattcttaaatccatgcaaatcgatcggaagctacaaccaacatctcgcataaatctggtggtgaccaatttacccagccattcggtatttacaggttgggtgcgtctgccccgtcagcggcggcgagccgtcgaaccctcttctcaagcggctgacaccaccagcaagaggaggctgcaccttgagcatgtagctatccaggggcctgaagcgttcggggtttatacgcgagcggagcgccggcagatccaaccatgcacatgtttatacccaaatttgacacctatgattaaaataggaaagattgccaaaatttagaagtctaccggtttcctccgagtgggccggtctgactgccgtgtgttgggcggtcagaccgccggttgagggccagtcagaccggcggagtgtggccagtctgaccggcaggtccgagtccgactgtgtttcgtcaggtttcgaggtttccttgctcaggaaggcatgttttgggtttcctttagtttctaccccgagttggacgtggaggagggcctgtagaggacaagaccaacccctatataagggacatggccgattcattgtaaaaaaccaatctacaataaatcaatcgaatcgtttttcatattgcttttagttttctcttagtttatccatctttgtcggtttgcgtcgtaaaccgtccgccgccgctgccagagtgcgacatctctttgtaggtttgtcctgaaaaccttccgttttgcccacgagacgggtagttatctagaaatcggctccgctagccggtttagttattaaaacccatctagatttagctctttgctagatcgaggtggttggcgactctaggatcaccgcaagacttaaggtgctgcgatcgtgcttgttaacttgtcaaaaaagttgccaacatgatttttggcgactccgctggggaagagatccgttcatcgtcaactcaacttcgatttcgccatgatgaagccgccatccaagacggaggtggagccatccaatatgataccggtcacattggatgatttcgtaggagaagaccgcaaagctatggaggagtacatcaatgaactcacacgggagacgttgatgagggcaagcaccaggactcgtcaaggtgtgatcatcaagcccgggccacgtcctaagctcgcccccgatttggtaagcaatgatgaggtaacacaatctatccaacaacaagtagcatctacaatagattcatctatgattgcttttaaagataagttagatgcaacttttatattgcgtttgttttctttatctttgtccggtaatgcttttacattgtttacttctttaccggcaaattctattcatacttgggctcaattagaagaaaaatttcatgattatttctatactagagaaactgagcttaggttatgtgatttaacatcggttaagtaaaaatataatgaacctgtcattgattatattaagagatttagggatgttagaaaccgatgttatagcttgtcacgaccggaaataacccaacgggcgttccttacatgcgtgtattattccttgtcccaggaggcaaggtacaccaaaagttgatacaatacagagtttaacaagcggaagcgtaaatagttaatttattacatgggcggcgagggcccagcacacatgaagataaacgaaaaacaatggaagactagggcgacgaccacaggcgcttgacggcaggcacgagctagacaccaaagccttcatcatccaggaactcctcttctgggattgggaaaaattgagcaagactgagtacaaccaccgtactcaacaagacacacccacgagtgcaaaataaatgcaaaggagtacaagggagttataatataggggtggttagggtttgcagtgaacagcattaaaagacacttagttgctcaaagctatttcgtaattacgatcctagagctatacaatattattaatcaaggccatgaacccacacgaacctgccttaacccaaggcctacgatgatttggaccgaactggcaacctgaccctgggtcctagctcgtcccaagccaacccaggccaaccatttcacattttagttgttaagcgggttttaagaattaaaacactaacttgggtacattgctaggcatgcccataaccgagggcgcggctattcgaataggttatactctgatcagaggtgtacatctttacccacaagacacatcttcttcacgtgtaaccatgtgccacataccaccacggtatacggacggaagacgtgacatagtttccaacccatcctagccatagacaagagtaccgacccaaccccacctacggccggaacctccaggacaggtaggcaggactgagcccatagcagtaggacaccagccctgtgccatgacatctcgactaccgggccgcagctcgtgtagccttcatttgccctagagatgtccatcgacccccgacttcgtccatctccatccgtatacttttgtttataaccagactgagccacaaactaagccttacccactagacatgtggaagtacggtagtgctttgcaacagaggcacgagcttaatccttatagtacccaaggtacgacaaacaaaacccaaccacgcacctcgagcccagcctaaaaccattttgggggttttgaatagagggggaggtatgtgtccaattccaccataatccaaccattccatagtgtctaagtgatatgagaattcccaaagtctaaagttataaaaccacctaatgttgcctaattaaccagcgaagcatctacctaagttcatactagtggaaccataaatagagtacccactagttggggttttattttcctagggtgaacaaggtaataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcgcttttccaaacgtcggcttcaacctccacgtagagcggatcttccgaagctacagcgtctacacgaccaaagaaaaggaaaaagtattttactctaataaactccatataacaagcaggaacaaagtacaaaaatgggttcttgacttcttgaggaaaaattagagacttgaacggtccaattccgagttcaaatggccaagttatggccatttgaagtttatatgctctttaagtgaatatttgcgaatttcttcatttaaattttaatttaaaaaggatttattgcgtcagccgaggggagagcgcgcgcggaccgggtccacgggggtggggcccacgcggcagcctcacggtccacggtggactgggtgcacccgggctcacaccggccggagccgtgggccccacgcgtcagcctcactcgagggcacgggcggctgacggccgggccccacgcggcggccactcggcgcgcccgaaggcggccacgacggcgcggtcggcggcaggcggcacccgcgcccctatggtcgccggcagcggccataggcacggcggagcagcggtcgagagaggggaagggaagggggaaaagaggcggtggtccacggctcaccctaggtcgacggcgacgacgaaaaaggcggccagagcggaggaaggcggcggcgcggctcgggtcgacggggtcggcggcgttccggcggtcagcgagctcggcgtgggggtggacggggtcgacggcggtgcggctaagccggaggaggcgacgccggggcgggagacggtcctggcgagcggagaaggccggccggaggtcgtcggcgacggaggagagagagggcaacgacgcgagctcgattccggcgaggagaaggcgcggcaaagggtggaaacgggcgaaggaggtgcggggagggtttaaatagggttggaagggggagagggcggccgggagaggaaggaaaccggccgggaggtccggctgccatcaatggcgccggcgaaatttgcgtgggcaaatccggccgtttgaatgcgagagagagagagggaaaatggggggaaagggggaggggatcccggggaatgattccccccacttaattgcacgcggggacggcgggatgcggcggattcggcggcggcggcggcgcttagcgcgggcggggcggcgggaggacggggatgatgggtgggccccactcgtcaacgagggtggcgggcgggcccgcccgtcagcggcgcgcgcggggggagaggccgagtgggccgcggggagaggagagagacggggaggggactctttagggtttttctttttataaagcctttttaactttgtttatttcttcttaattattatttgtgctctgaaaattccactaaaatttatttacacattttaggcttttaggaattatacaaaaatactctaagccttatttgacttttactttgcacattttaattttttttgaggctttcacgaggattttaattattctaggcataattttaaaggatatattttagggtcgctttgggacgtgacatagcttgaatataactgacagagatttggctggtcttgcttttaatagtttaattgctccttttagagaaaaactagatggccaacaatttcttgatgttagtcaacttatgcaaagggctctcgcttgtcgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaagtggttttataaaaagaaaaatccctaaaagtccttttcccccccgcttcctctcttgggccggctcggcccagctccctccctctctctcctctcccctgcggcccatcggccttcccccgcgcgcgcgtcgctgacgggcgggcccgcccgccaccctcgctgatgggtggggcccacccgtcatcccctacctcgcgccgcacccgccggctcgcccgtgccctagcgccgccgccgccgcggattccgccgcattccgcccgccccgcgcacaataaagaggggaaaatcactcccc

SEQ ID NO: 5813 - DNA, 18851 bp, Oryza sativa
ctcctttgtactcccttgcatttattctgcacttgtgggtgtgtcttgttgagtacggtggttgtactcagtcttgctcaatttttcccaaccccagaagaggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtcgtgacaagttggtatcagagcccccttgaccctaggacgagccgtagatcccaagccttagcaatattttcgaaataaaaatcctttgtatttgtgaaaatcctctagtctctctctgtcttgctgcttcatttatcgccaaaatctgacctttaaaatgttgcttttctttttgtttttgtttgtagatggccggcagcgtcacccgtcgtggtttggacatgactggtttcgtcttggagctgcggggcatgtgcgtggccgtggggtatccacacggagtggactaccaggccaggccgcttctggagcaggagggtgacgatgcagagccccacgctgcttgggaggtcactgcagtgatcctcgctggctctcccgagcggacttcgctgacagtcaccgcgggtggagactccttccccgccgcttgccagagcgccgctctcctcgccatcggcactcttcaccagcgctacccggacgagttgcagcactcgccctaccgctaccaccctcgtcgcggaggagcccgcgaccacgccaccttccgggatgctagctcggaggatgacgctaccatcgtgcacttggcgcgcatggtggaggcgtacgacgcggctcgtatcgacttccatcagatggtgcgccgtgggatggtcgagaacaacctgaagatcctggagctgcgtcaagagaacctgcagctcaagaaggacctggacgcagtggaggcgcagctgcatcagctcaagatcgcccagggagagatctgccgccccaagcgtcgccgcgtctgccgcagcctgaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacagaggatgcgctgttgcttaccttccgtcctggcccgtcgcagcagtagacgagcagttagtaggcttgcgcgtgtgttctttctcgtttgtcttcttgttgggttgtgtggggcacggttatgccggtgtgtggtgtaactgtgtcggagcctgtctttattttattcgcctaagcaacttgaactttaatgaacccatttaatagcagtaataaatttaagaattatggtagtcgtgggtggttagctttaattgtcagctctctctgtttgctggttctgtgtggggttttcagatggtgatgaccaggagaagtgctaacaccggtgatggcaaccaacctgaaggcagcaaccacaaccatcagggcaacccacctccacctcctcctccgcctccaccaccaccaccagacaccaacgccattctcacccaaatcctcgcccagcaggccaacatgatgactgctttcctccaccacctccaaaatccgccacaacttaatgctccaccaccaccctcacaacactctaaacttgccgagtttctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgtagggacccgcatctctatggtgggaccatttccaggctacgcagccagagggacagcctattacatgggctcgcttcaccgccgctttccgaagaacccatgtgcccgccggagtcgtggcccttaagaaaagggaattccgagagttgaagcaaggcaaccgctccgtgatggagtatttgcacgagttcaacaacctggcccgttacgctccggaggatgtgcgggaagatgaggagaagcaagagaagttcctggcaggaatggaccctgagctgtccgtccgtctagtctccggggattatccggatttccaatgtctggtggacaagagcatccgcttggaagccaggcacaaggaactggagtcgcacaagcaccgcttggcgaatttccgcaaccaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagtatcaacaagggactcgtgcgccccgtcctcctccaccgactgtgcagcttggtcaaggccgcagggacgctcaaggtccgcagcgtctgtgcttcaactgcttcgagcccgggcactttgcggataaatgcccgaagccaaggcgttagcaaggccaagcgcctccccgccccaacaacggtggtaaggacgtcattcggggtcgtgtgaaccatgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcatagaaaccctctgctcatcaccacccctggaggggttatgacagcaaagtattatagccctgccgtccctatagaaattcgggggattccttttccctcggatctgattctgctagacaccaagaacttggatgtgatccttgggatgaattggttggctcaattccaaggagtagtggattgcgcgagacgcactgtcactctgtaccgagggccggaacaaccggttgttttctttgcacccccaacctcagtcagaagttcagaacttcatcagatagaactgtcagaaattcccatcgtcagagagttcggagacgtgtttccggaagaactacctggtatgccgcctaagcgagagattgagttccggatagatcttgctccaggaaccgctcctctgtacaagcgaccctaccgtatggcagcaaatgaactggccgaagttaagaaacagttggaagagctgaaagaaaaggggtatatacgtccgagtacttccccctggggtgctcctgtgatttttgtggagaagaaagacaagacaaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgcgaagaagatattccgaagaccgcattcaccacgcgatacggactgtatgaattcacggtgatgtcgttcggtttaaccaatgctcctgccttcttcatgaacttaatgaacaaagtgttcatggaatacttggataagtttgtggtggttttcattgatgacattctgatatactcacaatcagaggaagaccatcagcaccatctccgtctggtattgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcaccgattggaagcaacccaagacagtcactcaagttcgcagtttcttaggtttggcaggatactaccggagattcatcgagaacttctccaaaatcgctcgacccatgacacagttgttgaagaaagaagaaaaatttgtgtggagcccgcaatgcgagaaggcgttccaaactctcaaagaaaagctagtttcctcgccggtgttaatcttgccggatactcacaaggacttcatggtgtattgtgacgcttcgcgccaaggattggggtgcgtgctcatgcaggatggttatgtggtggcctatgcctcacgccagcttcggcctcatgaaggcaactaccctactcatgatttggagttagccgcggtggttcatgccctaaaaatctggcggcactatctcattgggaatcgctgtgaaatatatactgatcataagagtttgaaatacatcttcactcagtcggacctgaatcttcggcaaaggagatggttagaactcatcaaggattatgatgtgggaattcactatcatcctggtaaggccaacgtggtcgccgacgctctaagtcgaaaaggccattgcaacactcttaacgtctgtggcattccacccgaacttaatcaacagatggaagccctgaacctaagcatagttagtcgcggattcttggctgcgctggaagccaagcccaccttgctcgatcaaatccgcgaggctcagaagaatgatccagacatgcatggactcctcaagaatatgaaacagggtaaagccgctggtttcacagaggatgaacacggaaccctatggaacggaaatcgagtatgcgttccagataacagagaacttaaacagttgatacttcaggaagctcacgaaagtccttattccatccaccctggcagcatgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtacctgaatggaaatgggatgaaattgggatggatttcatcaccggacttccaaaaacccaaggtggatatgattctatatgggtagttgtggatcgattaaccaaggtagctcgattcattcctgtgaagaccacctatggagggaacaaactagccgaactctacttcgctaggatcgtaagtctccatggcgttcctaagaaaatcgtatctgataggggaagccaattcacctctcacttttggaagaagctccaagaagagctgggtacccgattaaacttcagcaccgcgtatcacccgcagacagatgggcagaccgagcgtctaaatcagatcctagaagatatgcttcgcgcatgtgtcctggatttcgggaagacctgggataagagtctcccctatgccgagttctcctacaacaacagctatcaagccagcatacaaatggcaccttatgaagcgttgtatgggcgcaaatgccggacaccgctaatgtgggatcaagttagggaaagccaagtgttcgggactgatatcctgagagaagctgaagctaaagtcagaaccattcgggataatctaaaggtggcacagtcccggcagaaaagttatgcagataaccgtcgccgtgacctggaattcgcagtggacgattttgtatatcttcgggtcacgccattgcgaggtgtacacaggtttcggacaaaagggaagctcacacctcggtatgtgggtcctttccgtatcgttgctcgacgcggagaagtcgcttacaaattggagctgcccgcctccttgggcaacgtgcatcatgtgttccatgtgtcgcaactcaagaaatgccttcgagtgccatccgagcaggccgactcagagcaaattgaagttcgcgaagacttgacctacgtggagaggccagtgaagatcctggacaccatggagcgcaggaccaggaaccgggtaatccgtttttgcaaggtccagtggagcaaccacgccgaagaagaagctacctgggagcgcgaagacgagctgaaggcagcccatccagatctcttcgccagttcttccgaatctcggggtcgagattccgtttaaggggggtaggtttgtcgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaagtggttttataaaaagaaaaatccctaaaagtccttttcccccccccttcctctcttgggccggctcggcccagctccctccctctctctcctctcccccgcggcccatcggccttcccccgcgcgcgcgtcgctgacaggcgggcccgcccgccaccctcgctgacgggtggggcccacccgtcatcccctacctcgcgccgcgcccgccgcctcgcccgtgccctagcgccgccgccgccgcggattccgccgcatcccgccgcccccgcgcgcaataaagagggggaaatcactccccgtgattccctccctctttccccccacttttccctctctctctctcggattcgtttggaaatcctcccgcaaacttcgccggcgtcattgatggagccgagatcgccgcgccggtttccttcccctccggccgccctctctcactcccaacactatttaagcactccccgtgcctccctcctccgtttccgacccttgccgctttctctccccatcggaatcgagctcgcgccgtcgtcctctctctccgccgtcgccgccgagcttcggttcgccgccgtcgtcgccccggacctcctcccgcttcggcatcgcctccttcggcttcgccgcgtcctcgtcgacctcgtccaccccttcgtttcgcccgccgaccgccggaacgccgccgtcctcgtcgacccgagccgcgccgccgcctctctccgcttcggtcgccgttcccgtcgtcgccgtcgacccggggtgagccgaggaccgccatctcgcttcccccttccctcccctctctcgggcgccgctccgtcgcgccggaggtcgccgccggcgaccatcggggcgcgggcgcgccgcctcccgtcggccgtgccggcgaggccgccttcgggcgcgccccgcggctgccatgtggggcccggccgtcagccgcccgcgccctcgagtgcggctgacgtgtgggacccacggcgccggccggcgcaagccgcgtgcacccggtccaccgtggaccgtgaggctgccgtgtgggccccactcccgtggacccggtccgcgcgcccctcccctcggctgacgcaataaatccgattttaaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgcttgttatatggagtttagtagattaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatacctatttacctttgttatgaccttattattgttattgttattatttctttgttcaccctagattaaacaaaacccgaactagtggacactctactcatggtaccactagtatgattataggtagatgcttcgcttttaattaggtaacattaggcggttttacaactctagactttgggaatgttcatatcacctggacactgtggaattgttggagtattgtagaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacgaccttgataaataatattgtttagttctagaatcgtgtttacaaaatagccctgagcaactaaatatctttaaatgctgtttactgcaaccctaaaccctttatggtataactcctttgtactcccttgcatttattctgcacttgtgggtgtgtcttgttgagtacggtggttgtactcagtcttgctcaatttttcccaaccccagaagaggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtctactaatgattacatcgagcatattgtaaatggcatgattctcattctcattctactaatgattgcaatgtgtttcgacgataggttcaatcggccatagatgaaggacgattgaagttcactgatggctccaagatgaatcttgatcatgatccttttccggtgaatacgattaatttcaatgataagaaggtgttgattcggccggagcaagccgaatctactaaaggaaaaggagtaatcattggtgaagcaaggcctaaaatgatagtgccaaagaaaccggaggttggcgtttggaaggaaaataggagtggagcttcaacttctaaagcccctagaaagaccaaagtgacttttgatatgcttttggaaaagtatgagaagcaaggtggtgagagggttcgcaacaaaggaaaaagaccaagatcacttcctagggagcgatttggtcattcaccaagacagtcgcattcacctccatatcatcatccacaagatatgtcatggggttcttatccaatggccaccgccgggttatccttatccttattacatgccctccaatgcaattcaaccaagggtggggaggaccgaggaggccaattcatgagcgtttattttcaccgaacaacggccggttatatggtaagaatcgggctaatgaagaaaagagggaaagaaagcgcatcaaggtggaggtaaggacttcggaagtaattaccatcaaagtggggtctcatgatgtgtcaataccttctggagatgaagttggagagtcttcaaggaaaaaatccgaggccggtaccagctcatcgcagtcggatggtctgaccaggccttctggccggtctgaccgcagccatacagccggtctgatcgggccatcaggccggtctgaccgccgacccgacagcggtccgaccgacacctcaggctggtctgaccgtgcgccaaatgtcggtctgaccggcgcatctggccggtctgaccggtggtctacgtccggtctgacccggctccagcgccggtttgataggaggtttgcaaagggcgatgtgagggcttcatcgtcttcaaacaaggttaatagagggcattatttacctcctggaacagagccggatcctaggtggatgcctaaggatttgacggctactcaaaagagaaggttgcaacgtcttcgggctcaagagataagagagaaaaaagccgaagagcaaagagataaaaggttcaatgagttgcgaccaccaccggtatggaggcataagtccatagagaaggaaaaaccggttgttgtagaggagaaggaggaacaatcggttgataaaggtgaatcatctccaaaagaagacatgaatatgaacatggtatgtatgttgcctatgcagttttgtgctatggatgaagccgaggttgctcaattctcattaggtcctaaagacacggtttttgagaagcccgatgagtcaaaccgtcacatgaaccctctctatctcaaaggccatgttgatgggaagccgatctctaggatactagtggatggaggtgccgcggtgaacttgatgccgtactcattattcaagaagttggggcgtgaggatgatgagttgaagaagaccaacatgattctcaatggtttcaatggtgaaccaacggaggcaaagggtatcttttcggcagagctcaccgtgggaaacaagacgctaccaaccgctttcttcatcgtcgatgtgcaaggtaactacaatgttattttgggtcgttgttggattcatgccaattgttgtgtgccttctaccttgcatcaatgtttaattcaatgggacggcgatgatgttgaaattattcaagcggatacatcggccgaggttgcaatggccgatgctacttttgagtggcgccatgggaatatccaatgcttatcggggagggatctttctagctacgattttattagtatctccgatggcaaatttgtatctatctctgtaaagccggctagtatagcacgactaagccatataaatttgtataatgagtaaggaggctaatttagaatggttacaaaagagggtgcaagaatatcagtctacaaagaacgatattggtgaaatcgttgaaggttttgatgaagtggagaagcttggacaagggtttacatcggccgatccattggaggaagtagacataggtgatggaaccaaaccaagactgacttttgtaaacaaaaatatgagagccgaatataaggttaagataatcgagctacttaaagaatatgttgattgctttgcatgggaatatcatgagatgctgggtcttagccgtgagcttgttaagcatcggctttcaattaaaccgggttttaggccttataagcaaccgccttgtcgttttaatcctttgctatatgaccgagtaaaagaggagattgatcggttgttgaaggcggggtttattaggccatgtcgttatgcggagtgggtttctagcataatcccggtggagaagaaggggagtcgtaagattagagtttgcatagattttagagatttaaataaagccactcccaaagatgagtatcctatgcctatagccgacatgatgattaatgatgcatcgggtcataaggtaattagctttctagatggtaatgctggctacaatcaaatctttatggcggaagaggatatgtataagacggcttttaggtgcccgggatttgttggtttgtttgagtgggttgtcatgacttttgggttgaagaatgccggtgcaacctatcaaagggcaatgaatttgatctttcatgattcgctaggtattatcttagagatctacatttatgatattgttgtcaaatcggatggtatggaaggacacatagcagatttgaggttagcttttgagaggatgcgccggtatggtttgaagatgaacccacttaagtatgcttttggtgtgtcggcggggaagttcttaggatacatggtgcatgagagaggggttgagattgattctaagaagatagaaaagattcgtgatttcaaagcaccgacatgtaagaaggaggtccaaaagttgctaggtaaggtgaattatttgagaagatttatttctagcctagcgggtaaaatcgatgcttttattcctatacttcgcttgaaaaaagaagccgattttacttgggggcaaaacaacaagaggcgtttgaagagttgaagagatatttgtctactccacccgttgtgcgagcgcctaaagccggaaaaccttttcggttatatattgtctccgaagacaaagtcattggtgccgttttgacgcaagaggaagatggcaaggatatatcattacatatttgagccgccgtcttttggatgccgaaacgaggtatgtctttatagaaagactttgtttatgcttatactatgcttgtaacaaattgaggcattatttgttatctagtacatgcatagttgcttgccaagccgatgttattaaacacatgttgcaaaggccaattctaagtaggagaattggcaagtgggcatatgctttgatagaatatgatttggcttatgaaccattgaaatctatgaaaggccagattgtatgtgattttatagtggaccatcatgtagatattgcttatgagaaagagatttgcctagttgaagttatgccttggaagatttattttgatggttcttcttgcaaagaaggtcaaggcataggggtaattttgttttcacctaatggcatgtgttatgaagcatcggttcgtttggaatattattgtacaaataatcaagccgaatacaatgctttgttattcggcttacaagtcatagagatggttggagctaagtatgtggaagcttttggtgatttggaattggtggtgcaacaagtcgccggagtctacaaatgcttggacggatcactaaataggtacctcgattcatatttggatattattgccaattttgataattttgctattaaacatattgctaggcgtgataattctagagcaaatgacttggcacaacaagcatctggctataatgtgaagaagggattatttctgatattagaggagccggtgcttgcttttaaatctttgtgcgaaattggcaaagctggggaccaggggcggtctgaccggcattgcgtggccggtctgaccggtgaccaggggcggtctgaccggctacatgccgccggtctgaccggcgaccccgagcggtctgaccggccctgtgtggtcggtctgaccggttctgggcagagcgctggggggcacgtttcaatcaatttagaggccgaattaattgtgaattcggacatttgtgcccaggaagcagaagaagattggagaattcctttgattcgatatttgaaagatcccacacttaaggttgatcggaaaattcggcggcaagcattcaaatacacattgcttgatgaagatttatatcgccgaaatatagatggtgtcttgttgaagtgcttagatgaagatcaatctaaagtggctatgggagaggtgcatgaaggaatttgtggaacttatcaatcggcccacaagatgaattggttgcttagaagagcgggattctattagccgaagatgattgatgattgcttcaaatattatagaggatgtgaagcttgtcaacggttcggcaatgttcaattggcgcccgtcgccatgttgaaccctataatcaaaccatggtcgttccgagaatgggctttggattttattggtcaaatttatccttcgtcattaaaggagaaaaggttcgtgctagttgctacggattacttcaccaagtgggccgaagccgtgcctttgaagaatatgactcatacggaggtagttgactttattttgaagcatattatccatagattcggtattccacaaacattaactacagatcaaggtgcttcttttatgtctaaggaagtgaagaatttttccgaatcttatgatattaaattgttgagctcttctccttacaacgctcaggctaatggacaagccgagtcgagtaataaaacattgttgaagttagtgaagaagaagattgaggaatacccaaagaggtggcatgaggtgctttctgaagcattgtgggtgcataggatatctaaacatggtgccactaaagtcactccttttgagttggtttatggtcaagaagccgttttaccggtggaggtaaatcttggttctcttatatcaagcaagatgatttgtcaagtgaagattacaagatgttgatgggagacaaccttgatgaagtcatcgacaagcgcttgaaggcattggaagagatagagaaagagaagaagagggtggccaaggcgtacaacaagagggtgaaagaaaagttgtttcaagttggagacttggtttggaagacaattttgcctttgggtactcgattcaaggagttcggtaagtggtctcctagttgggagggtccttatcgagtgtgcggcattgttcgagggaacgcgtactttttggagacacttcaaggggagcgttttcagcgagcgattaacgggaaatacttgaagaaatacttcccgagcgtttggcaagacgcttaggaggtactatggccggtaattgggttatcgtcctaagaccaaaaacgtgttctatgcttttagattcacgttgttcatcaaaaagataggggggcatgtgtttacacccaaatttggcacctaggattaaaataggaaagattgccaaaatttggaagtctaccggtttcttccgagtgggccggtctgaccgccgtgtgttgggcggtcagaccgccggttgagggccggtcagaccggcggtgtgtggccggtctgaacggcaggtccgagtccgactgtgtttcatcgggtttcgaggtttccttgctcgggaaagcatgtttcgggtttcctttagtttctaccccgagttggacgtggagaagggcctgtagagggcaataccaaccccctatataagggacatggctggttcattgtaaaaaaccaatctacaatcaatcaatcgaatcgtttttcatattgcttttagttttctcttagtttgtccatctttgtcggtttgcgccgtaaaccgtccgacgccgctgcgagagtgcgacatctctttgtaggtttgtcctgaaaaccttccgttttgcccacgagacgggtagttatctagaaatcggctccactagccggtttagttatcaaaacccatctaggtttagctctttgctaaatcgaggtggttggcgactctaggatcaccgcaaggcttaaggtactgcgatcgtgcttgttaacttgtcaaaaaagttgccaacagcaccagagcagaaaagcgaatacgtcggtacaacggcgccctattcttccacccatagccgggagccggcatgcagttcgtccactcgccggcggcgtgatatatccgatccatctactctgttcccaggtgacggtgcaaaactcttcgtccatgcgtgcatgggatattcccaggcggttttgcttcgttccggtaagtccattaagtttctttgatttttcttgctgatcgaaccttcccttttgttttctattagatcgatctatttctattctaatggaggatcatccaggcgatctcgcagtcatccgcagacggcgtcatcggcaacctcagttgttctcagccggcgtcattgtcaaacatacgttggtacttggtaggtcagagtgggccgggatggtgttatttcatcgttctgccgtcagctcgattccaggggtcggtgatgcccattcggatgatccctgggtgttgaatgctgcatgccatgccgttcctcattcttttctgctagatcgaattcccattactgctgctaaatggcagtatatatatggcacatgattattcatcttcgtgctgccaagccgatgataccttgatcgattactcagtatgattacatactgctcgttcttctacaatatgtactgctcttttttttttggttatatactgtcttttctacctatgatatgatatagtcagatgtatatactaagtaaaagatcatatatactgctttctttggagaaaaatatacgtactaaaagtacttgaaaaatagtatatactgctccatcgagaaatgtagtatatacaactaaaaatgactatgaacatggattaatttgtagtatgtactgacaaaaagaaaagtatgaacctagatttgtagtatgtaatggcaaaaggaaagttgtatcctttcattctaagtagaaatcagtatatctcaattcataaatcagtacatactgattacttgaagaaatcggtatagcccagctcttgaagaaatcagtgcatatccactcagacaaaaatcagtatatactcattccaagataagtcagtatatactcgttttaaaaaaaatcagtatatactcattccaatatatgtcagtatatactcattcggtcgttccaacagtatattgcagctaccaatataacacaaagtagattatactgaccaaacataaaaagtagtctacgtggtatatactgagcaaacaaaaaagcagtataaactcctttagccacgatgatgcagtatacactgaccaaatataaaaagtaatatgttcagtatatactgaccaaacaaaaagtagtatgcagtatcaaacaaaaacgtagaatgcctaatatactgagcatacgaaaaagtagtatatgtactgaccaaacagaaaagcagtatatactcattcagtccggatcgatgtagttggaaagaaaatttcaaagcaactgcgtgccaacgctctctccattaaaaaaggggagtacataacacctaggtgtacagaagagtcgtctctctctctctatctctctatatatatatctccgatgtcaattgttcgtcatagaataataataaaaaacacctttgattttacaatctcctccttgatgaacacattggcaaactcattaaaaatgttttggtgtttggaaaaataaaaacaaaagtggtaaaaagcacacttcgtacaaacgtacacatcgtgctcaaaaatccaaaagaaaacttatccccctttgtaaaagaaagaaattcccaattgaaccaacaaacgtgctcttctcaacaactctccaaaaattcaccttgcttcttctaaaaatccaaaaaattttacattacttctcccccttttggcaatgatttcatcaagcataggaattatgttcattaatgttcaaaagcttagcatacatatagcatatcaagtcatgtgttgcaataaaaagaagatgaacccatctataatataacaagcatgtattaaagtataaccatgaaccaaagattttacaattaagcttgaatcaacaatcaaaattcatgatttcaaacgatttataatgcaacatcttaacaaatacataggttgaagaataaacactaaacacatatacctattgcatttatcactctttctcaaataacctttagcacaaaataaccaagagaatttttaactttttcttttcttgagccttttttctcatatttttctcttttattccggatacgtccctgtcgtcaagacagtttccagagattcggcacctattattttgctcacatcgaatacgtccttgtcgtcaagactgtttccaaagattcggtattcattttttttcatatttttattctctttttcacaatgagcaattaaagctatttgaggaataacaattcaataaagcatatatatagagtatttacaaatcaaaccatatgctagcatcaacattgcattttttttaattcaagtatagaatttaagtgtcatgcatcatctcccttaagagcaaaatctaaatctcatgaaaaaactagaatacatacaagctatgctagagacaaataaaccttcaaagtattgctagcatgcacaagaaaataccatatgcataaacaaagctctcttttatcaatttttctcattgtcatattatagcttgataaaaccatgaggtactaattccccctcaaaacatgccaaaaggatgaattatgcccaattcaccatgaagaaaagcaaatcgattagaatccaaaggtttagtgaaaatatcagcaagttgcaactttgtgtccaaaaactgcaattcaacatctctcttctcaacatgatccctcaaaaagtgaaaacaaatatcaatgtgctttgtgcgtgagtgttgaacaggattcttagcaatattgatagcactagtattatcacaaaagagaggtactttctcaaaagtaagaccataatctttcaaagtagataaaagccaaagaatctgtgaacaacaattagcagcagccacatattcagattcagcagttgatgagcacactagattgtttcctaaaagaccatgccatcaatgatggaccaagaaaatgacatggtcccctaggacttttccgatccattttaccacccccca

SEQ ID NO: 5814 - DNA, 342 bp, Oryza sativa
cggggacactagctcccctatgtgtcattcaattgagtgaagaaacttacttgcacatatgatgctgtaaattctttcgattgcattatctgctctgattcaacaaaatttgcagcataaccctctggatcagctcctcgcctccacatccgggtaccttcaacaaagaacagctcgtaaattcctaaacgatcattgacattcagtttccaaaaatagtaaaatagcaaatgaatacaaatttaccttaggttctaactacggtaacatttaatgaaaagaaaatggcgaataagcttttgatggttcgtaactcttacctatcctacgtgtacaccgacg

SEQ ID NO: 5815 - DNA, 729 bp, Oryza sativa
tgaacctacatctatatagtatgctaatataatgcttttctctttggcatagctagcatcatgttaattaggcctggaaagcaccaggacgttcacttgcaccatggaaagaagtcaacagccttcactgtatggttatgccgattcggttttttttacgtgtctacttggtgggtaaggatcgatagggtgctccggagaggaagcattccacgaagatgctagatgaatgctccggttaaattgctggatgaggatatccatctttgctaatctctatcattagtaattatttgcaataattaatatattttgttgttaattggtaattaacttgtcaaaaatagtattgataagatataattagtctattttgttgttaattagtataaactatgactatattaatgataattaatatattttattattaattaatatgttcaatccattcttatccacccaatcaaacaagaaattggatcatcatatctattagaaaaaaactgaccatatctgtgtaaatatggatgaccaaacgtgccggggaagatcaacgatgaagatgatgtgaggccgaagggattgatgctgaaccaaaacgaacccacttatctcaggaaaaaacggcttgcactagataattatctgtagactatgtatatattccgactgctgcttgtgttggtatgccggtttgttcaacgtttacagattagggctgcagga

SEQ ID NO: 5816 - DNA, 9138 bp, Oryza sativa
  unsure (1)..(9138): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcaactattaaatttgagtcatatcttagtataattcaataaacagagaaacaacgagactatagtgaaaacatacaaatcatcaaccttcaccaagaccactttaggaaatcagaaatacaatactacacataaacagaggatgaagatccattagtgccaaggtgggccttgatttcagtttataagatgtattctcaatctcagaccaaaacatacataataaaaaatcgccaaaacactctcacaaagttatatcatatacattaacgaccattgtactgaacaatttcaggattgttaataacaagaagaagcaaggttatacttatcaccaggaagtagaacacttgcgatttgccattagaaaaagaagttgacaacatagaaaatatctgtgaattttaatctagctatgagaattcctacaaggcagtttgaacaccacatgagtagctatccatgttaaccaaaaatggacaggtagaagaacacctcaatacctccaagtgtgctagtttattcctcatagtgcataaggacctcccggctgactgaaaatctaacttaggcctcaagtgtgctcatgtacaacaggcaaagtccatattaatgccttctatcctaccaatatgcatggaagctatatgtatataacaaattatgcaccaacactacaaacaattcatctatcaaatgtgatacgagaaaaccgatgccaattatatctgcaaaaaaagaaagtgagtagggcaaaatcatgtgcacaagacatacttttaaagtcgtgacgttcattggggtccatgttttagtttgcaaattccaatagctctgcatccatgaaactgctgcaaataagagcatggtcgcttaatttttcaactttgccagaaaatgaaaaaaaatcatggtaaatgactactaagcaaagaattgtgatctctaatgcattacacgagaataatatttgacaataacactattgattgtagggagtactaactttttgaattcactcctagcaataatatttgacatcaggagtattaacttattactcccaatatcaaatactgttgattggaggaagtagtctttttaccaagctctctaccaaatagctttagccttagtggcactaaaataggagaatcattcattgataaaaacactaaaaaacggttgcagtttaggttaactacaacaaccatttacctgctcctcacaagcaattcagagtgttccactcacaacattttagagatagcaacaatagcattagagatggtactgctttaagtggataatcatttagagatgatactgcttttagatataggaacaatagaattgagcatatagtgaaattttcggagtgcaataagaatctaaagaagcaaattgctaatgttaagtggtcaacattgagacattcaaggtaatttatcagatggatggcatgtactgctgcaacaatgatcacacaacgagcaaacaaaacctgtcaaaaaaattcgtgtcaactaaatttcatatgcagatccaaatttgaaacctttttgtagtaaaaaagttggttttaacaaccccctccctccctccctccctcccattttagttatgttgcattgttgcatattacatgatatgacctttaaatttccttgagggctttgacacttgtaggtcggtttttttctagggatgaaaatggccacggaaattccctgccgactgagtgtcgtttcatatcattggtacctttttgaccgttgtcctttttagctacatataaacaatagtttaattgataaatatggcctgttaccaactgaccgagggccatttccgtagagacagtaccgattccggctgttttgatcccttgttttttctacccggttttgacaccctattgttggtgtaataatctttgtaaccactctcctaaaatattaatgaaatttagttggccttgtccttcatctaacccagctaatattaattttttttctacattgtggatgatagctctgtccatgtcccatggaggaaagccgaccacctgaagcaggtgcagttgagctcctatttctcagtcaccacaggtgggagatgtttagtgaacttgtgattttctttatgtcggcagaagcagaaacagacaactaaatgatcatccatggcggttttaacgtctccatcaagagattctagtgggctagcagatgtctactggtaatatggtacaagcatttatgccaaaaaaaggatgataatataagcatatggaatatgtgataagataatgcctgaaacatgttctgtgatacctgcacaagattggccctgtgatcaaccatattagacctcgactctaaaactttgatcagcagaatccgaacaaaccgatatctctgatgccttgtcaaggccattcgacttgtatggagcgacatgatttgaggctttgagtggaggggtagatcaattcattatgtattcattagtacctgcaaatttatggtattagcactcagctatagctacaattggaaaagtccattatagtaactttctatatttacatgtggagtgtattagcacatcagaaaggtttatgaaatgcttaactgtatccaaaacctcagcttgagtaaacttctaaaataccctttcaaaaaaccagaaagcctctctaactgctattgctgatcctacagttttttgtttttcttcagttccttgggatgccatctatcctttcatgatctcattccaaacatgtgaatccatgcacccctgcctaaatttttcatcagtgagtaatgaaaacaacgctaaatataacaaataggacattccaagatagatgagttatagcctaattaggtttcaaaaacattcttaaaataagtaggcaaaagttctcgcatgccaacagatatttttgcccaactaccactgaaatgatccgactttttttttagaacttgaaatgacagacttggtagcatatgtccatctgatctcctctataaactaaacaatacatggcgggagaagagtagaaaaggaaggctaactaatctaaatatgtggttttcctttactgcttgagaacagtcattagtatctctcacattatggaggaattaaaaaaatgtgttgaggcctaacagtgaatgatcctagataataatcagacaactccacaaaaggagagacgttatgtgttttattagtactatattgcaaaattcgtaacccgttcaaaaatatttaacataacccaatgagagaatggacaattagaaaaactaagaacaggatgtggctaacaacatgacatcggttggtaaaaaggtcaagctttttaataggagtgggacggaaggaatggattatatttggctgcgaaatcaatcatgttgatacactgaaaatctagaatagattagaggaagaagatgctgacagggaggagctgcaagaaaaaattaccatgaaactgatccttgccgatctggctatccctacgcaggctgaacatgtcatcgacattaaccgcctcgcagtcggcgtggactcgcggcagccgcaactgtcatcgtccattggtcacagggacagcacggcccctccatggcgcccgcagtcccctacggcggtccaagcctgcagtacaggctggtcgccctcgccggcggaggaggctggatgaccctgctgatgatggccagtcaaagcatgtggccccagtggaggttgagccgcagcaggaccgtcctacccccgatgagaaaagcaaacgtgcttaggaataaaattaacagaaggacaaaaaagctttacctgcagctccttgaaggtgatgttcatgtttagccggttttgcagtaagctcactatttcaccagcacgtcgttggggcggttgggctgagacaaaacacaaaaaacatgcacagttcatgtcaagaaagttgcatatttggagcatattctgcgagaaagtaaaaatgggatcacggaggacatggtcggggtccttccaagaagttcctgatggccataatcttgctctccagcccaagctgctcggtgtcaagctcgtcggctagctcctgtgtgccaccggcttccacgtcactctgcaactctactcctctagagaaagccggagccgcctggcgacgtacggtcctcctcttctcgacgcaaccactgccttccttggcgccggctccgtcaccaccgccgtttcttcgatggcagccgcaacggagggtggagcaccgaccgtcggcgacggcggcgaagcacgcagcaggggcggcgggctcgtcagcaacggggcgaggcggtggcggaagtggcggcgctcggcgacgacgacggtggtgacggaggcggagatgctgcccggcgcacgggggatgtcagatccccgtcccccgaccacatgggggccagatccggacgctggtggccagagacggcggtcggcagggacggagggaggcgaaggtggaagtggcggcgcgaggcgacgacgctagtggaggcggagatgggtgcgctcgccgacggcgacgatgcgatggggaggctgaggcgctgggagacgacggggcgacagcggcggcgacgacgcaatggggaggctgaggcgctgggagacgacgaagcgacggcggcggcgatgaggtggacgcggcggcgcgaggggaaggcagaggcgtaggcggaggcggaggcggaggtggtcgcgcgggacggaggcggcggcgcgagggggaggcggaggcggaggcaggagagcgagaggatggggacgagtgggaggaggcgagacggaaggcggcggctagggtttgggggtgggtgggctagtggggatcattatgcaaaaaatcccctcgactttaagattgtacagcgcggtcccgattcgcgttttttctctcccacgcacggaatatccggctactacaagggccttcacgtaaaacatcggctcataggaactgtttgctaaggacccatattgaattatatataaatcggagggatttttcgcaaaatttccaccgcgcgcctcaatcccagccgcccacgcctgatcggacggcgggaggaaaaaggggcgacgtggcccgcaccaacatcgccccagcccgcgccccttaataatatgcgattcgccactttccatatataaaccatatagcaaaatcattcatgaggtctatccactgggcattataatttttgtttttcatatttgtatcaatgaactgcacaaacaaatttatattccctccagtataacaataattgtccttttttaatcattttccatggtattattggtcatactttgacaataactttataacaaataagtttgagacgattgtaacaaacttcatacttgttaattatcattccagggtttttgtttggcaaaatttggtaccacacattgaaaatttgtggtttttgcatgtagacatcacaaaaatatagaacggtctgagtacatcctaaaaatatggtaatctgctgaaggacggtctgtcaattattttattatttttagcctatacaagaagagaaatgtttcgaaaagacaagattaccctgccacccgtgaagaccacccggtctggtctgtttcaaccattcgatcgattcccatctcctaacctctctctgggcctcacaccccaagtccccgatcctaggcagtggtaagggcttcaacaattgcgagctgatggtagctcttatctaagagctaactcttcacatacattaaaataaatgcactaaatgtatatgcatgagaaagagagaggagaagaaaataaatacaaagttagagcccatctactatacatactaactctaatatgatcttatagctaatatttggctctactgttaaacttgctctaattgcttgggagggcatgtcatcacctattgcacgcaatggcttgtcgagacccctcatcttttaataatgtgtgcacaatgcatgactagtgacaacataatagtggcccgctgttggtatttattatagtcttaaataaatccgcaagaacatggatactgaagtagcacttcactttagagtattccaagggtatcaaatcacagggaacatgtgtgtataatctaagaacaagattcaaccaaggacaacaactaattgggatgcttaggaaagagcggattcctatgggttaattaagttaagttaaaactctataaattgtttcgaacactggcttactcctgatcttccaaggagactccggcctacagctctatgatgtaccgaacgtggagaattacaaaggacagatatggctgttaccacctgccatcaacttctacaacccgtggagcacacaacaaacaaacgtaaactccagccttaacaccatgtctacgctattgattattaccccaatctcgatgtcacacttacataagattaaggtactctaagtacagcgatgaacctggaatgatgagaatatatcttaattacttaaataagaaaagttaattccaaaggagatcacaaatacttatgtaaaagaagcatccaacgaggtacaagatcagagagagagagagagagagagagagagagctgacatcttcggcactcctctagaattccttggaagaatgtcgacatccctagcactccttcggagagaagtccgacatttggggcacgcatgcacgcttttcaaactgctaagcggtgttgcttttgcaaaaattttctatataaaagttgttttaaaaaatcatgttaatctttttttaaaaaaatagctaatacttaattaatcatgcaataatacgtgcttcattttccgtgntagggaggagggattcccaacccctcctcccgaacacaccctttgactgtgttcttcccccatttttcccaactcacctctctcgttttctgcgtgcacgtttcccaaactactaaacggtgtgcattttgaaaaaaaaatctataggaaagttgttttaaaaatcatattaatccatttttcaagtttattttagataatacttaataaattatgcactaatcaccgctctgttttgcatgttgggagtgagggttcccaacgctcactcccgaactcagcctaaatgtgtaagtgagttgcactccacttgttgtgtaattttagagtgtagtgagctccttcttttatagcctccttaagtcggttggaaggtcggtaactgccggtaatcaagcataaccacctttggggcttcaggatcttgctccacgcgtcggcagatggcaaggggaggcaaaggtggttcagcataccttgggttcggccaaccccattggcccacctcccagccaatccttcagctgggaggctgcctggtgggccccctacaagttgtaccttgtatgggctcaattgtaggcgattatgattgacatgtagggcctccaatccgtgtactcacgtctgattgtctagatatgtattttgtcgcatggcgggttattttcgtccataatgcacccacgtacaaatattcaccaagacttgtggaaatggttagtaataagcactacctctaagtttagtattctactttgtattctttcatttgcatttgtgcatgaattgatggttggaattggtacttaaggaccgtcaacaacaccatcacattgagcatttacttgtccctgagtaaagattattgattacatcagagcaatgaatccctttgtaatgatactggtataataattatttcaagtcatacctatacttgtgaatcttaaattgtctaccgtgtcatcttgggtgattgacgaatggaacgaccatgattcaagttacctccacttctcctgatgagtgccatgggttttttcctttttctcataaaaacataactttaatcctcaattgattctcttgaatcactcaatgtgtatgattattcaccgagtcatagtgttgacggtcattaagtgcaaacttttaccatcaactcctgcataaaagaaataaaatataatttcaaaacttagtggaaggggtttataactaaccatttccactagctttggtaaatatatgtatgcaggtgattttcggtagaaaacacacccaccaagtgatagaaggaacctccggacaatcagacatgattacatggattggaagcctcacatgtcaatcaaaactacctacaattgagcctaaccaaggtataacatgtagggggggggggcaccaggcaacctcccagccgaaggagaggccgagaggtgggccaaaaggttggccgaactataaggtcgcccgaacggaccttggctcctctcaccatctgcttccacgtgtatgctcttgatgactccccaatggcggttatgaaggtttcatcggcagttatcaccgatgtaaagcattgtaattatgagctacaaaaggaaaaggtcttcgcactctcaaattgcacaacaaagtagagtacaactcactttcatatcatggtagctactttagtatgtgggattaggaagagagtgagagaaagctccggaaggtgtgtcccaaatatcggagttttctccgagaattcttccatcagagtgccggagaagcgcatgagttgctggctttcttctctcgcttgtacctcggtggatgcttcttttaaaaagtaagtattcaagtttccttatggtatttaattagtttatttaagtgagatatattctcatcggtgcgggatcgtcgcttagtatttatacttaatgctctagtactaacactctggataaacaagatagttcttggccg

SEQ ID NO: 5817 - DNA, 13454 bp, Oryza sativa
actcatcatgttgtcctttgatagaattctgttcgtagaaagtatatgcacgttccttatatttgataccctggaatactctgtttggtttgggctttcttccaaaagccggggtaatatatgatcttttatcgaaaaaaaatgatggagatcacttggcttttttggatgtttatcacttggctcaagcacttccccaaaactatgtcaaaatagtggtgtctgatcacatgttagttgaagtaaactacaatccgttgctagagccaaaaattggggtcaatcgtgatgatgaggaaaagggttaaataatggctgtcaccatggtttttaagaaccagcagatatgtatacacactcaatctgcgcagttttgatagggtaatggggtgaggatagctatattctcagcctctctcagagcatctccaataatgctccaaagttgaagatgatagctaggaatttccgatatttcaaaatagcagatgccgttgtttcctttaccacatgtttgaataaagaaataaaaaaagctcaagaagtatggatatctttcccacgaaaggatatatatatatggaccaaaccatcaagcagtacatatgcaggcacacatatttggggacattcataggcgtattaatggtcttgacacttcagcgtgtgaagatagggccgtggggtggaactggaggccatgcttgggatgaaggaggccatggtgccagtgctggcagttacaccggagtacgccgaatgagtatagggtcttcctggtgtgtcagctcgatgttgtttgaatacgacgacaatggcaaacgtgtgaaaggtaccctgcatggagagagagacaatggaatacccgaggtatgtagcaagcaatacttgatagatttgtgatcttaggatttaggaagtgattttccaagtgaaaacaatttctccactccttataggatctactctatcttattagaaacttatatttattactgccatgtctacccaaaatctaaatattttttgttgaaaattgattaggcgccaccaacatctgacgtcatcctattcgtcgccctctctgggtggcttttagttaaccggtacctataaattataggtacaagtttttctaaaaaaaaccgacacatatagtatttgtgttgattttcctctacaaccagcatatatagttacccaaaggtgacgtttctgtaacttttttcatcctgtggaggtagggaaaggttcatatgtgccggttttaaatgaacggacacctatgagggttttgcagtaatgatgcgctaagggttcagtactgtagctgtagagaaagaaactattaacttaattaccttcagtggaaaggtgggtaaattttacaattaatataccatttaaagaaatgcccacgcaaatgaatggttggattttactcacaccagtgccccttgtcacttgtaccgtgtatcgtaaaacaactcctggtaacgacgatgggcacagatcatgaccaatttattaaagcccaaggcctctgcttcttgcttctgacaatctcataaaggttttcatgagcggtgaaccggtgactagttcatttaatcatgatctaatagaactcatcaactagttgtattatagaatcagtagggactcttctttaatcgtggagttgtattaatttttccactgttttagttatgtaaaaacacagacaaatactcagtcgtcgattgaacggtttaatttgggagaaaattaaaacaaacagcttgcagagagatgctttgtactaattaatcactgactgacaaataacctgatgcatggacgcacacaggaggagctcgacttccatggggaggtgttgacgcacatgtgcggctaccatgacaaccacctcatccggtggttgcagttcaggagcaaccggaacaggacgttcggaccatacggcaatcttctagaagaccaggctggatggacgcggttcgaggtctccatggagcactcggggtccatcgtcggcttctgcggccggagtgacgacttcgtggacgccatcggcgtctacgtcgccgtctggaatcccgagaggttctatgatagcatgcgcaggcagggcgtccgcgtttaccgggcgtcgcctctgcgcatggacctgcgtcaaatagaagaagagaaaaagaaggaagaagtggaacgtgggcgcctacagaaggagctcgaggaggggcgagaaagtcttcggaacatacgattgaagcttgatatgccgccggatcagagaaaacgcctgatacgacgcgacctgcgagtggagcatcaagaaatcgaacgtcagttacaagagatgcagcaactggaacgcgagcgtcagcaactggagcaacaagaaatcgaacgtcagttaccctcgcgtcagcaactggagcaacaagaaatcaaacgtcagttacaagacatggaacgcgagcgtcagctacaccggtggagaaactttgtaaccggtggagaaactttgtaaccccctttagtcccggtttccaaaccgggactaccaatccgggactaaagatcgctatctttagtcccgggtgaaataaccgggactaaagatcgatctttagtcccggttggtgttaccaaccgggactaaagatcgagctgacccatttttttttttacatggccctgttgctgcatggtttatatatatatatatatatatatatatatatatatataaaccatgcatatatatgtttcaatacatatatatgcatacatatatatatgcatatatatatattatattatattatatgtatatacatgcataatatatatgtatttatacatatatatgttatgcaaatgcatatatatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatacgaataaactatatgaatgtatgaaattgattagtaattaaacaagaaatcgctacgtaatgaaattttgaatttatttatacgtacattgagctctcttgtggtgatgatttggtttgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagacttttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgctgtcgggccctttgaatctccattctacaacgataaaagggagtatattattttctatagtctacttatatacaaggacctaattaattaaaggagacgtatagtaaaaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcctagggaggatgatgtaccgcctgcgccatagaataatggcatggcatgtgtctcgtagatgcgtctcaccgtctcctccagggtaatccagctcgaggtcctcgtacgcgccttcgaccacctcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgagctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaaccgtgctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccctactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactagtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattagaacactacacaatcttatatgataagtctaattacaggtctaataatcttaattaattgcattacaaatataacaatcatttatattattacgtcacttgcctgctccaattccttctaggactagctcttccactcaggcttgacggacgactccgacaacacgtcttttctgcaagatacaaaaagatgtattaggataaatgcgaagtaacatatatatatatatatatatatatatatatatatatatatatatatatatatatatatatatatatatatatatatatatatttcacgtcacgttccgtcctcgttcgttcgctcgttcacgttccctagctcgttcacgttcgttcgctcgttctcattcacgttcgttcgcttgttctcattcacgttcgttccctcgttctcgcttgtcttcgttcgatcgttctcgttctcgctctcgttcgttcgatcgttctcattctcgttcacgttctcgcggcaacgtacgttgacgtgttcgttctcgctctcgttcgttcgatcgttctcgttctcgttcgttaacggtggtgtggcagcatcggggcggcggttggggcggcggcgtggcgacggcggcggcagcgtggcgtgccggcggcggcgtggcgtggcatggcggcggcggcgtggcgtggcggcggcggcattgcgcgcgcggcggcgaaaggcggcggcggcgtggcgacggcggcggcggcgtggcgttggcatgcggcggcggcgaaggcggcggcgtggcgcgtcgtcgtcgtggcgcgtcgtcgtcgtggcgcggcgtctcgtggcgggcggcgcgacggagagagatcgagatcggagagatcgatcgagatgcatgaaggggagatctggcggcggcggctctcaccccagagatgcggcggcagcggaggaggcggaggcggaggcggcggcgaggacgacaagctcgagacgatggcgagatacggcggggtcggcgcggggatttgccctaggcagtggcggcgaaggagagaggccgagagagatcgatcggccgaaaacgtctaagtgttggtgaagaagacgagggcgcaccgggaatatatatacccccggatctttactcccggttgttgagaacaaccgggactaaatctttactcccggttgttgagaacaaccgggagtaaagaaaagatatctttagtcccggttgttctgaacaaccgggagtaaatatcttttcccgctatttcgaaattctttttaaacccggttggggttaacaaccgggactaaagattatagcactgcatatgattttcgcttacatatgtgtttataaaatagaagttaatgcattaacattatttcaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttcaaaactgtaatgaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgtctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgcgctctcgtgtagaatgtgtacccattgatctcatatccctggaatgtcgtgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaattggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacctcttcagaacgcccatgtacctctcgaaaggaaacatgttgtgtaggtacataggcccgagaatacggatctctttcacaagatgacaaagcagatgcgtcattatattgaaaaatgaaggtggaaatatcaactcaaaactgacgagacattgcaccacttcattctgaagggcttctaatctatccagatcgatgactttctgcgaaattgcgttcatgaatgcacatagctttgttattgttgctcggacattgtctggaaggataccccttattacaactggtagtagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctagctggactcaagtaatggcttcctttctcctttggttccgggtgaaggtcgccgtgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcatgaccatcttcgctctctataggctggcttccaggcccctttccgaatactactttaagatctttaacaatagcaaacactgttttcccgttgcgatgtttaggcttcgtacggtggtcggccttatgttcgaagtgcttgcctttcttccgtaccgggtggtttgctgcaaggaatcgacgatgacccatgtatataaccttcctacagtgcttaagatacgtactttctgtttcatccatacagtgaatgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttctaccagtggtcttaggtacacgtcgatgtcgttaccaggttgcttggggccttgaataataatcggcatcattatgtacttcctcttcatgcatagccagggggggaggttgttgatacacatcgtaacgggccaagtgctatggccgttgctcatctctccaaaaggattcatgccatccgtactcaaaccaaaccgtatgtttcgtgcgtcctttccaaattctttaaattttctgtcgatgtttcgccactgcgaaacatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcatagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaagttatgggcctccttttcactttcgcagtcctccctggcgtcctgcaacatttgaccaagatcattcgcaacgtcgttaccattagcagctatttcctcctcgcccgtttgatttccttcaaatccaacatactgagcaaagtccggaatattgtcgtcttccacttcatcttcttccatttcaacacattgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagtgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgcagcttgctcgggcagctggaggaggaagaagacatatatataggggtgggactttagtcctggttggtagcaccaaccggggctaaagatcaccgggatctttagccccggttggtgctaccaaccaggactaaagtcccacccctatatatatgtcttcttcctcctccagctgcccgagcaagctgcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgtttt

SEQ ID NO: 5818 - DNA, 20358 bp, Oryza sativa
gactaaagatcccgggggggcctgacaggcccagacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagattgtttctccaccagtgctactatcgcaactgatacgctcgcgtcagcaactggaacgcgtgcgtcagttagacttagacttagacctgaaggcaacgagtagcttccctttcatgccgcggtgaatccggaagccgatcaaccggtcaccccggccgacccaactctatcacgcccaccctcgcctgggtacgtcggctagaggaaagctacactacaagcctagccgttgcccatgctggcttgtggtaagtacgataagttcttccagggcatcccgcgaaccggtccttaatcgccatgggcacaactagcaaaaccatgcacccacaacccaccatgtagtgtattttaattaactaacaccattgcggtggcactaatccaaagctatgccaataatcaaagtctagacattaatgtgatccccctttgtgtactagttaaactaagcatggctaagcattccctaaaccaacatctaagcatttcaatacccaagttaccaatggcgtaagataaacaatatatggctgagtagtaggacccatcccccatgatattgtaaaccaatgcaacatttaatagaaatgcgggacatttgtaaattgggtacaatatgatcaattgtaatgcatgacttgccttgctctcgcactgatggaaccacagcaacgtcttcgaggaaccatggatcgacgaaacggccgaaatctacgcgacaaacaaagcacacgagcaaaacatgctataagtctactaaaataggaaacaaaactatttttaatggattctatacatttttatgaatttactaagacttgaatggacttaaacggagctcggatgaattagatatgatttttagaagataaactgtgtttattactataacaaaaagtacttaaatcatttattgcgcaatatgtcccagggctgacgtcagcgaggggggctccgacatgcgggccccactggtcagcggcactaagagagggagagggggcggctggcaggcggggcctaccgggcggcggctgaaaaaaagggagggcctgccgggctaagccgggcagccggttaggcgatgcggcagcggcgagcggccatcgacagcggcgatcggcggtgcgagagacggcggtggccggcgaggagacggtggcacacggctgaagcggcggcgcggacaggaggcggcgacgcgcccaaaggcggcggcgcacacggggaagggggagtaaaagagggggagggagtccttaccagggattcagtcggcgtggctgaagacaacggcggacggcgacgacaagcggcggacggcggggcgcgcgggatggacgagacgggcctcgatctcgcgaggccaatggcggcaaaggagcggcgcggcgacggcactagcgatggctagcggcggttggaggcggcgttaggcggcggcgcgtggggaaaacggtgcggtggcggcgcgcggcaagcgagcggtggccgggatagctcccgcgacggcgaagctagcggaggtgacggcttggcgcggcggcggcggctctagcagtggcggtgcgcggccgaggttcaacggtgaccggcggagctcggttcggagtggggagagcggcggaggacactagagagcgcggcgagcacggaaaaagagagagggaggctcggggtggcgttttataggcacgagagaggcagatgagggcgggaaggtggccgatttggccggcgacgtgagagatggagagagagagtggggagaggattcgaaattcgaatccaccccttttgggcgcgcgcgcatgggcgggagtggggtggcagagggcggcaacgtgggcacgggcgcgaagtggggcgcgaggtggagcggagaaggggggcggcgtggggaggtggggcgccagcgagctccaaccggctggaggtaagggaagggctgacaggtgggtcccaccagtcagcacccgagagggagagggaggccgggtgaacttcgggagtgggagggaggagcgggccgacgcgggaaggaatgggccgacggcccaataaaaggaaaaaggaggaaaaaaagaaaaaagaaaagggaaaaaggattttcccagggatttaatattgcactttgcttattttaattggttaaaattatttccaagctcagaaaattccactaaaaatcctgttagcatattttgacatgtagaatccaagaaaaattccacatgccgatttcgattattatttgcatttattaattagggattcatctctaggttaaattaaataatttctttggacgatttattttatggattttaaagcagggaggggaacttcagggcgtgacagtgaagcacgtcttttgatgtacgcaattgtctatcgacaacagctggcgtcgaccgtggggatgaagcatctaggcccccggtgttaattttggtaattaatgacaagtgctaattgtggactaaccgttgtctttgagataatattttaagttaggtccacatcatgtgtgcacatggatgacgatcggtggattaaaattgacggcgcaaggcaaagagaaagaagacggtaaaactagtgctttaatttagaattgatcgaggtgtagggcgatcaaatttgctagtttatttctagtttcgccgtactattaagaggggtaatgacctagcaaagagatgattttaattgccacattaggtcattgcattatcacttgtgctcactttttcatcacacacacacattcactggattcggcctgaccaggggcggtcagaccggccacatagtggcggtctgaccggaatgtcctggccggtctgaccggccccaagttggcggtccgaccgtcccataaagtcggtctgaccggcggcacatgcccggtcagaccggctccctggagaccgaaatggtgctcctcgggatggccgatacagagccgacggagccgtagtcggtcagaccgagccgatggcggtctgaccgagcctactccggtctgaccgcctaatcaactccggtctgaccgtctaggccgatgaggccctctgacaacgctacaacggctagttttctagccgttgcagagtagcacggtctgaccggccacatacctccggtcagaccggcagagcacaaagttggggggatttcgcccctaacggctagttttggtgggtgggagtataaatactcccccaccagcagcaaggggactctcttggcacccaattcaattgcatacaccccttgcacctctctcacactcatttgagatttgtgttcatccatatagtgttagagggttgattagccaagagtcaagtgcatttgcttccattgtagagctagtgtggcacttgatcatctccacgtcgggtcattgcttgttactcttggaggttgtcgcctcctaaacggcttgtggagaagttgcccggtgacctctccgagaagattgtggaggaggcccggtgccggtttgtgagtggtttggagttcaccaccttcggagtgaaggaagaactaccctagtgatcgaggcttgggtagtcctctccgtgggccggctcccgccttgcccaccccttgacgaagggggcgtgcggaagcttcgtggttgagcggtggagttgggctcgcctcaacggggagtaggaaaccggcgagtttccgaacctcggtgaaaaatctcttgtctccttgtctcatttgattgtcgcatttacttttgtgcaatttacttttctagagacaaacttgagatcatatcaccctaggattgctaaacattgacataggagtgtgatttacttttctagagatatatttgagccactatcaccctaggtttgcaaaacataacttagttgcttagttagagttgaccctcaccaagcctagcaacttaggttagttttgattaggtgtcatttagttttaaatcgcccattcaccccctctctagtcgacatctcgatcttacaagtggtatcagagcttggtctctcttgattgggcttcaccgcctagagagaagatgtcgaacgaggtgaaccacgtagggaaggctcccatgtttaatggcacaaactattccacttggaaaattaaaatgtctactcacctcaaagctatgagcttccatatttggagtattgtggatgtaggctttgcaatcaccggcacgcccttgacggagattgatcaccgcaacctccaactcaatgcccaagccatgaatgctttgttcaactctttgagccaagaagagtttgatagagtgagcaaccttgagaccgcatatgagatttggaacaagttggcgaagatccatgagggcacaagtgagtacaaggatgccaagcttcacttcctcaagatccaatatgagacattctccatgttgcctcatgagagtgtgaatgacatgtatgggaggctcaatgtcattgtgaatgatctcaaggggcttggggccaactacaccgatcttgaggttgccaaaaagatgcttagggctctaccggagaagtatgagacccttgtcaccatgctcatcaactctgacatgtcaaggatgacaccggcaagcctcttggggaagatcaacaccaatgacatgtataagttgaagaagaaggaaatggaggaagcctcaccttccaagaagtgcattgctctccaagctgaagttgaagacaagggcaaggtgaatgacgtcaataagaacttggaagaagagattgcacttcttgctagaaggttcaatgatttcttgggaaggagaaaggagagaggaaagggctccaactcaaataggagaagaaataaaagacccaataagactctctccaacttgaggtgctttgagtgtggtgagaagggacactttgcttccaagtgcccttccaaggatgatgatggagacaagtcatcaaaaaaaaagagtggaggctacaagcttatgaagaagctcaagaaggaaggcaagaagattgaggccttcatcggggaatgggactcaaatgaggagagctccgcctcttccgggtccaaggaagaagatggtgatgatgcaagctccaagaagaagaagatggccgttgttgccatcaaggaggccccatcactcttcgctccactttgtctcatggcaaagggctcctctaaggtaacatctcttagtgatagtgagagtgatgatgattgtgatgatatttcctatgatgagcttgtgagtatgtttgaggagctccatgcttatagtgagaaggagattgtcaagttcaaggccctaaagaaggatcatgcttctttggaggttttgtatgaggagctaaagacttctcatgagagactcaccatttctcatgagaagcttaaggaagctcatgacaacctcctttccactactcaacatggagctctcattgatgttggcatatcttgtgatttgcttgatgatagtgctacttgacatattgctcatgttgcatcatctagcatttctacctcttgtgatgatcttgtggatatatctagctctagctctagctcttgtgtatctatttgtgatgcctcacttgttgttgagaacaatgagcttaagtagcaagtggctaagctcaacaagagcttggagaggtgcttcaagggtaagaacactcttgacaagattttgagggagcaacggtgcatccttacaatgagggacttggattcattccaaagaagggtaagaaaccttctcaccgtgccactcgttttgtcaagagcaatggtaagtattgctccaagtgtcgtgaggttgggcatttggtgaatgattgccccggtggtaagcctcctaagacatgcatatttgattctcattatatgcttaggaagattcatgatggtagcattgttgctagatatgtgggttcccctatactcggtggtaaaaagaatgccatttgggtgcccaaagctttggtctctaacctccaaggacccaaacaagtttgggtacctaaaagagcttgatcttcttttgtaggtgaactaccacaccggtgggagccattgggtgcttgatagtggatgcactcaacacatgaccggtgatagggctatgttcactacatttgaagtaggagggaatgaacaagagaaagtgacatttgtagacaatagcaaaagaaaggtaattgggttaggtaaaattgctatctccaatgatttgtcaattgataatgtctcttttgttaaatctctaaatttcaatttgctttcggttgctcaaatttgtgatcttggcttgtcatgtgctttcttcccgcaagaagttattgtttctagccttcttgacaagtcttgtgtgttcaaaggttttagatatggaaatctttactttgttgatttcaattctagtgaagcaaatttgaaaacttgtttagttgcaaaaacttctttgggttggctttggcatagaaggctagcccatgttggcatgaatcaattgagcaaactttcaaaacgtgatctagttgtgggcttgaaagatgtgaagtttgagaaagataagctttgtagtgcttgtcaagccggcaagcaagttgcatgttctcatcctactaagagtatcatgtccacatctagaccattagagctcttgcatatggatttgtttggcccaacaacctataagagcattggtggtaatagtcattgtcttgtgattgttgatgattattctcgctatacttgggtgttctttttgcatgataagtctattgttgccgagcttttcaaaaaaattgcaaaaagggcccaaaatgaatttagttgcactcttgtgaaaattagaagtgacaatggttccgagtttaagaataccaatatcgaggactattgtgatgatcttggtattaaacatgaactttccgctacctactcacctcaacaaaatggtgtagtggagaggaaaaatcgtacattgattgagatggcaaggactatgcttgatgaatatggtgtttccgattccttttgggcggaagccataaacaccgcttgccatgcaaccaataggttttatttgcatcgtctcttgaaaaatacttcctatgagctaattgttgggaggaagcctaatgttgcctattttcgagtttttggttgcaagtgttatatttaccgaaagggtgttagactaaccaaatttgaaagtcggtgtgatgaagggtttcttcttggttatgcctcaaatagcaaggcataccgggtctacaacaagaacaaaggtactgtggaagaaaccgccgatgttcaatttgatgagactaatggctcccaagaggggcacgagaatttggatgatgtaggtgatgaaggcttgataagagctatgaagaacatgtcatttggagatgtcaagcctattgaagtggaagacaagccatccacctccactcaagatgagccatctactttcgctacgccaagtcaagctcaagttgaagtggaggaggagaaggcacaagatccacctataccaccaaggatacacaccactctttccaaggatcacccaattgaccaagtgttgggtgacattagtaagggtgttcaaactctatctcgtgtcgcttcgatttgtgaacattactcgtttgtttcttgtcttgagccaaaacatgtagatgaagctctttgtgatccggattggatgaatgctatgcatgaagagctcaacaactttgcaagaaacaaggtgtggactttggttgaaagacctagagaccacaatgtcatagggacaaagtgggtctttagaaacaaacaagatgagaacgggttggtggtgagaaacaaggcaaggttggtggcacaaggtttcacacaagttgaaggtttggattttggtgaaacttttgcccccgtggcaagacttgaggctatttgcatccttcttgcatttgcatcatggtttgatataaaactatttcaaatggatgtgaaaagtgcttttctaaatggtgaaattgccgaacttgtctttgttgaacaacctcccggttttgaagatcctaaatatcctaaccatgtttacaaactttcaaaagctctttatggtttaaaacaagctcctagggcttagtatgaaaggttgagagattttcttttatcaaaggatttcaaaattggaaaagttgacaccactcttttcacaaaaatcattggtgatgatttctttgtatgccaaatttatgttgatgacatcatattcggttctactaatgaggtattttgcaaggaatttggtgatatgatgtctagggaatttgagatgtccatgattggagagttgagctttttccttggacttcaaatcaagcaactcaaggatgggacgttcgtgagtcaaaccaagtacatcaaagatctactcaagaggtttggcttggaggatgcgaagcccatcaagacacctatggcaaccaacgggcatctcgaccttgatgagggaggtaaaccggtagatttaaagctttatcgttctatgattggtagcttgctttaccttaccgcatctaggccggatatcatgtttagtgtttgtatgtgtgcatggtttcaagccgctcctaaggagtgtcacttagtggccgtgaaaaggattctaagatatttaaagtattcctctactattggcttgtggtacccaaaaggtgctaaatttaagcttgttggctattccgattcggattatgccggttgcaaagtggatagaaatagtacatccggtagttgccaaatgcttggtagatcccttgtgtcatggtcatcgaagaaacaaaactccgtagccctctctaccgccgaggcggaatatgtttcggcgggtagttgttgtgcccaattgctttggatgaaacaaacattgttggactatggcatatccttcaccaaaaccccactcctatgtgacaatgatagtgccataaagatagccaataacccggtccaacattctagaaccaagcatattgacatacgccatcacttcctaagagaccatgttgccaagtgtgacatagtcattagccacataagaaccgaggatcaactagccgacatctttaccaagcctcttgatgaaacccgcttttgcaagttgaggaatgagttaaatgtcatagacttctctaatgtggcttgagatggtgcaccatggttgcttcttttgcatattgtgtatttgctcctatttgctcttatgttttggatatattgccatttggttcttcattgcgaaaatggagcatgtcacattaagggggagttttgcactcttgcatgtgctccacttccttttgtatgtgagcaaatcaactaaaagtgctagtaatgttttcaaaatgcccaagtcaacataagtcaaaacttttgcaaaatcaatgtaatttgaaaaccatctcttggaaaatgtttcaaaaggttccctatatgttttccaaccctcactttgcaagaaaaatgttttttgaatgaaaatgctattttggccctcttttgaagaaactagaatcttgtttttggccaaaatgagattaaaccccaaaatgagattgagaaggaatttgagaaaagtttcaaaacaaagttggtagagaagaagatttgaaatgtttttggtattcaaatcatattcaaaatccaaatatttcaaaagttgtttgaaaatcaaattcgcccaaaaacccctatagaccataaatggtcacctcctagcactcaagtgagttttgttgcaaatcttcataaatctcgaatattatgaatggttggcaatatttcaactcacatatttcaaaattgctccaaaaatcaattttttttgttgaattttattatgtgggggtagccgaactgtgcaagggctatgcacagtcggctgggggccagacggtctgaccggcgctatatgcgcggtctgaccggactgttggctgcggtctgatcggcctttagagcccggtctgaccggatgcaccctggtggtctgaccggccgcgtatagccggtctgaccggccggggatggtgggcccgagaatctgtctttttcttctctcttcctcccctacccgactccatctcctcccattcatccttcttcttccccaactcgaaaaaaactcctctctcctctcccaaaccctagccacctccctccaccaaatccatccggttcaaccgccaaaatcactccggttactccgtaagtgaattccctcctcttcctctctctattccatggattgatttgagtttttattgagtttgtgatccatggcatggaaccctaggtaaaggaaaaggtgttcatcgatttgcaccaatagagggtagtttcttggtgtgattcaactccttcaaccggtaaattcctctccctcttgtacattactctcaaatcggtctatttcaatctttagggttaagggtagtttcccctattgcttcaatcttgatgagatagacctacaccttgatgttctagttccaatcgtgtgcaacactgtcctaacaatttttagaatcatttgtgtggattgtggaaggatttgggtgtgctcttgtcagtggcggtctgaccgagagcggtctaaccggccattcgccgtcggtctgaccggccgtgggcccgcggtctgaccgtcggagggccggcggtctgaccggccgtggctctcggtctgaccgcccctgacaggcagcactcgcccttcctcccacttcactatgtggtttctaaaattgttgcttatccatcctttgcttcttgtttttcagctatgcctccccgcactcgccatggtcgtcatgagcccacgcccgatcccgttagtgagaatgaggaatcaagcggagatgagtatgttcaaagtgatgacgacaatatggaaaatgttgagggtaatgagatggatgtaagtgatgatggtgctgacaatgggagtggcaatagtgaagatgatgaggcaagtgatgatgggagtcctctcgattccaccatccaatttgtgctaaatttgaggaatgctcaacaatacactatcctccgtcatcatgatcaattccggaggcctaacaattgtaatgatctaagatttcatacatggttccaaaagtccgtgtatgaacaagtgtatgccaacaaagccttcgccgaacacaagtggatttcttggaggcacattggtgagacaccgaagtttgaagatttgcaagagatgttccggaccgttgggattgatagaattgtcaccatgaagcaaccttttgatgaagatctcatccggcaattctatgccaccgtatgggtgtccggcgattgtgatgcaatgaagtggatgtcggggacccttcgatgctctatcaaccgccatgaattcaaggagctcttgcacattcgcttcaacaacggggatgaccttcatgatgagcacacctacaaccccttctccattgatcatctttctcagttttatgaagaagggggaaggcacacatatggaaaggtggcgggtttgagggctctcccaagtgtgatcaaccgcatagtaagggccaccatcctcccaagatgcggcaacaatgatgacatacgcggagttgcttggcatgtcattgatgccattatggatggtcgtcggttcgatgttatcaacgttataatgaaggagattgccatctcaaaggggactattggacaagaaatctattatgttccctacataatgaggttgattcaaagcaagttgggacaaattggtcacaatttaaaagagcataaggactacaagcctcgtctccaacagtagttagtactgatttaaatgactaattagggaattgttacataagtattcataaatttttattcttacatcaaatgctgcatgttcatttattattttctcttttttttgtcaggtatataatgtaagttgatatgcttacggtttgttgctgtatggtgacagttggactataaattatttggtgcatgaggttagtgtagctcaactatccttcctgcacagttatatgtttattagtttataactgcatgtataaaatagttttatatgctacatctatgctttttgattagtgtacctatcttgggtctgagtttagcaatgtgaattgatcatatagcatttgtcctccataattgacaacttctgatgcaattgttcctatggtattgcttaattctggtgaattgaagttttttcctacatgttgtattttcctgcatcctgcattttgaaaaagataaagatcagaatattagatcagtgtatgttgcaattgttttgttggagcttgtcgacctggtagtttagaaacttagttagtacctaaatggggcattttgttgctgcttccttcaccctcctgcaaattgtagatattaggacttcctgcatatgccagcctccctgtaaaatttatataaatcattagagcatatgttagaatcaacaaacataattgtagttacctttatttattcttagagcaaaatttatccaaatatattttctgacctggagccatgttgatgtttcttttgcttccttcaatctgcattgcatcatttttgctctcctctgattgttgtctaattgtttctccttcttgtattgcttcacgacttgtgccatgggagaaatgaagtatatgaggtactgatttgttaaataggtatgtcttttgagaatcatttgtattttttagcatgtattgagctttagcagtatatgtttagtgtggcatttgcatgttttatgtcaaacatgaatatatttttcaaatacattgtggttgcaccaaaattacaatacacatacatgttacacttcaattataccaaaattatagtgtacttacatgacaaataaactgaatttacaaatgtaattttagtcataaattgttgtaattttagttataaactgaaccacatttgtagtgcacttacttgtcatataaactgtttttacaattgtaattttagttataaatcactgtaagttttatactttttggatttattacatgttgtatcaactgaacttacaaatgtaattttagatataaagcactgtaatttttggccataatatttaggtcaaattatgattgttagcctagaatggttttgcatatatttttaaaatttttgtatttaggcacatatgtgattgtatttatgtgtgtttggtattgagtggcaagtgaatggagtggtatatatgtgattattatatttggctatgtagttgaagtttttgaaattgtgagatgttttgtacttgaataagtagtgtagtgtttcaataccttttttctccatggatccaaccttgactggttcagtaaatttcattcttgcaaaattcatggaataaattagtatacatgtccactgaaaccatcttactagaatgttaagtattacatatttatttacatagcttattcacaaaaattacagtgaagttacacgcaatataaattgtttttacaactgtaatttctaattttaattttaatttcaaatcactgtaatttctacttccagtgtttgattttgcatatgtatggcagcatggatagtgctatttaagattgggtgctatgttaatgtgttttgagtgtttaacccttttctagttttgataacaatggtgtgaaagtagtagtgtttaacccttaatgtattttttaatattttgcatccttcaccctgcagctgaacattttcctgtgatttttttttcaaagttgtactatgatattttttaaaatttctacatgatgttcagatcaacatagtatgtgatttttttaaaagaaaatacctaattgtagtttttccttgtttgtctccctagattccttgttctgcctgatgctaattttgacaggatctgcatatgacttcatttctgcaaaattttattgaatgtattagaatacagcaatacatcatagagtaatacattataacttacacaacaaatgtataaaaattacagtacacttacatacacaatgacctgaattttcaaatgtaattttagttatgtaggactgtaatttttgtattccatgtgtatcatctagttatgttgatctaatgaatctatcctgatctagagatatagatttgatgtgcataaatgattctcaatgatgatgtaactgttgtataatgcatatatacttgtagttgtattagtgaaataagtactaaaatattgtggatcgggctctgcatgtactaagattgtttatatggcagatcgagtcatcacacatttccaagatattgagtaccctagattgtttactatgatgttcttggactgatattcttttaatcctagatttgatttgaatggattattggagggtcctactcctatataattcctgaatgttctgtatgagaatattaaatgtgatctatggtctatattctaagccaaatatatagagaactatgaatctgttttgctagttccaaattggaaatcactaaaattttatccagccatttgtcttaaatgagtgaatacctagtattgaggagtgaaatatgcaggtgttctgtatgacagattactaatcaagcatcattttatcaattacacttcaataatgcaaaaatttatgttacccaaatttacagtgcaattgtactaaaattacagtgcacttacatgccatatgtactgtttttacaaatgtaattttagtgcaaatgcaatgtaaatttctacttttgagcatatatcaatgtgaaattggtttggtgggttgttttttagtttctgaacttgtttttcattatttatcccttgtgcatatatttgtttttcatatggattgtgcgctataccaattggtttgtaactgaagtttactgtggaacatgtcctaattcatgcttgtgttctcttaattttagtttagttctgactccatggatctcaactatcctatccagcatcaagaccaaacccggcagccatcatgcaggttagttgtctctaacccatatcaccatactacttactattgtggttttattttcttttttgtgctgcccaactgatacagatatgttttggaatatatgatgtatttggtgctggaactcctgagttcatgtttgaatagatgtattcagtttttaggtagtaaacaacagaagttgttctgtatggtctacttgtttgattgattgataattttacagtgcatttgtactaaacttacagtgcacttacatgttatatatactgtttttacaaatgtaattttagtgcaaatgcactgtaagttttactttcagtgtatgaactgtgccctgtattttgttcaaaacactccttatgcatatgggatgggggcacgtatggtgctatgatctaagatttgtagtcaattttgaggatgagcataggtttatggaacatacctagtttggatttattccttatttcttgtttctcccctgtgatttcactttgatttgaagaattttgctttggttcaaccttttttctcttctttctctcctactcgttctctatggtgtgcgtgctgttgcttttttggatctggtgtgttagtttggatttgtgtttgtcctttttcttttagctttcttggcagctaagttcatacttttggacagggttgactttacttctttgggcctctcagatctgttctttgtttgatttatttttctaatttgttgtttgggccaattgcagcccatgttttatctgttttttagtgtgttggcccagtcatttttggccttttttggctgtctgttcggtttttttttactccattggatgaaaatctaaaggcaaggaaaaatctgggtgatttttgcccgacagatgcataggtggttccaagaaattaatcacgtgaagtcattagttgctcgatatactaatcatgatttggttctgggctctgtttccaacagcggcccataaggcctagccggcagcagcacgcgtctgcgcgagcaacgcatctggcgcgtgcgcgcccattagcattttcggactctctctccccctcaatcgatccccctcccctcccctccccctaggcgagggcgaggagccacaaaacctccggtcgccatggattctaccggaggaaactcaggtacctcacctcacctcacctctacctgttcgcgtatctcacgaggtgctgcactgcactgctgcctggaagctgatccacatccaccggtggttgtcgtgcaggcaagctgttcgacggaatgcatctttgcttgtcggaacaaggatccccgcggacccagtcgccggcggcggtggatcccagcttggacagatccggtgtgttgcttaagtcctatgtgttattgcatacgttcttggttgtgggtgatgtttgctatggagcgtgacacacccggccggtggctcgtgcaggtgtggtgctcggcggaatgcccaagaagatgtcaaggttggagttggacgcgggggtgtcgctgtgggcaggccttcaaccggacatactgggaatcgtgctccacttccttccatgccttgccgaccgtgcgagggtgcggtcagtgtgccgtcactaacgagccagcgcgaacggccacgtcctgccaccgccgctgcccctgctggtgcttcctggtttcaagttctcgagcctatcagacaagggggatttgatgcctgtgcggtgcgtgccggtgcctaagaaggttgcagctgatgatctccgatgtgtgggttcttttcatggatggcttgtaggtgtgactcctaacaaggatcgcagcgacgagtacaacagagatgccgatggtgactgcttcctggtgaatgttctctcgcaaggtcattcgcctaccgcagctgtgccatatgcgttacaattttcctgcttactccagtaagaccctccgcatcgtcaatggttctggtgaggtccattttggtgtcaatgatatatacacaatgtcactatgtaatgtggcactatctgcttcacctgagtcatccaagtacatcgtggctgcttcctcagaccacaagggtgcaccagtaccagctctctggcagcctgggatgatttcatggcaggtttgctctggagttgagattgatggcccaagagatctctccttctaccaggggaagctttatatgctcatgaggcacaggacacgcctattcacttgtgaacttgaggaggatgatcgtgggttcatggtctctcgtattgagctctctcactgagctgcctcgcaatcatccctaccaggaaggtggtgcaataagttgcaatatggttgtgtggcgtggagagctattattaatcatcagacactacaatggcgattaccgtaagagacaacttcataaatgaagtgtttgcactggatgttgacacaaacccttatggactaactgagattcacagcttgaatggtgactatctttgttggcttaggtggctgcaagtcctttcctgctggtctacatcatggagttgaaggtgaccatatctactttgtccctgatgattggaagccttatgatacatttgtgtatagcatgagagatggtaagatgaggtcctttgccgtcaaactattagcttccgaatttgatgtggaccagttgagtcatgatttcccggtgtggttacttcctaccgaatgatgctgcgcagcaaagctgatctagctgggagggtggtcaagagcttacctttcattagactccttggtcgagactataatgtgtattatctgctatgttcatgttgcaactctcagattatcttttgtatttcctgttgaactggcaaccatgatttggtgctctctttcggagtctttcttgtttctgtttttctgggacagtggtactgttgttgtctgactgaggacatataaagtatggctgcattattctgctgttgtttgtggcatgtcgtttcttcaagtccgatctttgatggtgttttgagaaaaatatgtcatggttttgcgatatggatcagaagttagtatattattgctactatgtatctgaaggctttgatgttgcagttgttgctggatcatctgtagagattttatttcttaaggcgaaaagtttgattcatatactcaccagatattccatcttgttctttctactcaaggtccatgaagtttgtcatggggttgctggaacgcacaaacgggctccctgtctcttttattccattttctggttatttttcctatctattttgactatgaaactcgagacaaaatttagctgtgaaaatttatattttctcataaggcattagaatttggacaataatttgttcatgttctcatataaaacttttcacccaactttcaaaaccagataaataactcagcatttgcattatattgacctgcatgctgtcactaaatcctagacatgaacacccttgggttcgggcagatggagaatctcgcatgaatggaaatgacaacactagttcttacgtgctgcatgcccactctgttcatatattggtgctccacatatgtgctagaatgttcacaacacttttttctctctctcatatctcaccaagaactttgatatatcaaaaggtctatcaattaatcatgtgaaatagtttcggactagtgaacatagttaagcggccggatggtgcgaattaagtcatgcctctttctactttttcaaaattacctactatccaggatgagtcccatgattttgttactacgaatgcgtctagagagcatataatttcaggtgttgatggaggagtttgtttcttcagataaaattacaagccttcagaatcaaaggttcaactgatcaattactcaattcctcaaagcaaagactcccagtccctcaatgcactacaagaccttatatagtgtggatggaatcatcaataaataacaaccctactgctaccgttttcctcggtcttttgaatttcttttggctcatcggaatttttgtagtacagaagctcctcgatggggcagcttaaccgttcaagcatatcatatataaaatccatgtatagtacatccataaaaaaatattagtgcttacacattgcacagccagctcgatgctgaaaagatataaccatttaaaataactaggtgaaacctcgcgccttgcagcgggagtttggtatgataataaaaaatagaaataatgtgtaaaatagctagacaatagaaacttgcataagctgatttttttttttaggaaaccgacggcaggagctctgccggaatttgatttgagaaaagaaaatccgtgcaatacagaccagagcgagcaaaataaaaatacagatcaaggtggcttaaaagccgagctacgaaggtctatttcctgcttgacaaagtaagctatgtccctctctgatataacagaactattgaaaatcctattattcctttccaaccaaatattccaccatgttgtgaggagagctcctcttgttttcagcttttgctcatttgaaccttgacgatcgatttcagtccaccagttggatgttccacctgtggcttgagcatttcctcctgccaagtttagccatgagcaaacaaggttccatacttgcctgacgaatggacattcactgaacaagtgatttgtgtcctcaaaagcacatgtgcagaggcaacatatccaattgcatggccaatgtctcctgagaaggttttgtgcagtgagagttttctgatgaagaacaagccatccaaaaaaaccttgtttttggttcggccggcgccttccatatcgaggagaaatttatggaagcaaaagacccctcgaattggaaaaggtaagcactcttgcttgtgtaaatccctgcttcattccacttccaagagatatcatcaggaatagcagagaggttaacatcctgtgacaggcttcccaagtggactaactcatgtatttccttgaccgtgga

SEQ ID NO: 5819 - DNA, 531 bp, Oryza sativa
ctttgaagaaaagactttgtttcttcgatttatgcaagaatttcaccatattttgaacataaaggaaattgtcgtgaatagcccttttgcgaatgaaagcactttggtttggggaaacaagctcatgaagctctggggctagtctgtttgccaatagcttggaaattatcttcgataagctatgaattagacttatagggcggtaatgctctgctccattagcgtcatcttttttggggaggagacagatgaaagccgagtttaagtcacgaagttgcaatgtatttagattgaagaaagaaattactgcctttagcagatcctctttgattatctcccaggcaaccttatagaaagccttatgaaacgtctggacctggtgccttttcggccggcattgagaaaatagtcgctttcagctcttcttccgtaatgtcctcttctaaatcctcaaggtctaaagaaggtaggttcaacatgctccaattaattccagatcctctttggaaagaagttcccaatctctctttg

SEQ ID NO: 5820 - DNA, 11134 bp, Oryza sativa
cttcgtaaactatggtgggtgtgttggcgttatgatttgatgatcccgagcccttccgggagtgtgccttttataccataagttgccttagtctccaagtagaactcggagacaatgaaccctgcacgatatagaataatctctatcctctcctagtaggactctgataatctacatgctgtgaggatattttccataataccttgcatatttctttatcgcatagggaaacatatcgtaggatatgagatatgccaatccggcatatttggtaaattgtaggataggaggtatgtcttatccgtaaccctgaaaatactcaaagaaaagatgttggattatctcttgtggataacagaaagaacaatgtttcttcctccccccccacccttttcttatggccaggttttatttcgttagaattactttcttatgaaaaaaccacatacacacctttatctttagtggaacctttaagtctcatataattccttttatccaaacattagagttcataatcatatagatttgactgaaaattggccattcttatggagcgaccatacgaaacagtccttttcatttttgtttgacggagtcatacaaattagctagcctgaggatcccaattacttaatccacaattttcttagagattaacacaaatgtaaaatggcctatattacatatagtacgtagggcatgttcactttgatgacattttcaaccttaccaaattttggtaaagttgccaaaaaagtggctacatttagtttgttgccaaaatttggtaactatataagaaatcctaccaaaatttttggcaagttgtcaaaattttggtaatgccaaaatttagtaaggtttttttagcatcaaagtgaacagacccgtaatgactatgagatatcaatatatatacatatatatatatatatgtatatatatatatatatatgtatatgtatatatatataggagttggataatatgaacctaggtgcatctgcacctcaatcccacatgtgacacgtgtctatttttcgttgtagctgatcatcattttcaccaaagctcctacaacttgtacctacccagcccaaactcttatagggaaaattttaggcaggtacacaatgatgctgtagtcatgcatttctcacccacccatgtactagtactagtctgcaactgtattcatgtcttttcactaatgtgaccgtgagagagaatgagagagagagagagagagatgaacatgtagttttaatagatctcttggctacaatcacattactccatgtgattagccatcaaatatacgttgatttttttaattaatctgaccaccttgttttgtatgtccggaaattaatctatatctggttttattcggacatgatatatcaagatgaatgtccaatcaccaaacaaatacaatatatccgatgtccaagaatgacattgtgaaaataatatatcatttggcataaattaaaataaaaaatacatgatttttatttttacagatatatgctacataacaaagtataatttcattaattgacaaagaaaataatatacactgcaatttgttgacaccgaaaatgaaatacaacgaaaatatcattttgaaaagtcatgtctaaaaaaaagatgtcgcaaaatgataacatataacttgacatgtattgaaattaaaaaaaaaatcacatgcgtgttatttccaaaatggtcatgtgtactaaatttccatggataacaagagaaaagaaacaatattcaaatgatgagtaaatactacatgatgtgtggtcaactacctctcatctgttctttctctctctttgctcaggaagtacatgtcccatgtcagagcaacacatgcattacgtacctccctgacattttctcgtgtagacaatcttcattagtgaaaggtccatttagaaagcacgcatcttggaacgattgaatggttgtgattctgggtgcagatgaacctcggttcatatctgcttttatatatatatataaactgtgcaaacgaatagaaaacttctaacaaatctcgatggccttgctagctaggtgaatcatcatatacttccatctttttttttcctttgacaatttacagcttactagcttacaggattgggaaatctctggaattttcatatagctgcacaaattgtggcacagagctgcattcacagttctagaagcaaatcatcatagtcaatatgcaagagtggccgattagcagttactccgacagttggaagtagggtactagtacattctggtttttgagcaaacagttctaattggccattggtcagttctttttttgttcatgttgttactgtagctagaaatccaaaacgccaccaaaatggatatataccaaaaaaaatgtgcaattcttaagttgcagtcaccactgaatctgaagtcaactaaacttcatacactaggctcatattcttgctaatatacttcatacaaaataggggcacattcttacataggagtagccatttttaattcaactaggaagatagcccgtgtattcacgcgggcatgtgtcgtacattatgtttgaacatctacaatatatgatttctccataaattgttttcattagcattgctttcataattgtctaacctagttattagttatctttatagcatatcatatttaattaattcctacaagcaattatttataatattcttcatcatctactaagtaggtagacatattttgtgttagaaaacatgtatagaaaattaagtgtaaaatgaaaagtaagatgttttttaattgaatataggttgtcattgtttattgacggatgaattgggtgggatatgaggctctactaaatgcatgggtttatattattgtttaatttgagaaagaacccatatgtgaacattccatgtagagagtgtgtgagactccatgcaacctagcgcaaataatattggatgaagaaatatggttgtgcaatatattattttgatagatgatgtattatgaatacacgcttgtcttttaagatgagatagaactaatggttggaaataatgggcttatcggtttaaaaggcctaggaggatttatggggtaataggtggcgactttatataaaaaagaaaccattatctaaaattgattagatgatatataaaataaaattatcagtgtagcttaaaattatgctctttttaatatttgtttctctctatagttttgtagctgaaaatagggaggagactggagagaaacgaatagcgtagaactcaaatcagatatgagaaagggttcgcagtgcaatggtgttatgtgaatatgattggagagggaggtggatggtacattgtttttttttaataaaaaatcttcgtaaacaatctaagtgagaacctatgatttgttgttttctcattataaggatctttaagacatgacatgtggtggcttaagtttttttataaagagaaaggcaatctaatagttaaaaataatgggtcatcaaattaagtggaaaccgatggatagatatatactttattttctcttggaatttcaattttttcaaagttttaaaatatcatacatggtgacttgagagtgctacagagcacgcttaatcgatctttactatgtaaaacgattcaagaatatataatatacgttttcatgtttttcaatgtttcgttgttatttggtaaggagattttatttttattgaggtatatttaatgccttcatcagtttgaaatatttatgtctttaaatccaattgttaaattataactcgactgatttaaatgaaaattgatgaaattataagtctgccaatttaattgaaaattgatggttagatttgttttcttcggatcgccggccgagtctcccccaggcccacggctcggaccgggccccctggagccaccacccctgccggagccgccggtccgactgccgcccgtggtggcgccgctgctacccgtgccgtcgccaccgccaccaccggaggcgcctcggcgggaccgacccctacagcaccgacggccgacatcacagccaggatattctcccggtcgcggtcgctgcagagggggaggatcccgtccggaatcagcatttgctcgacggtgtccaggcccagcaccgccgaaccaccgtctttgcgtcctcctcgccccaatcccagcgctcacctacgtgggtgcacatgggatcgttatacctggtgtactcccacgcgccgcgggactgctcctggagaggcgtgatgcgacggcggaagtagtcgccgaacaccatcgccgccgttaagccctagcttcccaggcccttgaggcggtcccgcaccgcgtcgtactcctcgcccagctctgaaactgccaaccacgcggcagatcgttcgggagggccggtagggagccgaagtcgcggacgatccggcagcgcagtgtagaaccaatccttcttccaatcctcccacttcttgcggaggtcactatcgatgtactgccccgccacgcctggccggggctggaagtagcatcctccccctaccgcgccttgcagcagctgtgggacgaggaaggactggaacagccgcattgtcggccgcaccccgacgaacatcttgcacaagtgcgcgaagatggccagcgtcatcatagcattgggggcgagatgcaaggcatgaatttcgtagaaatccaagacctcgtggaagaacctggagaatggcaggatcaaccccaccatggtgaaggataggaggtgcacggatcgctctgggtaccgtggctgcggccgcgtctcccctaccctcacggcggcatcctctggaatgatcttgcggatgaggctaaggtgcctctccgccgtaatgcgcgatgccgggaggacggcgtcgccagcatcttgggccatgatggccagcgggaaacggcgaggagtttggcgtacggaataggatggagggagagaagcactagggcttgaggggcgagtatgcgggtgtgcagtcggcgagaggaaggagacgaactctccgcctcccttcccttttatccccacctcggccgcgctcgcctcctcgtttcacgcccctgcggttgccccatcgattcctgcgcctacggttgcctccttgattctcgcgtccactcatcacgtcgccccactgaacccgcgccccgcggttagtgcgcttgtcagtggcgcactcggcgcgggacatgcggtgttcacgagcacggctaggcgggcccgccgtcggtcccttcgcgtgcctagcaggcgggggagttgaggcggcgttgggtgacgattctgggtgtgatctggcagaccccccgacttttgcgccctaagtgccccagtgaacggcgcacttagtggcggtcaaatcgccattatggctgatgcgccagcctggccacccgacggcggctgcctagtttccccgccggacccacaaccacagcacgggaactcatgaggaaccacgccagaccgccctcagggggccaatgtccgacgcggtgccgggggctactgtcggtgatatgggcccgggggtatgcaaagtacgggggagttaccttcaaatgcagccacgtggccctacaacttggccctccccccacacctcggaagacgcaaaagcagccagggggcctcggggtgccacgtcacgcccctcgggccctcgcgctgccacgccccgaggccctcgcccagctgccatgtggcgaggggagcgcgcggggaggagactcaggctgaacccccatcaatgcgcggcgccccaaccgtttgtcaccgcatttaatgcggtaagggcggacgtgcggtgcggcctgattgacctacgtcaatcaggcatgaccagactgtgaccagcccgtcgccggtcacgtccggtcggacgggcagccgtgtccccacgttcgcccctgtacccggcggagtggaggcaggtatgccccgtcccatcaaggcatcatccggagctccctccacgtgagaaggaccgtcacaagtcttcgttcatttaagagggaatgacagagctgtcctccgtgtcaggcgggaggtggcgctgggtcccactcgaggacggacggccgcttagcttctgggcgaaggcacagatcgtggtccggtctgagtagagtgggtccccctcccgtgatagagtaggtagaagcggtgcatgtagtatccccttgaactataaaaggaggaccttgcccaccgagaaaaagggacgactcctagtaggcctaaaccctaggagaagaagagcgagagtgctctccagagtttaggaacctttgtaacactcaaccataaatcccatccataggagtagggtattacgctccatagcggcccgaacctgtataatcttgacaccgtgcacgatctcgaagcactcagggcagataaacgatttcgtcaagcgtgccttttcccccggccaaactcacaaaagggggatctcactgtcacccgctagagaggatcattcctcgacagcactagacctctactcctccctgagcatagtcccggtcctcactattgaccaaggctgacctcaagtcacctgcacacaatcagacaaaacaaccgttcctgggcacagatatcacaacctgacccacattagtcacacgcactcacaccaacattcacataaattctcaaaccaattcattgattaaatcatctgcacagccaattgttcatcacaaatatattaatcatgacaatgatttcattaatcaatcatccccgaattgcctccaaatacacaaatcgatcatatcaaatacatcacaaaatcttaaaaaaattacatcacaacttctacaaaattcatcacaaatccacatcgcatacaaatcaaatacatcacacaacaatctcagatccaatcaaatacatcacacaacaatatcagattctcccaaaaaaaaaaccgccaaagtaggcgccgcctcgccgcgcgccgcgccgctgccgcgctggccggccctccacgccccgctgccctcgcgccggcctggcatcctcgccctgccgcttcactccggcctggcatcctcgccccaccactgcagtagagaggagaaggagaggagaaggagaggaatagataaggagaggaacagataaggttgaggagaggaggagagaggagttaaaggagaggaggagatacctcgatctgatcggcacgcctctccgatctccgcgttgatcttttttcccggttggtaacaccaaccgggactacaaatagatttttagtcccggttaccaaccgggagtaaagcgtatggcgatcttttttcccggttggtgttatcaaccgggactacaaatagatctttagtcccggttggtaacaccaaccggtacttaaagattggaaagtacccctggagtttttaaaccgggactaaagatatttatagtcccaatttttaatacaaccgagactattgtgaaatctggtcgaccgaccaaagatggtttctccaccagtgtcaagcacaccctccaaatctccatcagcgcttgcccaaggacatcctctcacctgtagctctcatgttgcatgactgtaacaacatgtgcacctgccaattaaaattaaattgaatttaaagtgcactcttgtttgaagcacgatctacaccgacttgtaggattatttctcccaaggccatgtgctcctttccacctatgcctcatcaattcgccatctcttattcctgtcaaatttatttcatcgactgccaccaccgttcgatatccagctaggggcgcactaccataataattagcatcagcaccatctagccatgtatgcaaacccatgtcccagatatagagccacaacggggcagcacctgggaccctccatcaccgccatggtgccatcaacattgaactgttgattgcccctctgccaagaatactatatatgcatgccacacggtgcccctcagtgccttgctcatcattcctaaccattttctcggccacccatctatcttccactggcatatccacccccctcccaatttgatcatgcatgggtccacatgctcaatgaacggatcatgaggaggtgactaattctcattatctataagttaaaatggctgctttttgggaggcctgcatgccctacgctagcgaaacaaccgggactaccaaccttgcatctatttaaagcaattgtataagagtccttcaacgaaaatggctgccaacgatctccatgctgcaccacacattttcttaccaccccctcccccctccaccataaatatgcacccagctgcaacatggatcaccgaacacatcgatccatccctctaccaagcaagaaacaagaaacattacaccaaaaaactagctagctagccaatggcctccatgtcctccttccgacttgccgtggcggtggctgcactattggtcattggctcacatgccacagagctcaccttcaaggttgctgagggctctagcgccactagtctagagctcgtcaccaacgtcgccatctctgaggtggaggtcaaggagaaaggcggcaaggactgggtggggctcaaggagtcgggctctaacacctggacactcaaaagtgatgcaccactcaagggccccttctccgttcgcttccttgtcaagaacggtggctaccgtgtcgtcgatgatgtcatccctgaaagctttactgccggctctgaatataagagtggcatccaactctaagtaacaggcgtgcatactcttgtgttgggtcatattggaattatgaacctctaaataattatgtcttaaaagagatcgctccatgttcgagcgaaccattaattaattttctattaattaattttctgtggttatttttttgtaatgggctagtggcaaaataaggcatacatgtgtactccaaaatattgctgtggagctatatgcaaagcatggttttgaatatatgttatttatataagatatatgggaaaaagtatatttggtcaactttcattaagatgattgggtgcattatttgattttccaaagttttagtacataggtatgtccaaaccaatgtgttcctttcaccattttagcgtgtcaaaaatattgtagagtgacatctatacttgtttttttttttcctttctgaaaacaaattgttgattctcagccatactatgaactgaaactataagcactagccatcaacccatactatctaattatatcatcataaatattaatactttagttgcaaatgaatatttgttttttgtaattacaatagctcttatgttaaattaaaataagattttatatgaattatatataccttgttaattagtgattcctaattaatagaatacttagtggataaaattcatgatttttaattcgttttgactatgacttccaatggcatgttttcttaatacaatgtcccaatatattattgtttgtattataaataaaacaattttagtcatttttatccctcaacattggtaaaagaaaagtaatttcactgaatttgttggaggaatcatgtattttctgaagcaacgactattaatagaaacataagttattgaactgggtgaagcatatgcaacagataatatattatagtaataggataacacacctatacttatcgtgaaaacctgacataaaggatcaaaatcaaataacatataaacattataacatatagtgagaggacaccatgcactagtaggtatgaatggattcttctaggagccaaatcaagaactcttctatactgtcctatcctaatgcatatgaaatcagttattatgattcttaacattacttgttttggcccataataaaaatatcgcttataaattttaaaataatagaaaaaactgtaggatacattagtttttcctttgatcaccattggggaattgcaataatcatctattaatttggaaaatctattattttaaacaaaaaatatataatcattctctcttccatgatctagggaaataggaacaaaaataagccatgtctcgccacataccatttggaaaataatctattagtttggaaaaatcattataaacaaaatatttataatgattctctcttgcatgcatatatgtatgtatattactcctacttcactaaagccacgcatgcatcattagtggaaaaacctgctagatgcatgcatatttattgatttttttccttgccccagaccatgcatgaccgcctttataatgcaaattttccagtgcataaactaaatactatatatacagatagtttcagaaggtctgaacattttttcgaacataaatttgaaaatttttacaaaataaaaataaggatagaaaattcataaaacatagaaaaaatacattgtaatatattatatactcccttcgtccaaaaatataatcagtcatagacttcaaattttatccacaaatactagtatgtagagagttgcgcgtttgcgcggccgtaacatccctgtatattaaatgtgttatttgttatttacagtaatcaatttaattttacaataataattaacactctagatgtaggtgtgtggaccaaaattgtcggacactgaagtgacaatattatcatgacaaccaataatttaacatgctttcatgcgaccatatcacctttgtatttatactaatattgtaaacaggtaattagagaaacatatggtacatagtttagtattattgttctaaaataaacaatgttattgttacaataaatgattacaaatgaactatctagaacatatttcataagttttagtagtgtggctggcgggatggaaggccggtcagctggcagcaaagccagagacagaaggtttggatgcagttttttttttttaattaaaagaaaaatcaacgtatctatctagactatccagttgtttctctgggccatgatttttttttatttctctaactttttttaagcatcaatttgattggatggctatgatcttttcttctacttt

SEQ ID NO: 5821 - DNA, 723 bp, Oryza sativa
taataataaatgttcatgttcctacactgtcgatgaatgatactcgtataccggatgattagggtattagggtatgttagaatgatgatctacgtaatacgacatcaagcaaacagaagacaagaattatactggttcaggccccttatcaggtaatagtactagtccagtttatatgggattgatgattgaaaaccgcatatttcaatgggagtagaaaaattcgacgataccggcaagatcgtagttgatgtattcgacgagatctcccggtgacttggctccgtgtattccggcttcgtaaactatggtgggtgtgttagcaatgagattcgatgccttgcaccccttcccaggggtctcttttataccgtgaatcatcttgatctctatgtaagactcggaaacatcggatcccgtacgatacaatataaattttatcccctccaagtaggactttggaaatcacttaactcgtagagatattttccataatttgtaacggattcctactacatgtatagatacaccggtcagaccggcggtacagcagcggtcagaccagtggtacaactattttggagtatagactcgggaacatcagatctacaatataaactttatccccttcaagtaggactttggaaatcacttgactcgtatagataatttacatattttgtaatggattcctactatgtgtatagatacaacctgtgtacg

SEQ ID NO: 5822 - DNA, 15687 bp, Oryza sativa
aacaaccaggacggtcaaacttgcatctacttaaagcaatagtatgagtccctcgatgaaaatgcctaccaaagatctccatgctgcaccgcacatccatgctaggttttcataccggtccataaacactcctttagggagatgcttgagcaataggcccaagcagaactaggctttccccaagtccttcatctcaagctcaatattaagataagccattgcttgtttaatgtcctgtgtggtgccaaggatatttagataattgacatagaccgagatgatacaaaatgcattcagggatttctttataaacacagggggacaatcataattgtttgggaaacctctctttaggagatatctatttaattgattgaatcacatccttccggattgttttgatccgtacattgatcgctgcaggcgaacaatatagatgttgcaatttcctttcggatttgggatcttgagtccttcagggactctcagataaagttccaaatctaatgccccatacaagtatgcggtcaatagatccatcaaccgcatgtgtcggttcacatgctccatgaacagatcatgaggaggtgattattatcattattctaagttttaaaaaaaataagtagagaagaaatgggaccacatagctgatttttgggaggcctgcatgccctaggctagcgaaacaaccgggaccacccaactagcatctgtttatagcaattgtataagaacccctcaatgaaaaagtctaccaacgatctccacgctgcaccgtgcatctatgcctagtttgcttaccctccctccaccataaatacgcacccaactgtaacatgtatcaccaaacatatcgatccatccctctaccagtcaagaaacaaggaagattacaccaacaaataaactagctagccaatggcctcgttgtcctctttccggcttgccgtggcggtggcagcactgttggttgttggctcatgtgccactgagctcaccttcaaggtcgctgagggctctagcgccagtagtctagagcttgtcaccaacgtcgccatctctgaggtggagatcaaggagaagggtggcaaggactgggtggcgctcaaggagtcatcatctaacacctggacgatcaaaagtgaggcgccgctcaagggccccttctctgtccgcttccttgtcaagaatggcggctaccgcgtcgtcgatgatgtcatccccgaaagcttcactgctggctctgaatataagagtggcatccaactctaagtaagaggcatgcatactcttgtgttgggtcacatgagaattatgaacctctaaataattatctcttaaaagagatcacgccacgtttgagcgagcgaataattaattttctgtggttagttttttgtaataggctggtgttaaaataaggcatacatgtgtactccaaaatattgttgtggagctatatgcgagcatggttttgaatatatgttatttatataagatactaggtgattccccgcgctttgctgccgaaatttctaagtaacttttaatattttttttaataatcgatctaaaagtaaaatttatattagttattagcaacaaataaaaatggtttgtcaaactatgttcagagagaaatatgatatgtatgagattgtagatgaaatatgatatcccacactttgattatatgaatgaatataaatgttaaaaatattgtgaaaaataatgtgaaggaagatgattggatgttgatttgtataattcaataaattatagatgatgttgcatgcttgcataagttttgcatgtatttattgctagtggatgatgaggtggcatgtttgcatgttgagctttagggttagtgggtcataactttatagtaagataggatatgggaaaaagtatatttcatcaactttcatcaagatgattgggtgcatttgattttccaaagttttagtatatacgtatgtcctaaccaatgtagctcatttcacctttttagcatgtaaaaaatattgtaaagtcacacctacacgtgtattttttttcttttctgaaaacagattgttgtatcaaccatactatgacctgaaactataagcataaagcatcggtacatcgtttagtatattcagatatcagaacaaactgcaagtcacattaatctcacatatccaacacgaatgagtgataatcggagtagaatggaaatgaggtcagctttgagaggagcaaaattaagcttcatatcatatagttgggccaggcccagagctatactcaacaacaaagtttatatactactatgagaataccaatctattggaaagaatctaaaataaatatgccattagttccaaactttaaatcatttttttttacattaccagtgtgttacaaaggatctaaaaaacataccgtttaattccaaacattcaacataaagaacaaataaatctttcactcctaaaaaatgtagtggtggtttatgatctgtcctccatcatgtatgcctaacctcacgcccatgccctctcgagcaactcccgcacgcatgatgtccctttaccctatgccaatggaaacagacccccaacccccaccaccagatcaaattatacttcctacgtgcttgaccatggacctccactcacctgtaggctgtagctctcatgctgcatggatgtaacaacatgtgcatcccgaactaacttgtgcattaaatcgtcgtctaggaaagtaggaattagctgaggtatacaaactgacaatttaactatatagtaccaagaaaactaaagcaattaatacttacaaaagaggctattagtcctcaccacgaagacaattgcagcgaaaaaagaaaaaactactgaagctttgtttaggtgatgattggattcactattattttatgttttgattattattctgtgatgaacaattggcatatgtgattattggttttgatatttggagattatcgtcgaagtggttttggagataatcaatttttaggtgatgattggattcactattattttatgtgaccggtccgaccgggctgtgtatgccggtcagaccggcggtgatcgagcagtcagaccggacggcccgcggtctgaccggccgacagtgtatcggtttcggtttcgggttgttccataggatatccgtgattgtttcatagctatggcttttagatggatactataaatatgtaatactggtgtttgctaacaatgagtcgagttggggatagtttggtctcggaatatggtttttttgtttgtttcatgtgtaggtgactcgatgcctcgggagagtatttgcagtgatggactgggagtcggcttggtggtaagacgatgtccgtggtggtcagatatcatgcgggatactaaggctagagttgatgcacgtggttagtgaagattccatatggcatatgatggaggtattatgtgcatatgggatgcggagtcgaatttggaaggagtccaaatttgatacaattggttatgttaagtttgtgtcttgtactagagggtttcctgaggtgtttaggactcttagtatgagtttggttcgtggctttaggctgcctacctcatgtataaatagagggggagcgtgaggcttcccggtatcgtttttgtatcgcttttaagagcaattgagttgatagtttagttagggtttcgagtttagtagagatttttgtaaggagtgttgttgttgcactttgtaaacacagagagaagcaataaagttgtcatctactttaagagttcttcgatttgtgtttcaccgggtttcgacggtctaaccggcgactcactggcggtcagaccggcgaagcaccgacggttagaccggctagggcgaggcggtcagactggcggcgacatcaggcgcggcagggattccagggcggtccaaccggaagatcaataccggtcagaccggcggctacgcttcggtcagaccgacagatcaatctcggtcagaccgatctccatcgatttcgagggtaacttttatttctgctaaaagttttcggtttttgggtataccaatcattcacccccccccctctagttggcttagttcttgtgattcgatcctacaacatcgaacgtttaaactcctgcatgaagtattaaatataggctaaaaaaataactaattgcacagattgcgactactttgcgagacaaatcttttaagcctaattgctccatgatttgacaatgtagtgctgcagtaaatatgtgctaatataatgatggattaattaggctcaataaattcgtctcatgatttactgacggatagtgtaattagtttttttattactgtgcgaacaccccatgcgacaccctgtataatatccgatgtgacacgctaaaactttacacacctggatctaaacaccccctaagtagagaatcgcttagttatttttatgcatttactatttacaaaattatttggcatatccgtgaatagtgtggatgactgacaaacctgacacacagccggataagctgcccaattgaggagcttctgtaccatagaaaaatacatgtcaccaattgcgacgagccaaaaaaattcaaaaaaccgaggaaaacgtgaacaaatttattgcccaagttgggtgaaaagttttatatgagaaggtcaacaaatttgttgcccaaattctaatgcctgctgttaatataaaatttaattcactgctaatttttttgtcacgaatttcatagtcaaaatagataggaaaaacaaaaagaaaatagaataaaagagaccaggagcccgtttgtgtgttaggaatttccagtaattcattaactcatgcatatataacactaccacaatagctatcctgcttcagttttgctggtaggaagaaaatggaaatattccaaaacactagaggggcagtgtattcgcgtcagattttcaaggtttggaatgcgaagctttggggattctagaatgtaaagaaagcacaaagagtcttggatatttaagaccttgcaactatttaagaccatgttggggttcctagaatgaagagattaaatgggatcgagaggattagttccaaacctcaataggtatggaatacttttcctccaaattaataacctttaatcccagggtgacatgaacgtagtaacaatgcaaaccattgtccaaatcatacagacatgaacataggtgacaatgcaaaccattgtccaaatcatacagatgtcaaaagacaggtagcaactcgttcagtcttcataatcttcgaagaacaaacagtagcaccatacagtgagaaatatcagatttgctctgcagcatcagttggatggaaataaccacactggaaaaatcaatgatttcctcaggaacgccaatgttgcaaggtaacaatttgagagcaaagggcttcatcataccatttcttgtgttgtagagtacaaatctatcatgccacaccacgatgttgcaacttactgaaccacttacaataatactaagcagaatgggatgagggcaacaacgacgatttggttcatcctcatctctcatatcttcatgaacaatatcaaatgtgaacctacacatacaagattggcatttgacaaaaaaaaatacagatgcaatctacaaactacaattgattaatgaacaaaaatggtaggaatgcaacatatcatttgctctagtttgagataacggaggtaaactttttcactctattattcagttctaggaaatattacaaaatatcatcttcagtgattgccaaaacatctctctcaatatgattcaacctatcattccccatcttatttctcaactcagtctattgacaattttctagctgaaaaggctcttttaaccttgtcagttacaacacagcaggaggtcacctccaccaagtgtccaaactccaaacaatgtttggttgtcacataggagtttcaatgtgtgaaactcaaattgaagcgagctttcagtggtcatgttctctgcaagcaaaacttatctcaaagaagggatgtaataatatttatgaatgcgattaatggtatttgtcctcttgttttatttctcttatagttgctaaaagagttaaatgttgaagtagaaccttccatattaatatttttcggaaagaaagaaaaatctgagaattgtgacaagagcatagcagattatacatgttatagtcatgaccaaagagtctaatgacaagtaagctctgtcttgataagagcaactagcggcacaaaacaaccagttagatcagttttgctgtgcagcatcattcggtaggaagtaaccacaccgggaaatcacgactcaactggtccacatcaaagtcggaagctaatagtttgacggcaaaggacctcatcttaccatctctcatgctatacacaaatgtatcataaggcttccaatcatcagggacaaagtagatatggtcaccttcaactccatgatgtagaccagcaggaaaggacttgcagccacctaagccaacaaagatacagtcaccattcaagctgtgaatctcagttagtccataagggtttgtgttaacatccagtgcaaacacttcaactttaagaacttctcggtcacggtaattgtcgctgtagtgtctgatgattaataatagctctccacgccacacaaccatattacaacttattgcaccacctccctggtagggatgatggagaggcagcgcactcagacaacgcttaacgcgagagaccatgagcccaccattgtcctccccaacttcaaaagcaaagaggcgtatcttatatctttggagcacatacagcttcccaaggtaaaaagtgagatctcttgggccatcaatgtcaacgccagcgcaaatatgccatgaaatcatcccaggctgccagagagcaagttttgatgcacacttgtggtcagaggaagcagctacaatgtacttgcctcttgagtcaggtgaagcagatagtgccacattgcatagtgacattgtgtatatatcattgacacgaaaatagacctcaccagaaccattgatgatgcggagggtcttactggagtaagcaggaaaattgtaacgcatatggcacagctgcggtaggcggatgaccttgcgagagaaaacattcaccaggaagcagtcaccatcggcatctctgttgtactcgtcgctgcgatccttgttaggagtcacacctacaagccatccatcaaaataacccacacatcggagatcatcagctgcaacttccttaggcaccggcacgcaccgcacaggcatcaaatcccccttgtctgataggctcgagaacttgaaaccaggaagcatcagcaggggcagcggcggtggcaggacgtggccgttcgcgctggctcgccagtgacggcacacggaccgcatcctcgcacggtcggcaaggcatggaaggaagtggagcacgattcccagaatgtccggttgaaggcctgcccacagtgacacccccgcgtccaactccaaccttgatctcttcttgggcattccgccgagcaccacacctgcacgagccaccgggtgtcactgtcacgctccacagcaaacacccacccacggccaggaaaatacgcaataacatatactagacgataacgaacacacagtgtctgtcgaagccgtgttccatcgccgccggtgacgggctccgggggcatcctcgatccgacgaacggggaggcatttcgtcgaacagcttgcctgcacaacagccaccggtggatcagatcagatccaagcctccgcactgtgagatgcgcgaacaggccgaggtgagatgggtagctctcacctgagtttcctccggcagaatccatggcgaccggaggtttcatagcggcggcctaggggaaggagatggggagagagtcaccgaagcgaagggggtgagcggatggctaggcttttgtggattgttggctgctgcgatgaatcatgaatgtcgatgttgggctgaccctatggccactgttagctgctcggtcccactagttagcgtctactacatttttatcttttttttgcaaaaatagaacatgtatttgtgtttctttaggccttattcggttacgcctgattcaatccagtctagaaatgacaagtatagtaagaaatttatgatagatgtaatgagagaccgggatttatttcgggccggaaaccaatttactcatgatagggacaataagagaccgggaatcaatccactagtcaagaggtgtggaactaatccggatgttttgttgtacctaatatgaataaattggttctcgatccggaataaatgccggtctcctttttacctattataaatttcttgttatacgtacctatcattcctagcatggaacgaatcccaaccgtgtaaccgaacaagatcttggtgggttcgattttttttaaactagtagaatgctggtgcgtgcaatggttcaaaacaattttaatcatacacatacatactttattggcagataacccacaagtctgataggtcctcgagtaccaagtgtgcccgtgggttagcgttagaacagagtgatgtctcaaccacagtgacggggaacagaagttagaagcaacagttacataggcgagtgtatgggggagcatgagattgaagaattgatttaatttagcgactacttatataatatttcatagaaaaaaccttataaattcttaaccagtgaatcgtttcaaaatttgtccactcctcctctgaccgtaacccctcctctcctctctcatcattttttcttaacactgccgaaactcgcgagcaagtgcacattcgcacgatgcctctgcctcctgtgtcatcgccatcgctgcccaatctcatcggctagctcacgagctccttctccctccctcctgtccccctagccggtcacctccttctcctaccttctctttcgcaagccagttgtgccgagttttccatccaaatgtctttctcatatctggcgaccacccccctcttaaccacacaagccctattttgtccccacaatcaacaccgccccactatcctctaccgtcattgcgtatctagtgacattgcccccatgtcggcttgccggaaggtgtcaacagcgttggtgaggctctcccaaccgtccacctccccatctcccttatcttttcaaagccgagggcgcaccagtgccccatccaaccattttccccatctcctatccacaagatccggtttgcccccaccgtgcgccaacaccaacctacatccttccccactgctctagcacctcaccgctcaccagaatgccgcctgccacagccatccctttaagccagccctctcccgctccccttacatccattcccacctccaccctgactcggaaccctaaacctaacttagcatgccatcgccagatgcaggagcttcctggagttggaggagaaagagttggggttgttggagcatgaatcacgacataaatccaaatgtcataattttttaggcaaaatagtcacaatttccaatcgatagtcatttaaggcaaatggttcaaaagcaggaagtaaccaatgaatgcactcttattagcaaggtgtaggcattatggcaaaaggtaggtaacaacaactacctagttgaagtgatactaccaggcagcaagcgcagcaagcaaatacgaaacagctttagagcattgcaaatgaggaaggccagagcattacgggagataccaattctaccatataggaaactagatagtgccccgcgctttgctgcgggatatatgttagacattgaagaaatgatgaaatgatttggaatgaaatattatgaaagtgatttgagaatgatgatttagcatgggtatgtttagttttagaatgaaataaattgtagacataattaccatatgtttgtatgtcgagctttctgtgctttaatgggttgatgcggcatgcttgcacgtaggttttaggagtgctaataaatactatgcttgttgagtttaggtgtgtagtggacattagctttatagaaaaaagagataatagttttttcttggtggaccccatcttattctctacctcctgttgtttgggaccacacactattaccaagttgggttagatacattgaggatgtacttagtaattctgttcagtttatgtactctctgtcacataatagaaggttccataacaaccctagggtccaattcacataggaataatttcatcctaggcccctcgatttatcgcccaatctgtttcgtccttcaacctaaaaaacagatacaacccgttctccaacttacaaaactagttaaaaaaagatccctcggtagtattgacactggttttagatgacgtggtgcctacgtggttcctttgacttgttcttcgtcctatggggcattgacatggcgcttacatggcagtttgatccggaaaaaatagaagtgcaaaattgtaaaactaaaaaactaaacaaaatatgagggacccacatgtcagtcaaacaaaataaaataaaaatatttgacctacatttcccttatcactttctcagagagggatagcgcggggaggctgacgagcctcgcggcgctctctccctagtcgtcgcgccacccacgctcctcagtcctctcctctctccccccgagtgccgtaccacccacgctcctctcctctctcccgtcggacgccgcatgttgttgtctccctcgccgctgcgtcgcccacgctccactcctttctcctgccagacgccatgtgcgctttctacccccaccgtcacgccgtaagtgcacctctcctctctcccgccggccgccgcggcgcgcacgttcctctcttccaccgcaagccgcgcatgctcctctcttccaccgcaagccacgcactctcctctctcccaccgctgtgccatgcgcttctcctctcctctctctcccgccgcgatgcctcgtgctgctcctctcccatgcgtggcgctcatctccgccgccgagctcgtacgctccatggccgaccgtcggagagggtgaaggggacggcaaagtggtttgacgccaccaacggggtttgacgtcacccgcggatctcatcccagcggtggtgggaaccgtggctatggaggcagtggcgggtacagcgatggaggttatgaagctaaacccgtgacggtttgcttcggtcgcccctgctccatgtcgacggcttgccgatgtcgtcagcggctacgggcgccgccaacatgtgctcgagggcatcgactgcatcctgaagcgcaaggacttccttgcaccgtggaccgcattgagccggagcaacagccgcgtgagcgcctcaccccacccatcgatcgcctgctccgactgcctaggtgggagagagagagagaggataaagataagaggggagtgagatgacatgtggagccacataggccccatcatatttttattttttatgcaactgacatgcgggccctatggtttttattattttttgttatagaattgccatataagcgtcacatcaatgccatatgggacgaagacctagtgaaatgatacatggaggtgccacgtcagccaaaactagggttaatactgcctaggaacctcagttgcattgttttgtaagttgggggacgtgttgtatccggttttctgggctaaagatgaaaatctgactagacgacaaattgagggacctaaagtgaactaattccattcgcataaccctaggaaaacacccattcacggtgctcacggtgggcgcccaaatagattccatgggcattcaaatgtaatcattccttccttaaaaaaaggcaacctacgaggggatgtgacctctcctatgtccagatttattgtactaagagatatcacatcccctcctaggttgccttttttttttttttggacgaagggagtgtacccatgatttttagaaagaaaataagtatatctattatgtaatatgtacgtggataaaaaatgataaaaggataagaagcaaataaacccgccttcctaggtttggctccctcctttgaggatccaattcgcacaagtattatggccaaattctgcaattcgcgcgcaacactatatgtacaactgtcaaagattttcttttgcccctttctatttttaatacacaaccttaaaatgatgggcccgcccctccatgacatgagattttgctgcttgcaattgtaatgatcttcccgggcaaaactaagaggcagataaaaaacgcacacttcccaaattaaagaacactgatatactctttaatttccccttcattttatgacaagtgtgctccaatggtccgaaagttataagacaactacgttttaagtggatggtttccagctatgaaaagaattggctatggttttaaggcagccagagatcaccaatggctgagatgctatgcatgttgctatcttctatatatttgttggaagtgaagcatttccacttatgattcactcggtcattgcatccatcctactgtacattctatatctatgtttggactggaaggtcccaggaatcgttgtgctgcaatgacgcaaagaactccgtcagttttcttctgatagtatacaaagttctgtggtttcaccactccgccaatgagaatgtcgactcgagggccgtgggatgataccggcggtaaagaaatcgcagtctactccagctgctctgtgcaactctgccgtgtgctggctagttgcacattttgttactgcgctgcataatttctttttactcgaattaattaacaagattcactgtacatactcgaagtgagaactgctccctccatttcatattataagtcatgtttgacttttttttctagttatgttttttataattatagaaaaatatagtagtattatcaacataaaacaaacgatctattaaaatatatttaatgtgagatttaatgaaactagtttaatattttagatgtgactaaatttttctataaacttacttacacttaacaaagtttgactagggaaaaagtcaaacgacttataatatgaaacgaaggaagcaaagattttttttttaaattagagaaggggttttttttttacttggcatgtacatccaaccggacatatgcagccatttaagctgggaacttagccccttcgttcatatatagattggaactcaggaccttattataatactcatgttattcacccactcgaaattaatttatatgtaagtatatattgcactatatccgtgcctgtttggagcaacgaactagctaattaagaaacagactaaaaagtgtagtatatatatatatatatatgttgggaaggttgtgcatacttgcacgatgtttatattagatttgcgccatggaagcctattctttgtacacaggatgatagcacagtttgatatttcattggaatcttaatttgaccaaacaaacggttgatctccatcatagtttctctctgaaagcattacagaataatcggtttttaaggctgtacagcttagggaccatcttggcatagtttttttgacgattcagagattaattcctcaaacccttcaattgttttcagtgacattgtctttcctcaaaactgaattttttacaatttgatccttttaaaaaacttatttcataaatagacaaaaaacttatactaaaaatggtcctttttaggatgctagagttgctggtgctgttgtctaacgggacatcctcctgctaccgtggcgggtcggcgatgaggtggcagggggagcacgccaatgtgattggcgccctccccccggagttttttttattttttatttgtatttttttgatatttttttcacgcttaggagcatacaagaatcaaccatagaaaagttaaactcaaatggatgaaatatgtgacctgtagaattttccaaagctctaccgaaaagcttctcgccttgaaaacacaatctttgcaagcggaattttgaggttctaatttcgccgaacccggcaaagtgggggagaatcggatgtattttctgtagatgtccgtggatatattatttacctgattccgagttcgtatcagaaagttagtcctattctaagaaatgacaccgaatgtaaaaaaaaaaaccaaactttttttataggatgtaaaagatgtaaaaaaaaatacaaaccctaacttttaggtgactattgcgaaataagttttttaaaaggatcaaattgtgaaaaatccagtgctcaaaatcagcaatcatgacaccaagtgatgacagaaggggcttaatccatttgcgaactgtcttgctcacgtacaatataaagcgtgcacatttagtcatttcaaaatatctaggatggcattcacactaaaaataataaaaattccaatacattaccgtgtatagatatactggaaaaaaatatgaatattagggaatatttaagcccaagtcatctagcctactatcttgtggagctagccgaaaaacccctatacgcttctcatatatagatatactgcatcacaatatataattacgagagtccttaaaataagtgggtcggcaaatacgtttcgccttatatacatttttacaggttcagaatcatgccgtaaaggtaaaaggacaaaaatataaaactaacaggagataaaaaaaacatactctcctatttaaagaaacacactaatatacattattttcccttcacttttgctaggtgtgtgttacaatgggacagacagttatgagatgacaacttctgtactacatgtatatatcgttctaattgcattgtttttagctatcaaagggattggatatagctttaagggagtcagacactatgaatggctgagatcatttttagtgtctatactagagaactgatatgttttcgtggtcacacaaatatctcgaatacattagtaccgcttctagaagtccaaatcccaaaaacaactttattttcgattagtattatcaactagtacttaaaaatacaccggttgataacaccagctaagataatactggagaatctttagtcccggttgacgttaccaatcggaactaaaaatatatttttagtaccatttagtaacaccaaccggtattaaaatattaaagatattttagtacaggttggtcaaccagtactaaagatatccctagggttagttaaaaaaaacatccctatccaagttagatgtgtggacttggtgggatggtttcacgcgtgagggctgaggtgagagatcttgagtttgaatcacatgttttttgattttgtatgcatatttagtaccaattatttcaactggtactaaaatcgagattttttagtctcgatttgttggtcacggatgctataaccgaataaatggggtttttccggtagtaaaaatgagttcttcagtagtggtacgttacctatacatatacatatttgttgcaagtgaagcatttcctttcgggaagttgaagggaatcttttttttcccaattctattaccttttcaataataatgacctactgtt

SEQ ID NO: 5823 - DNA, 716 bp, Oryza sativa
  unsure (1)..(716): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcggaggatgaggaggagggggtagagaaccgccagattcagtcgccgaaaacgccaccactatcgcctccgccggatctgcccgtcggaaacgccaccgccgccaactccgcaagatccgctagcgggagctaccgacgccactgccactgccttcactggatccacccatcggatatgccaccgccaccgatggatctgcgggagggggctgaggaacgccgaatctggcccgcaggagctgctgacaccattaccaccacgaggggaggaaaggggtgactgagtgagagggggagagagacgggtgagagtagggcagcgaatgataaggtcgccccccgtcacctcccacgcgtgcctttatccactcgcgtgcggctctctcttggctcggctcgtttgataggtgcgttttttttaaataccggcaccgataatatattatagctggcggtttttaatatattataattgtcggtttttttaaaaaaaatagcacgtatagtataggtattggtttttctattaaaccggcacctatattcacttaaaggtgatggattttttttttgtattttcagcctgtggaggtgg

SEQ ID NO: 5824 - DNA, 6165 bp, Oryza sativa
  unsure (1)..(6165): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatccaccaccaccactagatcacaattaagaaagaaaccaaaagatcggagaacaaaaaatagccgcagttcggttcaattcatccacctgttcgaaactaacatggttaagcagcaaaaacgttcattattttcgttggaagggggaaaaagagcaagaaatcgtccgtgcctagcatccaactccctcccgaatcagacgcttcataaacaaagagcaaacagtagttggtatctactcttgatgacagcatgatcataaataagcccacccactaaggatttaatatattcacgcgccaaagtaaacaagggcttgtacgaacacaatatgaacgacaaaacctttacaccaacgcaaaatccggcagaagggaaaaaacaagtcgcataattttctcttttgaaggatactcgcacaaatttcttcccttcagctcagaagcgtagcaacctaacgcaccaataaaaaaaacggacggtgcagacgacaaaaaaaaccctgagaaatactccatcggagtatgcactaactctcacttttcccgcaggcttcagctggaatcagcggcaaaatttccttttcttcatatacaaaacaaagcttccaatgacgccggagaagtcccggccacgggacccaccgctaccaaatacaccaaactaacccagcagaagaacacgaaccgaatcaggcatcggcgtcgagcggagggagggattacctgtacatgtagatatcgcggttgctggcgagcggcttccggcagaggaagcaggcctccaggaagtgcccgtacggcagcagcccacccgctccatctcctcctcctcctccacgccagccacccgcgccccccaccaccagcacgtcctccacgccggagctgaccagccgagtccacgccgccgccgacgcgccgccaccgccgatggccagcgtgatctcccctcggctcccgctcccgctgccgctctcgctcccggactccatcggaggggaggaggcgaccccggaggaggaggaggaggaggaggaggaggagggatccaccggggggaggggaaatcttccgcggcttgtggttattcgattcggtggcgcactcgatctcctcctcctcgtcgtcgtgttggatttgggcccgtcgcgaggcgcgggcacggggaagtgttcgtgctgctgcgtttaaaggggagacaggcggtgggaggtggttttattaaggttgagggggagaaaagggtgggtggtgggcccgtacgcggggcccacctgacggtgttggctagtgggatccgttgccttctgggccccgcaccggccttcttttctttttcgagggcttttaatttctttttgctgttttttcacgagcgctccttgcttctgtaaccgtgggcccatctcgggatcgctaggtcatgcgggccccgcggcgttctttgacgctgctttggagccgagccctgctggggcccaccggtcagtgagatcccaaggagttgtgctaggatctaggagtatcagtctaggagcttcgcttcggcgtctgttgcaggttggcgcacagtcctagagctagagtcttgcaccaccacacacgtcagtgactcatgcgaggccatgggcgtgtgagagtcccagaagctcatgctactcgtccgtgtgccccgaattggaccggtaaaaatcctttgctccaggcagcaaacacatgaggtgcgagggagtagtaatagatggcattaatttttgtactccatctttctccccaggaagcagcaaatgccattcaattcgcgcgtgatattacgtcgcccttgtaggtggatttgcaacgcatttgcatctcgtgtttaggggtgtcctggcccggtttaggtttagttcacaccaaactttccctcaactcctaactaggggtggacaggaagctactttctctcaactcccaactaggggtggacaggaagctcgtggctcgttagctcgctcggctcggctcggctcggctcatttaaatttcgtaacgaaccgagctggctctaaagctcgttagagataacgagccagctcgagctagctgctcgcgagccttaacgagctttcattagccaacagcccaacaacagcaggccacaaaggccacaaagcccatagacgaatggcccatcatataaggacaaccctagctgacctaccaccacatgagtctcgccctcctcttcctgttcgctccgcgccacccaccatcgcgagttcgcgactcgcgtcccctttcctcttctcttcactccgtgcggcgccgccaacccaccacgacgccaccatcccgtgcgccactgcctctccggatctccctctcctcttcactccactgctccgctgccaccaatccaccgtcgctctgccgccgccaatccacctccgcgctaggcaccagcgctctagcagcgagtgtcatgcgctcgcgccgccgctcatcgcccatgattccacgacgccgccccacgccgcgccactcatcatccacgtccatggtccgctgctggctgtgtggctgcgccgctggctgccatggaggatcaggagctacctcaaccagatcccagagcaaatgcgcgatttgttgttgttaatcttatattcagtactttagttcttcaattataggtccagtttcagcacctcattgcacttacgcacttaccctgtgtatccattgaaaaaattgtttgggtcagtgtttcagggcattagctcacgagccaaacgagccagctcgagctaggtttttagctcgttaagataacgagcagagccgagccagctcgttatcttaatgagctcgaccgagccgagccgagctggctcgctatccacctctactcccaactttccattacatcacatcacatcacatccaaaactttcctacacatataaacttataacttttttttctagactaacaacttttcccaaacttctccccaatttcagataagggatgtaaagtttcagcgtgtcatatcggatattatatagggtatcgtatgaggtgttcaggcactaataaaaaaacagaatacttgagtaaaccacgagacaaatttattaagcatgattaatctgttattagcaaatatttactgtagcaccacattgtcaaatcatttagcaattaggcttcaaagattcgtctcataaattagtcgtaatccgtgtaattatttttttagcctatatttattattttatgcaggtgttcaaatgttcgatgtgatatgatgaaaaattttagagtgatatctaaagaaggcctaaggctttttcttgtctcatggataggaagtaagagtactccacgagtttaaagcgaaaggtatgttagcacgctgcatgccgtcgctgcaggctgcactgatcggcgcagcaaagtcagcagcactgcatcgcgttcaacacttcaacggcagctcagtatggccggctagatggtgtaccacatcaacggatcaacctgtcgtagactggattactgaaacatagggcctgtttggcacagctccagctccagctccacccctcctggagctggagctcagccaaacagtttcagctccactaaaactgggagtggagctgggtggagctctctcacaaaatgaactagagttgtggagctgggtttaggcagctccacaactccactccagacccaactcctgaagctaaatttaggagttagagctataccaaacaggcccataggctgctttccctacttcatactttgaccacctggtctaccagtgatcccgtcctgggtcaattaccctcttttgttgaccattgtaacgatgatggactactacatgcaaacagaaaacgctgacaaatcatctttttatctccatttctcagctgcaattccggcgttgcattgattcacattcttgggctagtaaatactcctcctgttgatccatgccgtgtgcgcactattccggcgttgcagagcagggttcatgtttagatcattcatggagacaggcgaaagaattgaaagggtactactggtgtactgcatactcagtaaattcagattggccaggccaaaccaaccgggcaggcagctcaattatggcgctgaatgcgacttaacctgataaccacgcttgattcgagctcacatttcttcccactgctactaatttccatactttgatcagcccataagcttaggccaatggtgtgtggagcagtggagcaagtgaggattacgccagatacgttgctacgcgactcgtgtactactccactagcagttgaagcaaagttatctgggctagttaaagctagtgacttgcggtaattaagtatgctcatcacctccgatgtggatttcactgtctactttactccgctcctctcttctactgcctatagtggcactcaaatcatgtgaggaatgagtaagcgtaaagtctaaagctactttagcctagcttacttagagcatcagatcaccctggacgtccggtaattacctctgtttttttctcttttgacaaaattgacggcactggatgctctcctgtgcagctgtgctctgctaaccagacaaggaagtgaagcgcgacagttactgtgctgaccgtgtcgacaagggaagagaaagagagtgcgtgttacggccttattggtcatcggttgcagacaacaacgttataaacttgtcatttcgtgggctcgtttctaggaggtgaaagttagtaggagtagtatttacatcagtaagagcaaggataatattaaagctcatttactactattaatcaatcttaaaactaacatttagtaatagattagcaataaaatttgctataattttcttcttctctatctatctctcacttatatatttattgtatttgtcacactgaattgacattttcctctcactctcgctctcaccggccggccgctcatctaaaatattattgcagggaaccatttcgatattgctctgtgactctaaacaagtgaacattgctctgtgactattcttctctgctgcgacggtgaggattgagaaaggcatgaaaattcaaccctgcacccacaagaaaatgttaggttttttctaaaaagaaaactttctcacctagaagaaaaaaaaatccgggtgaaaatgacctaacgtccatacttctaacaagctactttcccttcacttcgacagagttaagtttaataaattcttaatgaatactccctctgttctatagtataaaagattttggtgggatgtgacacttactaatatcacgaacagggatatcacatcgcaaaaaaaattatattatgagatggagagagtatattattttctctcgtcttgtcgtccatataccgtgaagagcttatttttactgaaagacttttcttagacggtatagaatgcaagtttgcagcacatggtcccgggtatttcgagatcttgttgcagcaacatcacttgttgataggcgactgcacatctgcacctgcatactgacctactgctactaaggttttctttggtatcgagaaattttacataaaataaatcagctcttatgaaatattgtaaaataactgctgagattatagacatataatgatttaatctattccataaataaatcatgacattacagatgaaaactagcatgaacgcatcattagatctacacatgttaactacacagtttacacatgaacagat

SEQ ID NO: 5825 - DNA, 2599 bp, Oryza sativa
caatttttcggaccattcgacgcgtacgtcgtgcacgcgcgccgcctgcccggccggcccggccaggcgagcgagcgcgcgcgtgtgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaatcttcctagaagattcacccaaaatcttcatagactgcgaccaacagtcaagctcacaaaggtgagttctttcaagaatgctctgcaggacaacatcttcgctaattaaagccaacagaactcattaaggcatagtcaacctgccttgcagctcacaagagtatatgcatcttcacttggagagggtatatatattggtactctcctctagtttattaatggtttgttcttcccaggatctaattcacgggatctccgatcacatagactgggttaccaccatagtataactcacatgggtctcaagcccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcctggattagaggtaaatcggctcaacttgctcacagcaaaggagatatcaggcctagttgcactagccaggtacatcaacgatccaatgatttgggagtattccagttgattcctagcaattctcttgttcttgcgaagcaacaagctaggatcataaggtgttggagaaggcttactatcaatgtagccaaagcgatttaagatcttctccacataatgggactgcaagagtgtaatcccattctcacctctaattagcttaatgtttaagataatatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggtgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgtaccccacaggtttacacccatagggtcgctctatcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctttcaaaaaaggtagcat

SEQ ID NO: 5826 - DNA, 11535 bp, Oryza sativa
ccccatgtgcgcaaataaaaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcctattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcgaaacaggcctccgcactcataacctttaccaataaaatatccatgtttagacacgactactttattagactcaaaaacccacttaaatccgtttctagtcagacgggagccactaacaagattcctgtcgatagaagggacatgttgcacgttcttcagctgcacgatctttcccgaagtaaacttcagatctaccgtgccaacaccatgaacagaagcatgtgacccattccccattagaacggtggaaccccgtgcgacctgataagaagaaaacaatgagatgtcagcacaaaaatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgctatcaacccctcaacggagtattcctgtctcttgtgtttgagtgcagtaccgaaacttctccaagatggaggtagttttgcaataatgcacccggccacaaatttgtcgggtaagacacacttaaggagttcgagttccttagccatggtttgtatctcatgagcctgttcgactacaaaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcaccaagaatgctaagaatgcatcccacaaagagagtagtggcttcctcaaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacggtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgctttccaaaaaccttattgccgccttctcccggtgcagaacgtagaaggcagaggttccggagacctgctctcccgatcgccggtgcacgccggcgagcgggatggagtagtctacgagcgacggcgcagtacagagtaggaggcaaaccctagattgatttttcgtgagttgcgtgaagacggcaagtcggtttatatagagaagggttgcttgatcagggcgcccgcacgatctctactgcgcgtaaccgaaccggataagtcgcgcgtaacttatccgaactccatgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcaacgcgtacgtcgtgcacgcgcgccgccggcccggccaggcgagcgagcgcgcgcgtgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaattactgcgctatggactatgaagaaaccctaaacgctgtgaattgaaggtgattataagagctcactgttccaacatcgtgctgtcctagtgtcctaaatgaccactgtttttttctataataccattaaagactcttaatagctccctgacaaaactggactcttaatagttactaatcgtccttttaggtcggccactccagcgcaagataatgaccgtttgttgagcacattccttcatttttcttaggtgaatatgtttgttgttttatgtactaattctagagcaacgcccttttgttggttgaaatgttcaattagtatatcggacatgctcatgtgtcccggtggtccttttgatttgtttgattcgggatgcaaacaaagtttgggggacacctgccctgtattttagattgtggatccaatgtcaccgtcagaataatcaatttcagtttcggtgactccatatgaaaatcttttagtgattctaatgatatactgacccgtaagaaaaatatgggaaaaaaaagggtgttcccaatctcaaacttatgaatatccttttcactaaaaccatcgaatgatatttgctgcagcataagttgcctagttgcaatgcaacacagagcggagcaagacctttggacacggtgagaccctccatttttccacagagaacggaaagggacgcagcggcgaaagcaaaagggcccggaaaagtgcaccgcggagggcccacatgtcatggagcacgaaaccggggcttggaaaggacacgggacttttaaacgcgcagcggagcagtagcaagacgaaagcgacggtggagacgcgcagcaccggttccacgctccctttgtccggtgggcccgtggcctgtgtgcgcggtgggtacgccttgggtggtccgccatctcggtataaaacgacagccacagatattttgtgcacacacacacgtagctgtaccgctccaccatatgcaaatgcaatcctactctacgtgcctatatacgtgtaataaaaaattcgtgtggtgtatatatacacacggttgaaaaagtctctgctggtatatccgtgtgcataaaacatacgaataatacatgtttactgtaacacatatactctggtatttggtgcggtggtatgtttgttcaagaaaaagggatatgctacgagcctattgagtctatgactgttcctcttattgcttctttttgctggactcgaaaatgatccgagctactagtactttttttttctccaggtccacggatgcaaaccacgataattgaagtctgtgttcagtgacgacacttacttttttttttcctttgattcgataattgaagtctgtgttcagtgatgacacttactgaatattttccgaaaaagaaaatcacttctagaacgtttttaatctactgatttatgattgctagtttgctacgtacgtagttttatatccgaagtgacccgaattaggtagagttccaatatcccgtgaggccgtgaccaatcgccttcttccatggccattaaaaacttttaacgctacaaaacgatagaggtaagcactatctctcgatgctctgcgtatctgaagctcaagccatcaaaatggctgagacgcacatttgccatcagttgcttcgcttccaatcgcagtaacgtttcagagatttttgggatcaagccctttggcatgctaagtgactctttaaacaagggacaagacatcacacacaacgtaattcacctaactagttcatgtttgatttaacccttcatcaccattttttttccttttcgcaagaacatgcacctagacgagacgtacggagtactattgaatccattttctactcaccctgttcctagtctctgtacacgactgtaccgtattcgccgccttgaaagttgaaacactctacaggacggtaaattcaccatcatcactactagcgactatatctaatcgcgacctgtgatgctggctaccgtttaagtcaagcgagacaggtgccaaaaacaaaagcgacggtgtttgacaacgggatgtggtgagatcgccgtcagggcagtacagcgtgggagggagcttgccccagatgtaacgttacaattgtacactagctacatagatccctcccttccatgtcaaaacaatctgtggacagtgagccatcatgtagatgcagctagctaatgggttgggcctaatgcatcgatctaaagcctaaacccatggctaatcgtgactcaccagctaatcaaattttataatctgtagtaccaagaatccaagattaggtgatctaatctacctctacaaaggacattaaataaataaattaaataagtgggcgcagtacgtaagctaactccaatgccgctagtagtaagtacataattttaacggcattcacatttcataatcccagcattcattaatcaactgtgtgctattaccgcatgtactgtgtattcgggatttctgatggcatatgcctccccaacgaccagcaggtccccggtacagccagcagctagcattagcatggggttaagttttacgccgccggttgagcgcgtctccaggcactggcttacactataattttgctgagaccaccatcgagattcgtgcgtacgatcctgttacaaaacagaagaaatcgcagtgcccaacaaaagtgagcaaattattggtgatgggcagcactagttaattgtgtgtacagtaatcttggtggtattgtggtcacctttggacgctgtggcaataaacgtctaaagaaattgcgatcaaagcacggacctactacttgtactaggctagtagcaaggtcagtaaagtatcccatgtggagtaaaataaggacaagctgaccccaaaatttggtctcctggattccaaccgggccgcgtctctcgctggggagacattcagtgatacagctggatggacccaacgatctcgcgtttttcttttaagcagcacaaatctgcttttgccttgctttgaactgttcggtttggtaaatcgcggtaatattcgctcgtctcatacaaaaaccttgctgtgctagaaaagtttgtgcattgattcgtttgctaccacaagagaagtatacgaatctagtctaggaggggaaaaaaaaagttaaaattatggaggcacgtaaaaccaggatcggttgggacagtcaaagctgaagaagagctgtgcacttgtgctcctcgccatcgccggaaaaatgctcctgcttttccctgtcgaacgtggcaaggaaaaagatgccggaaaatcaggcaggaaatcccacacagaatcatgggctttggttgtattcctttaacaatactcgggagcatctaatcctacgcatctaatggaacttttaaaagtagctataatgtcagtttggcacaaattatatatctgtgtttgcatcatcaccggctccaatttgccggtcagtttttttattctgttgtgtttttctttctatcattgttgagctaatcctgttttgattgtagatcgatctcatcgacatgtatgtatgtagtagtttatgggattcctgattgctccgttccatccttgatctttcaatatgactcaggttgccatcagtgagattgcaaaggggacaggaaatcattcatttgagactcggacgttgccggatcgacagcatctcaattctgaaactgtggcaaaagctagcgaccaaacctgtaatttgcaggtaaaggatgggttacagctaaccgtatcagacttttcctgctatagagacccgctagtctgttgagatgttgagttgtaacggtggcgccactggtttgatttcctacccctgaagttctgaaatctgaacttcgcaagctgcagcactgcgagcgtgcttgtaatgttcaaacctaggttgcacctactagataagcgtgcttattatgtgtcacaactcacaatgtcacatacttttctctcattcggcacagtttcaatagaaagcatactaaggctgagttcggatgggggagatgggaacccaacttctgcgcacggaaaacggagcagtccattaacacgtgattaattaagtattagctaatttttttttaaaaaaggattaatttgattttttaagcaactttcgtaaagaaactttttacaaaaaatgcaccgtttaacagtttgaaaagcgtgcacgcgaaaaacgatgaagagaggatggaaaaggtgcatgcgaacacagcctaagagtcagcctaagagtgttcataaaacttgttgggtttcacacgcttacagttgagcccagcaaaagcaaaagtagggaagcaacaagtaaagcaagcctcttcggtttcaaatatgttggaaccggggttttcctctctgtttctaaagaacaagtaaataagcttgcatcgacatactaaagacacaactctgtgttctcatcataaagaaatctactccatgctaacatctagaaggaccataaccttaacttcaagaacttgtttttctgtcaggactccttgggcacttagattttgcagcttggcaaagggacaggcccttgatgacctccaaatccccctaacagcttcggcgaaacaaacggcttccactgttgcaaaaaagaaaaagaaaacgacaataccttgtaagccagctgcaaaactttagtaaaaacatttttctttaaaaaaaacatgtccatttcgctgcctataaaacacctaagaattgctaagggaagtaacaaaatgtacatgggggacagttcagttggagaaaaaaaacatatttcattcctcaaaagcagaacacagcggccaaaaaaacaggaggcaaaaatggaggagagcccatgaatcgatcgcctagctccaatgttctaaccttgagaaatgagaaaaaaaaaacaaaccaagactcgcccgaggaagctagggcccaactcggcccaagaccctcaggcgcgtgtacgcacgtagtactagtagcaccagtccccctacaaacagaaacagggtcgcgtacgttttattgttgtgaaaatgtatttgtctccgtcgtcctgcccgtgtcgcaccagaagtcccgaaaataaaaaagacgtggcctccccgcgcgcccgacgcgcggatgcggctcgatcggtctcacacgcgcaacgcggggcctcgcgcggtgccccacgggttggcgtcgatggccggccgcggctgtggctgctggtggtggtgccggtggtggtggtggtggttccggtgctccttccgcaccgacaccgcgtgcgccgccgcacgcttcttccgccggtgcttcgccctgtccacctcgatctgctgctgcctgcactcctcgctgcagaacggcgtgtctcccctgtgcacccacgccacaaaacctcaacaaacttttgcgtgcatgcatcgcggtgaaaggagggagaggacaaaaaaaaaaaaagctttaaacctgtacatgaagatgtcaccggagagggacttgccgcagagggagcactcctcgaggaagtggtggatttgggcgacgtccgcctcgtggacgtagaacatggacgacggcatcgctgcaccgctccccttcatgcctgcggcggcggcgttgctggctggcttcaaagctagctagcaagcaaggccccggcctgggcacgagcgggaagagggagcaaaattgcccccccgagtcttggcactgcactgtcaaggatctcggctggcttgacggagctccggttcgccggaggaatgtacaaataggtcgccggcacttcccatttttagcctcggggagacaaggagaggctgggaattggcagcgtccgacggcaaacctatgaatagaagcggacgccaatcaacggagcatgacacgcgtgaaaaatctgcgtatactttgtttggttttgtgattcttgtttactgcaaaatttggaacaacacactactggccattggagatttagtgaggaaatgggagccattaaaatcaaggcgtctgagatcattcttagggacaatgaacacgggggctaaaatttaaaaacagcgcatagaccgcaggttcagagagatgaagacatgaagtggatgcccccttggcacgtgattcttacttacagatagttactaggcagtatgtacgctgttttggaggttgtttacctacctcaacaatcagtatgctgtttgggcaggaaaaaaaagggattatggagttcaggcagtcttgtttacttagcactttcttaacgtgtaatgcttctgttttactgccgcttcaaaagttatggagtagtatattctgtcaatctgtcgtggttgcaagaaacattctccaatgtactacgcggtcggtgccaccctagcaatcttgttttcttcctttttctttcttgaaaatgcgtgtgcgtataatttactactaccagcatatactgaagtaggagcactattatgttattgacattggtctatagctcacatgtgtaacatgctagcagtacatgtgaatacatacaccacacctcgatcaacatgtctttcagaaattatacgtagatcctacctgtacgtatcccacttgtccatttactaccgaggtcattttcttgacaacaacgctctgaagaagaaaacatttctcgtcaccttcactggcgtctgttactattgacacgacagcaacagcgtacgtcaacctttttgaaaccggtgtgccgctagctaatctcaccgggaagaatcaccctctctattcatccacctttttcctccgctaggagagggacattttggcccaagtccagccgagctgaggtaagagcatgtacaatagcaggctataaaccagctgcaaacatattttaaggagataaataaggagagagaagaacagctggctactgatttatagctagttgtagcacagactccaaaacgcgatgtgtgtatgacagataagaccatatattaatagtgtagtatgtaactattgtataaataagctattagattgactatagattaattggagctattagttggctatactattaaacttgctctaacagtagccaacttcgccacagcaacactctctctctctctcgcgagccgtgcctgcatcattgttccatgcaggcgcaggccgtgtgtgagtagcatatgcaccacatggttcaccgcgacttcgctaaaccgttttcagttggcgtggttagtactagtagtgcaggttaatctagcgccacatgggtgagacttgagagagctatagtattgtgtggtctctgctatggttgtagcgagcagagggggcaggagcgcggcagccacagcgcatgggcgcggcgccggcacgtgcgtgcgggatgcaccccccgaaacaccggcacacggcgagatgcgctcgtctctcgctcaacggctcaagtgctcgtgttggttctcgctggctcggagaaggcgtaacgtggcgagggggaatcgggggaattctttttgtgtcgccaaaggccctagattgcctaaaaggattctctcgggtgcacatggggcgcaacttggggagccacagaaaacggtgaagaaaaaaatccacggcgtggccgaggatgattgatttgttatcgctggttgtttgggctttttaaagtccggagtacgcactaatgccaacatgctttgcgtagtttaattcggttgatggtgaacaacgttgggcgtgacatcatctgctgtagaaaaaacgttagtgtcctactatggctacatgtaccggcagattttgcccttaggtcgtatacgtgagactgtcatgtgggccctccgtttatttttcttttgtggaccgcctgtcaggcagtgttgttgaggaaacgatacggagaagctgtgtctgcaacgctttgagataaaaattgtccaactgctagtacttagtagttgctatagccatttacctcgtgtaagtttccgggaagcaaggctgcacgaatgacaatactaataacaaagcctgcgttgctttcttcctttctttattaccttcccgactttttcgtcgtggagcaaactgtctgttttactacaattcagggccgatattttctcggcgaggaacggaacgaacaatttacctctgccattgatgacggaccagctgctgcaggaggtaccaacatgtctatgatctactgtttgtacacggtatagcaggcggcgacgacattcaatttctgcatcgaacgtacagtatgaattctgttcagagggcaactgaataatggccgctttaactgtattttcatcagaaaaagaacatctaattgtagctgcagcgtgagctctagtagagtactcccttcgtttcacaatataaaactttctagtattacccatattcatatacttcatccgttctacaatgtaagtcattctagcatttcccacattcatattgatattaatgaatctagattcattaatatcaatatgaatgt

SEQ ID NO: 5827 - DNA, 2664 bp, Oryza sativa
aaatgctagaatgacttacattgtgaaacggaggaagtagatgttaatgaatctaaacacaactatgcgtttagattcataacatctatatgaatatggacaatgatagaaagtcttatattgttaaacggagcaagtagtaaaaaagctacgcaacgaacacagcatggagtactaggaaggaaatcgaccgaactaatgagaaatcggagagagctttttacgccactcactttttccatatcaacaggttgcattacaagcacacacacaatgacacaaaacgctgcaccggctgcacgcacgcaccatatttttttgcgaatttgcaaccgtgccaagaaagtaaaattcacacaccaaattgactcctcatctccttgttgcggagatcaggaggaaggaaccgaacaatttcatcgcgaaaagaaagacgcagccggtttgcttctgcttccccgggcttggctttcgttcccgtggaactgtttgatccgcgtgcgctcgactggatctttctccatccgcacacacggtcatggacaagctgtctctcgatctcctcctcgttttttcggttcttgagtttctctaagatctactgttccgtgaccaaaattgtttaccatgcccagaccgggatcctcgggtggctcgccttctgctgcctctgcctctcctgctctgccctccccgtctgcttcgatctctgctctctcgcctcgtcgatctcgatctgctcctgcctgcactcctcgctgcagaagggcatgtcacctctgcaagaacagaaggaatcacaacgccattagaaacacattcttccagagagatttaacctgtcaagagactgacgacagttgtgctgaatatttacctgtacatgaagatgtctctgtttcctccgaggggtctccggcagcggaagcagatgtcgaggtagtggtggtggccgaggaggtcgtcggcgtcgtcgcacgggtcgcagaagaggcggccgccgggccgccgaggcgacgccgcgggcttcacgggggaggcggagtggccggagaagccggcctcgatgtcgtcgtggatggaggtggggtggtagcgcgccatttcttggcttggtttgcttcggccttcggcaaatgagctctctctgttttctcgtttttccggttgggaaaggggagtgatggcggagcgggagaagcaactcgggttttatcatggagggagatggacgggaaggggagatttccgaattagtcctccactgttttgtgaatttctttatgggacttggtgtgttttggctttgtgtagttactgaaatctacatctacattgggctcttttgtaagatgggataattgtggaactttttatataggctgtgtttggaacttccggttccatcccctctctcgttttccgcgcacacgcttttcaaactgttaaacgatgcattttttataaaaagtttctatacgtaagttgcttaaaaaaatcaaattaatccttttttaaaaaaattagctaatacttaattaatcacatgctaatagactgctatgttttccttgcggggagatggattcccaatccacaagtaacgaacacagatgttccttgctcataagagcaggtttaatagtatagtcaactactagctccaaatcatttataactaatgtaatagccaatttatataataattacttactgcactattaatacctggtcccatatgtcatacattacgtcttggagtccgtgctaaagatggctatagatctatagcctgatgttttttctctcttcttttatctttttaaaatatttttatagctgatttatattctgttattatacctgatctaagtgcgaagttaacatctgccgagttgtttaggcacaaatctcaatctctattcgagcgtgtagagttgtatttgctccgtgacggcaccaaggaaaacaacaagcactagctatcagaggtaaaaaagaaatggcgcctgagacagagagaccaatagcacggcttccacatatgatgtgtttgatgcacttgtcagtcacacgattactaattgggccatggtcaaatattacgaaaaatatacgaattttaaaacaaattaagtggttctgttatggtgtgcgtcattgtgcatctctcccgtatgatcgaaaagaaagcaataatgtatacactaaaatttgtgttgttgtctaaaaatatttattatgtggagtatgtgttaccatggaaaaaacaacttctggttcagtgcgtgggcacctttcatacataatgtaaatatttaaaaagggtgtactattattgtgtgtctgattgtgcatatctcatgtatgattgaagagagagtaatattgtactacctcgttttttaatacttcctccgtttcatattacccacattcatatagatgttaatgaatctagacatatatatgtgtttagattcattaacacatgtatatatgtggacaaggctataaagtcttataatataaaacaaagaaagtacataacattgttaacttttgaatacatgtttaactatttatcctatttaaaaagttaagtaactgttatttattttgctatgagttattttataccaaaagttctctaatatgatttat

SEQ ID NO: 5828 - DNA, 1268 bp, Oryza sativa
caatatttttttaatattttttaataagatgaatggttaatcctatgttcagaagtcaatggcgtaaaaaacaaagatagtgtaaattcaaatttgtgctataatctgtacttattaaatttgtcttatcatggaaagggtgtcttccgtatgatgcaaaaatgaaaagaaaaaaatcatctcaaagttcaattatacatatttgtatttgaaaattgtgagtaggacaaatatcgatttaaagtactcctaagttcacctgggcagcaaattaaaggggaatttattaatcggacccgcgtaacatagcgtacaaactcgctttctctagaaggcgtcaggtcaggtgaccaacaagttgcacggccgcaaggctgtcatcgttgagtgccgttgctgccgcgatgaatcagcctagtggtccgggcccggccgcactattgttctacttcccgtaccactgttcatctcatcaagcaagccggtgtccgtctcatgactcgaattatcaaaccaaccgtctgataggtgcacgtattttttttctcaccaaatcacgcagtttcttgttcacaacatgtcacgtccgattggacggactgaacaattcaggttcttctgagctgagctgagctgcctgcaagtagatcgccctagtggctggccggtggttggctcctggttttttggtggccgcattcgccttacgcatttgatcgctatcaggcttgggatctcatctcaccacccaaaaccaaaaaccaaacagcagcgcagccggtggtgcagctgcttgatttgacgacaattctgctcaacctgaagggaggaaggtgggggacccggcaaattgcgatctcggaggttaatttactcgaaagaaaccggccaattggagggcctggcccctactttgcgtcgccttttcttttctttttttgcttttctatcttgtcgtttttgatgtaccgtgtgctgtgttgatggcctcttttttaagcgtgccatgcaactagggcgataaaggtattggtgcatgattcgcatgagagaatgtgagactgatgagtgtggcgggggataggcactgaagggcaactatgcaagtaggagtagtagccaaaaggatcaattgtttttggttgcttatataacctgaaatctacgaactactccgtacttttttttaaaagaggttctacgagctacttggagtaacgtgacacatttgttcaagtatagaaaccgaaaaaatgacatgtatattg

SEQ ID NO: 5829 - DNA, 15770 bp, Oryza sativa
ctacacatttatttatgtgaagaagaaatcccaaataataactactaatgttttaatatgtcgaggatgtcttgtagatagaagataaactaacacactgcagcgtttctcaaaataaaaacagacacattgcagcggtgtccaaaaattttagtacacaaatgtagaagtacgtgtatgatgggtagactattggtgcctcaaacttttccaattgtatgtagatatgtggtagtgtgggtaaaaatccgagctaaatgtttgtgccttgatgtacttaaaaagaaaacgaggattgctagaccacttaatgcaatccgaatgacatagttaataaatataatacccatacactcgcatgataaccatttccacaagcccgagctcaaatgcacaaaaggaacaaaccagcggtgctccaaccctgcctgtaggcaagaccaaggatccaggcacttgcgtcgtcgccctcggcggtgtgcaccccttccattcattcgagttggacacgagcgttgtcccaccaccgctagtatatgattgatgtcccctctctacagccacaaatgccgatgcactaagttcgtccccttgcctcgtgctcgaggttaccggatggatggtacgatcaccgccgccaaggtaccagacctagcatagtacctcgtaccaaacctgatatctctaggtatcagtcgttacctatagatatcaaatagtataggttaatgtggtgcaccgttacaccgccccactgcacaaagaggtgtgctgccgtgatggctacctcccatctcctcgcctaggatctccgtcaagcagactttgcctcccgcccctcagctccacccggtgctgtccactatcgaggtggcccctcgattgccttagggtggcgaggtgtgatcggcggtggtggaaggccacgtacagcgatgggtgagctcactgaaaaccagatgcacacggtggctattggcccggagggaacgaaagaggaagaggaggtagggaagcggagaggacgcgatgaagagcatgggggaagaagaggctagaaagttgagtaggcacaaacgtggatttcattaatctatacctgtagaagaacccgatattgttcttttgaaagaaaaataactactcgcctctaaatgatgactatgaatgaatcaacatttgagaaaattattagctaatgctagggcacatttggcaagggtgatttgaattagatgtgtcctcacttttcgtaagcatgttttccgacttgctaattggtacaattttttaaaattagatatataaaaatcatattaatctattttaatattttaaaagatagtactccctctatcccataatataaggtgtgcacacattccaatattcaactttaaaaacatttgaccaataattataataatataaattaaattttatttgctaaaattaatatcattggattgacatttaaatttactttaagatagttataattttgttgcaataatccttatagtatatgaaaaattatatgtcagagattaattttgaagactgtgccaagtttgactatgccatatattatgggatggagggagtacgacttaattaattatatggtaatcaatttttttcgtgaggctaatcagttcagccaacgctcatcttcatactcacactttagactgacatgcgggccgttgccactaaaaccactaacagggcccacatgtctggtggcattgacttttcgctgtatgattaaccagcatgaaccaaacaacaacagctcatcgtttcataagcacattgtctccagctacttaggcgggaggctctcactggctagtcctactcatgactcgtcgtacatcatactcattgctgactcagactcgtgcacatgcatgctagatctaagccggcacacgtgtaccagctgcttagccaacatgagtaatcaagcttctaccaattcctttctttacttgcacatcaactaatcccctctgcttaatttacttggacaaacaggagcccttgctgctgttttcccagcaaaggagaggagtatagaagaccacgaattaactatccatgcgtttggtgatggagtcatgtgctcgaatctacacgtacgattaggcagcctctaaacttttgcttaaaagccttaaactaagtaggcaaccgtcatacactcccaaatcataatgcttattccctccgtccttaaaaaaatcttaattcctaggttttcgtgactaacatttgaccgttcgttttatttgaaaaagttacgaaaaaatttaaaaagataagtcatgtataaagtattattaatgttttatcatctaataataataaaaatattaattataaaaaaatcatataagacagacggttaaacgttgaacaccagaaactaaaaattgagtagggcacctagatggccagccttttgcccacgaatcagacggcagcaccacatggttaggcacgcacactgcaacggtgtgtccagattccagaataggccaatcgtggagctaagctcctcctccaaacgacgggaatcatggcagatgttggtgctgcacgccatgtacagaagcacacacctagtgatgcggagacgcttgacgcatctgcagattccgggcgagacgcaagcaaaacaaccgtacacgtatgcatcaacgcacgatgggtcacacaactcacacacacagccttgcgctcgaagctgggcgggttttgtttagtcgagagcgtgccaggttgcgccttgggaaaaccgcgggtggagcttttgttttggcttgtgggagaaacaccggctagctagctccccacactcgagtggctcgacaaatactagtagtacgcctctttgcgcaattgcacgcctgcttttaatttgttgcacagagaaacgtacgggagccaatggggtctcgcgttgccggcgaggcctctttccgggaagcaggcagcggccattgtcgagattggtgcacggctttttttttaacctgcaacttcacggagaagcgcaaagcggattctggcgttattcacctcgagaggcctaagagcaactttaatagcataacccactgctagctccaaatcatctatagccaattaatacaatagttgtttactatactattaatacctgatcccatatatcatacacacattacgtcttagagtccgtgatgcagctggctatagctatagatctgtagtccgctgctcttctctttttctttatctctctaaaatatgtttatagctggcttatagactgctattgtacatgctttaacaggatggcacattggcaggaaattgtattgtatgagtggaatgcatcgaatggctgcataaaggagatggtttgaattgtcgctgccacgggcaggggcgggcatggacggtgcccgtgcatgcgctgtcacggcccccgcttcagcggtctgacacatgttgggttcatgcatccgtccgcgacgtgtcgcgctgcctgaatcgctgtgtccctggagttttctcttgctttcggtgaaagctaggcaacagaaactggagaacggatatttttgctgcagtaattccttgcgaggtgaacctaattttctcgtaaattagtctcgacctgtacacgcacaggcgagattgattgttctcgtaaatagttgaaactgtaactggggatgaaaaaaaaatcttaggaacggctccgttggggtagctatgttttctcatcacaactctgatgattcccatggccatctgatctattggggattttccacagcaaattgattcataagggacataccctaattgcattagagtacggtgaaatcgcgatcatatgttacttgaactcgtgattctgctaaaaaaattgcattgtaggaacttggaaactttaaagccttcccaactgctttggatttacaaagtgatgatacactcaggctctaacgcgcacgctggcgcacaaacgcgacacgacccgcaaaagggcgccaatctgagagccaagacaaggtcgacccgagcgacccacatggcaaagatctcatcttgccgatgaacttcctcagactcttctccggcgccgtcgggcatcgcggccttggagaaatcaatctccttcgtcgccgcatgttgatgcgtggcttagctcttgaaatctcgtctggattcaacgccaattcttctcagctgatcattatattatcgacgcagcttgattagctcgccacggacaccttcctggtctcccggtgcccgcgccgcgaatccgccctcccggagtactgctgctgctgcctccgtccggccgacctcgcgtacaccgcgtcgagctgcatctgctcgtagcggcactcctcgctgcagaagggcgtgtcccccttgtacatgaagatgtcgctgtccctcgtgagctgcttggtgcagagcgcgcaggcgtccagcgcgtgcctgccctgctcgcccaccggctcggcgtcgaagaagaaagcgcaggcaagagacgccgccatggtgatgatgtttatctgagaagcgttttctcggtggtttgtgcttttggctagtgggaagaagaagcgaggcgatgagttgttggtggagctcgaacgagtgggagtgcggggattatatgcgcagctcggtggggcgtcgcgtcgcgcacgggcgggtgggaggggagaaaaccgtggttccgcgccgagctgcgggcgagacggcacacgggtcggggaggcgggttcgcgcgccaaccggaggcgggatggtggcggttcgtcttgtctcacttttttttcaattcgggcctggaccacggtgccgtgtagtggttgggttgggttcggcttggctgccttgatgggcagcgtcaagtacgtggcggacgagaacgacaggaatctagagggggggggggggggggggaaccgcaccaaagacgtccctgttgttgttacagggacgtggagtcagtactcagtaccgcccaaaaaccgtgggctaggccattactcactgctctatcagcaagtggtgataatgcttgcggcttgctacgctttctgcagcaaaagcgaggtgcaacaatatattcgcggcaataatcaatcggaaagcacttggcgcggctctcttagtcggaatcgtgtgcatcagcatcaaatctacatcattacacggccctctaaacagcggcttataaactaatcatgtgccttagggttgataattagcgcgccagcctttttgccaacatatcgggcaggcacccgcacatggtttggcacgctaagagcaagtttaatactatagcccactactgtcttcaattcatctatagtcaatctaatagctcatttatacaatagttacatagtacactattaatatccggtctcacttgtcatacacacgctgcgtcttggagtccgtgctatagctagctacaaatctgtagcccgctgcccttctatctcctcatttatctgcttaaaatatatttgcagctgacttatagcctactattgtacctgctctaataattgagggcaattgcttcccttcccccactgcctggtttgccccacctagcaccatagtagtagtgagcatcgacgtgagctttcaagaaaaaaaaaggaaattcagggccttctcttttctttttctccttttttaattgtgtgctccatgggaatcttgggcgagtgtggcgcgtgcatgcacgccaggtagcaccgtgtgaacagcaagttggatgctccgcaagttggcacgtattctacgtactaattccccttctttgcaagcgaaccgtgcagcatcggtgatttttaatagtgaaccctttggagagaagcatatacttaggggtgtttagatggggttaaaactttttagcccatgtcacatcggatgtttggacgctaattagagtattaaacatagattaataaaaaaactaatttcataaataagagctaatccgcgagatgaattttttaagcttaattaatctataattatcaaaagtttactgtagcatcacattgtcaaaatcatgtcgttattagactaaaaaattcgtctcgcgaattagtccaagcttatggaatgagttttgtaattagtgaatgtttaatactctaaattagtgtctaaacattcgatgtgagagggacttattccaagtccctgaaaaccaaagagccccttaggcagatgattatatttgctgtttcattagccgttagatctcgccaggtttcgcctcggcaaccgagcacgtttttttcagcggtagaagtggtcagtgggggaagcacctcgcagactcgcggttggcacgccacgagattccattggtagtttacggctgctgccctcggcccgggaaaacgggagagatgggtggcatccatggcgttgccggccggtcaggcaggcaggcttcgtcctgggaggcagcttttctcgagatccgcgcgctgtttagtttaagtgcactaggcttagcactgaagcattgcacgtaatcatcggggtttgcgaggtaaatctcgtgatggagatacgcccgtactactaaaatcctcattagtgaggtacaaccagcataatttgtgctatcctcacacagattaagcagcatgcgtggtgagaaatgtttctacgtcgcggtagcaggacaggtccctccagtttgtcgattggaagtattcgcctctgggtcacagatgttgggcgatgagtggggatcacataataaaaagtggtgctgcatctgatgggcgtgggcggcgtcgttacgtgctgctgcatccgcaccgagtcacgctctgcctggtagcaatcggacacatgttcggtcctactacagtaggtccagccaaagccgtgacgcatcgctttatttggactcagcagcgtgactcggtgatgagtagggtgtgagcagaggagttgaaacgttcaatggatctgacgttggagcccctatcatttcctccactttggtcttttctttagttgtctaagtggttgttacctcgcccactgataatccaattttcttaagcagcagtttacgtggcgttttctacttaaaaaaacaacaattagcatcaaatcagctgatttcccactttcttggcacacatgatcagtactactacttcagtagtgttctcgtttactaccagttcatggaaacaacgccagactgaaggagaaaacagttttaccgctcgttcactaaaagaacagtttaaagtgtacagcttcaaagcagcagacgaataaacagacttgctcgaataacagacttgctttgagagcttgcagcgtttgacagattttttatgagggctcaaattatgaaaagtcacgggtgtttcatactcctaaaagagtagacacaaatatgattctgctcaaaaaattatggctcaatagaacttctcggaatgcctcgaatatttacagcggaattgctcttcacaccaactcagatcagctcctcatacaaaaggagccaaccaaaaggggaaaaaaaagagaagcacacatggcctaaattaaaccatggtgcctggtgaatctcggagtcccttcctcagatccgtcctttctctgcttcgactccgaccagatccatccatcggcacagcggccggccagacatgagcaagaacaactccttcatcacatcttgcaagctcacgctcgtctacctaaggtatgcagctcatcaacagctcgccacggacacccccgccttccgggacacgggcgccgccggcgcggtctcgtgcctgctccgctgcccctgctgctgctgcttccgcctggcgctcgcggcctgcctcgcgcaggcggcgtcgaggtgcatctgctcgtagcggcactcctcgctgcagaagggggtgtcccctctgtacatgaagatgtcgctatcgcggcgcagcggcttggtgcagagcgcgcaggcgtccagcgcgtgccgcccggtctcgccgaccggctcggcgtcgaagaagaaggcgcatgcgagggaccgtgccatcgagaatctcccaagcttttcttggctttgcaacctttttttgcttgtgcttcggagaagagagtgaagtgaggaggtaaccgtgaaggggacaggggcggggtatataaccatgcgggggagaggtaggcgacaaagcagcggcgggggtgacgtggtgcggaggcggaaagtggaggagagtgggggaagggggggaaaccgtgggtggttctggaaaaccggtacgcgagacggcccaccggctggggaataccagagtccagagccaccagcgtggcggagacgggacctctttttttttttttttgtacgagtagtggcttttccgtggcaatggcccagtggtgcagccgttgggcaggtgggctccaccgcgcggaaacgacgaaacagcgcgttggatccatcgtgccatggactcatcttgacgtggcacacagctggatggcttcacgagcagacatgggaacactgtactcctacagtcctactaccagcaaatctgttgttgctagctggagtcgcctggttcaacgagcgaagcttagcttccgctttgtaacacaaaacagccgggcctgaggctaacacgaccaacccacatagacccatcaaaaataggttgatgtgggctgcttctttcgggtgggttgggctgtttgcgtaacacctgtaataggaataagttcaccggaggtccctcaacttaacagtgagatttttttgagttccctcaaccacaaaacagaaatgtatacctctagactcactaaaaccgttcaccggaggtccctcggcagtatttttacccggttttgctgacgtggcatcctagtcagcaaaaaaaacacgtggggcccacatgtcagcttcacatcttttttctcctcttttcttctccttctctcctcttctcttttcttttctctctgagcagccgcgcgccgtggccgccgtcgtcgtcggctctccaccgtcgtcgtcgccgtgggcgaggctacgcggcgcggccgtccggcggcggagcggaggcagcgggcggagcggcgagcacggatgcgggcggggcagcggagggcgagcgcctcaacggagcagcggaaggcgcgagcgtggcggcgggccgagcagtggagcgcgagcaggccgcggacagagtagcggagcgcgagcgcggcggcggagcggcggcgagtgagcgcggcgaccagcgagtttgggagggagggggaggcggccggcgaccaagaaacaatcgcttcctctgcctcttccccttttcccgccagtggtgcctctcctagcatcgtcagccacccgcgggggcacggcggtggtggcgaccgagcacgggggagctcctcgtcccttccactgtcttccgcttcgcctagctcgccctccgctgctttgcccaccgctgcgctcgcccggcggccgttcttcggccgcgctcgccttccgctgcaccccctgcatccacgctcctccgctgcacgtaatggcatatatacatgtgagtgtgctcagccatatacacatgcttggctaatatatacgtctgcatgttatcgggcggcaaaccaacaagaagctagctaggctatagctggtcgtctccatgcatgcatatatatgctcatacgaagacgcatgtacatgcggccgtctgtacccggcgtatatgcgtatgagctacgacgtcaagtgctaccgcgaggtcggcgaagacgacgagggtcaccgcgcccgcgccgaccaccgtccacgacgccgatggcacgccgagcgtggacacgctcctgctgcagctgcgcgagctgggcgtccgggaggaccatgggatcaggctggcgacgctgccgccgccaccactgccgctgccgcggcataggaggagcgtgagcgactggggtgcatcatcagccggcactttgaaccacctatgcacggccactgcgacgcctggccgatgtcgccgaacggccgcgccgtgtagcctcgcccacggcgacgacgatggtggagagccaacgacgacggcggccacggcgcgcggctgctccgcccgtagcctccgctccgccgccgcgctccgctgcctccgctccactgtcgggctcgcccgccgtctgctccgcccacagcccgccaccgctctgctgttgcgctcggccatcgcggctgcgcccgccgccagcctgaaggagaagagagaggtgagaagagaaaagagaagagaaggagaagaaaagagaagaaaaaatatgtgcagctgacatgtgggccccacgtacctttttattttttttgctgactaggatgccacgtcagcaaaaccggacaaaaatactgccgagggacctccggtgaacagtttgagtaagtttaggggtagacatttctgtttttgtggttaagagacctcaaaaaatctcgctgttaagttgagggacttccggtgaacttattccaatgtaataacacttgtctatctccacattggacgttttgacaagaagtgggtcgtatgtgtgaggataacacttatctatctccgggtggaaggatatctttgtgtgaggatataacaagtcccaacagacagatcccgttaacttccaatggaagaaggcctagcaacatctcttctctactacttaaaaaatctatagtggtgacggtaactccatacacgcggaatatggatcatgggatcgggagatcagacggtgctgagggatcccatcgcacgcgctcctcccctccgcctgcgatgcatcccctccctgagggatcccctcacggtcctccccctcgactcgcttttctccccacaaggcagctcgcgctcgcgaacccgccgacgctgctcctccgttagcccccgttgctccgcatcacgcagcaccgcgcccccgcaacccatcatccctctcgtcgccctatctcctctcctccctttccctcttgcattgccgtcgctgccgccgtcatcgtcgcgtctcctcaccatcgatcgggatcggacgtcggccagtccctcctcgcctccatccccaatcccctcgccctcttgcacctccatcacgaccaacgcacgccacactagcgccgcctcgccaagcgccacgacctccgtcccgcgacgccgccacatccccaggtgcccatcttctgccgcccactgtcgatccctcgtcgtcgctccacctccatagcagatcccctccctggaaccccctccccttcccacacaccactccctcccattgacgcaccttgatgcacgtctccccaccttttgcccgatcgcccccggaacggatggatggatgcctccacggccacgctgccggtcatcgaagcgccctggccacctccgtcatcgtgtcttgcccgtctccttcgcgatcagccgtcccacccggcgtcgacgccgggagtctggagggactctccaattggtcctgtcacctatgatcttggtcctgtcgatgtccgcctctgctacaccacctatgattttgggtatggaataactgatttatcttgtgatggttagggattcatgttttggatttttttttttttgctttgattcccttcaagctaaggaagaagtttgtacttattcagtgtttcagtatgttgtatctagaactacaaatacaaatacatgatatggttgatgatctgcaattcttcttcactatatactgtctgtgttaatcttttagattgaccaatttgggattatcagaaaaatgtttctagattatcagaaaatgtcatgaagtcttgtatgtttctaaattatcagaaaatttccttcaaaaaaaataggggctattgcattcttacccctattttgaagttcaattgtgattttgccctcgctttttagggtttgcgtttttactcctacttttttgaaacgaagtagagatttgtccctggtttggatggtcaatttaacggggttaagtcgagcacgaaaagacttttatgcccttgctagctattgcatatttgcccctactttttaaacaacacttgtctttttacccttattttgtactgagctttcgtgaaatgattcaaaatccgtatgaaaatctaatggcgccacattgcatgaacatgaatgatgtctatgaatggtaagttcattaacatcctgtgtcttactgcataagtgcatagtatcagccacatcaggtatcttcatgttggtcaagtcctttcgatctgatgaacccgtcaagagcaggattcatcaccaatggtttgccgctccgaggagtcgctgccatcgcctgctgctcctgccatagcgctgaggatcgccgtcgctgccaggtactcctgccgcctcctgctgctcgcgacgccgtgttgaggagccatcaccgccgccttccggcctcgccgaggagttggagccgcagcttgctcctggccacgccgaggagctgcgccgccacctgctcccggccgcgctgaagagctgctccaccgcctgcttctggcgccgccgcgccaaggacttcgggatgggaatggatctgggggaaggaggatatcgaacatgtactgatgcacacccacatatattacttaagggtacaatggtaatcccatatttccaaaattatttttctcttctaatttctctttccttaactgaatattgtgggacccacctaactgccatccatagtaggggcaaacggcaacttcgttcagagaaagcgggggtaaaattgcaaacgctaaaaaactgagtaaaatcacaattgagattgaaagctggggtataaacacaattctcccaaaaaaatattatgagaaaatgaaagtgttgtaaacatgactgcttgttttccattgccaaacagactccattttggattttattaaccaatatagtctgtattgtcctggttattacaacaaatcacttgttgctctcaagtgcgagatttagccatcaaagctagatggagtaaaaagattttgttgtttccaccatcctctgcttttggtagatggagtaaaaagattttgttttaaacctttctgatggttaataaagctgttttttggtgatccattaagctagcagcacttaccgtggactgaagatgctgattaagtcttctcccgctcgcagacaacacaggtctggcttcctttcagcaaatctctcccaacctccatctccaaggtagcatcactattttccctttctttttattttcttgtgtgttggctcctagcctcctacagacagctgcggaatcaagaggccctatggctgtgtatcttaatgtttactcgatttctgctcaaaatgtttcctcttttatttataagagactgcagccatcttgtttgatttcatttcctttttgtctattcatttttcagtgcctggtctaataattcagaaagatagctgggtaaacctgcatagaattttcaaattcatatgaattctaattttccttccgggggtactatggccgattcaagaagtgtcccacagaaaggtgtgcgtccttcactgttcaaggttcaaatgaatcctcacgaaatgtaaaaacaggtgacttacgacatcattgattggtgaccctgttagattatttttcttttattgattatggtgctgtagaaaagaggttttgctgtactaacattgtataggatataataccagggccaaacatttgggtggtttgtattaatgctcttctttttctagccaatcacttcattcagtttgacaatatgtatatcattttttgtccttaacattagaatggtaatgctttaatgcagccaacttttttacaaaatattctaagcataatttccaagattgccttaatgaaatgattgtcagacatagatgcacgtgcctttttcttgcattatgaaatgtcagataaatttatttcaagttactacttgcaaagtcgtcaaatcttagtcgagcaaaagtcagcagtacacaatctgcacatatacggtaccgttcatttcgagcaatgtctatacatgaaagtccttttttagcagtcaattccatggtccctgcaagtgtacattctatttgacaatgccacgtttattatgattttgcatgcttatgcatgatattatcaagctgatacttcgcaatttccagatttatcaagttttgagttaaatttctatcaaatattggttatttacagtgtcaggttgtctaaaacaaatacatgatttttctgattgtgtccacattttggagttgtagaagtgcagggaaagctaggcaaatcagttgagagaccgagaagctgagcattagatggatttagggcactacatgcctttggcacttcttaagccatagccacagtattgatcaaggagcagccaagcggactgtggcttgaggtgatgtcctctgtacctaataaagaactcagctccagatttgatacagatcttctattgcataaaatacttttgtattcaatttgatttcatgaagcatactgatcaggaattaccatgttatgccaattgttgaatccatttttttttgggtgcaagtttcagtttgtcaaaccttttctcattcttttcatgccagagcaagaaagcatatgagatgtggataaacaaatgcacgcacaatagtattttggtgactttatttggatgtaatatatcttttaatcccaaggaaagaggatatattattcttctgacatttatcttctttcacatatggttatagttccttttttttgcgccattaacttgtgaaggtttagaacttagaaggtcaaggttttcttgatccataggctgccttgaacttcatagatggcatgactatccaactttattatcctaaacaataatatagatctgtttcgagcatatcctggtggcactgaacagtgtaagagattaagtgctcagctaggcgttcagcagtagcattgagtgtaagttgaatagcttcatgttttgcattcaacttatttgttgtattgcgtctaaggagtgagtgttagttctttatatttctgaagactagggtatggattatctggagattgtcaccaaagtttagcatattttaataaagtttataatcaatttatatgagatgtgatatcgttgttctcttttactatggtaggggctaacgaaagagagtggatttcatcctattatacttgtgcttagcatcagctcacagcatttgctacagttatcaacaactggctcagtaagggagggccggcggcacgtgaggcggtccactgctaggcgcaacaagctcacgaggaacaggcggcaaggtatgtgcatgatgcggtctgcacggcgagccacacagtttgctcgaatgggctggcgctgtgagctgcagggatgcgagctatggaagaatggatgacgcatgattatgaatcctgaatatcggtgatggtccaatattcaatgtaatcaaatgatgttcagtttctcacgaaatccattgctttttacattttgtatttttcttctgtcaaaccagatcaagctgtacaagaaacaaagtaaggcagattttttttttcagagggctgcagga

SEQ ID NO: 5830 - DNA, 15251 bp, Oryza sativa
aaatagtaaccgaatctgattcgtatccaatactagctcgcatcattgctgcttcatcttttttccccacagtaaaatcagcgaagtgacggtgcaccgacgcccaattcctcagcgtcatccgcccgccaccctgtaatttcccaccctccagaaccgcacaatctagcccatccaacgggcaggcccattagcacagaccaccacacttacactttcgctatccaacaggcaggcccattagcacataccaccacacttacactttcgtcctcgtttcgtgtaatatggttaacttgatatggttgaagtgttgatgcagttggaggtagaagcccttataagttgcttgcccgtaaccgctcgccctccagaaccacgcaacccaaacccatccaacaagcgggcttatttacacatatcactttacttgcactttcattcttctttcattaaaagggttaatatgatatgattggatggataagattttataagttgtttacattattgctaaactaccaatgcggtactaaacatgcacacacaactctcatgggctatgataccatatgtaatgacccaccatccagaacaccttataagttggttacactaatacaaaaccagtaatgtggtattaaacatgtcctcacaactctcatgggctgtaataccatttgtaatagcccaccctccaaaaccgcacaacccagcccatttgatggacgggcccacttacatgtaccattacatgtacacttccgtcctctcttcacgtaaaaggcttaactcaggagaaatgtggtactaaacatgtgcacacaactttcacaagccacacaatccacattctaattgggtcaagatgacatacaccctctccttctctagccgatggcactgccctatcctctcacgtgcatccgcctttcctttctggcttctaatagattgagttaatagatccaatcctcttttttaagagataaactcaatattttgtttgccctccattatcttaggttcccacaacccaagcaaataaaagtattgcctgactttgacatagataaataaagaatgatcacagtaagttctatctcagcttggtattatcagatgctttggttgttttttaacttgaccaagctttaatgaatatatagcaacattttcaacaaacaaatatagtattaaaatatattcatcttttgatttaatgcaactaatttgatattgtactcgctttttttataaactatagtcaaatttaaaataaaagttgattaggagaaaagttaaaatgtgttataatatgaaacggatgaaatacctaaaaacctaaaatttacaagccaaacagcagcctaggtaacacaaaacaaaatattccttgaaacaaaaactcgtcgctatcgctaaaatagtttcgcttgaaaatttgtttaaggcgctgttattttctccaacaaaagttggataaacttttggatatttgtggtacgcttttcaaactgataaacgatgtgtttcgtgcgaaaactttctatatagaacacaagatcatacgttaaaactcaattaatccatttttcaagtttgtaataattaaaactcaattaattatacgttattatcacctcgttttacatgaaaacttaatttttatcttcatgttcatcttcacgaccttcaaacaccacctaaatacagaaccattagtagctaagaaagcacattctttgaaccagctacagaagactaagataagtcagcatcgaactaccaagaaagaaattgagcagtcagcatcggagactcggtcaatgatgttccgctggtgatgaactgtatacctcttagctactggaggctacttgttatccataagttattttcacaactactcctaattgacacggtgagtatgatcgttggtgtgttccgcggaggattcggcgactattttagcatatattttttttcggctgctgcgagttggcgatcctattggtctgtggaaatgggcgcaggattactgcctgcacaggtacaggtgcacacacgccgtggaaaaaaattagcatcagcttggcagcttggacccagtaagacaaatcatgtactacctccattccaaaataagtgcagccatatatatccgtgtttagcgctttgatcatccgtcttatttgaaaaatttataaaaaaatattaaaaaaatagtcacatataaggtactattcatgttttatcatctaataacaataaaaatattaatcataatcttttttcaaataagacgaacggtcaaacgttgaatataaatagtgctaaaactgcacttattttaggacggagggagcacaaagtacaataagccgccagttttttcttatgctgttgtttgtaactagattcattaacatctaaatgaatatgaacaatgctagaaagtgttacattatgaaacggagggagtagtacagtaagtttcttgctggaatgtcaaaataggagtggacacatttagtatcagtgaaaattttcttttgggacagaagcggcgagggactgtcacgtaaacttatctcgcgtggaacctcccaataaactgcgaccattcgtactattacaactactgaccatgagagatcccaaagtccaattgaaactgaagggcagtgttccttctcttcaagctaaatatattttaaattagatttaaatagcgaaaaatataaaaaaaaacaagttcagatatatatagtgcatgcacttcacttaccttgattttcctttcataattaaatttacttgttcttcaggggacaagagtgaacatcccactaggtttagaaaagattcaatcaatcaaatactattaaagagaaccgaagtggttcgtttcacctgtttattttgtccttaaatcagtagtactcctagcaaacgccccaaaggccaaaaatctatcctgggccgaacggcacgtgccaaatcgttctgcgtgtactgcagggccgaatccgcgtctccgccgaatgagtaacccgaagcacacggcatagccgcatgggcgccagggtgggaaactcggtgcaccacagccgttcttgttccccccgcgcgatcccatcagctcaccactacaaaaagttttcacgcactcacccaaccagcaagaacgaaggaactaccacgctcgatcttccgctgcgcgcgccgatttgagctttacgccggcctacccaattacccaatccagcaagaacagcatatactcgtcccgcccatggcaggatcgactctgttccgatggctcttcttactgctggccatcgtgtcgcttgccgcggcggatagcggcagcggcgaagcagagaccaccgtccccggacaaattcgcctgagctgcggcgcgtctgcctccgccaccgacggggacggccgggcgtgggacggtgacgccgtgtccacgttcgcgccgtcggtgaccggcgtcgcggccgacgcgtcgtaccaggacccctcgctgccttcccccgtgccgtacatgacggcgcgcgtgttcagctccagctacacctactccttccccgtcaagcccggccgcgtgttcctccgtctctacttctacccgtccgcctacggcaacctcggcgccgccgccgccgccgcggacgcgctgttcggcgtcaccgcgggcggcatcacgctcctccgcgacttcaacgcgtcgcagaccgcgctcgcggtcggctacgcgtacatcgtccgcgagttctcgctgaacgtcagctccggcgccacgagcctcaacgtcaccttcgccccctcgccgcgtggcgcccccggccacgggtcccaccactacgcgttcgtcaacggcatcgaggtcgtgcccacgccggacatgttcacgacgccggtgcccgccttcgccaacggcgggcgcccgaacccgatgcccctccgcgccgacacggcgttccagacgatgtaccgcctcaacgtcggcggcgaggccatcaccccacgggacgacgccggcggtttctaccgcacgtgggacaacgacgcgccctacatcttcggcgcggccttcggtgtgaccttcgcgaaggacagcaacgtcagcgtccggtacaacccgccgtcggtgccgaagtacgccgcaccggaggacgtgtacgcgacggcgaggtcgatgggcccgaacgcgcagatcaacctcaactacaacctcacctggatcctccccgtcgacgccggcttctactacctcctcaggttccacttctgcgagatccagtacccgataacgaaggtgaaccagagatcattcttcatctacatcaacaaccagacggcgcagtctcagatggacgtgatagtgtggagcggagggatcgggagggcggtgtacacggattacctcgtcgtcacggcgggctccggccagatggatctgctggtggcgctgcacccggacctcagctccaggccggagtacttcgacgccatactcaacggcctcgaggtgttcaagctccacaagtacggaacccacagccttgccgggccaaacccgccgatcccgctgaagcaggtattcagcacggtggacggaagcagatcggagtccaggaagaagagcgtcgtctgcgccgccgtcggcggtgtggccgccggttgcttccttgcggtgttggttgccttcgccgtcgcgtgggctgttcgcaggaggcagaggaaggccgcggcggagaaaccggctgatgggcttcttggcccaacaaaaggctccgccctttatgacccggtccaaaaataaacaggccaattttttaagccttttgttttgataatattatagggtatgtatagctataattgggttaacatgaaagaattataaatgggcccaaaaacatcacatgctttggcaatttttcaaggagagaactatatattacctcccttaactatagcatgagctcaaatatttccctcaaccgcaatatcagttatcgcacatctctcaactaccaaaacttatttaattgagataatccaagaaataccattgacaagcgtgcaaatactagaaatgccatcgacaagtgtgagttccaagaatgccattgtacaaacaactctataccaaaaatgccatcgatcttaggattctgtccattccgcgccgttaagttctataggatgaacagtgtatttaatggcgcaaaatggacgaaaccttaacggcgatggtatttttgggacaaaatcgtttgtacgatggcacttcttgaaactcacacttatcgatatcatttatcgatatcatttctggtacttgaatgcttggtaatggtatttcttggattatctttatttaatttgtctccccaagcgattttaatgattattttattttattttttttgcggggaataattttatttgacatgacgctggcatgatattactttttttttttgggtacgaaacgctggcatgacattacaattagaaagaaagaggaaaaaatgggtctcagttgtcaatgatgaatgatccactcctgtcctaatttttatccctctgttttttttccctccgaggtctgtataactaaaattgggccgtcctgaaagaagtatattaatgagcccaaaaatgtaacatgctcttgcaatttcatctccatttctgtgtagcgtaactttccttctgtctcaacggcacgtcaataaggtgtgagccagatgtttggattaggttgtggtttgcctttcgcttgtatgggcgaccaaccaacaggatgctaacaaatttggctggtttcggttcagcatgcctcacaaagttggcacttgccacaattcctggtggaccaaccgaaatgcaaaagcccggggcaaaattttccgtgtgtatccaagcaagaaacctcctgcatggtgacagcatttgcctgtgatgtcacaggcgaattaggtcacttacggcaccatcaccgagatcgcattgtgatcatcctgggtaatcaatattagtacacgtacattggctggattttcctgaatagggcatagtgcttagtactagctctagctctgttcagtagtgtttctgaattgactaatcatcggtactccatggcagagaagtcttttttatttccatggcccgtcaagcaatcaagttccatgtgacgctcttttaccgtacgaaacaatcccgtttcagtgaaaattaggcaacctcaagcaatggtttcggtatggtctcgatgtaattttggtgtaactgaaactctatggcagtagtcttgaatactgtatgaaaggaggaccgttcaagttatgcctttttggattttggtagtgccatcctcagagtaggagagctactccattggaaagtgtaaggctcaacatcatcatgtcaggacaactctagtaagatcagaaagagtaaagtgaacgaagggaaagaaaaatgcaggcagctcatgctcatcataatttgggggaggggcactgaatgccatgaggcagcacgacacagaggcaggagaaatggagaattcatcgccacggcgccaaaacaaaccaaagtcttcgatcccttctccagacatggcacccagactgtgtgggtggccatggcgatagaaatataacccattgagaaaatccgcatgctaagtgtgcaaggcaagcaacactgcttgcttcctttgctttgggttaaaaggcacgggcttgattgatcttttgcactaacaaaaggggcctcgccacttgccaggatcggtgccaacacttcactctagtcggctgcgtactccaatactccatgcatgcctggatgatccattgatcctgctctcactgacagaaaaaacagggtagtagcagtcacaagtagctctgaaactgtttaattagtttccttctaaaatactcctgctaatagcctgtcattacctgtgatgctcaacaagtgacaactagtactgatatttatttactagttagcagtacaaacatcagtactctgtactcatactctcagcactgacgcctggtgggattaagagattgacctgaataatcggagatgtagccatgtttctacagatcattatcagcaacatacacgttgatttatcatgatgttaacacttgctgagttaggacatcgaagtatgtttgtttccctcttggattagtttctcaaattcccatgctgattgcacgtcataggtgcatctagcgaagcaagggacccacggtccgatacgtgtctcatcatagagttgataaacaccggacacgcaaattaatatttggtgccgcattgcattacagcatttttgtacaacaacgggtttgcgctgctttacgttaccctagtacttcaccccttgatccaacggcttttaattggttttacagtttggtgaaaggtacagcatgaacactgcggtacaggggtacgtgctgggatgcagagtttactagcatgttcaggtttcatgctaatctgctctgcaaacagaatcactgttgctgctgtaatgcagtatttttactgcggatttgattctttgcacgtacttaagttcactaaccagtgtacaacattgtactattgtgcaacaaactatcgaattgcaaacagttgagctgctgtctgctcaactgctatgcgaaattttccacgtagcagtagtagcagaatttcaggttgcaaagggcaggcagaggtagaaaagtagaaaccgagacgtggattggtttccaaggctgacctccaccatttctgggatctctccatcaggagagtgcaaacccgccactatttacttccggcctctgcatccgcaccaccaccaccgcgcactccaaagaaacccggggataaaaggcgcgagaggtctcattcccgggcgggttaagttaaaccattctcaagctaaggctaagcctcgccatggcgtccactctctcgtctccgtcgccgccgtctgccgatcccgtcaccggatcctccgacgccgcctcgtccttcctcccgtctctcctcatcatcgctgctcttcttgccttcgttctactagcgtcggtctcgatccacctacttctcagacttctgtccaggtcgtcgccgccgccgccgccgccgccgccgctcccacggacgcgccgtgaggtgcacaacgtcgaggcggcggacgcttctccggtgcggcgtaatggggtttgtgaggggaagaaggaggtggtgggcgacgagaagcagcggctgatcgagtcgctgccgctgttcacgatggcgtcgtcgctggcggcgctccccaagagctcaccggactgcgccgtctgcctgtcgccgttcacgctggacgccgagctgcggctgctcccggcgtgccgccacgcgttccacgccgcctgcgtcgacgcgtggctccgcaccaccccgtcctgcccgctctgccgcgccaccgtcacgctcccgcacccctcgatctccgccatcctcgccgccgagcagccgccgccgccggagccgaggagcagggaccgttccaggagcttccgcgtcgagatgggcagcgtcagcaaccgcagcgcgtcgacggccaccggcggcaacgcccgccccacctactcgctcggcacgttcgactaccacatcgacgaggaggtcgaggccgtcgtctcccgcgccgcgcccatgacaaccaggagcgccgccgcagtcaaggaagacaagccagcagccgagcagtctccaccgcctcccggcgaggcggtggccgaagcggcgggcgcgacgcgcggctggctgcgggagtacgtggaacggctggccacctccgcgtcatccctatcgtccttctccgggcggtggagctcccggtggagccagagctaccagagccaccatagccacagccaggaggagccatggctgtgggacgcggaggcggtgaggatgtcgccgccggggacggaggaggaggagacggcgttcatggtgctgtaccggtggatcgcaggggtataaacgtaattaccataaaaaggcacaggaaggctttcgtgtcaaattgtcatcttcagatagatagccttcatcaggtactcaggtgaatggtgaatccaatgttttggatgcttctgtgttgactcgatcgggtacaaactggtaggcgtaagcagtttgcaggcctctctttgcacatagttatcctcggagttcggattttggaaaccgaggagagcataattagcagccagggtaggaaggaatcatgcatgcaaaatattgttcttttccgtggacgagtttgatgcatcttgtttattttcccagagatgtagtagtagttgttgttgtgtactttgtgtgacttcatcatgtgtgtcacaacgtgtcagtcagagcaccaccatggaggcgcctggtgaaatgggaaagagtgccttggcatgccatgcgtggcggtagctatgaaacgtgaaatccaatttcagagttccggtgcatccatgtataatccagctagttcgctgatgctgcttatttacatgtgagctgcttgttgctttggtggcaatgccagtgcactgcacgggcagcccgagtgcgagcggccgagtataaattaagcggcagaaaaggcccaaatttgatcggtttcacccgtttctcgtgcacacgccgagtcgctgtgttgacggcagtcaatgtgtcaaatcgcctgcagcagcagctagctactctatctagctcgctgatgtgattcgggtcaccaactctatcgcccatgcatgacgagagcacaggtctcctggtggtcaaaaccacggcacaagcgttgctgccttcacgcaacgacgcacagatccgacgacctgcctgcccttcgatccgtagatacgatttggttttggtgcaacgattgcatctcgagcgaccgaatagttttaccatcagatcttgtcgtcattagctgcatcctgcatgctgaattgctgatgctttttgcttagcggtgccgtattagctaggtacgttacgtagcgaaatgcgcatgcgcaactttggtacggatgcaatttactgacgtacggtgtgagtaccggactaccggtgctgtcgaaacgagaagtgcagacaacgtttcggtacaggtacagccgtacgtacagtgcgaagtcacatttatattcgccggtgttcccgtacatactacatactgcatggctcgatcagtacggctcgtggagaggtccatgactttattgttatatacatttactaacaaaagtgttcatgcgttgcacctggtgattacggagcgtgtatattgaccaaaagtattgtttggtttagcaaaagtgcctctgcgttgcaacggaaagcgtacagatgagaagaatatgcaattaattaaaatataaattcactgaaatatttggtatctttaagtaggtatgtatacaattaaataaatttacaagtaaagtaagtgtgagaaataaaatgatatggttaaatttaattttattaaattctccatgattagtttcgctctttgaaattttattggaattttcagagcttaattgctaattttaataatacaaatatcatttaacaattatttaattggaaatctaatttaattttttgttgggccggccgacctacgtgcggcccatcactgatgcggcccgatgatggaggccagcccaacacgggacggctcagatcggctcctaatctatcaaaacccccaacccaaataaaccctaaccctaatttcattcttccccttcctcccctccacgcaggccgcctctctccctgctggcggccacgccacacccccaccggcgcacctctccacgctcctccccaaccggcgacgccttttgcccccctccccactgccggcagccttccccaccgagcagcggcgacgacggcggcagcggtggcgacggcacactccctcgcagcgggcggctgtggcagcacggcgatggtggcgccgctccctctccccactgccggctccttctctcctcgtcgggcggtggccaccgcaccactctctcggcagatccggaggtggcggcggtcgcgggccggtggcggctccctcctcccctctcgcctccctcctgcccctgatccggcggcgatggcggtgtcggcgggtgggtccgtggccgacgacgaggtggcgaggagcagcgcgctgcagcctccggtccggctcgcccctccctctcctagtcatctcgtgttaatatgatgttttctaatgattccgatttagatttggactgggattttgtgtttgatttggatttggattgtgatgatttgagattggagagaaggtgtgctcaatgtgggattctatttgtgtgatgatggaattccaactgggttttttgaggggggatgaaaaatcaccgtatggatgaggtgacgaccagaaaaatccgaatatttatattagttatagatatggctcgtggagataattatttttggagatggtctcaacataaaaaggcagtgttggaattgttgaacaacctactatatcccgctttgctgaccacatggaatgtcctctgggctttgaaggtaaacaatgcctaccggccttttttggtctagaaacagaggggaataagtccactttgactcccttaaatttgactcccttaaaagtaacccgaatctaatatgtgaccctcaaccacaaaaccggatagaacgactccctaaactattgaaaccagtgcaatttgactcccttggtggttttggagggtggttttgcttatgtggcgctgacgtggcgatgttgacctagttttcgtcccacgtggcgcttacgtggcattagaattaaaaaaaaaatctatggacccacatgtgattcacacataaaaaatattgtgggccccactgacatgtggccctacatgtcattcactctctccttccccttccctctctccccgttctctctctttatctctgtcacaccctgaagttctcctcctaagtctaaaattgaatttataaatcaccctaagaaaatgccggtgcaaatcaagagaaaaccttaataaattaatgcaaataataatcgaaattggcatgtggaattttttttttgagttctacatgtcgaaatacgctaacaagatttttagtggaattttcagagctctcgaaataattttaaccaattaaaattgagcacatgcaattttaatcctatgaaaaatcctttttccttctttttcctttttctttcttttcttttccccttttcctttgaataggccgccggcccattcctcctttttctccccctcctcccgctgggccggccgaaggccaaggcccagctaggccgcgcgggccggccgcccgcctcctctcacccgggtcgctgacaggtggggcccacctatcggacccgtctcccacctcgcgccgcgccgccgcgcccgcaaccaccgccgcgcccacgcctccgcctcctccgggccacgtcggccacgcccgcgcatgcgccgcacctcccgcacccactcccccctctccccgcgtcttccggccgcgcccgcgcacgagaagggcaggattcgattttgaatcgtccccaccttctctctctcctcccccacgtcgccggcgaaatcggggtgcctcccggccacgtccgcctccccctccgcctataaaatgctccccatgccctcctctctcgttttccgctctcaccgctccatcccgtgccccctaccgagctcgcgccgccgctgcttgcgccgccgcactccggccgtgtgccgccgctgctagagccgtcgccgcgctaagccaccgccacccctagcttcgccgccgcaagacctttcccggccgccgctttgcgtcgccggaatcccaccgaaaccccatctccctcgtgtcgccggtgagttctctctcccctccgactccggccggcgtggatggtcgccgtgagggtttcccttcgtcctaattcctcctctcttttccctaggtgtcgccgtcgctcttccgcacctcggcatcgccggtcttcgccgcctccctcgttttccgccgccggccgttgccgccccccccggtgaggtctccctccccttcctttccttccttttttttcccgtgcgccgccgccctcttcgcgcgctcgccatcgcgttcggccgtcgccgctcgcgccgccgcccgccgtccacgccgccgtttgccgtcgccggtggtcacatgcgcgcgccgccgctttgccatggccggccggtcggcttgatgccgggcctggccggtacatcggcccgtggagccggggccgtggggcccgcttgccagccgtgccctccccttgagccgctgccgagtggggcccacgtgccgccgccccttcccctctctcccgagccactgaccagtgggacccgcccgtcggcgccacccccccttgatgacgtcagccctgggagttattgcgcaataaattatttaaggactttttttatagtaataaacacagtgaatcttctaaaattcataactaattcatccgagctccgtttaagcccattcaagtctcagtaaatcaagaaaaatgtgtagaatccattaaaaatagttttgttctctgtttcagtagtcttatagcctgtttgcattgtttgctttgtatgtcgcttagattccggttcttccgacgctccggtgtacttcgaaatagtcgccgaggttcctccagcagcagagcaaggcaagttatgcttgtcacttgaacatgttgatcctatattgcaaatgctctattgtttttcttcaaatactgcatcgttttataatgttattatgggatgtttacctattgttacagccatgctattttggtaccttgctcctttgttagcttgggttataacatgaatagacattggactaggagttgcttagccatgcttagttcaactagtacacaatggggaaaatcctattaatgtttagactgttggttctaatggtattgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcatgggcaacggctgggcttgtagtgtagctttcctctagctgacgcatccaggcaagggtgggcgtgatggagcgggacgggccctgcgacggcctctgtcgcttccggattcacctaggcatgagaggggactgcccgctgccttgcgaggagtgggggtgaaacctgaggtgtggtgtgcttggttagagggggttatgcgaaaggtcttgtcacagcctctttacggtatgttgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtctattaaaattggatagtataggtggatggttgggcctgtcgcaacgtggtatagcgttggacagtggatgattaatattgattaattattacaactgttttcttctttaaacttctgtttataaatgctcgctttatgcaaatgaaccactctagctctcctttgataattccctgcatcatacccctattccggtatgacttgctgagtacagtgggtagtactcagtcttgctctatttttcccaaccccagagtacgagtatatgtcagatggaggtttctccgaggagtaggcttcgtccgtgccgtcgaggatgcctgtggagtggtgttcccgctgcagttctagtcaaggcttagctcctgttgtctttcatttttccgctgcatttatgtaatacgtttatgatgtttgtaagacgtggatctgaatgtcaacattgtcgtttgtgtactccggccggtcctggacggggattttaatgcacattctgcttggaattctattcgggaatttctgggcgtgacaatctcccccctttctcttcaccttctctctcgta

SEQ ID NO: 5831 - DNA, 8024 bp, Oryza sativa
  unsure (1)..(8024): unsure at all n locations
cggtctctgtcacgcccagaaattcccgaatagaattccaagcagaatgtgcattaaaattccccgtccaggaccagccagggtacacaaacgacaatgttgacattcagatccacgtcttacaaacatcataaaagtcttacataaatgcagcggaaagaaagaaagacaacaggagctaagccttgacttgaactgcagcgggaacaccactccacaggcatcctcgacggcacggacaaagcctactcctcggagaaaccttcatctgacccgaactcgaactctggggttgggaaaagtagagcaagactgagtactacccactgtactcagcaagtcataccggaataggggtatgatgcagggattcatcaaagaagagctgaagtggttcatttgcataaagcgagcatttaaaaacagaaattgaaagatttaaacagttgtaataattaattaacatcaactatccactgtccaacgctaacccatgttgcgacaggcccaaccatccacctaaactatccaaattaaaagattacactaaggtgagactaatcacggtgaatctggttgaccgcccataaccgcgggcacggctattcgaatagttttactctgatcagaggtgtacaactgtacccacaagacacagccccacgacacgttttcgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagatatactacaagtccagccgttgcctacgctggcttgtggtaagtacgatatgttcttccagggcatcccgcgaaccggtccttaactgccatgggtgcgaccagcaaaaccatgcacccacagcccaccatgtggtttattttaattaaccaacacccaaacggtgtcactaatccaacaacaccattggaaccaacagtctaaacattaatatgattttccccgttgtgaactagttgaactaagcatggctaagcaattcctagtccaaactctaatcatgttataaccccaagctaacaaaggagcatggtatccgaaaagcatggctgtaacaataggtaaccatcccatagtaatattataaaacaatgcaatatttgaaagaaaacaatagagcatttgcaatataggatcaacatgttcaagtgacaagcatgacttgccttgctctgctgctggaggaaccttggcgactatctcgaagtacaccggagcgtcggaggaaacggaatctagcgacatacaaagcaaacattgcaaacaggctataagactactgaaacagggaacaaaaccatttttaatggattctgcacagttttcttgatttactgagacttgaatgggcttaaacggaactcggatgaattagttatgatttttagaagatttactgtgtttaaaactatacaagaaaaaccttaaactatttattgcgcaatatattccagggctgacgtcagcacggagggagtgcggcgccgacatgcggggcccaccggtcagcgacccgggagagggcggtccacggcggatcgggtccacggaccggggaggagcggcgccgacatgcggggcccactggtcagcgacccgggagagggaaagaaagggcggcggcacgcggctcggattggctcaaggccggccaaccgaccgcggcgacggcgacgacgcgcgcgcgaacgcgttgccagcgacgcatgcgaccgacgacggcagcgaccggcggcacgcgaggcggcggcggtcgaaggcgacagcgcgcgacttgaagcggcggcgcggcactaagaggagaggaaggggaaaagaggggaggggatgcctcaccgagggtggccggcgcggaggaagacgatggcgaacggcgacggcaagccacgggaggacgacgtcggcgagcggacgagcttcggggtgccctaaggaaggaggagagagggattattgagagggagatgagccacggcgaccggaagccatggccgaaggcggcggtagaggtgatgctcactcgagtgcgagggaacgagggctccggcgacgaacctcgacggaggagaggtggacggggtggatcccggccacgcgaacccgacggcggcgatggcgcggcctggcggcgaccctaacggcggctagcggcggccggagtagcggaaacagcggctgcggatgggcgcacggcgtgagagcgatgggaggctcgagagagtacggcggaatggggaaaaagtgagaggggacgacggcgatgcttaaatagggggagagaggaccggacgtggccgggagaggcgggaatcgccggccgacgtgggggagtgggggaagagagagaggcgggattcgaaaatcgaatcccggccatctcgggcgcggacgcgagcgggagagagaggagagtgggcgcgggagacgcggcgcacgcgcgggcgtggccgacgtggcccggaggaggcggagacgtggacgcggcggcggtttcgggtgcggcggttgcgggcgcggcgtcggccggaggaaggggaaagacctgacaggtgggccccacctgtcggcgaccccgggagaggagggaggcgggcggcctggctgggcctcggcctgcggtcggcccagcaagggggagggggaaggaaaggggagaatgggccggcggcccattcggaaaaaaaaaggaggaaaaagggagggaaaagaaaaagaaaaaggaaaaagtattttccctggaattacaatattgctggctcaattttaactggttaaaattatttctagagctctgaaaattccactaaaaatccagttaatgaatttcgacatgtagaactcaagaaaaaaaattccacatgttaaatccgattattatttgcattactttcttagggttttctcctgatttgcaccggtattttcttagggtcatttataaattacaattttggcttgggaggaaaacttcggggtgtgacagtctccgcggatgcagtccataaacccagcctggcaatccggccaacccccacaatgctccacgggtcagcctcggcagaatcgagcagcagtacaacaaacacaccaatgtagcagcataggagaaggcgagcaagcaagaggatgtgtatagctgtatagctcgattacttcctgctcatcaaaaatcatgtcgagaaggtgatgatatgcctcgccttcgtcccaaggcaggcatcgctacatgcataccatcatggccaaaggcgaggatggagctcggcctcctcctggcgcttggcccaggggcttcgacctctatggctgggcgtacagtgagggactccatcggcaccacggtggggatactctttggcgggtgtgctcgttggcgccatcgccgccgctgtcggcactgaacgtgagctggcagatcaccgggacgctgaccgacttgacgttgcacgccatcatgggggagtgcggcttccggtggcatgaggagttcctggagacgctgggcgaggcacagaagaaggcgactaggttcggcgtcgctgacctgttcccgtcgtcgaggctcctccccgccgtcgggagccggagtggtgacggccggcaggagctgacacgggagctagctggagcggcggtggaagtgggctggagctgacggaggctaggaataatccagcgcgctagtcagaggcagccgcagccgcagccgcctcgttggaggtctgtggcgtggggtggtttccaccgccgcagccactcaagcccctcctgtcgccgcctccttctcctccgcctccacccgcattagctccaacccgccgccgcttcagctcccgctggccgccagcacttcggcccctgccccaccgccgctccagccgtgctccccgcggacggtggaaagggagagaaagagagaagggagaaagtgggggaggaagaagaaagagagaggatgacatgtcagtgggccccactttttttatgacaaatgggtcccacatatatgtttttaattaaatgccacctaagcgccacatcaagaccagagtagatcaacaccgccacgtaagcaccacgtcagcgaaaccaccatccaaaaccattaaggaagtcaaattgcaccggtttcaatagtttagggagtcgttctatccggttttgcggttgagggtcacggattagattcaggttactttttaagggagtcaaagtggacttattccaaacagagcccgagtacccaaccatacgccctctacatgggcaacggcccatcagcgtggccagattgcagcggtcgcggccgaggccgagagcccgataatactcgtgggccttatccgctaaacgctcatggggatcacggtagtctaagcccatagaaaacggcccatctgagtgggctaaatcgctcaggtgctggcggtagcccatatggtgatctgagctttttgttattattttttaaacaaaaaatacataaatataattttcttttacaaatttacaaacatcatactcctttcaccctatgggagagtttttttttcataaattgcctctcaaaaggcggttctgatggagattatggtggttgaatattgcgtacatgcctttcccatgctccttagaggcgacttttatatgccacccaacccaaagacagtgaaattaaggcctatatatgcttgcgagaaaaataacggtcatgagaaatttgcatagactacttttgttctctaggtgggcgggatatttaaaattattctctaggagtgtgataaggggctatacgcaaatgtcccatgcctaatgccacgtcatcagatctgccctctagaagggctgtttttaaagcaaatccctaaaaaaacactcccacggtgaaggagtattttttaaaaaaatttacagaagcgaaaaatatattcctgtaatttaaaatatatattaaaataaaaaataaatatttgagcttccatttgttagttaccatttttggaataaaaaatggttggatccataattttcttcatttaatgtatttcaagcatatcatgtatcgttgtattttcaattatatttttcaaaaggagttttataaagcaccctatgtatcgttgtatttttaattgtacatgcctaatttctcttttcgagggtacaaaaataaatcaaagacctataagaggaaaaggtgaaaaatacaggcatagggatttatgcatcagtctaatcccaaattttgtagcttccactcccattaatgtttgggaatccgataatgacatatccatgtttatgtatttattgtctttttttctgtaaagagatttagaagcattaaattaagcaaaacatatatacacgtacttcatttattgtggtgaagccaatagtgtgcacacacactcctacccacaccatctatatattcatgcactccttggctagatcacaaaacacacaccaaacaatcgagcacagcaaacaaaggtgaggactgaagcaagaacaccatggcttttctgagggcactctctcctctcgtcttcaccctgctcctcctactcgccgcctccacatccgacgcctccatcttggaggaaacctgcaagtcgctcgccggtaaccacacggccatcgactacccctactgcgtcaggttcttccaggccagcaaggagagcgccaccgccgacacgcacggcctcgccgccatcgccgtgaggatcaccgaggcggccgccgagggcaccgccaagcgcatcgccgccctgcgatcctcgcacaaggaggagaagatgcaggagtgcctccgcataagctccgacctgtacgcctacatgctggccgttctcggcaacgaggcgaaagccgccgccctggtggacggcggcgcgcagcatgcggcggcgtcgccgccaacgcccgacgtcgcgcggtatgtcgcggatggttgcgagggcaggttccgtgggaacaaggagaccctgccgctggttgcggagtacgccgagtttagacagagtgcgtccattgctctcgcattgatagaggcgatatcaccaccgagtgatcagtgaatgtgtgtttttactctcagattttgtaagccaaacaatgtagatgaataaacatggcaattatcaatctattgttttcctgttactattatctttgtttattttctatttcatttttatggccgagttttgcgttgaaaaccggttatgcttttgaaaaaaaaaagatgaagtcaccctttgctactttgtttagaaaatagtcattcatcgtcgcataagtagaatagttatctttgctaatttacttataaattaataaattgtgtgatttgataaaagtggattaatcttaaaatatgctccgctagctaatttgatctattgattttaactactccgttaattataccgtaaatcatcagttgagtgtgtttggcaaaaaaaaaaaaaagcgtcaacaatgttagtagtactttcgatgcaaagtataacagccaacaagcacttgaaatatagtgatatgctacctctacaccaaaataagtctatttttgagatagattaatacaaatacaaactaaaaagtggactaaaatacaaactattttatcaaactaagaagactaaaatactttgcacttgagatagactaaaataactctaatttattaaatatcaatgcaattatttcttattttatccacttccaatgcatatatcaaacaaatactttcacaaacttcaatgcaatgattactccaaaattaacttattttactagaaacggaaggaactaaaaataaacgtatccttctcttgagatagtatctatcaccactgttggcgtttgcaagatttgtgtatctacatcatatctgttacgggccttccagcccactgcccacgccaaattcacctctccaaactgcaaacatccggacaacggaatttaaggcccaggtggcaactatcagttattctcttatttcacgattattaagcagactctgtttcgtaataagagattttcgaatttcgaccatgaatttgtaaagggaccttttggaacttcccccgattaagactctggcagttcgacatgtggtgtctaaacatttcgtcatgacatgaaactatatagattagatttggctcgaaaggaacagggaccctgtcagcaggtggctgatcctaatttctgaagaagagcgatcctggttcctggatcccgagactcgcggcaggcgtgaagagactgcgagacacccgccaacgtttcagcaggcgtcatccaggaaatcctcttgaatgaatgaatgaatggtgtaatatctcgtaatgattccagtgcaatcaacagctggatcctcttttattgttcagagattaagatgacgatacctgctagtataaagttgttggttctaccacgaaaaaacacaccaaacaagtaaccaagcggcaccaggacaagaaaagccatgacgaccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5832 - DNA, 612 bp, Oryza sativa
tacctcgatggatgccttattttacaaggaagtggtcatgattcctggtatttaaattaccttggttaagggagaaatattctcataggtgcgagttcgttgcttattttttgtaataagtgccctattataggactcttgatgaaaaaaggaaattcctgcgccaggcttgaatagtaatcaatgacttaggcatagtgttgaggttaggggttaccttcgtttgttatgggctacacggaaagtgatattcatagcaggtggtgatagccctgtctgccctttacatccctccatgtttggatacatcatagagctacaggcctgtaagttatgtctagttaattattccattgctgtcctttctagccaaagcgtaccattagttattgtccttggataaaatctctttccttgatatacacaccccttagctatgattcgatacactcagaatactctaaagctgaagtgctacatcggtatctgtgcgcttgcgggttgatctgtgaccgtaacaaatataaatacctacccatcaacgaaggtgtttagtggtacgtggtttgagcacggaagttgaacttgccccaggggattaaaaaaccagcg

SEQ ID NO: 5833 - DNA, 27255 bp, Oryza sativa
atttgtgaattgtcatctgcataattgtcaataggtctttgcccacatgttacctcaaggataaaaatgccaaaagcatacacatctgttagaggtgttgccttaccggtacgtgcgagctctggagctaggtatcccatagtaccgactacatgcgttgtttgcgggtctgctccatggtcatataactttgcaaggccaaaatcacctaggcgaccgttcatttcaccatcaaggagcacattacttgctttaacatcacggtggatgacaattttttcccacctatcatgaaggtaaaacaagccagatgcaacacctttgatgatttgaaacctctgagcccaatcaagcgtaggtttgctatcttcgcagtacaagtacttatcaagactaccattcggcatatattcatataccaataatagttcaccttttctcctgcaataaccaagtaactgcacgagattgcgatgtcgaaggcggccgatactaacaatctcagcgataaactccttcattccttgctttgaatcatgggacacccttttcacagcaacatgcaacttagaagttggaagcacacctttatacaccttcccaaatcctcctagaccaagtagattcctattcttaaatccgtctgtagcatgaaacagatccttatatgagaagcggtgtggcccaaactcagcctcccaatcttcatgtagctcagcgtacctcattcgcctccgtaccaaaagaacaatggtggttcccactatgagaatgaatgttgctgtggcaattggtagaatgatctctagtagtttagtccgtggttttgggctaacacgaggtagttttggtaatttggataagtcaatggctggggcaggacggtttatacccaagctcaatccgagcacacaatataatgtgttgattggaccagttgaagctgagaagccgatataggatggttcttctagcacaagtgagaggttatgaatttctgacaacagtggcctcaatggtttgcctacctcaatgggagccatggtcaccttgatctgtgtggtgtcttcgttgtagtcaacccatacttgcattggcttgtagctacagagggacaaattgttgaagatactcttgttatcactatagaaaccagctggccgagattgaactgaggtgagattgttgatgtcgatgccaacgtggttgtcgtcgatgtcgtggaactcggtattttggctactatcaagctcgactgcaaaaatgtggttgcttgcttttccatctgatgttttgttgagtagacccaagtattgggagtcctgagcacttgacatatcactggttggagagatcacgaaagtcatgccatcggtacatttttcattagagtagacaggaatcatgccaaacacaaagttaattgagaaggattgcaccgtcccgttgggcgtcttcctgaattgccatggagttgggtagaacgcatggcctttgatgtggacggtgcgattggtcagctcaagaaccccatcatctgtaactgttgctgcaccatcaagggtgaggtttctgccggagaagcccgaatagacgaactggtcctcgctcatggtgatggcaaggtttagggctagggcgatgaagggtaaaaggagggacagatgctccatatgaggtatgtttgctacttgtaaaacctcaacaagagcagaattggaaatggggtgttctcctagaccttgaggcttgagaggtgctttgtgttgttactctactttcaagtacatgatttatttgtattatgagcaattcttgaccggtcatgcctccgacgcacaagtcaattgtctatgtagttttttcaagtttgtcattgtcttcaaacgatctaggctgcgagcctttcatgaaagccaagtcatttgtctacactgagaaattatttgttcaatcatctatgtgaaattaatttaggaaatatttttacagagtactatcaagtttctgaatttcccatgttgtatgtctgaacaacttaaagtgttaactctttagcattcaaatatatcagtttattgctacaaaattccagatgaaaataattatgcctcctttttgtataacatgactggctttggcatatcttatttctaaatgatatatcaaataccaaaagaacatttactagtagaagtgaaggaaaagatcataactagctatttgaatatactatgtagcagagcattctagaaagaaataagatgcatacaacactattcacttaagaatcggacaacattctacatgtcaacaatatttttttttcaatcgctccactttcattttgaactgatcaagtcagttttgctcctatgttttggcattccctttgttgaatggagctattcctagctatagtcaaggtaggaaaaacttcagtagaattatgtggtttagttaagctcagctccattcagaagattccttctgtcactgccggccaaattcagtttgttatatttggtcaattttgtgtacacacctggcgttcaatttagttttcactatggtacagaagattccttcgtcactgccggccaaattcagtttgttatatatttcgtcaattttgtgtacacctggcgttcaatttagttttcactatggtacatttgtcaattgaaggacaataattcctgtccacatggaacagtggatgtggaatatattgtatggatgggatcttttttttgtttgctttttttttttggttggtagatttttttttaattgttatagatagcttgtggtcagggatatgcgcaatatttactggtgttgtagaattctaacagtcaaaatcaaaatctgtagaattgctatccttctaatatattcggcaattcttttgccgcttccactttaaaaaaacctgtagaattaccattcaactactctgtaaatttttaatgctcaaagtcaaaatcaaactcttattctcatctaatggttgtagaaacttgcagtcctgagatgaggcatcaataaaaattcacctgaataggacaggcatggacaatttatggaaaattgaaggaaattctcttctcatgatgcaactggtgacactgatgcttggtaaccatcattattgaacagtcaccatggcaggccaagcttgctcgatcaacatccaagtcatactggtgctgggttgtaactacttaccacccataaccattttttaaagaaattaaattcaaatagttttgttttaccatttgatgtatttttataaaatttaaacttctgggcgttgcctgtcggtattctctaagaaaataaatttgaatatccgtctgataaaaccagtaaaccacctggcggttgcgggactggcagtgtttgccaagatttatagcaaaatccatatagtaatgatgaaaacttataaattttcattaattaagggaaatggagaaggatatgctacttattttggtgggaatagattatgatatatgctgtaaaatataagaggaaaatgctcttatattactccctgaattcactttacaaaagataataagagttcaatctaatagcaccgaacaactagattgagtaccaatggtctagatctaatgtcctcagcctatttccgttacaccatcctctctctcatgctcccaatatttgatcacatccttccttcatcccccttgtgattcctgagataagctcaatgggcactatgtatatttatagcatttatcactggcttacaagttacaactctggtacttaaatagcagtggtatcagccactatttgcaaccaaatcacagtagcagctgctatcgagggcacatgggcaggatacacagaggattactttagtggcagtgtgttgtgaagtgtataatgtacatgcttgcatccaaggactcgcaaaaccaacattagaaaaaatttcaagaaacaagggatatgattgatgaaactgaacggtaaagggaacccttaaaatgtatcacaattttatccgctttactgataagagcaacccattacatttacatcagaatacaggctacaagtgcacagctagtgaaagccattaagcaagaacattgaatcaagccatgggcatcatcttccttctagtgagaagctagatgttgagccaaagcttgtcatcattggagatggatacaaagacatagcagatgggtcgtaaccttcattttgcttttgtatcaatgctaacatgtcaaagctgaagtgctccggtttaagctctggtagtggcacatccccatcgagatattgcataacttgtcgcacattgggcctaacattaggaaatgggtgcgaacacatcaatcccagctttagtacaagacatgcttctcctatatcatagttaccttggatcttgatatccattgtatcaagaagtgatcctttgtgccagttctgaagcacccaatcaaccaagataagttgtctgccttggagtcttccttgataggcttttgcccacaagtaacctcaagaataaatatgccaaatgagaagacatcagtaagagtggttgcctttcctctgtgtactagctctggagctaggtatcctatcgtgccaacaacatgtgtggtttgtgggtcagttccatggtcatataatcttgcaagaccgaaatctcccagtcgtccattcagttgtttgtcgagaagcacattgcttgccttgacatcacgatgaatgacaactttatcccattcttcatggaggtagagcaaaccagatgcaatgtctttgataatttgaaacctttgtccccaatttaaagttggtttgccctcttgtcgatgcaagtatttgtctagacttccatttgccatgtagtcatacacaagaagaagttcaccttttctcctacaatatccaagcaatttcacaacattgcggtgttgaagatggcctatacttacaacttcagcgacaaattcttttataccttgcttcgattcatacgaaacccgctttatagcaacctctagtctagagttaggaagcacccctttgtacacccttccaaacccacctgtgcctaccaagtttttgttcttaaatcctttagtggcatcaaataaatctttgtaagcgaaacggtgcgggccatactcaacctcccaatcttcacgtacctccttataccttaaatgtctcctcacgagtaaaacaatagcaacaccaatagctagtacgaatattgctgatctattggtagaacaatctctaagagtttggattgaggtcttggactaagattaggcagtttaggtagctttgtggggtcaatgattggagcaggaatattcagcccaaaactccaaccaagaacatagtgatgtcctgtgcttaagcctgttgaggatgagaagccaaggtatgcttgatctgttagcactgttgagaggttatggactacagagagtagtggtctcttaggtcttccaataccaagaggagctaatgtcacatcaatttgtgtggcattcccatcatactctacccaaacttgcattggtttatctccaatgaggctcacgtttgtgagcgcgccattgttgtcattatagaagccgacataagaggatcttactgagttgagactgttgatatcaatcccgacatgattattgtcgatgtccccgaactcatcattcctaatggtatcaagctcaattgcaaagaggtgattggtcgaactgccattgtttatatcattaagaagacccaaaaattggattggaaaggcagtggagaaatcattgcttggggcaatgaagaaagcaaatccatggcctcttatatcaccaaatgaagagagaataccaaatacaaaggagacagagaaagattgcaccgtgccattgggggacttgcggaagcatagcggagctgggtgagatgcatggcctttgatccggaatgtatcatttgtcagcccaagaaggccggtggctgtgatttttgctgcaccatctagagttagattgctaccggtgaagccggtgtagatgaattggtcatgatctccactagcactgatggctaaaaggctaatgcttatggtaaggaagaggatgataggcaaagtatactgcttcatgctagctagacatatacagttgtgacaaattggttaatgtaaatatgtcttgcattgcatccatttatagggttcacatctcgcaagctaggttgtggcctagtcagttggagcatgtccatctcagcatggaaaattctaggattcaggctaaagacatggtagaagcagccggtaatttacatgtcttggctaccatgaagtccaacaacatcgacatcaggtgtttgctattttctcggaggaaaaagtcgcatcactcccatcttgaaaaatgaagatttcactttcagactatatgatgccagcatagactatattattgcaggtgaagaaatagaccgtagtttacaagtcgtgagatccttttctttactctcacaatgttagttttgtataatctttgtaagtacattcaacatccctattattaggactttctgttattataataggatttatacatgatattatatggagtatacattagtttgactttgaattgttcttagaactcagaagaaaactttgaatgcagccttttgaaaatgctaacgatttgcattaaggctacattcagaaggctcttataatgcaaataatgcaaatagttagcattttcagctgtgttcggctcttacactttctcaacatctattttgtgaaatcattatcatgattaatatttatgatgaataattggctatgcaaatgatttaatcaaagaattggtttgagaatttgtgtgaatgttggtgtgagtgcgtgtgactaatgtgggtcaggttgtgatatctgtgcccagaaacggttgttttgtctgattatgtgcaggtgacttgaggtcagccttggtcaatggtgaggaccgggactatgttcagggaggaacagaggtctagtgcggtcgggataccatgtgagaaggtgactagagtcaggattcttggaggtcaacttcggtcaacggtggggatcgtgactaaactcaaggaggagttgaggtccagacggtcaaggataccgggtgacgaagttggatacgatatggcacacggtggatggacatcgtgtgggagagatttttgcaacgggcttcacgaggtgtgcgtgcaagcgtcggtgtttgcgaaggagattggtgtgagaaattgaggaagagtatatggtgctacagtacatgtggtgctgtagcatgcatatatgtgtgtgcagtacgtgtatgtgtatgcgtattgtgtgggctagcaggcatgtatgtacgtgtggttgtacatgtgcagctagttggttagcatgcatgtgatgcatgcgtgtgttgatgagattggttgagcaggccgaagcagccgcggcgtggacgtgtgttggctcggtggtgacaagccgactcggctcaggcagcaagcagcagcagcgtagcaggaggaggagtccggctcggttggcggctgaagtttgggctgtgcgagttttggtaaattgtaaaaggtttggaaattgtggattgagtcctactgtgaataggagttctacacctactttgagtaggggtttttgtggtataaatagagagggagcgtgaggcttcccggtatcgcttttcagagcgtggagttgatagtttagttagggtttcgagtttagtcgagatttttgtaaggagtgctgttgttgcacttcgtaaacacagagagaagcaataaagttgtcatctactttgagagtttttcgatttgtgtttcaccgggtttcggcggtataaccaggcaattcaccggcggtcagactggcagcaaggcggcggtcagaccggcgggagcaaggcggttcgaccggcggcgtgcaaacggttcgactggcggcggcgacaggactacgttgagattttcatcgatttgagggtaacttttatttccgctaaaagttttgggtttttggttttccctaccattcacccccttctggtaggcttggtttcttgtgttcgattcttcactattcccacgttttccacacatgttttccaaagtgctaaatatgtggttttgttttaaaaaaaatctatagaaatattgttttaaaaaaaaatcatattaatctatttttataaaaaaaagctaatacttaattaaaatatgttaatgagtcactctattttacgcacacgagggattagtttccaactgtaaagccgaacacagcaaaagctatcaacctgagaggtttatcagtgtgctctgtaaatttttgcgccaaggtacaaaattattgtaaaaagaaaacctctaaatagtgcaaaggagatgggacagggggtagtggcgcagggcagggggacttatattacggaatgcacatttcttcccggtgcaaaacagaactttggaaattttgtaaacttctaaccaaaataagttaaaattttgattcgatttgaatgaaatttgctaaattcattttttatcatgtaaaaggaatatttcggtcaaagcaatatcgtaccatgggacgatatacctagatatagatggccatggcccgaggcccgatggcccgcccaaggtctggtgattttggcccagcccaggcacggcacgggtcgggcctgtgcctgtccagcccaacagtcgtgacgtgcctagactgctacctcggcatgttgggccagttcagggatacaaaactaacttattctcaaccatatgtaaggcacgtcacaaagaatagagagcaaaaatagacttattatatggcacaatccaagagtagaggcgtaaaatagacttatttttaactatatatatgtcacaacacaaagaggagggagaagaaatatacttattttaaagaaggcacgataggccacccgtaccttcaggccggcatggcacggcccaaatattggtgggtcgtgcttgggtctgaggtgcagcccgtggatcgacacggcaggcctggtgtgttggtcgggccgtgccggcccgatagattctggcccgagcacggccgtgcctgggccgtggcgcccagatggccatctatgtatccactatccagagtttccaaaattccgggaataccattcccaaatattgaacctcaaaatcgagaatttaaaattagggattagtgttcgaaaatacttataggagtaagtaagatgtgtgcttgtaagaacgagagtgcgcgcgtttatgagcagctaggttgtaccgtttttcgaaaaagaaaagaagaaacactacttatctccgtcccagaatataagattctagtattagatgggacacatcacagtactacaaatctagatttataatactaagatatatcctatcatatactagattcttatattatgggatgaaggtagtaccaagagcatacagtgatgactgaggagttgttaatgccggatagcgatggcttacccacacaatcattcacatgtgaacaagacaaccaaagcaacaactttgcaaaaacccaaaaaagaatacgaagaaaagaaaatattaataataattaaaaaaaaaagaggataagcaagaaccgtacaaggcgagcagactacactacccttccatgttgccggccgccggccggtgagatcgagctcagccatggcatccgccgccgctcccgagatccaggagctcatccaccacccctacgacggccgcgtcacctccttcgtcgtcctctcctgcgtcaccgcctgcctcggcggcatcctcttcggctacgacatcggcgtctccggtaaccacccacccacccaccactctccctccctccctcccactcatcatcgacgacgagctcgccatgaacgacgcgatacaattggtggtgcaggcggcgtcacgtcgatggacgccttcttggagcgcttcttcccggaggtgtaccgccggatgcacggcggcggcgagcgcgtcagcaactactgccgcttcgacagccagctgctcaccgccttcacgtcgtcgctctacgtctccggcctcgccaccacgttcctcgcctcgcacgtcaccgccaggcgcggccggcgcgcgtccatgctcgtggcgggggcggccatcgccgccggcgccacggtgggcgcctccgcggcgggcctcgccacggtgatcctcgggcgcgtcctgctcggcgtcggcgtcgggttcgggaaccaggccgtgccgctctacctgtcggagatggcgccgccgtcgcggcgcggcgcgttcagcaacgggttccagctctgcgtcagcgtcggggcgttcgtggcgcagctgatcaacttcggcgcggagaagatcgccggcgggtgggggtggcgggtgtcgctcgccgtcgcggccgtcccggccgcgttcctcgccgtcggcgcggtcttcctccccgagacgccaaacagcctcgtccagcaaggcgaggaccacggcaaggtgagagctctcctgagcaagatacgaggcagcgacggcgccggagtcgacgacgagcttgacgatatcgtcgccgccgacaggtgcaaggtgacaacgaggcgcgggctgacgctgatgctcacccaccgccgctaccggccgcagctggtcatggcggtgatgatccccttcttccagcagatgaccgggatcaacgccatcgcgttctacgcgccggtgctcctccgcaccgtcgggatgggcgagagcgtggcgctgctcgcggtggtcatcaagcaggtggtcggcatcggcgccacgctggcatccatgctcgccgtcgaccggttcggccgccgcacgctgttcctcgccggcggcgcccagatggtgatctcccagctactcatcggcgccatcatggcggcgcagctcggcgacgacggcgagctgagccaggcgagcgcgctgctgctgatcgtcctcgtcgccgtctacgtcgccggcttcgcgtggtcgtgggggccactgggatggctggtgccgagcgagatcttcccgctggaggtgaggtcggcggggcagagcatcgccgtggcggtgaacttcctgctcacgacggcggtggcgcagtcgttcttggccatgctttgccacatgaaggccggcatcttcttcttcttcgcggcgtggctggtcgccatgaccgccttcgtctacctcctcttgccggagaccaaggggttgcccatcgagcaggtcgggaagctgtgggcgcgccactggttctggaggaggttcgtcgtccccgactccggcgacggcgaggaggaaggcggagccattgatgccgataagctctgaacaattaatcagctgtgcacatcactgactgactatctcattgtctgactgatccggcattccggacacggttgtttcagaacagaactggctatacccagcaacatgtacagactagcaacacattttttagctggatttaagtatgtaacaatacatatttgattacacataccaaggcttaaacaagcatttagtagtaactttttttttattttagagccctgacaagcatactagattatgtaggatcgaatcacaagaactaagccaaccagagggggggtgaatggttggtatacctaaaaaccgaaaacttttagcggaaataaaagttaccctcgaaatcgatggatcacggtctgaccgaagttgccttgccggtctgactgctcggatgccgccggtctgaccggtaattttaccggtctgaccgccgaagtcgtctgccgcgcctgctgtcgccgccggtccaaccgccttgctcccgccggtctgaccgccgccttaccgccggtcggaccgccgatgagtcgccggttaaaccgccgaaacccggtgaaacacaaatcgaagaactcttaaagtagatgacgactttattacttctctctgtgtttacaaagtgcaccaacagcactccttacaaaaatttcgactaaactcgaaaccctaactcaaaactcaactcaattgctctctaaagcgataccgggaagcctcacgctccccctctatttatacatgaggtaggcagcttaaagccacgaaccaaactcatactaggagtcctaaacaccttaggaaacccactagtacaagaaagaaactttacataaccaaacgtaccaaatttagtctccttctaaattcgactccgcatctcatacacacacaattcctccatcgtatgccatatagaatctccatcaaccacgtgcatcaactcttgcctaagtatcccgcatgatctctgaccaccacggacgtcgtcttatccccaagccgactcccggtccatcaccgcaaatactctcccgagacatcgagtcacctacacatggaaaaaacaaagaaaccatattccgagaccaagctatctccaacttaactcattagcagcaaacaatagtattacatacgtatagtatccatctagaagtcataatcatggaataaactcggatatccaaataaacaaaccgaaaccgaaaccgacacagtgtcggccggtcagaccgcgggctgcgccggtctgacagcgcattacacgccggtctgaccggctactagagcccggtttgaccggtccacataaaatcacagcagtccctgtaaattcacctgtgaaaaccaatcatctccaaaaccatttcgtgaataaattccaaataacaaaaccaataatctccaatgcccaattgttcatcacagaataataatcaaaaacacctttgattttacagattatacatgtataacattttactaggaggaaatatacctcaaaattaaataaactgaaacttaagtgtatatatggcagcaggtggatgctacctcccttcggagaggccagtgatggtgccatcgctcaccactgattggcaatatgcaacgggtgagcccacctgacgattctgcaccatgtccattggcgccaactcaggaaatggcaagtcatggttaagatactgcatgacatgccacatgcttggccttgcagcaggtgattggtgtgagcaaagcaatcctagtttcaaagctaggaatgcttcatcagcatcatactcattttggagctttggatccattgcctcaagaagtgatctctcgttccaacaatcaatcacccagtctactaatttgagctgatcactattcatcttgtgttcaatgggtcttcgtccacaagtaacctcaagaacaaatatgccaaaggcgaacacgtcagttaggggtgaagccttaccattttgtaacaactcaggggcaagatatcctatagttccaaccaggcgtgttgtttgcatgtcagtgccatggtcatataatcttgcaaggccaaaatcacctaagcatgcattcatctcttcatcaagaagcacattactggctttgatgtctctgtggatgacaacttgctcccactctccatgaaggtaccataaaccagatgcaacaccctttgattattcgaaaccgttgaatccagtctagaataggacggttactatgaccatacaaataattatcaaggctaccatttggcatatagtcgtaaaccaaaagaagttcacctttacgccggcaatagccaagtagctgcacaatattccggtgtcgaaggcggccgatgctaacaacctcagcaacaaattcccttatgccttgtctcgactcatgggacaccctcttcactgcaatttgtgacttagacttggaaagaagacccttgtacacccttccaaatcctccagtgcccaagagatgactattcttaaacccttcggtggctaaatataggtccttaaatgagaacctatgcggtccaaactcaatttcccaatcttctcgcaactcagcatacctcagccttcttctcacaaagaagaagatggccaagatcaccaaaaagacaaatgtgggagttgctagaggagaaattagtggcagcaagatgagctgagtagcttttccatctacacgagctttaggtagatttggtagatgagctgtgaagaaaggtggggctagtccattcatactaaagctccagcctaggatatagtgcctcgattctatttgacctgttgcagctgataaaccaacgtatgcaacgtttgtgagcacggctgagaggttataggacattgacaggagtgtcttggtgggtctggccattttgaatggagctaaagccacatcaatccatgttgcctctccatcgtagttgatccaaatttgcatggcctcgccactaatcagactcaagtttcggaaggaaccagtgatgtcatcgtagtagcctgcagaagaagatgttgccgagtgaagatcgcagatgtcgatgccgacatggttgccatctatgtccataaactcgttgttttgtgcagtgtcgatctcaacagcaaaaacatggttgctcaagttgccgttgttactgtaattgaacaatcctaggtactgtgccggtaacgcatcagaaaaattagagcttggggcaagaaagaaggccatgccctctgtgctggcatgcaacaagggagagacgacgatgccaaacactaaggaggcggagaaggactgcaccgcggagttgggcggcttacggagccggaaaggagtcgggtggaaggcatggcctttctgattgaccgtaccattggtcagctcgagcaagccctctggcgacaccattgattagtgtagatgaattcttgattgatgtttgcaggtgttgttcgtgatatttgacctgacggagaagcgatgcctttttatgttatggatctattccttttgaccaagttcagctcgttgtgccagggcatcactttgagcttgcttttgaagattttgattaatgcgatgatggttattctgaattcacgttgctttgccatgataatgttccgtttttcatgaaacaactgtttggcagttggttgttaggcaagataaagcctaggagattactgttagcgaagccgtagtacacaaattggccgtctcctagggttgtagccaaggatggcagaataagtttttgttcttaaatcctttagtggcatcaaataagtctttgtaagcgaaacggtgcgggccatactcaacctcccaatcttcacgtacctccttataccttaaatgtctcctcacgagtaaaacaatagcaacaccaatagctagtacgaatattgctgatgctattggtagaacaatctctaagagtttggattgaggttttggactaagattaggcagtttaggtagctttgtggggtcaatgattggagcaggaatattcagcccaaaactccaaccaagaacatagtgatgtcctgtgcttaagcccgttgaggatgagaagccaaggtatgcttgatctgttagcactgttgagaggttatagactacaaagagtagtggcctcttaggtcttccaataccaagaggagctaatgtcacgtcaatttgtgcggcattcccgtcatactctacccaaacttgcattggtttatctccaatgaggctcacatttgtgagcgcgccattgttgtcattatagaagccggcataagaggatcttactgagttgagactgttgatatcaatcccgacatgattattgtcgatgtctccgaactcatcattcctaatggtatcaagctcaattgcaaagaggtgattggtcgaactgccattgtttatatcattaagaagacccaaaaattggattggaaaggcagtggagaaatcattgcttggggcaatgaagaaagcaaatccatggcctcttatatcaccaaatgaagagagaataccaaatacaaaggagacagagaaagattgcaccgtgccattgggggacttgcggaagcgtagcggagctgggtgagatgcatggcctttgatccggaatgaatcgtttgtcagcccaagaaggccggtggctgtgatttttgctgcaccatctagagtcagattgctaccggtgaagccggtgtagatgaattggtcatgatctccactagcactgatggctgaaaggctaatgcttatggtaaggaagaggatgactggcgaagtgtgcttcatgctactagtcatagcagtggcaaattggttgattaaaagatggcttgcattgcaaccatttatatatagggcacactcacatcctgcaaagctaggttatgacctagtcagttggagcatgtccagctcaccatggaaaattctaggatttaggccaagacatggtagaagcagtcggtaatttacatctcttggctgccatgaagtccaacaacatcgacattaggtgttcgccattttctcggaaaagttgcatcactcccatcttgaaaattgaagatgtcacttgcaaactatggtaccagcatagactatattattgcaggtgaagaagaaatagaccgtagttacaagtcaagaggtccttttctttcactctcaaaatgttagttttgtataatctttgtaagaagatgaaacatccttattattaggacttcctatgattataataggatttatatgatattatttggaggatgcgctactacagaaacacaaaaaaaggacggcactataggtgccagttcatctaaaactagaacatataaggcttttccctccctcacgtggctctaaaatccaacactagcacctataacatcttgtaggtgccgattttttaaataaacgtgcacctttatatgggataaaaatgccagttttattaaaaactagcacatcaggatggagctaaccgagccaaacacccagcctacgggtttttcctcctcggcctcagccttactcccttcgtcccaaaaaaaaatctaggtagagatgtgaacccttgtccagattcgttgtcctaggtggagtcacatccctacctaggttgtttttttttgggacaaagggagtatgtcctcatcctcctccctccctccctccctctctctctctctctctctctctctctctctattcttcgctctttccccgaagagccaagcaccccccgcccatccgacaacgatagagctacctccgattcgggggctgcgggatctgtgcccccctcctccaacggcgagggcggtgcatcgatggcgccacctctggctcaaggggggagagggtgccggacttgtgcttcccccctccaaaagcggcagctgcctcctcccctcggcccgtccaatggcagcggcagtccgacttggggactgccgatctacgcaccccccctattctcggcgtagaccatgacgagtggcggccctgcctacccttgagcaatgatggcagcggactaacaggtaggtaccccttctccccttccccatccaccccttcaaaaaatcccttcactcttctgggatgtgacagtggtggtgagcggcaacgcctcggcctccgatgaacagtggcagctgtggatttgtgatgaatattatgttgtaattttatgggatgattcttgttgctggatatatgtgagaattttcttatctagtttcctttacatgttcttggctcgaagcattggttcgatttgagccgatgcgagccgcgtcacttttgattctccacatcggtgctgtttgagaggtgccggttggaaaaatccgacacctatgtgtggttcctaactggcacccattgggtattctgcagtagtgatatattaatttgactttgagttgtcatagaacgaactaaatgaatatatgcagcattctaaatatgctaactatttgcatgaaggcctagatatagcattcatgaaagctctatttgtgacgagatacaaaattattataaagagaaaaaaaataactctaaacagttggaaggagaggagaccagagggtggaggtgcaaggagagcaacacaccaagaggctgagacagtgatgcctcacccacacaatcattcacataacaacaaaacaaccaaagcatgcacaactcagcaaaaaaagaaaagaaaagaaaagaaagtggataaacaagcaccgaacaaggcaaaacagactacagtatatccttccatgatgacggccggccggacctgctcaagtactatagcacctggcatctctcccgaaatccaaaacctcatgagcacgatatatatggagcaacccctacgataccatgcccctggattgatcacctctttgctccttcatcagttcatggtgttctcctgtgtggtcagcgtcctcgcttgcagtgcgtgttcgactctccaagacatatgctcaccctccttaataatattgatatcaggctaggatttgaattaggaattcaaattttaactttgaattccaggaactaagggtaaattccagaaagaatgtcttaaagtttttgacgatattcagattttagaaaattcaggaattttgatttttggagaaaaacaattttggtaggaaaagaaatttcaaaggcaattttgaatttgatttgaaaatttaaaaactgagtttagggaaaaattttgggattttaaactagattttgaattagaatttcaaaggaattctgtgagcaacttaggagggatacaccgattttataattcgaaactagtgattttcatttcgatggtaatttttggatcgagattgggatggtcatagggagagatttaattgagatctttggcacaagcactaagacacactaaataactgaatttgttgaattaggtttttattaatcatactatcaaatcatatacagatttattttccattataaaccaaattaattccctccattttgataaattcgaggtactattttatcaaaagtaccatgagttacctccaactgtttatatgtgaaatagtgctacctagcatgcaagaaacatgactgtgagacaagaaactaaggtaaaaattgttatagaaatttaagaaagcaaagttaattgtggttgttttactctgcatttggagaatcctatctatcaaattatgtgcaagatttcttatgtgtgcttgacagaggttgccagttgccaatgcaatcaatacctgccttgtatttgcctcgacgaggactctaatatgtggttcttataatatggctaatggctggtagtaatctaaccaatatcccatattattttcctcggaaaagtataatcttttaattttcaccaaaggttgtgctttattgagtggttgcctgcagttacaacaatcaagtatcaactctgatagttgtgagaaataaataaggaacacaatctgaaaatgcttgaattctaaagctcacacgctctctgcacattgtcggaccgacaaaggctaactctgacgaagctgaagtaaaaacagagaatcaaagacagtttgttcggcgatctcgctgcagcttttccgggattctcttctccttctattcatacccaaaactaggggaaattacatgcaaacgtggccatcccacgttcgactaaaatcagttcagccacagtaacagatttaacataattttggttgaactggccaagtaatatgcatgaaaggaaacttcaagacaactaaaacagcacaagaacagaaatatggagtgaacaaggatgttgatttcgttttttggttagctaatatttacttttccttccccgtttcatagaataataaataatttacagtgagcatccacaaatttgaaaaaaaccttctgggtcctgattttgttaagaaagcaacattactacaaggctgggaacaccagcttacaataaagctacaatatgttcatacaagtagacaatcactactgggaatcccatccatttgtatcatcttccactcgtgaggctcgatgtcaggttgttgctgcaaactgtagatggcacagatttgtactggtcgaaaccgtcgttttgcaaatatcccaacatgctataactcaagtttgtgggcatcaaccgaggaagtggcatctcattgtcgaggtattgcatgacttgacgcataccgggccttctggtacaaattggatttgcacacaacagccctagctttaaaacaagattgacctcatctgcattgtggtctccttgtaatctgacgtccagtgtgcttgtcagtgatcctttttgccaatgctcaacaacccaatcaactaatattgtcgggctatcatgcgtgtaattgttaataggtcttcgcccacatgttacctcaagaacaaaaatggcaaatgcatatacgtctgttagaggggatgccttaccggtgcgcgccatctctggtgctatatatccaaaggtaccagccacatgtgttgtttgtgggtcattgccatgctcatatagtcttgcaaggccaaagtctcctagatgaccgttcatttcagcatcaagaagcacattgcttgctttgatatctcggtggatgacaactttctcccacttctcatggagatagaataatccagatgcaacacctctaatgatttgaaatcttttggcccaatctagcgtgtacttgccctctttacagtgtaaatacttgtctaggcttccatttggcatatagtcatagaccaataagagttcatcttttcttctgcaatagccaagtaattgaacaagattgcggtgtcggatgcggccgatactaacaatttcagcgataaactcctttattccttgcttcgattcatgagacaccctcttgatagcaacctccaatttagagtctggaagcacacctttatacaccttcccaaatcctccaacacctagaattttctcattgttaaatccttcagttgcatcaaataaatatttgtacgagaagcgatatggcccaaattcaacctcccaatcttcatatagttcagcatacctctttcgcctccacactaatgctgtgactgctgctcccacaagtaggatgactgtggtgatgactatcggtaggactatcttcaaagttttagaccggacttttgggccaaatcgaggtaactttggtaacttgatgatatctattgtcggagcaggactgttcattccaaagctccagccaagaacataattcaatgcaccgacattattagcaccggaagagaagccaatatatgatacaccttcatctaaaattgttgagatgttgaggattgctgacagcgttggtctcaaaggtttggttagcttgagaggagctatggtcacattcatctgtgtggcctctccatcatagtccacccatatttgcactgccttgccgccaacaaggggcaagtcattgaaaatgccgttcttgtcatcatagaagccagcaggatgggtctctagcggtctgctgaaactactgttgatagaaatgctgatgtcgttctcgttgttctccagaaaccttttgtcttggcaacttaaaaaattaactgcaagattgctctccctctgatcattcttgaggcccttgctcggaaatatcatgaaagccatgctgtcgggacatctaatagaaggagccatgaagagcacaaagttgactgagaaggactgtaatggtaccttcagaaattgccatggagtcgggtagagggcgtagcttgtttcgtaggtacttgcgccattggtaagctcaaggattccgtttggtgttaccatggctgtgccatcaaggataaggttgctgccggagaagccgttgtagatgaactggtcctgtccaatactgaccgtggtgaaggatgttaggaagaggaggaagcaggctaaatgctccatggcaggacgctgcaaccggtgatggaccatgaaaggtgggcaaccgggatactgcaaattaaccggcggtacaagtcgacccaatttatttgcagcgatgaggaaatagttatgcaggcatgacttctgtggcgcaatgcatagtcagtcttccatctagtcttttccatgttagggtgtgtttagttttctgggtgtaaagtttttaaagtataccagtacacatttgaagtattaaacctagactaataataaaaataaattacatattccgcttgtaaactgtgacacgaatttattaagcctaattaatccatcattagcaaatgtttactgtagcattacattgtcaaatcatggcgtaattaggctcaaaagattcgtctcgcaatttacacgcaaacattgtaattattttttcatccatatttaatgcttcatacatatgtccaaacatttgatgtgacgtttttaactaaaattttttggaacctaaacaaagcattagtcattgtggaaaagtagctagcgtgcttccaatattaatctcatgaggtcagagaatcacagctagcttccgtctcttaatttaaacctatgtcatacgtggatgtagtggcgaattgaagccaccatctggtgaccccgatcgagcagtcgcctggtggctcgtcagaaataacattaaaaacaaattcgatgttattatagggactgaatgtacaattgcctagctagcaaataatgtacaaccagttatatataaccaggaggtagcccgcgcgcccacctatgcgggcatccgtatccttttatatgattattaactagcacggtggcccgcgtagattgcgcggctagcaccattatatttgttttcttatataatagcttaaaatttttaatactttattactaaaatatattaaaaatagcaacacaatatttattttttattatattgatagttattaattattttctactttcaaattttacttatttttaattatatttctatatggactctaggctcttctcttattcttgcttatttttaattttagttatttataaaattttctttctatatgaactataaatcctacttttaatttttaaaattattttaattctgacttccagtcagttctgttcttcttccaatattcttaattttaattccaaatttccgttactataaattgtattcctacaagaactctatttccaatattccttattttttaaattccaaaataaattatattcttatgtcacatcctgattttcgtttcaggatttataaattatttaataaattattaatagaatttatattaaatgttctttaatttacaagtgaagttaaatgtgggaataaaatttcctaaatttaaagcatggatggatttaatttttattaaattctccatgcttaattatactctctgaaattttctcggatttttcagagctcaattcctaaatgatacaaagaacagttcagtaattatttgatcaataattatctaattataattgttaagagcttttcttgtttaaaaatccttaaattataaattgttgtttaaaaggaattattagaaatgattttaaaagcctaaaagagaagatctaattttaatttgttaaatctcaatataaaattgggctagataaaatttcattaaatactttgcttaattctataattcctagatttttctgggatttatttgagctaaggaagtatttttaataaatggaattgcatttaagaaataatttaaattgaaaaaggtttttaaaagtcttcttttggctttgggccgaaagtcggcccaaaacctctcttctctctctcctcggcccagtcggcccagtcagcccgcgctcctctctctcggtgtcgctgacaggcgggacccacctgtcagggtcgtcgtcctcctcgcgccgccgccgccgcccgaaccctagcgcaagccgccgccgtctccttccaagttcggccgcgtctttccttctccggccgaatcttttgaggggaaatgatcttctcgacctcctcttccttttctcttttggaatctccggtcaattcggtttggaaactcgaggattcgaagtcgaatcggatccatctctctcctccgaaccccgttctttccttctcgccgccggtcgccgtgggcctccgtcgccgctcgatagcccctataaaaggacccccgagctctcctctacccgccgcctctctcgccttcgcccgccgtcgtgtttagcgccgcctccgcatagccctagtcgctgccgtcgttgccgtcggttctgccgcgtcgcgccgccgttgcagccgccgtcgtcggtcgccgtcgccaccatcgggttcgcgaggtcatcgccatcctcgtccgccccttcgccgccgctgaagaccgccggagcaccatcgccgtcgtcgacccgatctccgccgccgcttcttcctcgtcgccggcgctgtccgttgttcctccgccgcttctttggtcaccggtgagttcgcctcgtcgcccgcatcatcttggtgccctctgtttgtgccgtagagccgccgttcgccggcgagcgtgcgccgcccgagccttccaagccgccgccgccggtggtgacgtcaccgctgacgtcatcgtcgtcctctcccgtgagccggtcgtggaccgttcgatctcggccgtccgttttggatagggttgatctcggccgttcgttcccgtgaaccgctgccgtgcgcccggtccaccgcgaaaccctagccgctgacgcaataatcctccttttccttttcaaaaataattcattattgcatcataattcaattaaaatccatataagtgttttaatctgatttaatctttaaaaattcataactaattcatttgaactcagtttaatgtggttcaagttgcaaaaattatataaaataaagatctacatattaaaattgtccataaattgaattaaatttatttaattctttttaaatgggctttaaatagatttaatcttgtaaaattcataataaattcatttgaagtcagattgaggccgttcaagtctcataattcatctaaaattaagatctacatgtttgtttactttttatgcattgtttatttggtttttattagtctttttcttcgttttgcgtgttagcttgtcatttccgtcgttgtgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgactactttattccttgataccttgggtgattataacttgactagttgagctatatatattggttcagctagatattagatatgattgcttagccatgcttagaaacattagcacactattgggataacttatgactcattatttaaggatggtttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagctatcgtgggcaacggctttaccttttgtatagcatggttcattgcggagcaccagactgagaagtggcggagataagcccacgggggtcgctggggagtccatgcctctggtttttgagggggtgattatgatccaggaaaggtgcgctgcggtgggttgtgttatgcaaggggtaatgtcacagctcctttccgaggtaccgtggtggtactgaggcacatggtgacatgatgtgggactgtgtcttgtgggtacagtggtacacctctggccagagtaaaactattcgaatagtcgtgcccgcggttatgggcgagttgagcaatgtttttcgtgattagtctcacacctctcacaataattatagatgttatacccgtgcccgcggttatgggcgagttgagcaatgtttttcgtgattagtttcacacctctcacaataattatagatgttatacctggtaataatttgcttagctcctggtttggagttagatctgttcagccgggtatggttgttcagaatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacatcttatatgcactttagactcttctcccaatattgcttattttttatttttaaattttaattttagttttctctaaattgtatttctatgtggactctaaactctatttttattttattttcttgattttgactttcaatttactctaaattcctatatggactctagactcttttttcaatattcttattttttaattctgaatttctgttgtttctaattgtatttctatatagactctaaactcatcttttaatattctttattttttagcccacgcaaattgcacggctaatatcattatattttctctcatataatagcatatatgttttctcaatgtattattcaaatatattaaaatgacaacatacttttagattttgtactaactttatcaaactactaatgtgtaatattcatattgtatttcagttatttataaattgtatttctatatggactctcttccaatg

SEQ ID NO: 5834 - DNA, 12332 bp, Oryza sativa
ccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccgatcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatctttatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcattcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaacttcctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaagctcagcagaccaccaacttcaagaagcagaagaagaacaaaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaatagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagcttttttccaatgaaggatacacatagtggttcgaaccaaccctctgaaataattcccaattcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggataaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctatgagcaagttgagccgatttacttctaatccgggagatgatcactggcgtgcgcttgagcgagtaatgcgctatctgaaaggtactgtggaattgggacttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagaactaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctatccaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgccgggccgggccgggccggcggcgcgcgtcacgacgtacgcgtcgaatggtccgaaaaattggctcctcacccttgcgcagatgcagcctccttttgcagttttgttttgctgcaaattcggattcgttttgttttggatccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcacgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacataatttgggcatagagccatagtataatagagacataagtaaaaacaaagcttcccaaacttagttttggcctagtagtgtaacagggacttagttttgcgtccttgcagtcagaattgcctcatccatgcacataattgcaatgacagctgaattaagtccgattaaaagttagataatctcattttttttcttctctcagaattcataccatcttatttttctcctttaattcaaagacattttgaagattactagtatacatataaaagaatataaattgtccacataatcgtgtggttatatttgcagttaggttaacgtccttttcatgaaattaaagcgtgatataccaagccaagtttcccaagtttcagggtcttaattaatttccggcagacgaaaattactcagggcgtgtcacattagctattatataagatgtcgtatgggatgttcgggcactaataaaaaactaattacagaatccgtcaataaactgcgagatgaatttattaagcctaattaatccgtcattagcaaatgtttactatagcaccacattgttaaatcatggagcaatcaggcttaaaagattcgtctcgtaaattagtctcaatttatgcaattagttatttttagcctatatttaatactttatttaggtattcaaacgttcgatgtgatagggtgtaaaatttttgcatggtaactaaacatgtcctcacttgtaagttctacgagtggttgattgacatgaaccttttccttgtttgaaccttccggccataagacaaccagtcagaataggggaccatgtgatatgacattttccggtagattgagtcttaggccctctttagttcccacaacaaaaaatttcacgatgttacatcgaatattaggacacatgcatatagtattaaatatagttaaaaaaaattaattacacagattgtgtgtaatttgtgagacaaatcttttaagcctaattgcaccatgctttaacaatatggtgctacagtacacgtgcatttgctaatgacggattaattagacttaataaattcgtctcgcagtttcctggcagaatctgtaatttgttttgttattagactacgtttcaaactttaaatatgtgtccgtatatctgatgtgacaatcaaacaaaaaatttctccaactaaacaaggccttagcgaaaaaaagagatgatttttactgtccagcagaggtactagtagttcagcaggaggtaccagtagttcagtgtaccatctaaggggtaaaacgggcactcttattttttccattattgttctctctcctggtgacttctcgaaattgtcgcactacgccggatccggtcatctctgacaggccctaactctcatcttgacggatttggccccagtcagggattagtggtcactgatgactacacctgatctctaatgggtgaaagtatgccaatggtaattaaaacctttgacaggccaaatcgtttcaaatcgttgagtctaacaatgctcatcctgcccagctagatccaacgatcggaaacgatttggtaccgtaaggtaccgatacctcgaggtactttttgttggaccagagcaaatctctatttggcaatcagggaggtcatcaaggccttttccggttaaagttacttaaaattttaactttttaaccgaataacatgccccggtaaaagaaagcagctttaataccaattaacaatcccctttattaccggttgtagcaaccgagaccagtaaatcgaccagtaaatcaagactaaagatctcgatgtttagtaccggttgaaagaacctttaataaagatgcatactaaatcataaattatatgtagaatgtgggattgaaactcaaaatctacctcaaccctcacgtgcattaccatatcccacctactacacatatctaacttgaatacaaatgcttttttttactaatcctggagacatctttagtaccggaatatttttagtccaaattagtgttatcaaccggtactaaaaatacatctttagtaccagttgataataccaacccggactaaagatcctctagctttaattagtctcggttggtgttaccaaccgatattaaaaatacatttttagtagcgactggtaacaccaaccgagacttaagatgtttatagggacttggatttttagaaccggtttagtaccggtttttaatctagccgagatatttgtgttttggggactcggataaaagatcgttactttaatctctacaagtgatggaattttctacgcactctttcttaaaaatatgacagattttgcagcaataaacttggacatacagggcgcctcttattacgttcgataaatacagtatacattagtcctcaataaaatatcaatatatagaaaatagcaaacaagcaatattttgtatcatttgggccgtccaaattctctgcgccagattagcagcacacattgaattaatatagccaaatcatcttccacgtgtagtcagaggcagcaagtatagttgaaccaaaatgctcatctctcatcacacttgaaacggaaacgatggcattgcggacaagttgactgcttctttaatttctacatcacggacacatttagttctggcaactgcgcatcgccatcgaggtattgcagaacttgccgcatattgggccttgcgtttgaaaatgggtgtgagcataataatcctagcttcagtgcaaggtaggcttcatcgatattgtagttaccttggagccttctatccattgtatcaagaagtgatcccttatgccaattctcaaccacccaatcaaccaagatgagatgtttaccttccgagttttgcctgataggcttttgcccgcaagaaacctcaagaaggaagatgccaaaaccaaagacatcactaagtgtagttgctttgcctgtgtgaactagctctggagctaagtatcctattgtgccgataacatttgttgtatgtaggttactgccgtggtcacatagtcgtgagagaccgaaatctcctaatcttgcattcatctccttatcaataagcacgttgcttgccttgacatctcgatgaattacaactttgtcccactcctcatgtaagtagagcaggcccgaggcaatgtctttgataattttgaacctttgtgaccaattcaaagttggttggccatgaaaattgtataagtgcttgtcgagactttcattttccatatagtcatataccaaaaggagttcattcttgcgccggcaatatccaaataattgtacaatgttgcggtgttggagattccctatactaactacttcagctataaattctttaataccctgctttgagccatatgataccctcttaacagcaacctgtaatttcgatattggaagaacccctctgtacacctttccaaacccacctattcctaccaagttattgttctaaatcctctagttgcgcgaaatagatcctggtaagcaaaccggcgtggaccatattcaacttcccaatcttcgcgtacctccttgtacacaagttgtctcctcacaagtagaaccacaatgccaataattaataccaatagaattgaccctattagtggaaggattaatagaatggattgagttcttggaccactataattaggtggttcgggtagcttgggtagcttggtagagtcaatggttggagcgggactgttcataccaaagctccaaccaagaacgtagtgatgagctgtgcttaagcctgttgaggatgagaaaccaagatatgattgatttgtaaacactgtagaaaggtcacgggtaactgagagtagtggccttataggtctagccatgccaagaggagctatggtcacattagttaatgtggtgtacccgtcgtactctatccaaacttgaattggccctcctccgatgaggctcaagtttgtgaatgtgccacccttgtcatcgtagaagccagcatgataggattgcatagaattcagactatttatgtcaatgccaacatggttgttgtcgatgtccccaaactcattgtttcggatggtatcaaattcgatggcaaagagatggttgctcaaactaccgttgtttttatcattgagaaggcccaggaactggattgggaaggcggaggagaaattattggtgggagctatgaagaaggcgaaaccatggccccttatgtcaccaaatgaagagagaataccaaacacaaatgaaacagagaaagatgtcaccattccattagactgaccgaagcggagtggagccgggtgcaacgcgtggccttgagccctgaacgtgtcctttgtcagtgcaagcaggccggttggtatgatttttgctgagccgtccatggtgagattggcaccagtgaagccggcgtacatgaatctttcatggtcaccaccggtgctggaagctgaaagattgagggttaggaacagaagtaggaagcacaagatgagctttgtgctactcatcgatcgcttcttggttgacttgtattttgtagatctagtacttgtcgttgcgcaggtgcactgtcagtatggtaacttagtaagcagttaaggtgattttataggttgtaagctggagcgccgtgcccttcacgattggaattaacttggaaataaatggttatttgacctggaaaatttgctactcttataaacgacgactcttcaaatgtcactcctattatcgtacttaatttttatgtcattgaacagacaagttttcctcttcttttttaccactttcacctacgttgggtgacacggtggattgccaacgtggattagtgttaagaactgatttttttcccctttccattcgcaaattcacgaacttaattagcattataaaaggagtaaatttagaatatgccatatcctgaactctcaaaatacattttatttttgtctttgaagttatcatgaatgtcatatagatccaaacagactccaacctactaagtgcgttgctagatgccacgttgacacctaggtgtcagtgaaacccacatatcagtcatatagaaaaaataaaattaaaattaaaagaggagagtaagatgtttgtaaatcttttaaaagtaaaattttaaaagaatggagaaaatacgttttaattttttccccaaaatatatgtgactgatacgtgggtcccattgacacatatgaaccaccgtagcgtaccacatcaatgtatggaatagcatacatgacatcaactaaaaatacattttaaaagttcatgaaactatatcatacactcatacaaagatcgtccatacacattattcttataaaagtattgttcaaagcaaattcccaaaccatttttttagctaagtagttgagatctttttaaaacgtttataattgtaattaaatatttttcttaaacattgaatatttacgatggcagcgagcactaatgatgaacactgttaagtacttcctccataaaaaaaaatttaaattctaaagtttaaattttgtttaaaaaatcaatttctatcatcctacctaccttcatcatgaaaaacgataagttttatctcttcaatactctttacctgcctatcactcttactattttttcaatgattaaagatattttagtcattctcactcttcactaattctatcttaagatgttaggaatatttttttttgggcgggaggaagtaagtgtaaaggaatacagtactctcgatcgcctttccaggcttgtaaaaatctcttctttcaatggcatgtacatcagaacccgtgggccaattctgcaatcatccacacaatcagccatcaactactctgaaaacagaagaaaatgacaaaaagtggataagcaagcaccgaacaaggcgagcagactacactacccttccgtgctgccggccgccggccggcgtgctcgacctcagccatggcgccctccgccgccgctcccgagatccaggagctcatccaccacccctacgacggccgcgtcacctccttcgtcgtcctctcctgcgtcaccgcctgcctcggcggcatcctcttcggctacgacatcggcgtctccggtaaaaccacccacccaccactctccctccctccctcccactcatcatcgacgacgagctcgccatgaacgacgcgctacaattggtggtgcaggcggcgtcacgtcgatggacgccttcttggagcgcttcttcccggaggtgtaccgccggatgcacggcggcggcgagcgcgtcagcaactactgccgcttcgacagccagctgctcaccgccttcacgtcgtcgctctacgtctccggcctcgccaccacgttcctcgcctcgcacgtcaccgccaggcgcggccggcgcgcgtccatgctcgtggcgggggcggccatcgccgccggcgccacggtgggcgcctccgcggcgggcctcgccacggtgatcctcgggcgcgtcctg

SEQ ID NO: 5835 - DNA, 2981 bp, Oryza sativa
tctttttcttcttcgcggggtggttggtcgccatgaccgccttcgtctacctcctcttgccggagaccaagggtttgcccatcgagcaggtcgggaagctgtgggcgcgccattggttttggaggaggttcgtcgtcaccgactccggcgtcgacggcgaggaggaaggcgaagccattgacgccgataagctctgaacagttaaccgtgcagatcactgactgactatctgattgtctgactgatccggccacggttgtttcagaacagaactggctatatccaacaacatgtgaagactagctagcagcacattttttagctggatttaagtatgtaacaatacatatttgattacacaaaccaatgcttaaacaagcatttagtagtaacttccttttgttttggaggccttacaatcatactagattatacatgtataacattttactaggaggaaatatgcctcaaaattaaagaaactgaaacttaagtttatatatggcagtaggtggatgctacctcccttcggagaggccagagatggtgccatcgctcaccactgattggcaatatgcaacgggtgagtccacctgacggttctgcaccatgtccattggcgccaactcgggaaatggcaagtcatggttaagatactgcatgacatgccacatgcttggctttgcagcaggggattggtgtgagcaaagcaatcctagtttcagcgctaggcatgcttcatcagcatcatactcattttggagctttggatccattgtctcaagaagtgatccctcgttccaacaatccatcacccagtctaccaacaggagcttgtcactattcatcttatgttcaatgggtcttcgtccacaagtaacctcaagaacaaatatgccaaaggcgaagacatcggtgaggggtgaagctttacctcttcgtactagctcaggggcaagatatcctatagtgccaactaggtgtgtggtttgcatgtcagtaccatggtcatataatcttgcaaggccaaaatcacctaagcgtgcattcatttctgcatcaagaagcacattgctagccttgacgtctcgatggatgacaactttctcccagtctccatgaaggtacaataaaccagatgcaacgcctttgattattcggaaacgttgaatccaatctaaagtaggatggttgctatgacaatacaagtatttatcaaggctaccatgtggcatatattcatagaccaatataagttcatctttgcgccggcaatagccaagtaactgcacaatattccgatgccgaaggcgaccgatgctaacaatctctgcaacaaattctcttatgccttgccttgattcatgggacacacgcttcacagcaatctgcatgttagatttggaaaggagacccttgtacactcttccaaatcctcctgtgcctaagaggtgactattcttgaacccttcagttgcaaaatataggtccttaaatgagaacctgtgcggtccaaactgaatttcccaatcttctcgcagctcagcatatctcaaacgcctccgcacaaataggaagacagccaaggttatcagtaagacagatgtggcggttactataggaacaattatcggcaataccttgcgccgtgaagcttcttgagctctacgaggtagatctggtagttgagcagtgaagaaaggaggagtgggtccattcatgctaaagctccagcctagaatataatgactcgaccctgctaagcctgttgcagctgataaacctacatatgcaacatctgagatcactgatgagaggtcatagggcattgacagtagtggcttggtgggtttggccattttgaatggagccaaggccacgtcaatctgctttgcccctccatcgtagtcgatccaaatttgcatcgcctcaccactgattagactcaagttatggaagccaccggtgctgttgtcgtagtagcccgctgaatgagatgtcacggagcgaagatcacatatgtcgatgccgatatggttgtcatcgatgtccataaactcgctattcaatatggtgttgatctcaacggcaaaaacatggttactacgattgccaatgtttctaatgttgaacagacccaggtactgtgcggctaacgcatcagaaaaattagtgcttggggcaaccaagaaaaccatgccttgtgacccaagatcaatgtaaggggagatgatgccaaacaccaaggaggcggagaaggactgcaccgtagtgttgggcgacttgcgaagccggaaaggagtcggatggaaggcatggcctttcatattggccgtactgttggtcagctgtagcaagccccctggcagcaccatggcagctccatcgacggtgagactgctgttggagaagccatagtacccgaactgaccatcgccaatggctgcagtggaggatggaaacgtgataattatcaggatgatggtgaagaaatggagtaccgcaagaaagcaccgacgattctcgccagggacaggcatggctccaaacaaaacctggaagagaggagggaaggttcaacaatagggcatgcaggaagctgcatattacgatgttgcagtgtgctggtatagtgatacagatatggctgccttgctcttcagtcaacgtagcttcatgacaagtctaaaattgtgtgctgtcattcaatctaagtctgctgtgttgacgggccaaatcagtttttccacaaattttgataattcgatcctttgcagaaactatttttacaaatgaaccgttgccaaaacttatttgaaatctgacccttttgctcaacgccaaatcttgtggcgctgaacttagaaacctcagcgccaaatagcatggcgctgaatgtacgttggcatgctgacttagtctctcatccgtcgtggcacggcattcagcgccagctgacgtggcgctgaggtgtctaagtt

SEQ ID NO: 5836 - DNA, 1134 bp, Oryza sativa
gcgccacacgatttgacgttgagcaaaagggtcagatttgaaataagttttggcagcggttcatttgtaaaaatagttcttgcaaagagtcaacttgtcaaaatttgtgcagtttttccatactgcaccttccttcaaattaccagtgaaaataaccgggcctgattattttgatggcccagagaaagcgatcctctgacttaattactgtgtagttgagagtcactgacatgtggacgatagtaaagtaggaccacatgttagtgatttaactgcatgctcagttaagtcagaggatccgtttccgtggctcaggatgaaacttgaaataaggacccttaatactatatctaatttaatcaatatgtatacatacatataattaatgttaccggtaagcattgaaattaagtgcaccaaaagcaatgtctataataaaaaaaacttcataaatatttccttattaaaaaatatttttagatataaaagcatagattaattcacacattcttttttctgtaaaagagcaaaaggattgcatgttaattagaagaaagcaaacattattagtacacatggtgatcacctggaagccatagcagacaagagacacgaaccagttaggatagcggcagattacagaaaatttaaagagatcctatgcagtcgattgtaccataccattatcatttacatgtagcgactgcagaggatctcaaaatccgtaccaatattggtggttgcaagcgcggagtgtgtgcatactgtactatgcctaacatcactgattgactatataattgtctgactgatccggccacacggttgtttcagaacagcactggctatacccaacaacatgtacagactagcaacacattttttagctggatttaagtatgtaataatacatatttgattacacaaaccaatgcttaaacaagcatttcagatgtcaaagggcatgcagtctagtggttgcagtggccctgttcgataggctaagttcctatctatctattatatactaaaagtccattaaacttcctacaaacgcttttaagccgccacgtgtcacttctacaaacgctcttaagtcgccacatcgcacaatctaatctcaccgtcgatttt

SEQ ID NO: 5837 - DNA, 18306 bp, Oryza sativa
catacatgatagatagttaatttgctacaatacaacccttaattcatcacaagaattatgtattttctttgccaagtagtattggaaaaacatgaataatccaataaaatacgcataaaactacttatgttatatttttttatagttgatagagattctaatataccgggtataattgatggacaaatgttatacaccactaaacccaactgtaagtgcactctagcgaattatttaatgtaaataagtttgtgaaaataagtacattcttagtattagtaaatgagtctcgtattcttagtattagtaaatgagtctcgtatagttgcttacaacatatggtggaaacaaatttggcgctaaagtataaatctttatcaaaatataaataatgatatggtgttttgcatattctcatggtggtatgtctctttagctatagtttttattaagtagtgtgaaatgattaaccccactcatttgaaatacatcatattatatatattccattaaaatttgagaagtacttattactaacttcatatgaaaaaaatgcattttcatcacctcctcctttatgtccctctgtccttgaatgcagggtgcagtacttgcaataccatcctaaatattgcatgggtatgtacatggttgtgttaaggtggtgtctgtgaaaggccaccataggcagtgtgactaaagtgacatacttaccatataatcatttgtgagtgtactgataataaactaagtgttaaaattatactctaggatggtttttaggggtatggctacatcgatgcggaacctatatgtttcaaggcagtacatacaaaagccttcgttcgcagatacagtcgacttcatccattagagagacattcatgtttattttaaacagagttatcgtattattcggtagatatggtatatttagactatttatatatagatgcaaaaataagtgatgaacaccgggttatgcaggtcgatgaattttttagtgtattaaaaatgtattatttgttttagtggtactaatacagttttatttattaaaagttgacctaattcttaaaacaatgatagtaagtagtgatgacaaacgaccagtttatatatgaccaggacaaaggtatttttatttaaatctaagagacattattatcacgttagaagtatattaaaatctaccgtctattttatggtaaatatatctcttatttttcttattgtagggtaatctaaattctcttacagtgtgtgtctctctctatatatatatgattccttttagcattattttttttaataacaaataagatgcctgtgcatatgtgtgaatttcctttccgatttatatttcataaatgttctccggtttatatccagtcattatatagtttgaaacacaaactataatacatgcccgcgcgaatgcgcgggctaccttcctagtttaaaaaaaaggctgcatatatccgattggatccagaggccgggtaaaaaataccattgtctaaaaaaatgcttaaacaagcatttagtagctagtaaccattttttttattttagagccctgacaagcaaacaatagtaatacatatacgtgtacactccctccatcttataatttcgcaccatgtccatcgcccccttctcaaaaaaaaaaaaagcttaaacaagcatttagtagctagtaaccagttttttttattttagagccctgacaagcaaacaatagtattatatatacgtgtatactccctccatcttataatttcgcaccatgtccatcgccctctcaatggctcacctcccatcactgctgccgcctcccgtggacaggctcgccatcccttggccctctccccgccagtgagctcctcggggagagggggagaggtgaaaggccaattacatgtgggtcccacatgttctttaatattttttttctaactaggatgtcatgccatccaaaacaattatccatagtgtcattgggtctaacttaaatggttttgtcaagcttgaggtgaagttttttgtattataatttacagatgtcaattaaacttgatataaagatgagggataaaaagtagacttactccgtataaattataggagagtacgaattaccccccgaactatcgcggtcggctgaattccccccgaacctgaaaacagacatcactcaccctgaactttcaatgccggacgaattactccccttgacccaatccagagtggttttgtcctacgtggcgtacgcgtggcaatccagtcagcattttctttctttaatggcagggtccacatgtcatatatactctctctcctcttcccctcttccacacattctctctccctctctctctcgtctccgtcgtcgagcggcgggtggcggcgtgggacgcagaggcaggagcggacacggaggcggcagtggcgagggatgcagaggcggcggcggcggcagggcgggatgcggacccactccctccggcggagccacctgttccaagcagccgcagcacatggacgagcaccaccaccaccagccgatggcgccgcatggtggcctggtggggaggcgctcgagggcgacctgaaatggcccaatgggctgtcgttcttcaccgcgctcaccgcccggaccgaggatgtgaagctcctgtttggcgacggcggcggcggcgcggatgacgggagcaagatggcggcagcggcagcggcggcgcaggacgtggggcacggcggcgtggagaatgtggaggagtacctgagcctggagagcaccaagttcaagaggagcttcacgttgccagcgaggatgagctcgtccaccacgtcgacgccccgtcggtgtgtcaacggcaccggtgccaccgtcgcagcagcagtagcaaagggatggagtacaggtgcccacacgagggccgcgtctactcggacctaatggagacgttcttggagtagcctaagctagcttgctaccacaccaagccgaacgacgaggaacaggaatccgagcgtgtcaacggcgatggaagctcgacggatgaggatctcgcggaggaggtagtcgctgagcacctcgacgccgccgccactgggcccgcgctgccgcccgccacggtggggaaagagaaggaggaggattgccgggttgtcccggcagatcccgacgccgccgggagggagcgggtccgcgtcccgcgcgccctgccgccgccccctctgcgtcccttgccaccgccgcctcgcatccgctcccgcctctgcgtcccgcgccgccgcccgccacgtcgacgacggagacgagagagagggagagagagtgtgtggaagaggggaagagaagagagactatatatgacatgtgggccccgccattaaaaaaaaagaaaatgctgactggattgtcacgcgtacgccacgtaggacaaaaacgctttggattgggtcgaggtgggtaattcgtccggtattaaaagtcagggtgagtgatgtctggtttttagcttcaggggggaattcagcctaccgcgatagttcggggggataattcgtactttttcctaaattatatcatgtcaacaatattttacatgctgggctcaaaattcatatgcttggatcggcccaatatgacggaagtcaggctcggcccactccagcctactccggcgccatggtggcactgccgcggcgacgaagacgacatcatcatggacgcggtggaggccgcgaacgccatcgccggcgtggcgagcttcaggcgaggatgtgtggccttcgtcggcttctgctgctcctcacttcctttctctggtttggcagcgtgattcgtgatttggggatatcaggaggatgaggtaggagaggtggtttcgcgccttgttgtttgatctattgtacaatttgatgtcgttccgttctcaaatttcgatgatagtactgatttaatctgtaccttttcttttattggttgccaaactattcattttgagatggatgtttagatctgaaagactgaaactgctggtatgttcatacttaatgaaccttgtgcaaatcattgagctgggttaccaagatttaaagagtcaattcatcatatctctctctcctgggttccttgatccctaggattttttttccttttttgggggggcttatgccttgcgacagtataatgttgtatgtacctggctctttttttctctcttcttaatacaatatggttggtcgatttttcggccgacccggctaaaaaaatatctctctctcctttctcctaaatgaggttgctcaactagcactacatttgtttacatttactcatcttttttaaaaaaaaatccatttttgtgtttgagaatatttgtcactttacctttttggaacaattttgtttttcatttacatatgatcccatgatatttccatatagtactgaaacatgtaagataaacaaaagaaaagaaagaagacgaacaaagtcctcccatttgtaggcagtttattggtcatctggacaaaggaagtcgatggaattgtcttgtcctagtgccatggttaatagtcaattaaacaaaacgaagggggtaattgacactgacagtgtggaataacgctggtgggttgcttggaaagttaggcatcgggcattgttggttaacaggactgtataatttgtctgatgcttctgcaacttttgctttcactagacgatgacgttactctaatcagccctttttattctttaaaaaaaaaagaagtctcgcaaagacttccttttccaaattgacttcaagagtcaatccattctttttcttccctttgtgaggtgcgatgaacagtgtgcatgcatcgttgttaatttgctacttttaacttttctgtctgttaagaatatttgcaactccatgtttttcaaggtggaaatttcagttttatgtttttatggggccataatatttaaccatttggtattaaaacaaagttaaaaagtattgcatttttcctttaaccaaagaaaatatttaaaacaagctcaatcccacttagggcccctttgaattgcaggaatggaaaaacggaggaataggaaaacgcaggattctaataggaatacaggtgtaaaacagaggattggaaaatacaggaaaaacacaggaatgaccgtttgattggaccacaggaaaaatacaggaatcggatgagagagatagactcagggcccctttgaatcgcagggtagaaaaaaacggaggaataggaaaaacacaggattctgacaggaattgaagtgtaaaacagaggattgcaaaacacaggaatggtcgtttgattggagcgcaggaaaaacgcaggaatcggatgagagagatagactcaaaggaaattttccaagaggttggagctcttgctaaatttcctccaaaatccacatgcaatatgccattccataggaatttcataggatttggaaagcttcaatcctttgaatcaaagggccaaataggaaaatttcctataggatttgaatcctatgaaattcctacataaatcctttaattcaaaggggccctcaaagaaatttttccaataagttggacctcttgctaactttcctccaaaatctctataggatcacccattccataggaattttaaaggatagtataggattcaatcctttgttttaaaagggttttataggaaatttttccataggattgaaatccttcaaatttcctatgcttttcctataaatcaaaggggcccttaggcttttttttttctgactggtagtagcattacatcatgctagaattaaagaagaggacaactgaaggggcaaagaaaaaattgatttccatcttgtcacaactaggccttgtttgaatctgcaatttagtttagcctttttttttttaggagaaatttggtttagctttttggcaacatgtaaaacgagataatccattagcacttagaaacttaagaattgggtttatttgattttttttaacaaacttctatgtaaaatgttcttaaaaacacacaccgtttagcagtttggtaagtgtgctaatggaaaatgagtaagttctattttggagttgaagaaaagaatgcagctggatggtatttgtctgcataccatggtcgtggtgcgtcaccaagtcactgttcattattattatttggttgacatactggcaacgcgtatctgtagccaaatctaactactactccctccatttcataatgtaagactttctagcattatccacgttcatatagatgttaatgaatttagatacacatatatgtttagatttattaacatcgatatgaatgtagccaatgctagaatgacttacattatgaaacgaagaaagtatatatattttgctattgccactccagctttgcattggtactactactactacactagccagctagttatacattgctactccagtgttgagatgatcatcccatctactcacatcatgctgtcggtggtggtcttgctgctgctagctgcagctctgcccatgagctgcagcaatgacactgacctcactgctctacttgctttcagagctcaggtgtctgatcctctcggcatccttcgtgttaactggacaaccggcacatccttctgcagctggatcggcgtctcctgcagccaccatcgtcggcgacggcgcgccgtcgctgccttggagctccccaacattcctctacatggcatggttacccctcatcttggtaatctctccttcctgtctttcatcaatctcaccaacacggggctagaaggccccatcccagatgatcttggaaggttaactcgtctcagggttcttgatctcagtagaaacagattgtcaggcagtgtaccatcatccataggaaatttgaccagaatccaagttcttgttctaagctacaacaacctgtcagggcacatcttaacagagctaggaaacctgcatgacattaggtacatgagtttcatcaagaatgacttgagtgggaacatacctgaaaacatattcaacaacacacctctgttaacctacataaactttgggaacaatagcttgtcaggatccataccagatggaatcggttcatcattgcccaatcttgaatacctatgcttgcatgtgaatcagctcgaggggccagtgcctccctccatattcaacaagtctagactgcaagagctgttcctatggggaaactacaagctcactggacctatacctgacaatggaagcttcagtcttcccatgttgagatggatcgatctccattggaacagtttcagaggccagattcctactggattggcagcatgtcgacatctcgagagaattaatctgatccacaattcattcacagatgttttgccaacatggttagctaagctaccaaagctaattgtcatcgccttgggcaacaacaacattttcggaccaatcccaaacgtgcttggtaatctcactgggcttcttcatctagagcttgcattctgtaatctaactggtgtaattccaccaggattggtacacatgagaaaactttcaagattgcatctctcacacaatcaactaactggcccatttcctgcttttgttggtaacctaactgaactatcttttctggttgtgaaatccaactcattgacaggatctgtaccagccacatttgggaatagcaaagccctgaacatagtgagcatcggatggaacttgcttcatggtgggcttgatttcttgccaactctttccaattgcagacaactccaaactctcgacatatcgaatagtttctttactggtaatctccctgactatatgggcaacttctctaatcagttggtaattttttttgcatttggcaaccagttaactggtggcatccctgcatctctgtcaaatctaagtgctctcaacttattggatctttcaaacaaccaaatgagcaatataattccagaatccatcatgatgttgaaaaaccttcggatgcttgacttctccggcaatagcttgtctggtcccataccaacagaaatctctgctctgaacagcttagaacgattgcttcttcacgacaataaattatccggtgttttaccacttggccttggtaatctcactaacctgcaatacatttcgctgtccaataaccagttcttttcagttataccaccaagcattttccaccttaactatcttcttgtaatcaatatgtctcacaattccttgactggtttattaccattaccagatgatattagcagcttgacacaaattaaccagattgatctatctgctaaccatttgttcggtagccttccggcttcactcgggaagcttcaaatgctaacctacttgaatttgtcatataacatgtttgatgactcaattccagactctttcaggaaactatcaaatatagccatactggacctgtcctccaacaatttatctggtagaattcccagctactttgccaatttgacctacctcacaaacgttaatttctccttcaataatctacaaggtcaggtaccagaaggaggtgtgttcttgaacattactatgcagtctttaatgggtaatcctgggctgtgtggtgcctctcgtttaggactttcaccatgcctgggaaattctcactcagctcatgcacacatcctaaagtttgtattccctgcaattgtggcagtaggacttgtagttgcaacttgcttgtacctactgagcagaaagaaaaatgcaaagcagagggaggtaataatggattctgcaatgatggttgatgctgtcagccacaagataatctcctactatgatattgtccgtgcaactgataatttcagtgagcagaatttgttgggatcaggaagctttggcaaggtttacaagggccagctgagtgacaatttggttgtcgcaataaaagtccttaacatgcagctagaagaagctacgaggagttttgattccgaatgccgagtactgcgcatggctcggcaccgcaacttgatgagaattctcaacacctgttccaatctggacttcagagcattgttgcttgagttcatgcctaatgggagcttacagaaacacctacactcggaagggatgccgcgccttgggttcctcaagagattggacactatgctggatgtgtctatggcaatggattacttacacaaccagcactatgaggttgtgctgcattgtgacttgaaacctagcaacgtgctatttgatgatgagatgacagcacatgttgccgatttcggcattgcgaaactgttgctaggtgatgagagctccatggtttcagtaagcatgcttggaacaattgggtacatggcacatggtaattaatttgactatctttattcctttatgcagcagctcctctgtcattacatccgttgattgatacttctgtagctaaacccagcttttgttttgcaataatttttgttgtcagagtattgttccatggctaaagcctcgaggaagacgatgtgttcagctacgggatcatgctactggaagttttcactgggaagatgccgacagatcccatgtttgctggagagctgagcctcagggagtgggttcatcaagcatttccactgaggcttactgatgttgtggacagcaatcttctgcaggactgtgacaaagattgtggtactaaccacaatgataatgcacatgaagatgctgcttctagcaggctgatcactgaccttcttgtaccaatatttgaggtgggcctaatgtgttgcagccatgcacctgatgaaaggccaactatgaaggatgttgttgtgaagttggagaggataaaaagggactatgctgattctacagggagccagaggactgaataatatctgtacaccttccgttccaaaaagaatcaaatcctgactataaatctacataagtgtttgtttagattcataactaggatttgatttattttttttaggacgaagggagtactagtttgagagttgtaatatatatgcagattggggagaagatattaaagtattcagcttgaagtgttctctttattactggtcattgtgttgatttagttgtccaagtagccgatgtactgtttttcactgatcaaaactatggttgattagtaaactgatttttctctgaaacttttaccatgatatgatttttgttttcctgtgcctactgcctaacatcactgactgacatccgattgtctgactatcagtgtttcagaacagagaacaccactggccatctccaggtttgcctcatctccaagaatacagactcttcactctacggactagtaacaagatttttagacatccccgcaaaaaaaaagaaagactttttttagatggttgtaagtatgcaacaatacgtatttgattacacaaacccatgcttaaacaagcatttagtagtaactttttttttattttagaagcctgacaatcatactagaattaactaggaggaaatatacctcaaaattacaaaactaaatcaagtaactaggtgtacatatggcaatagatggatgctacctcccttcagacaggccagacatggtgccatcgctcgccactgattggcaatattcaataggtgagtccacccattggtttcgcaccatgtccatcgccatcaactctggaaatggcaagtcatggttaagatactgcatgacatgccacatggttggccttgcaataggtgatgggtgtgagcaaagcaatcctagttttagagctaggcatgcctcatcatcatcatatccattttggagctttggatccattacctcaagaagtgatccctcgtgccaacgatcaatcacccaatctaccaacgtgaacttgtactcactattcattccgtgctcaatgggccttcgtccacaagcaacctcaagaacaaatatgccgaaggagaaaacatcggtggcgggtgaagccttacctgtgtttgccagctcaggggcaagataccctatggtgccaaccaggtgtgtggtttgcatgtcggtgccatgatcatataaccttgcaaggccaaaatcacctaagcgggcattcatctcttcgtcaagaagcacattgctggctttgacatctctatggatgacaacttgctcccactctccatgaaggtaccataaaccagatgcaacacccttgattattcgaaaccgttgattccaatctaaactaggacgggtactattacagtgcaaatatttatcaaggctaccatttggcatatagtcatagaccaagagaagttcacctttacgccggcaataaccaagtaactgcacgatgttgcgatgccgaaggcggccgatgctaacaatctctgcaataaattctcttataccttgtctcgattcatgggacaccctcttcacggcaatctgtagcttagattcaaaaagaaaacccttgtacacccttccaaaccctcctgtacctaataggtgcctattcttaaacccttcagtagcaaaatataggttcttaaatgagaacctatgtggtccaaaatcaatttcccaatcttcccgtagctcggcatacttaaaccaccttcgcacaaagaggaagacggccaagctcaccgcaacagcagatgtggcagttgctataggcacaattatcagcaataccttggaccgacgagaaccttttcgatctgtacctctacgaggtaagtcaggtagctgagctgtgaggaatgatggagctgatccattcatgctgaagctccagcctaagatgtagtgacttgtttctagtggcccagttgctgctgacaatccaacatatgcgacatctgtcagcaccattgagaggttataggacatcaacagtagtggcttggtaggtttggccattttgaatggagccaatgccacatcaatccgcattgcccgtgcatcataatcgatccaaatttgaatcgcctcaccactaatcaaactcatgttctggaatccaccggtgttatcatcatagtatcctgccgaagaagaattcactgagcgaagatcactgatgtcgatgccgatgtggttgctgtcgatgtccataaactcgttgtttcgtacggtgtcgatctcgacagcaaaaacatggttgctcatatttccattgtttttgtaattgaacaggcccaggtgttgcgccgcattcgcgtcggagaagttagagctcggggcgatcaagaaggccatgccgtccgtgccaacctcacggtaggcagagatgataccaaacacgatggacacggagaaggagtgcagcgtcgtaccgggcgattcgcgaaagcggaaaggagttggatggaaggcatggcctttcatcatgccggtgccattggtcagctggagcaatccccctggcagcaccatggctgctccatcgacggtgagactactgttgaggaagccgttgaacacaaactggccatcgtcgacagctgtagtgaaggatggaagaagaccgataccgagcttgatgacgatgatgatgaaaaatagtggaagaaagctcgaacggttcatgccagacatggctctatgaaaacctgagagagagatcattcagggaagaggtttaacaacagggggaagctgcatttgttgcagtgtgctgctatgtggttgcacttgctcttcagtcaatatagcttcatgtcaagtgtgtacgggtaaatagctagtctgctactagaaatgggagaggtgggcactctctttctcgaagaaagaaaagaagttcatgtcagagtctaaagctgtgctttgttttgtctaagtttgaattgaccgggtgtcccagttagcagtttttccacactgcacctgcaaattagtagcgcaaatgagaacatagaaaatctcctatgcagggtttaatagtaagctcccttcaatcacacagacacacacaaaaaattcatgcagccaaattatatgggcagtgatctaatctcaggattaattggacttccctagattttcctgatttctctttttgtaatgaactattgttaaagagtttttttactgtccaacgtaccacgcggtaccatagcggtaccaaatgctggccgttggatctggcctgatccaatggctggtgttgcgtggtaccgcacggtaccaaaaatgtcccttaggtggtcccgcatggagaagagagttggaagggtaaaagagtaacttcgtgtgcaatagatgggtctggattgggcggctcgaaccctagctatgctagatgatttttgccgccgccgccgtgttcctcttcctcgccgccgccggacttattcctcttccgccaccgccgaacttgttcctcttccgccgccggacttgttcctctcccgcgccgccgtccttcccttgttcctctccggcgctgccgtcgttctcttttttctctcgcgcgccgccaccggactttatcctctcccgcgccactggcgttgccttgttgctctgcgccgccccaggaacggactcgaacgccgcatccacccttgctcatcttttctctcccgatcctacccatcccggattcaacggtagatgtgttttggttctgcggggtaccagtaccgcccgatacaacctgttgggccgtagcaatcctctttgttaaacgttttggttgcatcttagttaatttcagtatggttttgtcacattgatgtaattgggagttcagtaatagcttcttttatattaaaaaataggtttgaccattttgggcacatcaaaaatgatatttgctgaaaaaatgattttgcagtattttacttaggtaatcgttaatgatatttgaagtttcaaacaacaaaaaaattgaacggatgaggtacttcgtgaaccccctatatgctctctacttctactcttatagcggtgtttaaaaatccatgcaaatgaacgtttcaattttgaaagattagtaactataaataattggatactattgcaagttggaattgaaggtctcaaaagtacgggtcacagtcacaacttacagaccataaaaaactattagtgtcatgcaattcacactgcagggtacacctaccaaataagagtcaacagaatttatatatttttagaaaatggattaaaacctagtctctgcatccacaaggattgaatggaaaatgacataaacaaaacaaaggggttgccggtggttgtcggtgtcggcgtgacacccacatcggcctattcaaggggtggacgctgttcttctccgtagctcccaggtgcttatgccgtaggttacagttttataccagcaaaagattttctttttacaagagatattcaatataatacaaagttacggtttttagagcaagttttgaacacgaactcgaaaactctcttaagaaatttcagctggacagggaatcatctttaaattatctagagggaagagggagaagtatagcggacttcttcaagatgagccatcgatagatgcatccttttttggtggcgacgatatccaaagtctaaactacggaaagagatcgagggattagccttttggtgttgggtggtgatgagaagggggtagatggcatggtttggagggatggctgttttggtcattgttccaaaaatccatatatatatatagtcaatataagttagctttagctatcattcttacttttgaaatattacaaaattttccatttttagtatatcaaaagcttttttaatagaaaaagcttggtagcattatatttatgtaactatttctttttttatacaagagaattacatgatcaaagttatgctctattgactcccaaaagtatgaaacaacatttttctttaattggatggagtaaattaactgtcctcctgtttggttcggctatatatttgggtggtagcatataattcttaattatagccgaatatgcgcaatctagatagaaggcccatcgaaatttcagaatttagggccttccgtaccatgagaagtgagaactaaaaacatggacaagcccacagatgttcaattaaacaacacaaagcccatttaactaaaaagaaaacaaaagggaaaagatggacaagacacaagatcacagatactaccttcgttttcatataatagatagtgggcactattcattttcaaactttgatcagtcttggctgtgtacatcctccttcagagccgggttttctaatccattttctaaaaaaagactttgatccctcgtccttttttttaaaaaaatacaaatattacaaaagatacaaactgtatttcatcttaaatataaccaagatgctctcattcgttgtagtataaccatttaagagtaattatcgatcaaagttgaaatagtaatagttatggttcagttattgaaaattggggtagctttttttaaagccaaattaacatgcacatcagcctgaactttcagatacaattgcctgatcaatcttctgagtacaggtctcccagttacaagtatggctccacagtcaaaacagactgcctgttcacctccgtgagactgaggacatatggatagactgaccagaggccatcgatcgccttcacgttagaatcggttcacccccatgaatagtggcagatggggacgaacgacggcttgaagatggaagaaggaactcgcagctgagctgttcatggctttatcagaacacaggaattttacaggatttttaaaggaaatgttcggttcctccaaaattaattcttgctaaaatttctccaatccgactaggcatttagtgtgaacaaaaacaaaaaaaaataggagcgagataactacaagtacataaataatgttacatacgttagatttccctcaacggtgctcaaaatttttctagcaactatcaactatgcaaataacaactagtactaacaaagaaaaacacatgttgagaggcctatttcctatgtgtgtaaattctatattataaaattataaaaatgttaagatatgaagtccaattatctaaaaaaaattaagtggagggctatgttgtctacttcgtattgtcccaacggaggcttcggttgattttgactaaagtccatgttaggtttgagcaaacttgcattgagagcttatcttcctccggagaggtcagttgatactgtaccaaagcttgtcgacggtggcggagaagacacgatgatatgctcctgcccttcatggcttaggagttgtgccaatacctcatctgggaatgatatatcgccatccaagaattgcatgacttgcctcatgttgggccttgcactaggcaaggaatgtgagcatagcagccctagctttagtgctaggcatgcctcatcaatattgtattcattttgaagcctcttgtcgacgacatcaataagtgattcattgcgccaatgtagaagcaccaaatcaaccaacatgatagggcaatcttgctcttcactttgcataatgggtcttcgtccacatgtcacctcaagaaggaacatgccaaatgcaaacacatcggtgagaacagaggccctgcccatgcgtgctagctctggagctatgtatcccatggtgccaaccacatgtgtagtttgtgggtcactgccatggtcatataatcttgcaaggccaaagtcgcctagccgaccattcatctctgcatcaacaagcacgttgcttgccttgatatctcggtggacaacaactttctcccaatcctcatggagatagagtaggccagatgcaactcctttgatgatgtggaacctttgagaccaatctaggttttgttggttatcatggttgtgcaagtatttatcaaggcttccatttggcatatgatcgtacaccaatagaagctctcctttacgtcgacagtagccatgtagttgcacaatattcttgtgacgaaggcggccaatactaacaacctcagcaatgaactccctcattccttgccttgattcatgtgacactcttttcactgcaacttccgactttgattttgtaagcactcccttgtacactctcccaaatcctccgatgccaagcaagtgtttgtctttgaacccttccgtagcatggaataggtccttgtaagagaaccggtgaggaccaaattcaacttcccaatcttcgcgcagctcagcatacctcatttgccgtcgtctaagtacaactatgccactaacaatagcaagtactaatgttgcagtagctacaggaaggatgattatcaataacttggattgtggctttgggcctaaacgaggcagctttggtagtttcttgacatcgatgaccggagctggttggttcataccaaaactacaaccaagcacgtagtgatgtgtatcaagaatacccgttgaggatgaaaaaccaacatatgattgattcttgagaacctgtgataggtcataagtggttgtaagcaatgcccttgctggtttggccatatgaagaggggccaaggtcacactgattaacttcctctcgccattgtagtccacccatacttgcattgcatcgaaagaagcaagagttaggttgcagaaggtaccattcttgtcatcataatagccagcgttgtaggaatccacggacctaagatcattgatgtcgatgccaacatggttgtcattgatgtcttgcatatcgttgtttagaacggtgtcaagctcaacggcaaagatatggttgcttgtgttgccgttgttcttcttgttgaggaggccaagaaactggttggagaaggctcttgagaagttcttggtcggggagacgaagaaggtgaggccctgcgcgctcactccgggggcgatagaacggatggcaaacacgaaagagcggagaaggatcgcaccctcgtaccattggaaccatgctcgtggaagcgcagtggtgttgggtggatcgcatgacctttggactgtgccatgccattggtgagctggaggaggccatttggggtgaccatggccataccgttgacgaggatgtcggtgccagagaagccagagtagaggaatcgctcctcttctccagcagcagcgaagaacttatggctgagagcaaggaagagaaagaatgttttggttatgattttgatgcccacccattgctctggaaaacggatgaagctagtttgcttcaagccatg

SEQ ID NO: 5838 - DNA, 10185 bp, Oryza sativa
attcctgcagcccgaagctagtttgcttcaagccatggtgcaggtggtttgttgcctgcagttgcagtctataattaaggcagaatatatatacagtagaagttgcactattttattccagttctgaaccgtacctgagctgtttatgactgttaattactcgatcaacgctgaagaatatggtcatgcaagtacattagttcagtcctttcaaaatcagtgaccatggctaatcatacacgtttatgtcctcctcataatctaactcaacgtgggaacacgccattggattaaaattaagttatctttgcatcattaagtcataattttctagttcgagttgagcttgagctatgatctagcacgagttgctcaactctgactggtcatcacaaatataacaaattacttagcattctagaaaaaaaatgaatggaacaaacaagagactatgtatcgatggttcagtctattcagaattataacgacatccatccaatcatatttctccaaactaatccttaattcacagaaggaacaagtcttttcagcatataatttgtcaaaacattttgctcccaaatagttttgatacttcataaggtgattcagtcacagtagtgtttcttttctttttagtgattaccaggtatattggacatgtgcaattagtcgaaaaaagaacagtagtttcgtagtcaaagattcctatagaatagagaaacggttttcctaagaccatctctgggggtttggcttatcaataatttggagaccattcaatggtcaacttcatagcatgtggggctgctaagcttatcgagagcaaataaagttacaaaattaaggatattattctacagtcaataattgataaagaaaaggaaaagaaagaagacgtcgaaaatggaatgtccaaggacaataatatggatgaccaagttgacaatttcacgcaccataatatccgcatactcatccactttccttcctcgcccttctcattcgttcctcttcgcttcagccgtcctccttccttgaagggtatattggtcatatatcatatgatttatttacgattttagtgataagtgtgtatttatcaatttgtgcactatatagattaaatcaacaccttgatttcacacaaataccccttcctatccaaaatgcaagtcattgagagtattgacaaggtctataaagcaggcaatttgatctgagtaccaatttctagaaaactataggctttgatcggttgaactatagttgattagccttagaaaaatgagcgaagcaactgaaaaacagttaatgaataaaacttttatgtatgtttctattaggagatttattccggtccaacaaaaaatacctcgagataacggtaccttacggtactaaatcgtttccgatcgttggatctagctgagcagaatgggcattgttagattcaatgatcggaaaggatttagtaccgtaagttaccgctacctcgaggtactttttgttgaaccagagcaaatatcttctattagagatttaaaagccacggttcaaaaatagactacattaaaaaaaatcaaaatcaactctaaagctaagttttataattaaaattttagcagtggctacatgttatgaaagtatttttcctgatgaatacaacaacaacaacattacgtctccagtctacacaacattgatggtcaaacaaaacagtttgccaacacattctaaaaccatattttgggttgaaggtaaaaactaaaaaaaaaaaggccttttcctctcttttaatttttttggtcttgtgaaccaaagcaacaagccggggcccaaaccattgttgacggtgaatttcgacagtggagaccactccagatctagggaatgaaccttagctaagaaaagaaaaacagatcagccttaattaacagagacagataatgcagacacatgatatgtagacatgagcctgatcgactgtccaattaatctgcaggcccagactgatgaaaataagcactagtgtaatccaaagtgcatctcagggtgtgtttagtttacgtcaaaattgaaagtttggttgaaattggaacgatgtgatagaaaaattgaaagtttgtgtatgtaggaaagttttgatgtgatggaaaagttggaagtttgaagaaatagtttggatctaaactaggcctcattgtagtaatgtactatgctctgctccgagaaattccgaaacagatctcatttggcaggaggaagaaattggcagagagaagaagaagaatggggaacagtaggtgactgtgagtgaatgtgtgatggactcgcagtaaagtgaagtaaagaaaagcagatatgaatatgatcttgctgtcaaagaagaaattgaattgaaagaaagtaggagtagcagtattagtacagtgcagtgggggactgatggtggggggtgagctagctaggtagcttagctgtgtgcagattgtcggcatccggggagaatcccccacaaccacctttgctctttcttggatcatgtcatcctggactcaatcaatcaagtggtcatgttcatctcccagctctctctctctctctcaattctcacgtcctttttgttgtacgtgtcgatgtgttcatggcttttgctcctttaatctggcactacacttccagcctgtcttgccctcctctcctgatgatgatttcagtggtacagttttatatgctcaccatttttgacaatgttgcagatccatctgttatgctagcaaagtagcaagtcagtattaggttttactcgctttgtcgactctttcttttttcccgagggaacaggcaaggagttcatgcaattcattatagaagaagagaattgatctagtttataaggaaaaccagacccaaaaaccttacaacagtatggttaatttgtgaaaaccaacgaaaactctagcattgacagactaaacctaaaaactaaggacagccgtccattaaggaaaaaactcctaaaacgatgccctcaagaaggacacgccgaccgaacggcgacattgtccgatcctacgaatctaggattttcacccggagaaaccccttgatgtggagttgaatgagggctccaatagcaatgccttcaagaaggtgaacggtgcatgagagcgtcaccgttgttagcatcagcaagccgagtaaggctttcaccttggagtctcatccaaacaaagtaaccgcaatggaagccaccaaatgccacttgcacatcgaaggtatctgttatatgcacacaaccacctgcacattgttgacgacctgctcagccaccacgccggaccggcggagcttgccggcgccacccgaactccaccaccgtcggtttgcactggcctcacgccaggacctgcggagctgcaggagaggtgccggatctgggcctacgcggccagatccgaccgtccccgcgcggccctcgtcgtcgaaccgggagaggagacgccgctagcccgaggacgaaggccactggcgctgggtggaggaggcaagccgccggacaccccagatctggagaaaaggagggagggagagaagagaaaggatgaagaaggagacgggaagaggtagggagccgccgccgtcgccagcactaccatcaccggcggcctcgctggcggcggcaacacaagcgagaagcggccggggagcccccgcgcgcacaggctggcacagctagggcgagcgacatggaagtcacaggaacatcatggggattcggagatcctgacgctcccctctataatcatgacaaaattctttttcttaaaaaaaatagtatacgctaaatttcgggtgactgaagtttccccaaatctcattgaattgaaatataacatcgtcttcaacctttagatgatggagagagagaccatgggaatagggtggtttctcggggattagtgggatggatgggaagaaggcgaatcagcagtgggcaagaggcgccgttgccgccacgggagctatggggctagatcaggaaagtggtgggcgaggttagcgacgaggatgtcttggtggtgcgagctatcggaaacatggaagacgagcgaggtaggggaatatttgccacactatttggggaggagaatatgagaggggtgagaggggggaggggtgggaagagggaagcgataggcacaggcagcgctcattgttagcagtgggactaggaagtagcgaattggggatagggagatgttgtcgtagtgcgagtggctcaatctggtcgacgcattgtggaatcgggggagagagggtagaggggaagatagggtttcatgtgctgcatgaatctcggtgcaatctaagccgtccaaacgtgactaatttttttttgatactttcaggttacttgaaactaaacagttccattaaaaaaaactaaaaattgtggcgttcctattcttcactaatctgcttttatctctcttttgctgatgctaactagcgctttaattaataatttcagctgatcatcaggctcaactactgctagaagacagtcctatcagcaaaaacaaattggtactggtattagtaagctgagggttgtcacgtacgacacgcacacgcgcactctgccaacactaccaacacaaataaattcagcagctactctccacaatccacattactccagcagcacacacactggtactgcactgcactactgctgctctgcctgatcacacacactcacctctcaccactcaccacatgaggtttatcaatgctgcactcactcacctccatgacacctggaaacaccagccacctgcctcaccaattggcctcttcatttcactcctctcactcccagtagctgcaaaaccaaacaccctatcttcttcttcctcaactactactcctgttcttgctactgcctagctcagctactctgcttgcccccaacctatccaacctactaacattgtagtacactacacacaagcctagcttagcttaggttgcagctgtgtgaggtggggatccagatcagctttgctgttggagagatccatccatccatatagctagctgtaactacatacagttgttcattcagattcaggcattcagccactgcctgatttaggtgagggaagaagaaggttcaagcaactgcacaccagatggtccatctcttgccatgcacccatgctcacttgcccctgcctctcttcttctccatcctcctcctcatcttctccatggaggtggcacattcagatgcaagtaagataccaagatccctctctctttttgctttctttctagcattagcttctcactcaaccatatttgtacttcttcatatgcatagggaggttgccactgaagcttctagaagttggcaacatcaaggtaatcaatcaaacaaccaaccaaatgagttcttgcttctgccacattgttttcctttcaatcaatctgagtttgcatatgtgtgtgatgttgagtaggaggagcctgatgaaaccattggagagaagatggagatggagatggaagggaggaggctgataggatcaaggccaccaaggtgtgagagggtgtgcatgtcctgtggccactgtgaggcagtgcaagtgcccattgtgccacaggtgattcagaagacacaaaccaaagctgctgctgctgctgctgccgagcaagaacagcatgtggtggtgagtgctactgccatcagtgctgcagtgttcacctacagggtgaatggcctctcaaactacaagccattgagctggaaatgcaagtgtggtggcatcatccttgatccataatgttccaactcatggcagatcacttcaacattgtgcaaaaatgtaaacaacttgctcctctgcttgttcatctgaatttttctttctttgttgttctactactagctagtagctacttcctccttttgatttctatctaggccagagattgaaaatgtggggagatggagatgaaaagctgcatgtttgttgtacatttaggcagcaattttgtgaaaatgaatgaatgaatgaatgcctgatttaggcattgaatgcattttgatttggccctgacttggaggcacaggatattaaattgttgtgtgcattcaagccaatgaaatgagccatgaggcatggtagggacaaacatctgctctgctctctctctctctctctctctctaattgtgtgagtgtgagagaacagcagacagtacaccagaccagtgttaggtagttgtcattgctacagtgaaataaatatatatatacatatatgttttcttattcaatattaatcagaaggcatcatatttgttcaacaaatgcaataatattactacaaacagcatataaaaataattcaaactgaggataaagcctaggaaacactctcaattgttggtgtacttgaagaaaaggcgcgtgtccacaaaatgctgattatacaacaagttagtactcctatccagggtttacctttcagtttccaaagtgaaaaccgctcccttccggtttatcaaaaccaactaaaaacaggtaaaaaacgatgactttctattaacattgcacgaaaccagctaaaactaatcgatttccacgaattgacaaccaacagtttcacgaaaaccgactggttttgttaacttgctcattcatagggaggattgaaggaaatgcattgacaaagaaattaaaagaaaaaaaaatagaaaggtagaataagaaaagttttgtgatgattggacctttctgcagcaagcaatggcggaccactagaaaagcaggaggcaggccagggaggcagagagagagagcttgaccagagccatggctgctagcccggtggatgggatgatgcagatttgcacatcatgcagaggcagatcgaacaggtgtgtgtccatccatcgtccatgcatgtgacaatgtgagcagcaacatttagggtttgttttgggagcttctagcagctgcagcttctccaaacagtctagctttttacccaagttctaagaatctgtagttgtagaatctggaaaatgaactagaagacagaagctgggtttcccagcttacccagttctccagattctcaccagctagcttctcgctgcttctcagaattttaaactccccaaacaggcacttagctagagtagatgcagatagagagatagtaggagtagatagatgcatgcattgatctggtctggtctggtcaggtgtgctctccctttcatggcacggctggactggtcactgccatcggcccatcgctacatgctgcaccatgccattccaatgttcattacttcagatatataggagcatttctaggcatttgatattttgattcacatgcataagtatttttggagcactactttcttaattcaatcaccttaaattttaaaatgtagtcggttggtcgaacgctgattatgggtaaaaacgtttatatccgtccttattgattgaacgagaaataaaatgtaatggaataaccttaaattcaacttcaaaattaagttttaaatttaatttttgtcagtggcttgtaggattctctataccattgcatcattgtacatgatttttgtaaactactatagtaaattcttagaggcatcacaataatatctgcaaaaactacgagatatgattaattacatcggaagcgtagcctatgcacacgggctctcacatgtacacactgtgtataccaactaaaaattatcacaaaaaattctagaaaaattcatacatgtactttcgtactccttccgttttaggttataaaacgttttgactttagtcaaagtcaaactgttttaagtttgaccaagtttgtagaataaagtagtaacatttttaatccaaggcaaatttattatgaaaatatattcaattattgatttgatgaaactaatgtagtattataaatattattatattatctataaacttagtcaaacttaaaacagtttgactttgatcaaaattaaaatgtcttataacctgaaacggaaggagtattacatctacatgcaaagtcgcatctccaaaatcattttacatagagagtaaaaaaaaacaaaatcctgacagaattacaacctcaaaattgtaagatttttttaggctaaaatataataaatttgaggttacgattttattcctaggtgtaatacaattgaaagtatatgtatgaattttttctaaattttttggtgacatttgttagttggtgtgcatgtgtgtacatgtgagatcttgtgtgcatatataggatatgttgtctaattatatcatgggcggagtactatttaaaaatagtttatttttaaaaaatggattttcttttagatgcggttacttaagaccactgtctctggaaatataaacaaccgtatttcaataaaaataatcataacattttcatatgaagttaaatgggataaattttatatgaaaactttagccctagacgagttgtattactttgaagtcgaaaggcttttcatttcaaattgtttaggggtcaaatattcgctacaagttcctagtctcttctgaattttattttttttcttttgtatttttcaagcaacctaggatagagataatctatatcaaagttatatagaagttttatagctcagcaaggttcggagaggtgaattaagaagagataatctattctataccactgagtttgtgtgagttcaattatttgccatcgacattgtatctttctataatataccggccactttatcaattgttctacaatacgtcactaggttggacattcttttcaaaaatacccaaaatacccttatgaacatacaaggttaacaattgatttatctcactagaaattccaaaaaaatatgaaaacttttatgtggcctctttacacaacatggaaatttttataggagtttcaagttttttcatttctttttttaaattataacttatatgttatattgtatataaaaatattttttattattgtttttaatataaatcatatttcacacactacataagatatttttatgctatcatctcctttataagcgatttatctcatataccacgtaaaaatattttttgtaaaaatataaatataccaaaaaaaatttaaaacttgtatacaaacttccatgttgtgtaaggaggccacataaaaattttcatatttttttgaaacttctaatgagataaatcaattgtttatcttgtatgtctctaagggtattttaggtatttttgaaaagaaggtccagcccaatggcatatcatagaacaattgctaaagtcgtcggtatattatagaaagagataatgttgatgacaaatagttgaactcgaacaaactcgatggtatagaatagattctctcaattaaggaatagggaacatcctcctttagtcaagtgatccataagtgagttaaggaggttacggcccatttgattcagattattgagcggattattatcgtgaaatatctaattaattaccaggcaacttaaaattttaataaataaacttaacaaacaacttaaattaagtggtaagtaatgcaatacaagaaaatatatctttttaaaaaatatatcttttaatgtatgaagcaaataatccatttcaatgatcccgtaaataatccgaaaagaacaggacaccacacatggagagagagaggtccaagagaccaagagcgtatatcatgttcaaaatcgcgtgacttgtggcatagaccatggatttagtgattttgtttctctgagaagaagctataagcagcttattgtccctatgggtttagtgatttgtgctcaacttacaattagagcaaggataataatgggctataagcaagctatatgcttatatgaaagagaaagataaagaaaagtgggtagtgttggctcttatacaagagccagcttcacataagctccaagaaatatgaattaaattcatagagtgagaaagagagagaatggaaaaaataaagttaaacttatagctaatttattatacaagttaactctaacattaacttatagcaagtagtgagctattgtattaaacttgctcttacatgg

SEQ ID NO: 5839 - DNA, 6508 bp, Oryza sativa
taaacatcactctgtcatctttgtttgtttgcctacctaatcccttctttcttctgtatagttggtatgcacttaactcattcattgctataaagctgatcccacagtaagccacgtcatcaaaattaagtaggccgttggattttgatctgaacgatcagtattccctagctggctggctcacaaaactggcggctatatcttcctctcgcaggatctgtttcttccatccctaggtaatggcgtaatgttactctagcggctgcttccttcctttcttcagagtatggtttgctagagcaatcacaggttactactcgccttcgattcctcactttgagtgctactgccacatcttggtcttcattcatcttttcttgactatgtgaattgaagagttaacccttctaattttaatatagctgtacttacaaattctctaactaggagtatgtatcagcattttctctacaggatgaagctggtatcctggtagtcaactagattgtgccaaaatagccaaacaaggcagatcgatcggatggtaagtccatttctatcctacacacatttactactgttaatttcacatttgcttcaggatgatttttcatatacattatatttgatctgagaaattgcaggatgcatgtacatgaccatattatctacaaatttatcctaattagtcgttgattaagagaagattcagaccaaccgtaagtttcttgacaggaagcgaatgcgctaaataggaattcaaagatcagtatttcctttttaaaataaccttcagttccaactatttatttcgtgtgctgatgtttgatctgtatgcataaagataaaatctttgttgacttttaataaaacttatggttagctcttttatgtagtgcacacatcttttcaaagttatttgtctacacaactatcccgcagcaaagcgcggggtgtccactagttaatttgagagtggcccgagggtaagaattccagttattagtaatatagataactagtttgttgatattccacgctttgctgcaggatatgtggatgaatacatgttatatgttatacattatggaagtggtagatatatatatatatttaaataatataaaaattatgagaagataatgatttgacattgtctgcatattgagttctaaaaatacaaaaaaattatagataatatttatatttgcattatatttaaaatactatgtataataattatgtggcacacttacatatgatttaaaatactctagataataattgctagtgtgtgatgatgggtagacttgtatgatgagctaatctactgtagctacaagctagtactacttaaataaatatttaatgtttgacggttttatgttcttcaaaattaatttgactttgaccataattttacattaaaaatttatgtttttgtaatagtcattttcatgcaaaacaatatgctatttttatggttttagaataagtatgttagaaattattaatggtgtttttaaaatcttaactggattttattattatacatgtcgaatatatatatatatatatatatatatatatatatatatatatatatatatatatatatatatataaaagactattctacacccggagtatagaatagctattctataccccccttctaagggccaaatctatctcccacattagtctaaggctagtcaaagtgcttccacgtcggtcaaacctcaggtcaaatccgcctgtgacttctcccatcacccaccctttttcagctctcgtctcgcagagacggtgcagtaacgtgacggtcattgtgtagtaacgcgtagtttacttgcagtaacaacggtaaaatatagttaaaatatagtcatgacggatctacttttaacaagtacttttttttctagcatcatggcgcaaacggttttaaaaaataatgcatattttgcgagatattgctcttcaaaggttagcattttgaagtttaatcctccacatgtagtaacactatagcattattgttactaccatttgatccgtgttactgcgagagtgcagtaactactacaacttttgcagtaaaagtgtgttattgcaattgcttggtaatgttaccacaagaacgtaataacaaccaataaattttacatagagaaaaaacaaatggtttgctttatgatgaggaggacatgtgagaggcgaggggtggtgagtgtttgcttgaatcgggaatattaggagtgcgatgggaggccacgaaccaccaccaattttgcttaactagtcaaagtgaatccatgatgtgtaatctcgttcaaactcccaagcggatgcaacattcatcttgtgaaaattgtgcagtaacgttagtgcccgcgtacagcaacaatatatgtgttttgcagtttactgcaattccatgatgatgttactaagaaattgtaacggaattgatttgcttctttcatggaggtagaaataatctaccttgtttttgtttgaatagcgtactaaacaatatgtgatagcatattagaatgaaaatgatactatacaaactgtccaatcttggtcaaaccctcaagcggatgctacatatatctagttagaattgtgcagtaatatagtgctaaatagcagtaataacttgtgttttgtgtagtaacctagcatgttactttaattccgtgatgatggttactacgaaattgtaccatgtatcttacacgtgctaaatttaatttactatgtgtttttgtttgaacaatgtattgaatggtacggacgagggaggagagtgcacacaaggcgggtgaggagacatgcgtggtagggcaaaaaaaggatgtgttttgacatgataggttaaagcatcacatgctaaccgtatacttattactgcacaaaagtataagtgttactacatgataggtgcatgttactacttccaagtagttatgttactacttccaagtagctatgttactgcacgataattgtagcgttactatgtcaattttacgagatgaagatcgaataggtaggccataggtaaagtctgtaggtggctttgagcgaggtctaattgatgtatgagtgttttgaataattttatacatttggtaaaaccatgttactgcatgtatatgccattgttactgtaaattatacattttgttactgcatgtggagggctaaagttcaaaatgttctttgaaaagcaatatctcacaagatatatattatttaaaaccgtttccaccatgatgctatggtgttactgcatgtggagggttaaacttcaaaatgcatctacgtactcccctcctcaagaaaccgttcttcctctctcttctcaagaaaaccggtatcctccctccaatatagtgttactgcatgtatatgacgttactgcacttttgacagtaatattgtggtgaattatagtaaattaggaattgaaacaaaaattatatgtgttaaaagtcttatatgccaaccatatacttgttactacgtaaaagtaaaagagttactacacgacagatacatgttaccacgtttatgcagtaacactatccaaaaatgcagtaagacactttgttactacaaaacttatagtctttactatactttttacagtaacatcgtgatagtaacacttatgatatagtattcatatagtattattacttgtgaagagttaaattttaaaagactaatctttgaagataatatctctccaccctttgccccgcgagtaaactgagccaattccacatattcttgtagtaacgttatcaagtaattgcagtagcacactatgttactgtgaaacttataatcgttactacatcttgtagtaacgacatgatgtgattgcagtaacgcaaaacaggcagtaataacacttttgatatagtattactgcttgtggagagttaatttttcaaaacaaatctttgaagggtaatatctctcacatcatttactaattttaaaaactgtttgcaccatgatgttcaaaaaaaaagtgcttatcaaaagtagatccatcatggctatattatgactaaattttaattttgttactgcaagtaaaacacggtgttactgcacgatgaacaagacgttactacgtcgttctgagacgagagctaagaagagagggggtggtggggaaagtcaccggcgggtttgaccgagatttgaccgacgtgggagacctttgaccggcctttgactgaggtgggaggtgggttttgggcccttagggggaggggaggtgggttggagggaggggggtatagaaaagctattctatacccgagtgtagaatagttttatatatatatatatatatatatatatatatatataatcaccaaagtaaattatcaggatttattttttcttttaaagggcaagatattttattattatgtatgagaggcggccgttcgatatttctcccatagatcggacgctcgattcgtagtttcttcctgcatggacacgtacctgcggacgagactaccgatcgggcgcccgatgaggagtggaaaaatcgggcgcccacatcatgctgacgtcagcatgacgcatgcatgcaaaaatactttaaactattttttctcttaaattatttatccaaatcatgatccgattacaccattaaattcgttgcaattaaatctttaaaacaagaccatacatggatatattctgatgaaaaaataattagcttattattgaattatttttaaatgttgcacagtgttccatcgagtatatcggaattgtctcactaagtagatcgaaaatgtttcaatagtttaaattggacgatgtttcaccttatataaaaacaatgtttcagcaaatagcgaaagaatgtttcaactcactgcaacatttgatctatacatagtgaaacattataagtacactaggtgaaacattttgtgtggcgctgtttcaccttatataaaaaataaatgtttcagcaaatagcgaaagaatgtttcaattcactgcaacatttaatccatacatagtgaaacattataagtacactaggtgaaacattttttgtggaacaaaaattaaaacgaattcccttaatagagggtttctacaatatgtgtgtcagggttatggataccacatacctaatagtagttgactaaatctcggcaggacccatcacataccatgtcctttacggaaacaaccttcagatattgagggagttccggataaggaaagacaactagagttctatatggaaatgacaaggactactcggattgtatccatattggtttctctagttctaatttgacaaggggacacctatgggtataaatacgagacctcctaggaggagaggacgaccacctcaatcaacacccaccatagacgacgcggaacaatagatcaagacagaagatcgacatacaagccaacatacaccaagacaagacgccggatatcgacttcagagataggcacggctagtcccctacggtgtctcaagatactgataggagagacattgcgctgtctctgatcacgccgggcacgaactcgaggaggaatactaccctgttgtcgactatgagtcagaccttcagaccgccatatcgacaacaattagataggctatcccaaatattgtattggtgtgattatgatgaataagagcaatatcggcttcggccaacaggatgtagggttattacctgataatttaggggcccgaacctgtataaaaatccatgtctttgtctcttttacctcagtctcgcgtatatcctagtgccaacgatccccatactatgcaaataccgcaatcgcgacatcaaacgtcgacaatatggttgatttgttgcaaaagaatgttttaattcactacaatattagatctatacataatgaaacattatgagtgtactaggtgaaacattttttatggaataaaaataaaacgaattcccttaatagagggtttgtaaaatatgtgtgtgatttgtttcaacggattaggtgtgtggagttacgtggcaggtggacagagccatatggtggggccagggggacacgtgcgcttagcgccagaaattttccctcccccggccgatagcgagcaattccgcgtacatgccaggaagccgtgtatgtgtttccttcgcgtgggcaagtgcatgtactactggtcactaacaatgctcatttaatttcgcttttgacctcaaattaatcatctgaacagcatgaaggcccgttgcaggaataatcctatttattctctcacctactcacccacccaggccacacgccgtaaacactgaaacacaccaattcttcagagttttttcgctctgaactttcttcagcaaacaggcctgcataagatagctagctagctactactacatatacactatatggtttttggctgatcgatttgctatcatcctaactg

SEQ ID NO: 5840 - DNA, 3625 bp, Oryza sativa
ctggccaatggatcatcatatgcatacacaaaaggccatgctttcttcccttctcccatccaatcgcgcaactccacagatggctccatcttctccttctcggcaacctttatcttcgctatgcttcacacgcttcctttggaggagggcgatgggattgccttcttcctagctgcacacaccaacttcaccggaacaggtatttctggcgactttggtcttcctgctgaagatgacaatggcaaatcgttggaccatatcctgtccatagagctagataccttacacaatgaaagatttggggacatcgatgacaaccatgttggcatcaacatcaacagcttgaactcctcccagtcctctccagccggctactacacagatgaaccctactctattttgcacccgctgcggctcaagagtggtgaggagatgcaagtatggatagattacgaccaccggcgcatgcagctcaatgtcaccttagctccagtccccatggccaagcccaagcgccctctcttatctgcaactcataatctctcaaaactgttgttggaccacatgtatgttggcttctcttcatcgtcgtcagcggccttgtatattagtggtcatgctcatggtcattttattgccggcttctgcttcaggctagatggaaaacctgcatcactgcaatactccaagctacccaagataaacacatctgatctacctgatcatgtcacctatggtactggaagggggagctcgatttattggccagattttttgacacttccattgatatatgcctcagctcttggtggtgcaatatcgatgcctgttatcctctacctaattgtgagaagatgtcgcaggtaccaggagttacatgaagattgggaggtcgagtttggcccgcataggttctcattcaaggagttgttcaaagctaccaatggctttgttgacaagcagttgctcggagtaggagggttcgggaaggtgtacaaaggagtgcttccatcatccaaattggaggttggtgtcaaggtgatgtcccatgattcaaaacaagggatgaaggagttcgtcgcggaggttgtaagcatgggccgacttcgacatcggaacctagtacagttacttggatattgccgtcgcaagggtgaacttctactagtatatgagtacatgccaaatggcagtcttgataagtacttgtatgaccaggataaaccctcgccgaattggattcaaaggtttgagatcatcaagggtgttgcatcaggtcttctctacctacacgaagaatgggagcaggtcgtcatccaccgtgatatcaaggcaagcaacgtcctcctcgacagtgagatgaatggtcgactaggcgattttggcctagcacgattacacgaccatggagttgatgcacacacgacatgtgtggcagggaccagaggctacatctcccctgaactagcgaggctgggcaaggcgaccaaggcaaccgacgtgttcgcgttcggtgcattcatcctcgaggtcgcctgtggccgtcgcccgataggcatgaactcatcaggagaattgcaagtgttggtggacttcgtgctcagattctggcagcgagatctgatcctgtgcatgttggataccaggttgggaggagagtttgtgacggaggaggcagagctagtgctcaagcttgggcttctctgctcgcacccgtcgccagcttcaaggccaagcatgaggcttgtgatgcaatatttgtgcggcgatgtgctgttaccggcgatgccggagagttaccggagcatccggagtttcagtgagatgcaggttgaaggtgatcagcttgatgagaatcccttattaagacagtatctgtcggtgcaaacgagtataaccggtctctctggtgggagatgatactgtcaagtgtcaacaactagagtttaattagccgataccaaggagaagagaaatcttgatatggattaaattaagaagagatttaggtaatttgagccagagcagacccgaacagaggtttttagttcagtgaacacacgggaagatcggcctcgatatatatattttgtgattttattattttgcggtttcatttagacttaaagatacgctttatttgtgcgtgtaactacttttataccgagcaggacacaatatgctagccagtccgaattccatcgaaacaggaatggaagctacggctgtgtttagttccacgtcaaaattggaagtttgaagaaattggaatgatgtgacggaaaagttggaagtttgtatgtgtaggaaagttcgatgtgacggaaaagttgaaacggaaaagttgaaagtttgatgaaaaaagttggaatctaaacagggcctgagtagtgatgtgtatgcaccatgcatttatttctctatgtaggtgatgagctcctagtctatgcatcaaacgagaaatgtactcgtgtactccctccgtccaagtatttgacaccgttaattttttaaaatatgtttgatcgtttgtcttattcaaaaaatttaagtaattattaattattttcttatcatttgattcattgttaaatatacttttatgtatacatatagttttacatatttcacaaaagtttttgaataagacgaacggtcaaacatattttaaaaaatcaacggcgtcaaatatttagggacggagggagtatatataagcaatatgtatcatacatgtacaatactatacagtgtgtaagcgcctggtatagctgtttgttcattttccatgcaacttcatatacatatatatatatatatatatatatacactcatcatacagctccttgtcattggagctagccggcacacatttttgttgaggtttgctgcacagcatataaaaatgaactgcaccggtaaactgaaaaacggacatatcttgttggttcgttggttggcaagtgtgcgtagcctgctaaaacggcccagcctagagcccacgtactatatgacgggcttagtagatgaagcccactaacttgaaaagcctagttcaccggcggaaaaagtgcaccgaaggtccctcaacttatcatcgggatacaaaaacatcctcgagccgcaaaactagatacgcggggtcccttaactatacaaaaccggtcacccgagatccttgggtggttttagccccggttttggtctacgtggcggctgagtcagtgtgggacccatgtgggccccacatgtcagtgtgatacacgtcatctctctttccacttttttttctcttcttttttttactccatccaggcgttcctcgacaagcttgccgacgacctgggcgtcgtgctgcacgccatgcttgccaagaaggaggagctgaccgcggtcggcaacaacgggtccgatccctgcaagaggctgcggatcggggccgacacgggggcggtggcgtggggacccggcggcgacgcggccgagatggcgcagagcagaggcatcgtgccgttcccgtgctctgctggcggcgctgccatcggagtcgtgctgggtgccgcccatggacgaggacgactactcgtcgctgtccccgtggatgatcctgtcgaccaccaagtc

SEQ ID NO: 5841 - DNA, 2276 bp, Oryza sativa
  unsure (1)..(2276): unsure at all n locations
aggagggcggctgtctgccgaggagaaggccgatgtcggggccaccgccacggcagtccgctccatcgacgggcgcacggccatcgccgcggcgtcgggcggggtagcggccatgggcaaccccaccgccgccccttcgccaccccgtcctccaggggcctgctgctggggcggccggcgaggccgacgcggagctcgtggccgcgcaggaggtggccgtggaggttgcggcaagcgctgcgggtcgtcccgtcatcccgatggctggcgagggagggagaagcggggcacaccgtcgatgtggtggcggcggaggaggaggacgccgggcaccgctccgtggctggatccggccgcggaggaggaggagacgaggaggacaccgacaaccactatggcaacgccgacgaccaccatgctcaccagccgccgcgcgctcgcacgccgcctccgccgcccgccgctcagccctgctcgccgccgcccgttcttgctactcccctgccgcaaagagaagtaaaaaagaagagaaaaaaagaaaggggaaagagagagatgacgtggcacgctgacacgtgggtcccacgctgactcagccgccacgtaaaccaaaaccgtggtcaaaaccaccgaaggatctcggggtgatcggttttgtatagttaagataccccgtgtatctggttttgcggttcgaggacgtattttatcccgatgataagttgagggaccttcggtacactttttccttcaccggccggccacgccggacaagctacaggtgcggcatgggctgtaaagcgcatggagaggcccaactctctaacagttacgaataaattactttgagtttggtcgaagtcggttatagacaaatataataatatttatattactaaattaattttattaaattaataattaaatatgtttttataataaattaatcttaggtcgaaagtattactatttattttataaactttattatacttgaagcagtttgattttaaccaaagttaaaacattttataacttgaaacggagggtgtaatgtatttgttgattatcactggattttcaaagaaaaaggaaatcaattcattattctattatccatcaagaaattaaaacgaaagcagtcagcagcttagtcaaagggaaacgtacaaactaatgtccaatttttgaatcaatccaactcagaaataaccacacacttggcattaatcaaagggaaacaatcagaagcagcagacacagaaaggtagcgaacacaaagagccagccaacaaagccatgcaaagaaattaaacacgcattaaccagcacttaaataaacttaaacagcagatgaagaagccgcagtctcgttgtcggcggcggcggcggcgggcctggagacgatgccggcgtggttgagcagcgcccagagcagcgtgatgagctcgccgccgcgtgggcgtccaggttgtcggacggcgccaggtacaggatgatctccgaccaaaactccgcaagaaccccccacgccttattcccttcctcctcctcctcctgttggttttggaccaacgccaccagttgctccgcgagctgcgcgccattccttaacaccttgtgcctgcagcctgcgctgagcaatcggaccagcttctcgtactccggtggagcacgaccggcggcgagagcacggcgagcgtctgccttgacggccttgtacaggtccttgctccagccatcgtcgtcggggagcagctcgggacagcaggccaccaggtaggcgcagtagcctgacaggtgagtggcaacaaccctgttgctgctgtcagagcttgagcttgcagttgtacttggatttggatacttcacctcaaggatggtggtggcgatgtggcacaccaggaggacgtcggttgtggctgtcacatcctcccagagcagctggctgtcgctgccctgcagatgcagagacgccgtgcatgctttggtcagctgcaggctccccttgctgctcctgagcttggcgacgatggcggacttcacttggtcgggcaccttgacgatcttggttttctccggcagcggcgaccactttgctgttggacgatgcatgtccaggattgagcagaggttgatgttgtccttccatgggttattcaccagcttgcaactgcatcgcaataatnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5842 - DNA, 536 bp, Oryza sativa
gagtggcagctcgatggtataacctcctcctcactgcctcaccttccgtactcccgttagcactgcttgttgtgtggtccttcattctgctgagctatatatatgttaatttaaagaattatgaaaatgaaggaggcgcgtcactaatatttatttcctgcaggcgccactgtgccaagaaaggaagttgttgatctcatcaagaaattcaatattcaagttaataacttaacacaggtgtaccttcagtttatgttaccgttccctttgtttacattcgttatcattttgctttgcatcttaatcaagaggagccacttatccatttgtcgtgaacctattcctgatttctgttttcctgctcaactgtgttcagcttgaccgatccttcagcgtgcccttaattcagtgacttaataggcttggcactaaaaacttatgctcgtgtgtatatatatgtatcttctgtgttctaaacgccacgtcagtgataagtagtactgtcgtccttacgctctgaacattctatatttctt

SEQ ID NO: 5843 - DNA, 669 bp, Oryza sativa
attcctgcagcccagctaaaatctataattttaaaacttaattttagagttgattttaaatttttttcgtaatttatttattaacactagttttgaagtaactataaacacatcttacaagttatattttttaaattgctaataattaactgtggacgaaacgcgatggaatcatactgttcatcttcgaagaacagatgtcggtttgcacgtccttcttggcgcaattcaatacgattcaggcttgatgtcgacgacgacctgtcatggaatgataccagaattaatggatggggaacacccagcatgttgacgtctcagcaaccaatccaagtgaattatgatctaactagctactgaaaattcctttatccagtgctaaccaatcagctctaacgatgaaactgtcagggaaaaggttggagtgaatatccatgaaaacgaccgggttttctgaagaacattcagggagacgaaatgcttggatggatacatacatacatacatacatacatacatatatatgtatgtgtgtgtatatatgtatatatatatatatatatatatgtatatatacatatatgtatatatacatatatatatatatatatatatacatatatatatatatatatatatacatatatatatatatatatatatatatat

SEQ ID NO: 5844 - DNA, 3095 bp, Oryza sativa
gaggagctttaaattctgaaaagcagctgtttggtaaccaacttctgagaatttggaaaagctctgaaacccagattctcagaagctgtagactgtttggggcagattctagcagaagagctttttggaaaaagctgcagctaggacaagctctcccaaacagggccaattggcttctactccatcactaagcctcaaattgatttgaatgttgaaatgcctcaaattcattgttgacgaatccttgtttgtttggggtcagacgaggccccgacaaaattccaaaatcatctggtaaaacattggtacaattcaaggttcacggtgccatgtaatggatctgactccaataatatccttcgctgctagcttcatccctgatatatgataaatgaataaattacatattggatcactttttataatagttttaatttgaactatcttgaactaagttttcactttttttagaacaaagtttttactttggaccggataatattttcttctttgttacgcctatttccctttggaccggataatatttcctttccgttacaccctgggccacccacatagttctcctttcacctcccctcgcgtgcctctatcattgttgcttaaccagtggaactgcatcttagtggggataattaagggctgctatgttccatttattgtatatcccgagtgatttctccactaagatggaaaatggaaatggattgttaacccgacaaaaaaagatatgaactactttaggaaagcaaaaggagtggtgattatgcaaaacttggtgtaatttcacatcaacgtagaaactgcattgacgaagccacctaatttagttattatatatatagtgcgacattgggtggctttatccattctaggcagcaacttccaattaggagtgttattgctaattaatttgctataggcacaagtgggtgtgggctttttgtttatgctgtagaccaggcccagaatagcccagagtaattaagcccatggtggctaaaacccggctccaagagcccaagacaggttgcccgcaagagagatatgaatctaaatatttttttatattgaaatttaaatcttgagttattattttcaatagtttgtcggctatgggaaatcctgatgccaatattttcaatagtacatgtcaatatttaaaatttagggaaggatcgataatatagcggtaaggttatggatgcatgattatacccgtcaagatttaaatcatagcgctcatgaatattacgaacacattggtacatttttaataagatttaatattaatcttgtattttccatgtgtgttaagggtattcacaaatgtgagtgtggtgtgcatacgcagtgtgcaccagtgtatgcgcactatttataatcaagaaaaactagaattgattgttttttttgttatatatagtcatattacttgttttttacatgtattcgtatgcttcaaattaattaccgttacagatttattgtaagtcaaacatttcagcctcttatcattattttatacaaatttaacattataagatttttatttttacattcgttatcagaaaaactttcatgatgtataattcacttgttgtcaaactgtatggattattaaaattaatgataacgaattagagatagacatgattgatatagtacgcacaataacaataaaaagtttgaaacgaatggaatatttaacttctctagactcccttgttttctcagacgagatgacaaaaaactgtccggaaaatatcctgcaggggcgtaatattcggccatttactacagtggttaataatacaccaacaagtcaacaacaaaatgcagttagcagacagctgcgcaattacgttgcgtgtttgcatacaaaccgataattgattaacaaagttaatgatgcaagcacaggcgttagctgcaaccgtaagttgacttaaatgagaaagaatttgagatcgaatcgtttagtcgctgtcagcatgtgtaccacacctctcccgtactgccggcgtgctcagctaatgctcgaagcctcgaaatcagcaaaaaggattaataaaataccatttactaaataaactacaccatgtaagcaaataactagtaataaaatgccgtctgaattggtttgattggtggggaaaaatattaaaattatgtaagatttggatcatattagaaaatttctcctatttggtgctttaaaataaagctccaagaatcctatgaaatgctcaagaaaaaaaaaagataattcgaaggaaagttagcatgacgttgaactgtatgaaaaccttttctttttgagtctttttattcattctttaagagtgttcataattatattattcctcttatattttctctctacaacttatatgaaactaaaaattcttttagttttcatatactcattttttttgcgggaaagtttttttttaatatactctcttcctacaaatcgaatgatacttatataaattaattattaaaaatccaaatccttttttttaaaacggaataaacccttaccgtatcatacggttaaaaggaccctcaaacatttaggatatttaactatttattaccactcttatatatgataattaaccatttatcacttagatccacatgttacttatgcataaggccccacatatcattgacacatggttgccaaatggttaaacgccaaatctaagagttaaaataaaaagttaaatgccccccaattttagagcggaaatgctactaggagagccctcgcccgcccagagcgatcagatttcccaccccctcccttcacctggttttcttttttagcatcgtattacttttctattttagtaaatttatgtacctaaagtttatatacctcaagtttacacatctaaagtttagagaccaaaagtttataaatcaaaagtttatatatccgattcaaatttgaatttgaattcaaatattttttatatatagtatttctatacatctaaagtttatacacctaaagtttatataactaaagtttatatatccgattcaaatttgaatttgaattc

SEQ ID NO: 5845 - DNA, 22098 bp, Oryza sativa
aagaaagggggaggaaggggagaagtgggaggagtgcctacagcggagtggggggatccaatcgcctggcgatcgatcgcgcgttaggccccccattttagaggcgttttctagtcagtttgatgaaatttgagcaaaaaaacgccgtagcctgacagcctcccctccccttcgcctcgttcctatcgcctctagtgcccaccaccaccccccaacgcccccgccgctctcctgatatccactagtggccacgccgcgccaccccctacccctcgccacgccgcgccacgccacgcctcgcccatctcctccctataaacccccccgcgcccccagctgctcgggcggcggcggcggcggcgcgaactccaatctcttctgtccccttccaccaccgtccccccacaggagatgctgcgctgccacacgccgccgcaatgccgcctcggcgcgggcggcgcgggcgcgggggtgctgctgaggcagcggagcgaggtggcggtgcggtgccgcgcgcagcaggtgtccggggtcgaggcggcggcggggacaccggcggcgcgggcggcggtggagggtggggagaggacgagcctggcggagcggctgcggctggggagcctgctggaggacgggctgtcgtacaaggagagcttcatcgtgcggtgctacgaggtgggcatcaacaagacggccaccgtcgagaccatcgccaacctcctccaggtgcgccccccaccacccatgccgggattcctccccgtctcccaaagctactcttcgctggtcagattcgtgctctccgtggctcgatttggggtggagtcctctcggattgcgaaatgtgctgcggccacggtttgtgttgggggggagtggaagcatcgtcttcgttcttgttcttgatagattcggtggtttggatctgaatttagacagctccaatttctccgtacaattataatccgacctcatttgctgtgatgtgacaagatttagtaatactaactttcctcaaatccgtgggctatcatttgcgtagattgagctagagctttgataaagtcaggttgttctagtcttattctagtcgatgtcttttttgcttttatttatattttctggcaattaacaaatcctgagccggcgaaatcgcccatcgaaatttcatgggcatatgcttgcattcctaggtggtatcacactcctttctaatgctgattttcttgtccatgtgtaaatataataaagctataattcctgaattattatgcttaaatacctgataagtacttccaataggggttgtgtatcatgtcagtttaggtagttctgttctgtgtgtctggatgaatgtgcgtggctgttaaaaaaatattgaaattctgatttttgagttctactttggcatcaaatcatgcaaacaagtcaaaatatgactgggcgtatatcgagctagttctggtggaatatagtggattgaatataatcttgatttaaaaactaaggcagtatcaaatggaatgcttttttttcctgaaaacttctgatcattgaatttgaaaaattgataaccagtggtaacaatacgtgtttccgcgttccagaaaaacaataagtgtttctgcttctattagcatttttcttagctatcagtgttggctttatttatatgaagaacactgttgagaagcatctcattattttgtttgtactatgagcttttaatggtaagatttcttgtaaatgcaggaggtagggtgtaaccatgcacaaagtgttgggttctccactgatggttttgccacaactaccacaatgagaaaacttggtctaatttgggtgaccaaccgaatgcacattgagatctacaagtacccagcatggtaagttttcaggattgcatcgaacattgctcccacccttgtttttttagcaagatctagttctgactggtggttctgctctggtcaggggtgatgttgtggagatttgaaacttggtgccaagaagatggaaagatcggtactcgtcgtgattggatccttaaggatctggctaatggtgaagttatcggcagagctaccaggtacttattgctcaagtataagagtattcataattacattattttgaaagtggttgcctgatgtgcattcactcaaccatgttgtgcatgctgggattctgaataggtattgagggggtccactggtgatgtcttacatgttttaacttaatatttctcacctctttacttttctccccaccttatttccacttattacacctacacttctccaaatgaattcaaccaaggtaagcctgtaaaataggaaaactcaggtactagattttagcaatctcaaaagagagcgtgaatcgaaacactggaattttttttaatgcccaatgatcttggtgcttgtcttatgcttgaatgttcttacacttgctggctggcaattgtagcagccttaattattcgttcttaatgagtgagacctgctaatgattaattggaacttagtagtttgtactgaacgaaccgttctcttttggtggaaaacaacaaacattttcattatttagtgtttacagtgtaacacagccatatcttcttgtttgtccagcaagtgggtcatgatgaaccaaaatacacgcagacttcaaagagtgagtgatgacgtgagggatgaggtttttgtacactgtccaaagactccaaggtaaacctcctcttgtactcatttagccacagttttcttgcacatgcacatttttgttgctttgatgcatctctgtttttactcttcaattgagccacagattccctttctttaactggctctgttaaacacacttggatacatattcagtggttttgaattactcgagaatcagaagaatatgttttctttgtattcgtagttgcaaataattcattggtagcttgactgaagattgtacatgtattttctcaaatgactgttatggtataataattattgtaacaagctaccattgtgcagattagcattccccgaggaaaataatggcagtttgaaaaagattccagttcttactgatcctgcacagcactcaagactaggcctagtggttagttctcgtctcagaatgcggttcttttgctctgtccctaaacaattctgtgctgacatatattaatttctgtattgcagccaagaagagctgatctggacatgaaccaacatgtcaataatgtcacttacattggttgggtacttgaagtaagttttccattatctcagttttgctaccagttaactgttcttgcttcatgtgacaggctgacagccctctcctggctgtaatcttactttgagcagttatcatccttgttgatttgtgatgatttctgatctctttctttttccttctaaatggcagagtatacctcaagatattattgatacacatgagttacaaacaatcactcttgactacagaagagagtgccaacatgatgacatagtagattcacttacttatatcgaggaaggagaggagaagagttccaatggatccgcatttgctgcaccgcacccagaagagcagcgacagttcttgcactgcttaagatttgctgggaacgggaacgagatcaaccgtgggcgcaccgtgtggaggaagctagctagatgaattccctagttttgatcatacagtcatatgtattctgatccttccatttgttccatcattttgctcttggtgtctggcatagccctttcagagaatcggttgtaccccaaattttgtgttaatttgttacctttgtaatgtaccgtggtaacaattacagtttgtgacattcgtcttacctgaagttgtgcgttgctgtatactttgtactagtagaatcagtgtttatgaatcttcaaataattctatcggcaacagatagcaatggcatgccaagtttggttcttcctgtatagaatacccagctgctttcactattactatgatatctcagtgataaaaatgtctgttttatataatattataataataaaacgtgtgcatgatatgttggatttagaaatgttatgcagcttttattgtttatcatgtcataagttttgccatttaatttttgcaagtctctatgaacaattattcaaataatagatttataaattactctatttgcaagtgaacctttgctcctcatttgtggattatatgacaccgcagtcaacttgttagctgttatttgtatattgtgtttagttatgcccctagatctttgagggatttccttagattggattaatggtgagttgcttcgagctgaacttattactgattcttcttttcttcaggtcggtgttttcttattcttcctccattttacaatataagacaatctagacatatgcatgtgtttagattcattaacatctaaataaatgtgagcaatgctagaaagtcttacattgtgaaacggaggaagtagcctgtaaataaaaggcataggcaagatacctagcactactaaaactttgtaaatcaaaataggagtaacagctttcatagtttttcctgttgcaacgcacgtgcaatcatatgcacaaaactgctgcaaaaactacgaaatcttcaaaacatccaacggtgcatagaacaagcacaaatattagctcaggaaacggaccatcaattaatcccaaattcaggttctctttgagaacacacaaacagtaccatcaccacaagggaccatcaaccaatcccaaattcaggttctctttaagaacacacaaacagtaccatcaccacatgggaccatcaactaatgccaagttcaggttctttttaagaacacacaaacagtaccatcaccataaagagtacagacgcctaaagaaacacacaaacaggtttacaagacaacatgaaagctctcatactacaggagctggggatatatacagtctccaattctcttaaccatggagtaatgtttgatctgagcaacctccaaggcgaaaaactccctgatatgttgctgtatgtttcatgaagcttccctctcctgcaatttcatcaacaaggccacaaggagttcagcgtaacatacaccgatgttgcctgccctcctcatcacatgatgaattcatgacagtaaagcgttctgggtacttccttagtaggtacatcagcttgagccacggtttgcattctgttccagctgctgaagagccagcctctggtgccaggtgcatctggacctggcgctggggccatgttgcactgtaacacgcaacgagctgcaaataatcacagatcagttttcgcgttcatgggtgcagcaataatgcgaaataatgtacttcccccatcttaatgaattcggtcgccgttccttcggccgacccggcaaaaaaaaaatcataataatgtaacaatgtcttgttcaagtttctattaatggcagctgaagtatctaactaattgggaggatagtgacaatggtacaattggcaggcaccactaacttgtaatatgctgagtagtcacttaatttagtataccactcatgtaaaatgattgatttaaatagcaattcgccaattccttagtggaagctcacaatcctagggtcagtaccacctctcaagttgacaaagacacaaagtatttccaaactagtgagtaatgagagacactggatatttccaaaaggtcgcgagcttatttcatgacttccacaacatgttaatctgaggatacggtagggcatatcaggtaggtgaacatttcacaactaaattggacattgcatgctaaagagagtttataaaaaggttatttctgcatgcatgcaaaaggcagaaattgacattgattaccagatacagcaaggttttactttaggctatttttagacctgtgagtttatgcataacttctggcacaagtgatgcgaccaggggtatcatggccacatcaacaaggctatcgaaggatcattgaacttctaagaatgaggacacatgaatgtagttacccaaatatttctgttcaatgtggaactaaggacagtgcaactgatgaatatacttggtccttcagtgcaaagcgtagcctgatgacatatggaaatgaaagtaaatgcctttttctgtatatggatgctagggaattgtttctttttttttctttgagtagaggaattgtctattagttaacaaattattatttctcaaaaatgctgatactttagtgcaacatgtacgaaaggaaaattaaagtgctggataacacaacccacattcctgcacaaaacatatctggaggtggttacactaactttctgaaataaagagacactggacagaaatgagtactcttccacaacaaacctctgaatggagtttttcaataggaatcatctttttaagaccacataggtcagatatcacgattccaatagatgcgagaacatattcctcttcctttagaaggacctcctgctggtctttattattgtctgctggtcttattgctaaattattgactgcataaagaaaaataagctagttaggcatatctacaaataaaataagaaatgtagtaaaaactgatttcttgcatatctgaagagcataatgttaacaaaaaaaataatacaagtgaattggcatagcatgtaccatttagtctagaattatgtttcagtgtatccacaattttgcagaaaaaggaaaacaaaaacttgtagtatcccatatttgttctgttaatattttttttaacactttgcacaactctgtattgaaaaaacaagcagtgaaaaatttaattattccaagagatcaggatcaactaaattttgttataacaagggatatcataagacaggttcacataatcacatgatatgacaattggaaaatcagaaagatagcattgagaaggctagtagtcttggacagttctgtgcatggacctctatttgtccatctctaaccattagtttctgtaatcatgagagctaattgtttatcctctactacagtgggatgcaacgtaaaaatcaatataggccaaagaagtgatagtattattaagaagtaatatgatgccatttcaacctgataagaacaggggaatgtgtgccaacgactgccacaaattttttttggcatgcatgcctaaggatatgcgaacaaaatctgcgccactttggcaagcaaaggacatacttgccacattttttttgcatcaatgacacatgggacctaggtgttaaaaaaatcttgccactagtgtggcaataaccaaaaaatgcctaaatcagtgaaatttgtctaattgaagtgtgccaatatgtggctataaataaaacaggcccataaattttattgtctgtatgagttggttgcatacactttgcagcagaaaaccaaaatttgaactacataaggaatagaaaataagccaaacaaatcctcatgcatgcctgattatttgctttacgattcatctgaacagtttttctgagaagtatgatttccagttttacgtttcctatttgaaattgggtatcatgccaggtaagtaacaaaagataattcacggaatcaggcatatttatcagcatacatatgccatgaatgtgtatactactgctacataagcccatgaatgtgtatactacatattccataaatgtgtatactacatatgccatgaatgtgtatgttgcatatgccatgaatgtgtatattacatattccataaaagatcctaattacaaacagactgattatacacattcaaacttatgcagatacaccaaggtggcactaccatcaccaccaggtgtcattcataaaagtaaatacataaataaagtaagataggaaggaatcaggtctagcagaagaatgtgtcaaagacataccaggctgaccgccaggtgctaatgttggctcaattgtgatgtggtggctgctgcatgtatccaattcaccaaaaggcatcttgttttgattcatgaattcctcttgtgtttcaatgccagctatattttcattttcagcattgttctggatatgagcaggaggaagagtgacgatgccaatttgaccaggttgagcagtgccaatatgaggaggaggagcggcggtgccaatatgagcaggctgagcagcagcacttgcagtgagattatgctcatcagcagcggtgccattgttagcaggctgaaaagcagcagaggcactagggccatgctgattagaggaggtgccgaagatagatcgagttggcaggagaaagtagaatttcttatgtccaatctgaaggaggtcttgggagtccagtttaataggactaccacctggaaggtgaaggacaccttcaacagtgcatccacatttaccaaggactagaagggaaaaccgcttgcattcaaaatcatagaatatgtgtgcgtgatggcgggaaatagtaagatctccaccagagatgtcaagatctaccttttctctcttgctatcgcgtcccaagatgattgaataagtttgcatgaagtactcgaaatcttcaccttgaagctttgcaaatcctacgccacgattgcgaccagcagatgccataacagaaatagaggaagccatcttcaatattcctggtagtagcagtacactgagtgctactgcctttcagtttcttctacaaagtaaaagcaaggcggatgcattaaaatcctttcatgttataaaaatgaaatggttcaaaagatgctaatatactagacaaatgggtactatcggttctttttattgtattactagctaaatgcctgtgctttgctatccatagaaggaaaaaaatatcataatattttctaaaataaataaaagcatattttccatgaaatatgttacccacattttcctatagggaaggctcacattaatttaattttataatgtggcatgtttgtttggcatactcaaattgtcaaagcttgccatacttttttagctaacagcctaacatgcggctaccaaaattgaagccacactttagttcgaagagagcaaccttgccacacttttatgtgccaatgacatctgggacccatgtgatgatgaaggaatcttactacaagcgtggcacgaaccaaacagacacctaactcagtcaaacctgcctaacttgaggcaaattgtggtagtgaaccaaaaaatcagaactacaaggcacattacatgcaaaggtttggtagactcaaactgtgacaatgcacattgacactaaaaatgagaaataatcaaagtgtgcaaaaactaggcacatattttagtgacatatgcttgtctaaccaacctttctacctcttagtatgtggttttaagtaaacatagcggtgtactatagaatggcattgactggtatgaataaaggatagctatgatacatcatgtggatatttttcacaactaaatggactcaataccctatgagcttcaagaggtaatagattaatgaagcagtaaaacattatcacacaaaactgacattgtttcaaccaacgaaatctaggaactgcaatgaatttttatttgtttacttcttcagcaatgtatgatggtaaagttctacataggatgtattcagagaagccctcaaaaggctataattatttcatgaaattgatccaagtactcaaaaaaatgcttccatgtgcagccaattataaatgatcaccaaaacagtccaactcctctttggacataatgggcatagatcaagttaatcaatggacacataatggccttgtgtatcaccttttaggggtgtgtgtgtgtgtgtgtgtgtgtgtgtgtgtgtgtgtgtgttgtgtgtgtgtatgttgtgtgtgtgcgtgtgtgcgcgcacgcacgtgtgttctgtggggaggacagttttgttactctcctttgtaattattttccttttttgtttcttcttaatgaaatgaagtgtagttctcctacgttttcgagaaaaaaaaagttatcaatattgagattgcagaaaatatacactaccagatagattaatgcactgtcacaaactagtgcgatgaaacatacatttcaataaaacaaatgtgtgtgttgctctcatgtgcagtcaactataaatgatcaccaaaatagtccaactccactttggacataatggcatagatcaagtttatcaatattgagaatttttttttgcggggatcaatattgagaatttgagattgcagaaattatacactaccagatagatcaatgccctgtcacagactagtgtgatgaaacatatatttcattaaaagaaaatgtgtgtgtgtgtgtagctatgcccttgttcttaattcttctacctcacttgctgagttcttgcccttctgaagttcttagcgaagatcacacccattaccactaccacataaaaccaattggaagaatcaagaatattcctcaagcaagcactacagtagatgccaatctatgacgaatatttggaattattttcaagacgcagctaaagaaaaaacacggtgcaagagctagatgaaggtgaaagagatatacttagccaagctctcgcgattcctccggagagcgcaaagatcaccagtcgctgcccgagatgagtcagcggctgagcgagagaggaggatgtggaggcctccccaaatctggctcaaaaccctaaggatgaactcctttccactcctcgatgctgcatttaaatccaaaaatttcagttacaattttctcaccaccttcatgatgatttgcgtgttctactccgcccacaggaaaacccctaaaaaaaaacccaagaaaaccatgagatggccttgactggtatgcataaaggataactataatatagcatgtggatattttccacaactaaaaggactcaataccctatgagcttcaagatggtcatagaataatgaagtagcaaaaacattatcacacacacaactgacattttttcaatcaacgaaacctaggaactgcaatggatttttgtttatttacttcttcagcaaagtatgatggtaaagctctaaatatgatttattcagaaaagctctcaataggctataattatttcacgaaatcgatccaaagtactgcaaaaattgctttcatgtgcagtcaactataagtgatcatcaattcagtccaacttcactttggacataatgggtatagatcaagtttaccaatattgagattgcagaaaatatacactaccagatagatcaatgccctgtcacagactagtgtgatgattgatgaaacatatatttcattttaaaaaaatgtgtttgcagctatgctctcgttcttaattattccatctcacttgttgagttattgctcttctgagaaaagaccacacccagtaccaaaacctcgcaagactaattggaagaatcttcctcacgcaagtactgcagtagaagccactctatgccgaacaattcagaatataattttttcaatacacaactaaagaaacaacagacatggaagagctagaggaagaggaaagagatatactttgtcttaatgcattaaagaagaaagagagaaaagtttaagtgcagttacaaggcgcattacatgcaaaggtttggtagactcaaattgtgacggtgtacattgaaaccataaaaagaaatgatcaaagtgtgcgaaaactaggcacacattttatggcatatgctcatctcaccaacctttctagggaatataccagaactgtcacttaaagcaaagacaataatattgatgcagtatccatcgaattcacctcttagtatgtgattttaagtagacatagtagtgtggtactatagaatagccttgactggtgtgaatacagcatgtggatattttccagaactaaaaggacgcaataccccatgagcttcaagatggtcatagattaatgaagtagcaaaacattatcacgcacaaaatgacattgtttcaaccaaagaaatctaggagcttcaatggatttttatctgttaggctataattatttcatgaaattgatccaagtacaacaaaaattgctttcatgtgcagtctactacaaatgatcaccaaaacggtccaacttcactttggacataaatggcggcatagatcaagtttatcaatattgagattgcagcagcaaatatactgcacggtccctagcagatagatcaatgccctgtgacagactagtgtgctgaagcatatacattttcatcgtaaaaataaataaataaataaataaaagaggacatatgtagctatgcccttgttcttagttcttctacctatcctttcaaaacaaaaatagtctgcctcacttgctgagttcttgctcttctgagcgaagatcacacccattacctctaacacgcaaaactaattggaagaatcttccacaagcaagaactacagcagacaccccaactctatgccgaatgattcgaaattattttcaacacgcagctaaagaaacgacacgatgcaagagctagaggaaggtgaaagagatatactcagccaagctctcgtgattcctccgaagagcacaagatcacccgtcgtcgggcgtcgtcgtcggcggcggcggaggatgtgagaggcctccccaaatctggctcgaaaccctaacgatgagctcctttcccctcctcgctgctgcatttaaatccaagaaatttccgttgcaattttgtcaccaccttcctcatgatttgcgtgttctactccgcccacaggaccccataaaaaaaaaaaaaccaccccccggattgctgcaaccttcatccaatcgcaggcgcggagcggcggcgagggaacgccgccgccaccgccgctccggcgccccgctcccccagctcgcccatctcccaccttcagccgcgcgcctggccgcgcgcgcgctgctctcgccgagcccgacctggagcgagcgcccatttgcggcgagctcgcgcggcggaggcggcgcatgcgaggtgctcggcggcggaagcggaggcgttcgcgcgttcgcggagagttttttttttcctttttgatgatttttttttcgaaggggagaaggctgcagctgtgtggctctgtagagagagtctgcccggtggggccatggagtcagtgagatgaagattcttcgtggctatcgtcgtcttcgcagccagcgaggttcggcgagaaagccttcggcaatggcgaagctcgccgttgctcgtgggatgatcaggggcggaggtaaaacaaaacgaagagggtttcactcgttttctttactctaatttagatataatttagtttgatacaaatgtttaagtttggatgacaggtacatataccgtgaaattagataaaatatattaaaaaaagttatgaaccgggttcttgtacaccccatgagacggtggcgtgagaagaaattgagtgcacaaacacacctgaacttagaagaaatcctagcttgtaatgtatcatgtggatcggtcctatttttttcgcttgtgtttattcatatcttattaccagctaaaaataacttgagaaacttagcaattgaaaaacaaaccatgtaaaatagtctacgataaaaactataaaatcaatttcaaaattaagttttaaaatattcaattttggcttaaaagtataaatataaacaaacatatgagcctctagatagattacaaatggagtaggactaaaccataaacgaacaaatcagccttagatagattacaaatggaggagggctaaaccattaagaataaaaaaaagggctacataattgtttttgttaattttgtttgaggaacataaagacggcctagcattgtttaagaattgtcggatcatgcatgtaatttgggaagaggtcaacaaggagatatactatagtagacaaaattaggactatatttgtcgaaaatctttaattgattgttgggggaaaggtacaggccaaggaggaaaaaatatcaaagggaatgaaatcgatgttcattcttattacacgggaaaaagccagagtggatgtaataggatggttttcaagatgccaagaagttggttgcggagagctgctcggtagaataactgatgagctcagatcattgagtttgcgtggagcaaaaggtgatgtgattttttttcttcctatattttcactataaaccgatgtacataaattgatacatcttcttactataacatcaacaccctattggcttggttttagaaaagagagctggtttatcatctattttctaaaatatttatgtacttgaaggattagctggtcaaaattcatacgagtatgatacccaattcgaccaagcgttctttattttattttatgttcgacgaaagaagagggatggattaggttaaaaattaaagcatttataaattgtaagggattgcaagcgaatttttggtcgtgaacgtatttataacaatggcaacgtagattctttattgtcaatttttttcattgtttgttataagtagtttatgtaaaaatgtttagctatgagagcgggaattatgtgacagttagatcatattattatgttattatagagttcttttccgcttaattttatatgcatattacttgtaatcaatagtgttatgttacctcggcttaaattgagtctttactaactaatccaaccatacagtcatgggtttaatatatattcattgctaactttaaaaacctaatttcacccgttggttaatacacatatcgtcatggtatcgaaagaactagatacaaccatgcactttgtagcgatatttatagttaagaatggttgaaaaattgtcaaactatagcgtcatccaatattagtagcttgtgaggtggattaaggagaaagaaagacgtgtgagtctatatgggcccaacctccagtttgggatttgttaagatgcgaagatctaacgatggctaaaaataagtgatggcatgactcaaccaacatgtagccttttataccagttatttttgttggtggccctacttagcatgatagtttgtagcagaatggccattaaggttctctttggcacaactatgtacctaagatattttggagctaggcatttctagttctacaaattcatagatctagatctacggttactttgataacatttagataaataattttgttctcattttagataaaaattaaaatgttaaaccaatataatttaacatacaaattaaaatctaccatagatctgagatatatatttgtgtcaaatatgacctaaggggcacttttaatgtggaaccttggtccatgcgtggatggaccaggctcttctcccacctgctttggcccatgctcaagtctaaatttcatgtaatcagtagcaactttctttgattctcgtcaactacttctgatgaaccctgagttcctctcgacattcaaggctgttgttggcccgatctttcggtgagttgtgataactacgatttgggataaacgttgacgatccgactacaaccgtacgagacgttgtgttgcgccttagcgatcgatacacctctccgtgggttgttgatcttgcctgacggagcgtgggggctcctcaccgggagaccgcgcaggcctccctttgccggttcggccgggggccctgggtgaggttctaagctcctagcctgtggaaagttcacgagagtggaaacacacaagacacgggcgatgtatacaggttcgggccgctgagaagcgtaataccctactcctgtgttttggtggatctgtgtatgaagaagctacaaagtgcgagccagcccccgatcgttctgggatcgtttcccctcctctctaagtgggcaaggtcctccttttatatctcaaggggataccacatgcaccatctctccctctctttcttttgtgtggggactcatcctctcttccctccaacttgacttctcttcattaatggacggagatttgtatggctgccgtccgaatgaccttctgatgggacggcccatacctacctccacttccgccggaagcaggcgcgacgtgggaacatagctgtctgctgacgacatgaccattgtcagaccggtcacaaatcggtcattcttgtccaccacgtgtcagtttaacaatctgcatgttcgcccctcttcatacaatgtcttgcttgtaatggttaggatgaagcctggtatatatctgaccgggaccaacgtgccatctccaggaggtaacacgccggctccggctagggacgagtgcttggaggctctcatcctgatgggatggggcgaggcgtgcgtcagaccgcctgtctccacctaacccacgatctgatcggtctgtgactggtcacagaccggataaacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgactcctcggggagacaaagagaagggcggccgtatcaccctcgggcccgaccctcccccgagggggttaggccacgtgggtgatcgtgtctgcctcaagtctctaagtcatgatactcccggtcccatgtcaccgacattgccggtgcagaacaaccctatttctgcaagcaaatcgaagaaacaagcaagaacaagataaaagcaatctgatattgcaaataggaatttaatacaaatgataagttggggttccgaagaacaagcggacggacggtctagccgacacgcgcgctgcaagcaagtagcaatggctaaactttaatctatcaaaacccgagaaacccttaaggggtacctagctatttaaggaggtgggaggacgaccaagagggtcctagggtcgtgctccaccagcttgggccgcaccccacatgggccccacctgggccggggtcccaaatgaagttacaagcccacaggcccattataggtgacgcagcaccttgttcctgtgattccggccacacgagatggaattcggagaagaagctggatccgttggaaagagggctccgagagctttccatcaagtactcacgggctgaaaacggaggtcgtatgcagattcggcggccgtttgaagtcagcagtgtagtaggtggccgaatcggattccagcactgggaggacttgatctcgatatcttcttgttcatccatgatgtgagtaatggttacatccgtggtagccatggtcacatcaacttcaaataagctcatgtttaaatgccatcaaacaatttatgattttagcccaaaaatatttagttcaaaagccatgaataaagaagacggtgtaagagatacacatgtaataatgtcgtgctaccatggtacttcctcgttccaaaacgaaattgtttctagcacatactttgtttcgaatcgaaacaatttctccacctacccctcctctcgactgataacaaatattctccatctcattttttcacatactatcttttatcaatcaatcacaacatttatcaaacatttccatctactttattagtatcgtactaatctaaaaatatttatattttgggatggaggtagtacgaaattgaacggcccaaactgtccaaccaacccatttacccaacccaaattaatcaggccctgttactgaatcgaacagcccaaacggcccaacccaacccagcccagcccaaattgaccaggccctgttacgtctcgtgctccccttcatctccccatctcattggcagcggctgccggataaaataaaataaaaataaaaacttattttttttcctcccccactctccccgacctccaccctctgccaccccggccgcctcaccgccgcgccgtcctcctgcacggcggcgccgccgccgccaaagctgagcctgctctcttgccgaccgggcgcccaactcccagcctcggcctccacccttccggtaaagctcgccattcttttttttctttctttctttctttcttttctgtttgggttcttgacactggttgtccggcttggtttcttgcttagtcttgatctctccgattcggaaggggatttctgttggtgtagggtttgtacacggttcgtgcccggagtttctgcgcggtcgtgggttttttttcccccttaagcttgacaagatttgctcgtgtagttcgtgattgggttttgtttctctagggtttcttgagatactcacgatatggattacatttcagattcttgcgtctcggcatcggaagcgatggggaagagggtgaaggcgaaggccaagaatccgaggaaagcacagcaacaacaggagccgacggcagcggcgccctctgatgctggatctggggatgcggcggcggcggcggcgcaggactcggggaattcgacggaggaagctgctgctgctgctgctgctgccgcgtcggccagcggcagggagcagtgcggacactacggcggcgacagcgcccgcttggacaaggtcctcttggagatcatgacgtccaagcatttcgcgtcgtgcgagcattgccgggatgatgcccctaggaagaaagggggtggcaaggagaaagggggtaagcagcagcagaagaagaaaggaggtggaacgaaaggttccgcggccaaggcgaaggtggagaagagtgacatgtgggtgtgcttggactgcggtcggcatttctgcgggggtgaggttgatgtgaccaagccgtacggccatgcccgaaggcatgccaagcaggaccggcattggtgggctgcacggtttgatgatccgactgttgcgttttgtttgtcgtgtgagaaggaggtgtcgatcgagatgcctagaatagagacagttgccgcagtgccaacagaggtggctggtgcagctgacagagatctaggtttggttaactctcatggtagtgtaatcagagggctgccaaatcttgggaacacatgcttcttcaatgcagtgatgcagagcctcctcgcgcttgataggttgcgcagtaagatgttgggaccagatgttccaacgggggctcttttgatgtcattgaagaaactcttcatggagacaagtgcttcaaatgatgtaggaggtgcgctgagtccaaagaatctcttctcaaatatttgctcaaagtacccgcagttcaggggcttccagatgcaggacagccatgaattactccgctgttttcttgatggtctgcacacggaggaaaatgaagcacggaagctagcggatgaagcttcaagtgcaaccattcctacaattgtcgattccatctttgggggtcagctgtctagtacagtgtccagcacagaatgcacacacagttctgttaaacatgaccaattccttgatctgtcactaccagttccatccaggaggcctccagccaagagtgtgtcatcaccaccagcaaagaggaacaaacaatccctaagagataggaataaaaatcggagatatgggaagatttcgacccgagtgactcctacaatagaggtgagcaacaaagaaaagattcaaacagttgctgaaggcaataattccctgattcctggttcagagtcaggacaggttgtcagtgagaaagagcctgagccttctgaatgcagtgagtcatgtgcttctgtgcctaatctagaacaaacaggtacttcaaatgtggaggatggcacttgctggttggattacattgatgatgcagatgaagcaaaatcagagattcttgattctgcagattctattgaagcgggacagatctgggaagacaagggtgttacttatggtccatttcttccacaggatgatgccttatcgaaagagcaggtcttgggttctgaacactctggtgaaaaccctattgatgatgcaacatcttcacagcctgttatcttgcttccttacaaagaatttggttccactgccaatgaaatggatggaaccacagaaaattcacagaaaccagaagatgcagttgctcctccagctgtttctcccttgccagaagataatgcacaacctgcatctgttggcgatggggatcaagatgactatgttggtcttggtgatatgttcaatgagcctgaagttacttctgaagtcaagaaagaaataggtacagttgaagatattgatgtgatggcctggagtagcaacagtgctgaagacgaggtggatgatagtaatgctcccgtatcagttgagggctgcttggctttgtttactgaaccggagttgctctctgaaccatggcactgtgagctctgctctgactctattgcatgcccaaacaccaatgatggcaaagatgatgagatggcgactagtgtcaatgaaagaaaggatggtgaggagatgatggcaggtggtgatgaaacacaagacggtgataagttgatcgctaactgcaccgaaaaggagggcattgatcagattatggcaactgacggttgctcagataatttaaatagtgatatgaacagtaaagaaggtggttgtgcaaattcttctttggttggtgctgacaactcagttgatgctaactttccagaaaatgggaaagttgctttactgaaaacaggttcgtcacttgttgacacaactgaacaggcagacagcaaagcatatcgtcgagagattagggatttgaacaactcagcagtggaatatacatcttcgagtaagcaacctcatgattctgcccagcataaggatgaacataatgtggatgtagcctctgaagaaacaactgcaccagagtgttcttgtgacaacgaatctgcctcttgcagcacaaccaataagaatgaagctgaatgtggtgttggtgctgaagaaattgttactagtagccttccatctgagacgcaaagaatcttaccaggtgaaaaagacaatgaagatgttgtcacgcggaatcatggcagaaggaagcgaatgaagatggttggcaaggcacatcaagggcaagataaccaaaatgaacagaaagagaatggaaaaaaggttttcagatctgcaatgagaaggatccttattagcaaggcgccacctgtattgacaattaatttgaacagattcagtcaggactcgcatggtcggttcaagaaattgaaagggcatgtgcactttaaggagacacttgatgtgcggccattcatggacccaaggtattgaactttttttttcagttagaagtactgatgttttttatcaacctgtcagctttctgattagctgtgaccatctgccattagtctattcgcatttgctactaagaggtcccactgtccatgcatagccattgacatttaaatatttacactacaaattacctcacaagtggttttcaactatgtagctgatattactcctgcaaggaaattgtcgtagacacatagttaggatagatagcgaatgtttagcttccaggtaattttggttcctcatccctagcgattggccaatgttgtttgagaagataaattgctgcactatttgtcatgctttttaagaagaaatgtagatcagatttttgttacattgagagtgcattgcattatcgtattcaactccaccatgtccttatcgtcgtataaacagtaatatacctgaaaacatttcatagtcaatgtgaatttggaggtctgggttaatttagcagtgcaacacgatttagactacaaggtagtaagcagatcaatatgtctcttttgtttacctggaaatgtgtttgtatttacggatgctatgtctatgattaataaatgggttgcttctttgaactttctaattcctaaataatcagttatatctattgaaagagaacaacatcatgtggatacaaattggttagcttttagaagctgcagcaaattgttattcaccatttatatg

SEQ ID NO: 5846 - DNA, 3356 bp, Oryza sativa
gtcccaaagaaaaggcatttacttttaatagcttgtaccatctacacatgatgacttctcaagtgtatataacagtatgccttcccatctgtacaagaataggggaaaaatgtcttccagcttccaatcttgaattgaactaagaaacgttgtagatgtgcatgtatcacatctgatttgcacgcgagatatcagtattttcggtttcaatgttattaacttgatattgagcccttttgttgttgcatatttcaactgaatggtcttaaacttggtgtcttcaatttgtaatttatgaatactgcagccttagagttgatctgctcatcacctattctctgtaatctgcaggtctaaggagaatgacaatacaacttatcgtctcgttggcgttgttgagcacttgggaaccatggcagctgggcattatgttgcatatgtgagaactggcaagattgggggtcggcagcagaggagcaccggctccaagtcatggttttatgcaagtgatgcacaagtcagagaagcctctctggaggaagttcttaactgcgaggcttacatactgttttacgaaagggtgggagactaagaaaattatgtctgccatccagcaacatcaatcagtctctatcagggcatgttcaaatggcaagcaatagataagaaacgtcattttttggaaaatcagaggctcagttagtcttcatactaattactatccatcaagtccattttgtttctttgattgagtccagttggccttgttaccatttgtctactcagtcaaagagatttttcacaagtggacttgagcagttaatctgttcatactgcctacagcctttttgtcttttgaagcatattttggaggtgtgcaaatgttcagaattggcgagctgctcatacatatcttggcaagggctctgtggagaagcccatagatattgttttacaaccaaacaaacaatgttcaccttagtactacatattttttgattattatgtctccagtctccacccctaaattttgagtgatgggggtgtatactgtaacgtgccttaggtccatttaaaagtggtaattacatacttttacctctgtcatctgggatggaaaaaaatgctccttttattgagaatttttctgtttcatcagaatgtagtgttcgtgctgttgtttgccctggagcttgtgttgaaatgcagtgttttttttcttttttgccctttctgatactgatatctgaatatctgatggtcacacaagccagcaaaaaaccaagatgataattgttaacacatccagttctaactttacttttgcactcaaacctttttctttaagaaacaatttggttacaatctggatccatcctaatgctagtgtgctagtgccgatgctacgttggaaaccaactatggtgagcagactactcaacaacgccgcgtacagcttgtttggatgcaactggaccaagcaaagctcaccgcagatagcgtgcggattgatggcgattcactacgtactggcacacaaaacctgcaggtttctggtttagcacatctcttgttgccagcacaaaaacgtaagaatagtctcggacaaaaaagatgggggggggggggggggggtaggatcgtaagatctaagtagcgaaggtgacacgtttagccttcctgtattagcttaagctttagatcgaactgattgattcgtataactcaatataggttttttggatgaactgatcaacacatacaactcaatatacgcaatagtctctaaatccatttgtttctcttattcatatgcttatccgaatagcttattagctaataaaaattatttgtgagcgaagcttttcattagcgactaaaaatataaactacgataataaaaagattaaaaataaaattcaaaattaagtttaaaatttaagctttgtcttataagcataatagcgtgcggatcttaaaaataaaacaatgaagccttcagtaccgttccaatttttcccaaacatccaaagggacttcacacagtatggtcttcttgggacttcttgtgcttccagagaataacgctttgatttgtccgtttgacaaaagcacccagccgcccggcgcccaattcctgcatttctacctccttcggtgacccgcgccaacaaccaacgccaaccatccatccatccatccatccatcacaatccggtcactgaaaaatccaccagaaaaaacggcttcggaaacctgcccgccgcttcgtcggaccgcggctcgtagccgactagtccgtccgttgttccgtcacggtcacgccccgcgaaatcacccgccggtcgctgcaaaaacggggcgaaatcgcctagatcgtcttgctcgcgtggccgcggctaaactaactcgagtttttcaccttttgagttttttttttaagaattacacaatacaacacatacactcacccctataaatacacgcacgcaaaccctatccttatgagcatcattgaagactaggccggcaacactcacctctataaatgcacacacgtaaatcctatccctatgagcatcatcgaatactaggccggcaaatccattctggagattgacgaagttactacaggcgccttcctgttgatgggtacgttgcctaccactgaaagcacaaaaccgttaaatcctgaaaaattcgctccttactctaaattattttctaaattctatgactacaatttattgtaatctaaaaaaattaaattgtttggtagagtttctgattttaggaggagcttgttgctccgtcaccggacacggtcagagtccgcgaaatcacgcttcggacgctgcaaaaacggggcgaaatcgtcgtaaccccaccccgaccggcgcccgtgccgctcgcccgcgcgcaccgcgcccgtgggtcgccatgtggtggtcgcgcagcgcggccctcgcgagagccgcatcatcggccatccgccacgtccacactaacggacacacacacgcaaaaaaaaaaaaaaaaagaagaagaagaagagtaaaaccggcgagaccatctgcaagagaggataacacaacacaacacgctgacgctgctgatgcgagtgagataacgagatgcttatgtatttttaggctcttctcgtgaagctgtgtccaaataggcgtaggcttctgcttctccttctccttctccaggtgagtgaggagagaatggaggcgcgggcgatgccgccgccgacgcggacgcggcgaggcgtcacgctcgccgagcagatggccgcgtcgtccaacctccgcgacctcctcaagctccgcgacaacgacgacgacgacgac

SEQ ID NO: 5847 - DNA, 19702 bp, Oryza sativa
ggcagtggacgacggccgccgccggggacgccagccggaggcgcgtcgcggacgaccacgcggcggcggcggaggcgggcacaaacaagggcttcgccggcgccgccgccggcgtgggagggcggtgctgcgtgtgcatggcgcgcggcaaggccgcggcgttcatcccctgcggccacaccttctgccgcgcctgcgcccgcgagctccgagtcggccgcggccgctgcccgctctgcaacgccgccatccacgacgtcctcaacctcttctgatgtcaccatctccgccgccggcgacgacgccgccaccattaattccgtcgacccaatacaccattgctgtaatgtacttgtagataaaaaaaaggttctactacttcttggcttcttggcaactgcaaatcatatcaaagaattctcagagcatcacctgttcatcaatcacccacccgtgctacacaaccaatcgcgcgattcttggatcgatcgaataaccctctgttcctccatggcagcaacgatccgcagatcccggcacaagtgctttgctgctgattagtaattacgtttgcagccacgcgagtgattgaagattaagttggcgcatgtaattagcacataattaattaaattttaattattataaacttgataaatgagtgtatttgatttttttaaagcaacttctatatagaaagtttttacacggaatatattatttagtagtttaaaaaaaatgctaatgaaaatcgagatataatctacccactctgttttataatgtaagttattttagatttattaatatttatataaatacggacaatattagaatgatttatattatgaaagcaaatcttaatgagaaaataacaggttgctcggtttcagtgcatcgcagtcaccgttgaactccacccgtttgctcggtttcagatcaacgcattagttaaaataaatcaattgttttttcagacgatgcgatcatgtgatgtcatggctggaggagagaagattagatagggatgagttgaaccgtgagcccatctgaccaacggtactccaaacctgacaccttcgttctgatgatgttgacttccctgaagaaatgatcaaattaatttatttcagactaagatcacaccaattgacggcctctgcatgatccggagttccggacagtccacttaaacggctaaaccctgaactgacaaaaatttactgtactataaaatggtttcagaggagatactaaaaatgtggcacctttaggatcgtaaaatcactcttgaactgaaaacgtagaggatacgtacatcattgcttattgcatatgaatatgatatcttgtatacttgtgttgaggctatcaaggccagcactacagtgccaatcactttaatcacacttgtactaccatatttgttagttaagtactagattgagccaatggggcactaacacacactaacatatgcaaccatgcaagcaatgggcactgaaagtgtactttgtaacattggatatattatatcatgttgggtaagctaacttttaccatcaatccatcatgcagaagcacgggttcagagtttcagagcaaaaaacaccccaatcttaaatctaaatctatccctctctagcctgtgattgcgtgcattcgtcgccgttagcctgtctttgcgagcggcgacaccgggaatgatggcgacgccctgcatctgcatgcaaatatgcaatgcaaagcgctagggaccgggaaatggttagctgaattcgctgaaatggcaggagagaagaactggacctttttggagatttgcaagggttcagacaaagcgcattagctggggtggaattgccgtttagcgagcaggaatcgtgtagggctcatgcagtggctgatgacttgtgacagcctacaggaatggggtacccaccactgtactggtacttcgcctgtaatggatcgagagaataattgtacactcagatcttgttgcttaatactttaattccttctggaattacagtcccatcgatcatcgttttgtctccaactaattgtaacccgtgagaccataaaaaactaatatgtaggtaaactttttatatatgtgttcttagctatttaaaaattaatgctgaaaaataaactacgatgagaaaaattatcaaaaacaactctaaaattaaattctaacattaaaatttgcatgcgagcgatggccaataagcatattttacaaactttacaaaaaaatatcttgtgatagattttagcgcaaatcagtctctgtaaaacatggcatgggtagctagctctggtcgccaataattgatctcctcatgaggggacacaatgacctaagcttaattaggagtttaggacagtgattcagtgaacaccgttggttgatgctgtcctagatcgcggtggttgagctgccccgtccgtctgcatggacgcagtcacactatcacaaattcacacaccatctggcattctctgcttcgatggagatagcttgcgaggaagaggaagatgaacagtggcgtcgcacagtttctgatcccaatttttatccattgccacctcagcatggctccccacaataggactatatataaatctttgcctgcctgtcgatctctgtatcttgaattcttgatgtgttcatcggacatgcattgattgattgattgcatgggactccaatccatccactgtttggattggatcgaccgtttttttttttgtggttggcactgggaggaatgtttgtcagaggccggccggatgattagttaaccaaacgtacgatgagaaagaaaattaacaatgcagctagctttagctcatggttgcgaacttgggatggcgaactgtgcatggtccagacaccatacacaaatttcagaggagacgatatacgtcgtgatcatgtactccctccgttacatattgtaaggcattttagtattatcttaaatcaatttttagtgctgattaaatttatagataaatatatgcaacgcttataataacgggcgtattgtttatccgtcgagagcttaacacaaaaaactttactggttgcccatatttcctaataaaccaaacgacttattagggaataaaaattaatttataggtaaaatcattatatatttattcgtaactacttaaaagacaatgataaaaagaaataacgttgaaaatatcttaaaattaacttcacattcaaattcaaaaattcaaattatgcctttttgttttgacttattaggccaatcaatggggctccaagatccatttaggttggaggagatgggagactacggagacaaagagaaagtagccaagtaggatcagaaaagaagcctttcgccttcccatcaacgagtattcctcagttgaggtccttgagccctgaggacgccagcttaggggcctcatgcctcctccgtccagtgtcctgctcgataacgtgcttgtccatgcgattccatgtaacatgcgctgtagccatcagctatgctatgcaacagttgcaggctctacaggttagcacctaacagggatctcctcttagatgctagcacagtttgttatgtttcaagatcaatgtaaatatttttttagaaacacgttacaatcacataagctcacaacgcgtgccctacccctataaacattttcggaagattaggtcaatatatatcttgagattaatgaagtcaccacggccgtatctaactatagtacttaatccgggtgggttggttccaccacaaggaacctaactagttgagctacactcacttcgcaagatcaatgtaaatattaccacgttaaatctagaaatcttctattatatactaaaagtccattaaacttcctacaaacgctctcaagttgccacatggcgctctaataaattagagaaaaccctagaaaatctgagaaaaaaagcaaaacatccgtacattgattttcattaaaattggtgggtccaatattataaaccgttatattagatttgtcttaaagctaaccgcaactacaactatggtcccaccagcctctcacctccccataggtacgtacatgatgtacgtatgtatcgcaacaaaaaaaaacacgccgctctccttccttttgtatctttttttcccttgtatatagtttctttggaatataaatgcatacatatatatgtcgtatttttggattggtactttgtaaagaggagaagggttaatgcaaaatataagtacactgtaaccatgtaaggtaattattatgtctatattcgcggacaactagctactaagctcataactaaaatatcacaccagcgttaaatctaggtctttacagacatatataaattttatcatcatatcgctctttccaaatatacatacctaaattagaaatgcaatattttaaaataaagtttacacccattatatatatagccatttattatctatctattatatactaaaagtccattaaatttctagcaaacattctcaagctgccacgtgggactcctataatcattcctaagacgccacatgacactctaataaattaaagaaaatcatataaattttgggccacatgggacttctataatcgctcctaaaccatatcacgtgaccctctaataaattagagaaaatcatataaattttgagaaaaaaacatatgtaacgtttattttaacttaaattggtaggtccaatattataaactcttagattaaattaatcttacaacaacctagacattagaaattagaagtacatatggtcacacctgtacgtacgttacgtgcatatactctctcccacccactagcccacattgcaagtacatatatacatagtacgtatatgtttcttccttcctctaatcatccctccctcctacttatataatcctattctatagctaataaaatttgaagggtagaatccaatacgcttccggtccgtcacagtatatcaattcattcattttcacttaaatgggtggttccaatattttataccattagattagatctattattaaaaaaaagtaacaccttcctcatatatccatatacatgaggacaaatatattattgtggacctgggcaaaaaaatacttcttacgtacgtatgattgaagaaagaaataaagtaattattacttactactgttcgccacaagaaaaataaaccataagcacatatatacttataataaatcatgataaaggaaaaaacatatgtacgtactacgtgtacagttaggaaaaaaggtcgacgtgttctaaaataatatttctacaatttaaagataaacaacttacacagctgaacttgatctatatataattcaaatataatatatccaatcaatgttctttaaatgttctatattttaaattattttaaaattacatatctactttattatttatatttatgtaattaaataaactactaatatctatggtcctaaatacatcgcaatacatggagccgactgttataataatttttaaataattttacatcatattttagtttagggtgtcagataccactagaggaatatataacactaatttaaatctgcatatgtgaaaataaaaataaaaataacataatttagttgtttttaagtagatatgatttaattttaatttgacaaaaaattggaattttttaagactatttgattggtatttgagaagtgagagaataaatacaacataggtgtgaaaataattatcaaaaatatttccagcctatgatcttgctatatataatacaactccttaatccatcttgatatttatggtcattatgtatgttttttctttgctatatagttttgataacaaataaataatcaagtaacatgtgcgtaacaaacttgacgttacactatagatatttgtcaaaatataaacaataatatagtgcttaggagattatcttggtagtattctttaaaaaaatgactttgtcccggttacatataaattcctcttttgttttgggataaaatttgactcatcgaaattatgtgacgaagggagtataagcaatataagtctatctttaattagataaagtagtctattagctacgttttaacgaaaaataatttcattaatatataataaatccataaagtcatctatagcacacaataaaaaatgttagtaaaattttggaaactgaaatgctaaattctaaaaacgaatcacatatagtacaaatatatatgaaccaactccatcattgtgacacaattttttcttggttgtacagtttcaaataattttagtatagagtttatacgttgcaaggataatcagaagaaaaacataaccaatgtccaaacctattattaaccaaaatatgtttaaaatggactcaaaaaaatatttcaacaatatcatcctaacatttgtaataaaaactaaagcaacattaaataaggtgtctgcgcgtatgcgcgggctactttcctagttttctataaaacctatatataaaaatgtaatccatgtctttgagcaacggtgctgaaaaaaatgtgaaaatgtggtgacaccggtataagataatagcagcgcattgccatagtgagttttgttcggtctctaaaaaattcagctttgaacgtttgagatagctgaaattgatggattaatagatagtctgacttttctgataactatttaagggtatccacgaattaattctctctttcaaagttgttgcataaaaacatttcaaggaaaaaattatatagtttttttacacaaaacgtatgatttagtagattggaaagcatacagatgaaaaatccaaaattcataatcagaaaaagaagtacgtgaaaaaacaaactagcaatgggccaccaaggcccatctcaacattgccaatttctatatgggccgcaagtaaaaccaccgggatatacgaccgccgccgccgccgccgtgctctcgctcgcagggcgcatcggcgagccgccatggcggagcggaaggaaggggaagggaaggtggtggtggtggaggaggaggaggaggagcggcggctgcggggggcgctgcggagcctgcagcaggaggccggggtgctggagcggctggtgtacaagcaccggaaccagcaccgcggcgccgcctacttccagtacctcctcaaggtgaggcgcgacgtgaggctgctcctcgccgccggcctcggggacgtcctcaccgccgtcttccccgtcctcgcctcccgcaagccggccaacaccatcctcgccgtcaacaggtcaagcttcattcctatgcccccccttggaacttgaatcaacgctgataaaattttgtcgtagcgaggcgtagaattagacgaagccgctctaggattatggcttgattgtgttttttttctttaggcagagtaagaagaagcctggtgcaaaccattgtcaccatgagaggcttttgggtgtcgcacgcttgttatcagaggtgagtgttatactgttattcttttttaccccattgggattcaacacttagcttaagtgtttagagaagttggaagttggaaacactaatggtagtttggacttaataatgtgatgtcaactgacatttttttttcttttctgctactatccagctaattatgacatagatgcaaattattgtgattatctgtaacttatttaggatggcactcttcaccggcccaatgaaaattattgtgattgtccttgcatatttcaaagtcctaaaggaaattttaggtcatatgcaaatccatttatttcctctatggtatatgcggaaaattaagtgacaagctttgtatgctatattcaccattcttgatatgcttctggacagctctagctgatgatagctttacccaaagagaaacttatattttctctgttatgtgcagatggctgaacctgttatgatgggagcagtgtatcctttgcctttttttttgtttctttgttccttgtattctcttgtgcatagaaatattttttttgactggatgcataatatattaaactgtacacttacaactggtttgtcttgtgcaacgcgtgcctcatatttgtactagtatctttgcccattcttttactttcatatagttcaaatagatatgttcatttccctgttttggtaacaatcgatagttccttaacctgcggtatagtcagatctcgtttttacttgcaagatcattttttgttgatctttgcacagcgattcttgctttgctagcaagagtgagggctctggttcaacaggtgagagcagctgcagaattacctacagccaagactgtgttgctatagttatagtaggaaatatatatagtggaagcatatgttggctagtaaggttctttccctcttttcactgaccctatattgtgtgcagatgctacttgatgttgtctcagtttacaacaaggcttctgatcttattgataggaagcaatctgttaagattagtattggtggagcgcaggtgagtttgcttccagagtagcactctgcatgcataactgtcaaatgtcaagcatgatgaaactatactacgtcaaatcatgtttggattggcagaaaactatatttattcaccacataaatcattcatgtcacctttttttttaaaaaaaaaaatccctacaggctttcagagagtactatccctcaagcaatgatgcccgtacttttctggaatgtgtttgggtgaaagataaatttgttttgcatgaaaatacaaaaggtaactgtgagaaaacccaagctgaggatcaaaagtcatgtgcttccgaatcagcagtcctgtatgaaactcttggacaagtttctgaaggttgggatgcaatattttctgttcttcatgatatatttattaatactttggtttcttggtcgcattcttggaatatttacaaatgtccatggcatgttgttttgcatggtatcatgatgtatattagtatggcatttaacttctgattgttgtatcgttaccaccagataatttgattgtgataggtgatatggtgctggctagtatgttttgcaaatttcttcaattgcaatgattacttcatggaataaaatgaaaatgttttcattaccaatagttatgtactccctccatccacaaaagttacacatattacttttgacaccaagaccaaggggaaattaaatcaccttggatgttacaaaatcaagtagtgttgcaaacatgcaacaaatgagtatttagatgactccttaagttctaataaaacatttaatttatctcttcatttaagtcttgaatacataaagactacaaataggaacaacttatttggaaaaactcaaatgtgaaataggtgtaacttttgtggatggagggagtatttaatatgagagggcactacttttatttatggtttgatagcgtcaaactttaaaaggaagtttcagataattctagtgcttctgacatttttttcagatatggaaaatgctgaaggattgaactctcccatgaagctaccagatgccaccttagcaaaccagccagagaaaacccattgccatcgtgatgaagattctcaaagtaggaggcaattggtgaatgacaacaattctaattctctttcagatgcagttgctactcatgtgcattcaactccatgccctgatgtcaagcctgagacaaagaagagagttgcattcattgcagttggaaatccgaaagccactgctagttcgattggaacaactttaactaagaagcagagactagatgtgattccacgcgccactgcagaacctgaagatctatatgtcaagcctgagacaaagaagagagttgcattcatcgcagtaggaaatccgaaagccactgctagttcgagtggaacaactttaactaagaagcagagactagaggtgattccacgcgccactgcagaacctgaagatctatatggcaaattttctgaggatacagacaagtccatattttagattgttttgcactgcagctgaccagtgatcactgaaatacttctcagctttctaacatgaaaagaacaatcaatacaaaagagggctcggtgtagctcaagatatggttaaattttgaagcaacttttgctgtagcatctaggaggttgcttggtttatctcgctaaatcattagtatagccttcattgtattctgggatgcaatattattttgtcatccatttttcaggtgtaattttgcacaaagatgaattttagttcgtcccatctgatgttcaatgtaatatgcattcattctttgatttgacgctgactgcattacgtttgtggagtggccttaagaactcgaaaattcaggagtctggaacgaagtgtatcttgaacttgggttctaaagcatcagattatgcattactgtcgaaaaatcatatgcagacaaaacatggtaataattcctctgaaaaatcctccgtaagtgttaatgctgatctgaagttatacaagaacaccagaattgcatctaataccaagtgatgtacgtcacaagatcagaagcagaaaaaactaacagtaacagattctcctgctgctatctcatcagggcaaactagggagagcagctttgttggaggagaggaagctgacccgtccgttgtcaacatggcaaaatttcagaggaatgccctcaaacttgttttcaacggtttctagttcttcccttgatggtggtttgttgctgcaccaaattgaaaagcaatacatcaaaggtaggaacaacaatcgaagtacacgcaaataacccaaaagtcatgaaccatacgtcgttctcaattttattgcatgtaatgtgacctcttgcgcatttctttacctaccttatgacttgtatggtattttcgttacttctcagtattctttaggggaagttggtgaacaaaaagagtaagtcaaaatagatggagtcaatgataaaatataaaagaaatcatatgattgggtatgcaatttgatgagatggcaaccaactggaacttcggtgctaagcttgaatcgcattcatataattaacatagaagccactttgagtggatataccaggatgacaaacagatctatgactacgtagtacatgaatagcacgtcatagatacatcacgcatgacaaaatacaaaagcttcataccatatatgttactaaatttatatcaagaaaccacaaaaaatgatcatttatgaattgacaatggacggtcaatgcagtaattcaaatatagcactagtgaagatgaactttgtgatcaaaataaaacacaaaccatgatgagatgaaactagagcacgtttctaggtctggatggatgacattcaagtgaccggaaaaggcaacagtaccttaataggcataggacgaaactagggtctcctggggatgtcttcttaaatttgctattcggtagatacacttcaaaggatggatgcatatcatctatgcacatttccttgagcaatttagttatgtcattggaggcaccaccgactctatttaagctctgaatctgatcagtttcaaccacacttgtggaggcatcagtgacgctgtaagtatggctacgcttaactgtccagggaacgccatatcgtccaataatatagccgagcaacttcaagtgcttgtaagcttggaaggcatcccaggagcacccatatttccctccagcaatctttccgtagatttcctccattccaattgtttcaccctcgtaatcaagaagaaccaatgcccctctttctgccaagaacctgcacggtttggtcagctgacaagcctcaaattgagaacgaagcgaaaatccaaggcgtgagaatcatctataatctaaaagcagtgcagcagcgctagtgtagcattgtaaacagagtgcaaactttgggaatgtgaccgaagcaagtgcaatcaagtgtacaaggaatccgagtagcgcaggcatttcatcgaacaggtggcgtacccaatctcctcgacattgtagtacagcttgccgtcccggttgacaccggtggtcagccagagcttgcccttgctgtccacaacctccgccgcaccagcctcctccagccacaccgcgcgcgacgccaccttcctgctcccccgctacacaacccgatgagctaacacgaagcaaaggaaaaaaaaaaaaagacagcacctgaactggactctcgacgaagacgacgacggggcggcgtccaagaacggattgagatggtgctcctcgccatcatcctccgcggcaacggcgacggcggcgatcgccggagctcgcccgctcctccgccgccggtggtcgacggcgcgcgtgggcttcggcatggccacttccgtaatttttcccaccaaatttacccttttacctttttaccccccaaccactgccactaaaccaacgggcccacgcgccgggccggcccaccagccggcttctcagccacatgggccacggcaggtggggcccacccgcaagaggtcgaagcccactccgcctcgtcctctaccccctcctcgtctcccttttaaacaggaggagaagaatgggaaacgacctctcctcttcttctctcttcactcgtgttgaaattgaaataaatcgcggtcaagataaaaaaaaaagaaaaaaaaagaagaaaaaaatcgcggtctcctcctcatcgagccgcgcggctggatcgaggattcgagcaggtgcggaatctccaatccctcccgcttctgttcgtttcgatttcgcgtgggtgggattggctcgggtttgggaggcgttagcgatttcgcgtgcggatcgacggggagtttaggtttgatggttccgattcgtgggggggggggggggggtgttaggtttggatttgatcggggaattttggtttgggtggattgattcggtggagatctcttcttcttcttgggggaggttaggatttgggagcccgtgaactacgtgttctagtttacttcttcagtttctggattgttcgtgtggattaaccggggttgatggctacttgtacgattggtggtagggggttggtgggttggtaggttttttggtgataaggctattggatttggcaagtcgagaggttaatttcccaattctgttaaactgttcgcgattttcatttcctagtaagtgtgtatgttgtttcaagattcgtaaatttgtgttctgaattttagaagtatgaaatcctaataaattcaacagttagtttgaattgaaagacgcgaatattagggaaggacctaatatcaaataattagatatttagatggggcgaggcttcgaacacaggtcatttagcccaccaccttgtggagctagccggaagacccctaggtgtttctcaacagttagtttgaattgaatcatataagttcgtaaccccttgaatttcaggttgatttcagagttgagtgccactgattcagctccaaagttagcatgagtactgtcagcggcactcggcgtgccccaaggaggcaatcacaagatggtcctggtgataaagtcgttgtgaacctggacgcgatctcctccccagtggttggaagccgtcgcgcggtgccgacctccactggtgcgcgcgcctcccccattgatgtggaagctctggatgatgaagtgcagacattgtccgcttcgcaagtgcctcctccggtatgtcactttttgttatcttgaactgaaagtattagttcagtcttgattatattctgtactattatctgtagttattgttatatgattgggttcataatgatgtttaagtcttttaccagggtttatgtactactccctatgtttctcaggcacactagatgttcctgttaagaacgaactggtgactttgtctccatgaaaaaaatgatgcatcccttgcccacatttgttgaactgtcttgcattttgcagagaaggaaccggagaactaggaggcagcctgtggcagtagttgatctggaagtagatgctagccgggaaggttagttcatttatacaaagattgcattaatctgtcctaattcataaattagtaatcacgggaaacatgggaatatgctatctattcctatgtttgccattcatcaatctgtcctaagtcataacttaataatctgtcctatgtcacaacaataatcatgtattaagtcaagtgtgttttgtgatgataatacacagggaacaaacgtcaaagggttgcacctgttatacactgcctctctccagaaaggggagaagggtccagcttgaaggtatcctataatactatacaattgatccccacttagtttattttcatactccctccgggctggttttatttgtcgttggagctaagttagctgtggatgagaaaatttgttgttcgagtgtttttctcacgtatgggacgagattgcccttgtgcattgatgttgttattcttcccagatcaactcctccttaactccttgaatgcttcgttcccatatcacttaatgatggcatgcatgcatgcagcaaatgtggtataaatacatgcgtaatgtgtggcaaattagcgcggcaaaaagcgtgcgtaagcaaaaacgagattttctagcggcaaaacgcgcgcataagcacaaagtataattggttggtttaattttcgtatgaccttgcacgctggctgcaccgaagctgcatgcatggtgccatgcataatcgccaagacaaaaaaaatgcgcatatccgagaatcgaactcaggtccccacgcaccaagacagatgcactaagccaactgagagtaattagttgcttgtttggatgatacacccagccgtatttaataaggacaaaacaggaaataggaactttacttagtgacttcttggtttttgagattgtgtccgaaacgacaaataaaaccagcccagagggagtaatttccaagtcttcaacttttcagctttaagggcctggttggttattgattacttgtcgtcgctctttattttcttctatgtaaaaagtagctggtactgctgtgcgctcaatattgactcttttggcctccctatagagtttacaagttggcctttcagtggagtgagttatttgttttaagttgaaacttgtaggcatttttcttggtccattatgtcatagaatactcatgcttgtagtattatgtatttatgatgatctggtagagagctattaaaattgttcttgacagccactggtagttaagattcttgcttgtcacaaacaattaggattttgctaaatttcaagcattgtcttatgcattctagtgtaaaagtatctattacatgcatttgatacttgtggctgatggcttattgcgttatgcatttagcttaacactgattgcatttcctgttttggaacaatgctgtgaagactagcaatgagcctcctaaggcaaaggaaccggtttttaactgtccggtgtgttggaacaagttggaggagccctccacaacaatttgcggccatatcttctgcacgacatgcatcaagcaagccatccagattcagaagaaatgccctacttgcagaaagagtctgagggcgaacaatttccaccgtatttaccttccaaactctgatagttaaggtgagtcgtttacctatcaattgccttctcttgtatacctggcactctagtgaacttctgatttcatcaaatcgattgccttctcttgtatacctggcactctagtgaacttctgatttcatcaaatgcaggctcattggatgtaccaaaggaacttctggcagcagcagcagcatcctccaatctaatatattcagaggaacaggagttctcccataacgtgtaccattttgctgtggaattgtgtcacggcaaaatgaccacctagacccgcatgttcatccaaggctactgttgtttgtatgtagatgcatcaccaggagctcatcagctgcaggtgacaactctggtttaggctaccgaatggcctctctgcctccaaaggatacacaacaaaactaactatagtccccattggttagatttatctagtttgtgtactgttgtatttaccatgcgtttggccatgtaccttaccttctctccatagttgttgacgtagccttgaatcagcttgaaatcgtgatgatgttaacgcattacatgtttactcttgcttgtactcgtttgctgttctgtcttctgtgtcttcaagtttgccttctgtggcagagttgcagccaccaagtcggcacaagtgcagctacatttgtgttagaagtgatgttttttttttcagatgaaatggcccgtgatgaacgaactcggaataacaggagggttgaaggatgcaatcatgcaggtcgaacgaatttgacaggcacttcaacgagcaaacgagcagagacaccgcaagaatttttcaggatttcatttgctatagaaactaaatagtaccaaagccatgtttttttttacacatcaaaaacacatacagatacagaccattcccaacccgttgggatcttcattgtaaatgatttgcctcgcaagctgctgcaacaggaacagctgtatatagttcggaattctgaattaaatcgttcgttaggggcaattctgaattctgatactatatatatatatggctttgaaatataaagttctccaaggaaggtgacacatatttcctgttgtacgagcataaggtgatttgacgctcagactgataacaactgaactagggctcagtctgctttaggcctttgaaggcagtttgttcatcacaggggctattttgtcctctgggagccctctttgaggatcaatcttgtaggtgtcatagaagtccaaaatttccatcgagatattcttgacctgagaattgatgaaaatacaatcaatcattaatggatgaaaatagcaagagaatcaaacgatgggagccagggcaagatcaagtgatcaacaggcacacttacaatgttcatgtcaacacggagctcttcaaaccacagagttatgtccttgtctttaagaacgcttgcaatgtagatgcaggctaatgctatcatatatggtgggtgtatgagaataagatccatcttgtaagtatcattgacaattcccctgcaagtaacagcagatgataagcataggaaaaggtatagttgaaaattttgcgtgcattatgttcactaatcataataaagacaattcaattcatttgtttatttctcatgtgattccagataaaagctactagatcttattgtactctatcacactgaaatgattaaaagtggtaagagtccttcaaaggatattcaatatgacaataataaatggaaatactctcttcaaatctaaaaataaatgtcaacaaattatccatgtggtaattaaaaagggttagacttggaccaccaaatgccagaaagcatctaaaacagcttttctgcataaaacaaaactcaaaacagacttcacagatacaaaaatgcaaattgttataagaagagtaccaggcaaattgtgtcagatctgttatgccagcatcctgcaataacctaaaatcaaagcatctgttaataccattgcagctctgatgttcatttaaagtatatataagggcttcggtaattccggtgaaagataatgttgtttcatcgcatgatagtggaaaaagaatcttactgtaaaagaggacgatatgggtggtaaacaactaaataatagtcaagtgcctccaggagcttcatttccatttcaaggatatccttgatttcaaaccggtacttctcatcagaagctacattttgcggggggagagcacatgtttagttttaggttagtgcagttcttcccgataaatatgtgtccatttatgattatgagccttaccacacatcttttttatgtaaaagacaagaagtcttgcttgcactgtgctctcttccacctttgatgccaaatacaaacaggttggtgctaccagacgaggatcatattcagtcatgctctttctgtaaacatatccagcatcagaacaaaattctaatagcttgatgttccactgcaacaaagaattaaatgttctggaatgaaatattagaaagcactgtgcactgtgccactgtgtactctagttcttatcgaagaaagtagagaatcacatcaacatagtagagaatcacatcaacattttgcaagccccccacataccataattcttagggcattaattagctagagaaaggaaaatgatagccttattaggaagttagaaagtatattgtttatagattataaggtagtcaccttaatgggaaagtaaggccatctacagtgtgaattcgcaccaaacaagctataaagcagtctcgcagcttagcattgttagctctagtgtgttactcatctcctaattaacatttggaacccataatcaagtcactctcctctccacctctctcttgtatatcagggaatatatttattgtgcaccaaattgagaagttctattttacttacatgagagatggctttactttcccattaaggtggcaaccctataatcttaaaaatacgctttctaatttcctaataaggttatcattttcccttctctagctagttaaattgacagtcaaattcatatggatatcttaggcactctttctcctcgatgaatagaaggcaactgcctttcccatgtatccttaaagagaatcataccttgtgtatacacgcctgaaataagtaacagcagtagctatcaccctgaaaatacaaatgacataagatcagtatcttcaaaaacttgaggtcggtatctcaaggtaataatggataagtctggtggaaaatggacaaaattagtagatatagagtaaacattatgagttacagttaaccttgtgagaacgttgaaatgcccttatggttgacagatactacagtaaagggaaaaatataaaagtataactaacatgttcgtttttctcttaaagaaattatatctcagtctttaaggccaagcagacagcagaaatgttacagcaaaaatgaatcttgacgagggaaacattaaaacaaaaccaaagtatttatgtctctaaagtaatgagccagcaatttatacactataacatatatttccacaggcttgaaagtaatccttcagaaaagtaactgccaaatttgttgcaagtagaaaggaagcagaatccccttcttaaaataattaccctaaaaaagtcacccttggtaacatttttagaaatagtctacagcgcatagagtgtacaaggaaagcctgctaactaagtcccaatgcaaaatgacaactttggttgttcgataagggcatcctataacaaatggtacaggccagaaagtggagagaaggtttaacctttgtctaactttcacctgttgtgccaatcgccagatatctgaaatcatcaaatgatttgccttaatttgtaggactaacacaaaagtacaaaacatgaacatcgagcaatcttaagtgagacgctacagcttctataaatggaacgaaa

SEQ ID NO: 5848 - DNA, 25201 bp, Oryza sativa
caacgaaagcatcacaggaaagctaaagggaggagaagctcacggaaggacatgtggatcttgacgaggcggaactcctccagcgtgatgccccggtcgctgtccgcctgggggaccttgtccacgtcctcctggtccagcagctgcttgctgccctcgctcgccgcgggatcacacacgaacgaacaccccccaaatcagcagcagctcagctcacggattcgcagcccaagaaaccgaatcgagagggggggaaacgtgggggaggttggacgcttaccagtgcgacgacgtccagaagttggcggccatcgtgggcagggcggaggcgactccggcgagcctctccggccgaatcggcggcgctcaccgggaagagctcggagttcgccggaggggaggggggaaggggaggggacccaccggcgtcggggatggattaggaggtggttttatcaggctcgagttttgggccgtttgggctttgggctcttcgaggcttactcggcccagaccaaatgatgggccgattcactatttcgctagtattttgcctcctaaagttcaaaattacaggagcctctctggggaatgttaagattgtaagaaataattggttggtaaccagtttttgataatgaaaaaaaaataggtttttcaacttctaattttcagttcatttttttagtctacaactatagattcttagaatctggacgaaaagctctgggagaagcgggaggtgatagaaactcttcaaatagggccttgaactgtttggtgtttggtatgttacccaaatcaatcatgataaatcaaattatgtaattcctctattttgttgttgcgtcagcaaaaatgtaattctgaattgtgacaaaaaaggaacttgtatggtagaggtatgtgaatgcggatgtgatagtatttttggtttgatgccttccaagatgtggtacctcgtattacatttttggtatagtggggtacttagggtttgtttggattgctaccttccagaaatttgctatggttggtttgggcaaacataccaaacactttgttttcacaagcaaattggagctcttttttaaggagggaaatataattaaaaaccaaccatgaattatattagctttttttctaaaaggtgaaaaagtataacaaccatgaattcaaaagtgctacatcatcaacattgatttaaataaacaaagggtaggagtaacctttcatacctgtcttgtaacatgaggattgctgtggataaaatgcctatttaccccccaaaagtgctcattcccttatttatccctcgttctctcaataacactcgagcccatattccacatgtcaaaactaagacatctatacattctatatagttataacccactaagtttaaaactcaacatacaaatatactagctcatcattcactaacaataattacatataaaaactcatacaagtattcaacattatttacaattcattgaattctacaaatcaacatgcaaagcatatgtgattatcacaccttacatcatttccataatattttaacatatctattcatcattatattacttaatatatatttatccggataacatttattgattgctcccagcgaaaaacatttagtccttatttggttaatccttacgagggaggaattggaggggatttattgtggtgtggaattattccccctcaatcccctctaaaccgaacatggccttaatcattgccaaccggggctccccttttcccattaaattggaagtcatcgggaaatacatttcaccgagggccctggcaaatgacactgtagctagctctggtaggccttctttggctggtatgacaagtgccctcacatgtaggtcgttgtgcagtgtcatatattgtacagtactacatatgagtacttgacaggaggaaaaaaaaaagaaatctctttaaggtggtcgctcagtcgtctactcaccatgtaagaacaaacagttgctgctcccaaacattcacatgctgtcctctcccaagtctgaacatgcatattcagaccaaaaaaaaacatcagtataactaacagtccaatatgtactcgtgctatgtcatttgctctctcctgtatcgtaggatcagccgcagctaaaatctataattttaaaacttaattttagagttgattttaaatttttttcgtaatttatttattaacactagttttgaagtaactataaacacatcttacaagttatattttttaaattgctaataattaactgtggacgaaacgcgatggaatcatactgttcatcttcgaagaacagatgtcggtttgcacgtccttcttggcgcaattcaatacgattcaggcttgatgtcgacgacgacctgtcatggaatgataccagaattaatggatggggaacacccagcatgttgacgtctcagcaaccaatccaagtgaattatgatctaactagctactgaaaattcctttatccagtgctaaccaatcagctctaacgatgaaactgtcagggaaaaggttggagtgaatatccatgaaaacgaccgggttttctgaagaacattcagggagacgaaatgcttggatggatacatacatacatacatacatacatacatatatatgtatgtgtgtgtatatatgtatatatatatatatatatatatatacatatatatatatatatatatatacatatatatatatatatatatatatatatatatatatatgatggatggttagtttctgcattgggtctcattcatgagatgggctgtctagcttatccttcagtttcagattcttgctaagttctagttccttctgtttggctgaaaatttgtagagtgctgtttatctatctcccactgtctgaaactctgaattacagttcactagtatgagtatgtttgtttcagtctttcagaatcatgtaaattatactgttttcagtaattattgcccatatgtctagcactcaactccagtgattcctcaacttttgcatctctggctggattgctgtccattgaaaacacccattgaaaacacttgttttcagaatgttccaaagtttctttaaccaaatactgccatgtgtgtatacctgtttcagaatattccaaagttttttgactaaatattgccaagtgtggcatactcatttcagaatcttccaaagtttttttgaactaaaatattgccaactttgcatctctctatggattagatttcactaaagatattttcatcatgcagccacccatatgatccttgtacttacgcaggccgtagggtcccttggcttcaaaaaagtcaaggaatccaacctcaaatcagataaactttagtgcagcgattggaacagatgccacattggatctgattggacttgtctggataggattatcaatttatcatggccaaaacatccgtcatgtcatgtgcatacgcctgttcgtccattgccagctaaatattcagaacctaacactgaactttttccacactgatcagaaattaagaatgccaaacacaactagctcctgatcaatcaagcgacattacaatctgcaactgcaagtgagtagatgcatgtgtactgtagtataatcgcattcaaaacgaggagtactacattgcaatgaagaatttgtttcgccaagattgatcaacctgacatggcagctccttcgcaattgcagcattgcctgcccttctcctgaaagtgccataagtcttcctgtacctgaagaacataaattcttgcaacaccgaacagatcaccaataaatcatggtacttttgaaggacatatgttcgtcagatctatgcatattcagacacaatacttatcagggcaaatacttatcgttggaatcagctagcaattaactccatgaagtttcagctatacatatacatattcgatgcaagaattaatcaatacggttatacggagatcgacagacataattgcatctagcttgacgccttaatctgtctgacctacactcgtgtctctcgtagtactactactaaatatcaggattatatatgtcaatggcatcatttccattctctgcattcaatccaagaacctttcaggctttcagtgacaaccaaacggtccccctttgcaagcctgcaactgccatggattggagagcatgcttcgtcataaagtggcatgctctccatcgaaaatgacatgcgtgtgcttgatgcttcgatcgatcttgatttggtggtctcatgacaaattacgaattggggttgcacaaacatgtcgacattttctttcaggattttgccggtgccaacatgatcaatggacttattaatagcagcagcattagcagcatgttcaaccacatgtatcatgtacaagtacaactgcaactcacttaatctggaacatgcgtaattaaagaagggacatggattacagactcgtgtgtatagctgaaatagtgaaattaaactgtactctaccctgttaatcatttacgtttcagttttttgctacctaatactcgtcaaaaatatttgacgagatttcgttaaaaatttaaagttccgaccatcaataatttctttaaatttgctgcctgttactatagaaaatatttagggcgagattcagttaaaattttagaattccaaccatgaataatttatcaaatgcttagtttttttaagaaataataaacatggatttgtctcaaaagtagtatcataaccatgatatcgtaaacttattggatatcataaacttattctaataaaaagttggtttttagaatttaaaagtttgatagaattttatcctaaacattaaatatttataaccgcgcgtgggactaccaaattacgtgaaacatagtactaggtcagttcaacccaaacaaataacatggaatgtaaaaaaaaacacaaatattagataataaatagaagtgtgagccttcgaatctaggccggctagtctaccaccctatggagttagccgaaaaacgctgggcgtttctcaacagtgaaatatataacaatcaaattaaagaatcatgcatcatatccaattatatggtcgagcttaaccaaatgattagaggggagaagggagcacagacgttgctctcagctcgctctgtcactacccagtgagccactctgtcatgcacgttgcctcgattgctcagtaacgcactccctccgtcccacgatataagggattttgagtttttgataacaacgtttgactactcatcttaatcaattttttttaaaatataaaaaacaaaaagttgtgcttaagatactgtagataataaagtaagtcacaaataaaataaataatagttttaaatttttttgaataagacaagtggtcaaccgttgcaagtaaaaactcaaaatcccttatattatgggacggagggagtagttactagagtaatacccatgcttttctaaagataaaacaaaatatattatgatattatctaaaataattcttttataaatatattatctgtcttttttctaaggggaatattcatcttaacttagttttatatgtgtttatcatttagatttggatagtttgtaaaatttatatgtgtttatcacttagatttggatagtttgtaaaatttataatagaaagatgaagtggtagattactatcaagtaccgacatataattaagctggattgaccaagcatgcaatgatataagttactaagaacatccatgtgaaataaatatatattccttccgttttttaatagataacattatttactttcaaacacatatttaaccattcattttattaaaataatattatgcatatgtataagatataaatcatacttaaaatatttgaagtgataaaacaactcacaacaaaataaattataattatgtatttttttaataatacgaacgatcaaatgtgcgataaaaagttaactacgttatctataaaaaaaatgaggtctatggcattgctctcactctcagctagccaccgacacatccagaaacgcgtgcagacgccggccatggctgatggcttaggtacaggtacatgccctaacattgtctgcatttgcatgtactcctatatgaatgcgagaacgacgacgaccgtacgacagtaccggcttttgtatcttacgatgggagctgggcactgtgctgctgtctaacgctgataataataatactagtaatcaattaagtcatacccttgctgctggacctgtctgtcatgtggaagatacgactgcacccccccatggtctgctactcatatgctagctgactgatcagtgatccagttgtagtttttcgtttcctttcagctatctttatgataataagctgtaggtgtagggaccaaagaggatttttttttatttatttttgaacttttctatttttaatcttaaaaataaacactttcaaaacttatttacttataagatctgaatcttttggttatgtcatgattggcatggcaaaataacattgtcacgccgatctggctggcgtggcagcgttatttggccacaccatcctcactggcatggcgggataaaactgttatgctcgctgtgtgtgacgtgtcagtattgtttcgaaaataagttttgaaagattggcatggccaaaggttcaaattctgaaaacaagttttgaaatggtctacttttaaaataaaatataaaaaaataaaaaaataaaaaaatcaccaatgcgtggttctttaaccttttgagatcaatcttgcaaactcgtgcttgttttgcaccctatattcatcggatttttctcgcctattagagcaagtttaatagtactctttccgggttgataatacttgtcgttttggataagggtgaggtcaaactttagaatctttgattatcaatcatttttaaaatatttctctttcaaatatggtgactatatgtatagattggtcttaaaaaatactttaataagatcatatatttgtttaacacttttatatatattatagtagaaaataatggttaaagttgttttttggagaccgtgcctttgtccaaaacgacaagtattatcaacccggagggagtataaccaactactagctctaattcatctatagtcaatctaatagttcattcatacaatagttacctatagacatatactaatccattaatatatggtctcacctctcatacacatacaacgtattggagtccgtgccgcagctagctataaatctgtagtctgctttccttctctctcttcttttctcttctctacatgtgtttgtagctgacttatagcctgccattgtactcgctcttactcgctccacgcttgtaagattatacgatttctcaaaaagctttcatctaatgcattggttaaaccattatttcagatgttaacgaacttgccgtacacattttgcttggactttttttctttaatttcgggttgagatggctcagttgttttcagttttcagttggcagatcattaagtcgattcggatcggagtttccgacaggtacattggttaattaattaagacacaactgagaatacaaagataatgcacccggtttttttcaagctacactatcgaattatttccgcgggttttttttatttactatacgtcttgaaaaatatgtttcctcaaaaggatttctcaactttttttaaaaaaaaaccattcctccaaattgtcgacgggggatacccatagactggatatagagggtattggggtacgctagtacgaggatctacgtagtacaacatcaagcaaacaagagacagagattatactggttcagaccccttagtaggtaatagccctaattcagttgatatgggattatacgatgggaatcacagattacaaagggaatagtggaacttgataccaacgagattgtagtcgagttggttcgactagatcacccggtgacttggctcatgtaggctccggcttcgtaggctgtggtggatgtgttggcggtaagattccatgccttaggtcctcccaggggtcccttttataccgcaggtcaattggtctccaagtagaacttggagatgtcggaccccatacgatacagtaacgatccagttctgtccgagtagtactccttccatctgtggactccgtgatgaatttccttaacgtgtacatggaacatccgtatacgtgcaggtataccatatcagtacacgacgtatatccaagggtagagggtataccttatccgtaactctgacacaaatctttgttaaatttattttatgaagtttataaaatatttaattcatcacgataatcaagtagataaataatctaaggtaataatgcgcaataacctgttttcagacagcctcgctggtgacggttgagcgctagcaaacagctcgcgcatgctgcccatgcagagagtcaatggatcaatccatgtatgcgctcgccggcggccgctgctcctcactgtgcgccataaattccaccttcggattggatctgaatatctatcatctatttttagttcgatccgtttaatttaatttgcccccaattttcactggttgatctgacctctccatcgactgattgatcgatcgatcgagccctactagctgtacatgaacaatgaacaattacatcgtgatctcttaattgaatgcatcttaattctgcatgaattcatgcatgctcttctcgatcgatcgtgttcttgaagcgatcgaggacggacgacactgtgtacttggacgtgaccgatatgcatgagagctttgtaatggtagcgttccaacgctaattaaatacaagcaaattaatcaaggtcatgtcctaatttatgcatgactaaattatgtatgagacagtattgcagcttgcaggtatgccatgatgatgttaacagtcctgcttctggtatccttgacaatgaacgatcgatcgatcgatcgatcaaattaaaggacattagctacgcacagtactgatcaccagcaaaacacatggtcagttgttaatctaatcaacctcctttaatttactccgatcgatcgatccaggtgctaaatagctgttcattaaattcgcagaggcatcagatcaccgttacattcatccattaatccagaatttcaggtactatttcactgcctgcgactgcagtatttgcttctgtgctagtaagagtacttcttttctgaagaatctgttactgctgctgtgctcatacccaactcgatcaatcacccatgggtttagtatcctctatcttcgaagctactacataattttatcactggtatatgggtccgatagaccctaggactcacatgtgagacatagttacaatcggtgttgggcctatatatggccgccgctttctcttccttcctcagggcaagcggcgtcccgcatgctcaccacacctcgaggctgattcattgctagggatgcggttatgcttgcggcatcttaacatgggcaaaggtcattacccacaagaagtggcggctcatcgtccttatagatagagttggtcctcttagtgcggcatggcctcacatgatcttttggctaaaacaactacggtggcgtcaccatgacggtgacaacaacgactgggttagaggtgaactcgagttaggatggactagttatgtccgcacgatccgaagactgccacaatcagaacggtatctttagtggcgattgatgagtgtaaccggtaacgtcagaaatgacggtcggtgcgtcgtcattggcgagctggcttcgatagccatggtagtggcaagatccgacaagtgactgttttacacttcaattactcttcagtgatatttttcgctttggcttgacatcaatcatcggcgctgatgtgcacaaaaattgatttgaataatgatcggacgctgattttgagattctatattccgttttgtaatttgatttatatcgacggtgttatctatttctttagactaatgttctagctagttttcttattagctatcaagttatgatttgtaatccgcggatgcccgatctataaattctataataattaagtttagcttctttaaatgcttcggtccaacgaaaaatatctcgaggtaccgatatctcacggtaccaaatcgttttcgatcgttagatctaacaatatctatcctgtctagttagattcaatgattgaaaatgatttgacaccatgaggtaccgatatctcgagatactttttgcagtactggagtatatctcttattaaacaaactaattgtctcaaaatcctcacgaggaagaggaatccgacgttatggcccgtgagaaagatggcatcaatgcgcaccccccgcatcgcctcatgggctcccctcccctctcgctacacccccggaagcaccgacccatcgacccccagcacgtcacatgcgctttgacaacgatctgagatcgatcgatgtgccgccgcccgccggcggccgcaaccgcttgccggcgacaaaaaaaaccggcgatccccttttgaccttgccagtctccacatgtgcaggcaagtccgtgtgtgtgtataaactagttcagcacggaacgaactcacagcacagcacaatgtgtcattctgcctgctttttttagaatgatattttttatccggtctctacatccaaccatatatatatatatacaactcttttaaattgaaaacttaatctctcaaacaacctaatctaaaaattcactcatatgaagatttgaactcagaatcataagatgctacttagtcagtgcaaaattactatattttgatcaaagttaaaacgtctttgtaatctggaacggagggagtagaatatatgtgtcattctgcctgcctagcttgctagctccactgccgtgcggtgcatgcgaggtcggaccactcccactaccgcgtttcgcccaagttgcgacgagccgaacgaccaaacacaaacgctggatgctgcgattctaccgaattttcgcctgctttctcccgtgcgatctcacccgaattcctctctctctcgtctcgtccccgtttttttttacccgtctccacgaaccaaaaagaattcgaaaccaaaaaaaaaaaaaaaccgcagcgcgcgtcctctctctttataaccttcaagtgttcgtccactccctcctcagctagcagcagctctagcttattactaccaccaccactgtactaccccgcacgacacggcgcgacacggcgcgacgcgacgcgaggaggtgagcgcggatgccggcggacgcggcggcgaaggggatgaagctggagaggtacgcgagcggcgcgggcgcgatgctgctgctgcggcgggcggcgagcgggaaggtcgtgtcggcgtcgtcgcacctgctgttccgcgccaccgtgctcgccacgatggcgctcgtgttcctcttcacgttccactacccgtcgctgctgtcgcgctccttcacgctctcctccggcgccggcgccggcgaggggggagccgcggcgcacgcctcgcaccggagcttgctcatgtcgtcgtcgtcggcgtcggcgtcggcggcgtcggtgtacgggggcgcggcgtgggagaaggaggtgaggcggagcgcgaagccgaggaaggacggggggatagccgtgctggtgaccggcgcggcggggttcgtcggcacgcactgctcgctggcgctgagggcgcgcggcgacggcgtgctggggctcgacaacttcaacgcctactacgacccggagctgaagcgcgcgcggcagaggctcctcgccggccgcggcgtgctcgtgctcgacgccgacatcaacgacgcgctcctgctcgagaagctgttcgacctggtgccgttcacccacgtgctgcacctcgccgcgcaggccggcgtgcgctacgccatggaggcgccgcagacgtacgtggcgtccaacgtggccgggctcgtgaccgtcctcgaggtcggcgccaagcacgccgacccgcagccggggatcgtctgggcgtcgtcgtcgtcggtgtacggcctcaacaccgacgcacccttctccgaggagcaccgcaccgaccggccggcgtcgctgtacgcggcgaccaagaaggccggcgaggccatcgcgcacacgtacaaccacatctacggcctctccatcaccggcctccgcttcttcaccgtgtacgggccatggggccgccccgacatggcctacttcttcttcgccaagagcatcgtctccggcgagcccatcacgctgttccgcgccgccgacggcgccgacgcgcgccgcgatttcacctacatcgacgacgtcgtcaagggctgcctcggcgcgctcgacacctccggcaagagcaccggctcctccaagtccggcaagaagtccggcccggcgccgctccgcgtctacaacctcggcaacacctcgccggtgccggtcacccgcatggtcgccatcctcgagaagctcctcggcaagaaggccaacaagcgcatcgtcgccatgcccagcaatggcgacgtgcccttcacccacgccaacgtcacccacgccgcccacgacttcggctaccgccccaccacctccctcgacgccggcctccgccacttcgtcgactggttcgccgactactacaagctcaagctcgacgtccccaagatcgccgccaaggtcgccggcgccggcaagccctcctcctcgtcggcctccaagaagaagaagaaggccgcggcgatgtcggcgtcatcatgatcgagcagcacaacaccatgagacaccatgcaagtgtgtattccatagctagttcttggaggctcttgtctgtataacattgtaagtgcttattgtttaagcccctattaatttcttttcttcttcttcttgaggtgtttaatttttagtgattagaaacaagggaataatggtggagaaataacactgttgttggtagataaatatgagaggggtatagagatgatgataaagatcaaaaacacttggaagccaggacagaaagaaagatgaagtcactggcttccttcgaatcaaaatgtctcttttttttcttgttcttttcttttacagtgtcatcacttgttctgttcttgttccacctgatgatgtaagccatatcaacatgctgttgctgatggaatccaatccaatccaatccacatcatgaagctaagctcagctgcaagcaagaaagaacttcacttctacacttctacttttatttctgaaatctgaatcatcacaatcttttaatagataaaaccatatctttctgtctacagaaacttgtgcagattcaggccctgactctgcatttcagtgaggctcatcaaccactgacatttactacttctgcagagtgtgtatgtatgtttgtgtgatcaatcactgaatcacatggctcttgattcgtccagcaatgaggcagcaggtagtggctggttggtgaggggatcatcagcatggtccagtctctaatttgctgctcatttttagcatctttgatgggcagcatgagcacatattcagtacaggccgctgctgctgcttgccgtttcagagttcggccactgtttgcgagattttgtgcttggagacttcgacgcaagtgtactacaaggaagaaaagagagtatttttcctgccgatttgtgcggtgtttttagcgtaaattcagtagaatgtcggcacgatgtcacgaggctacagttttcagaattttcggtgcgttttcaggcacagggttcagcaaatggatattaatcaagagtgccaggctatcttcacttcactcgttcgtagtgagtgagtgatgactgaatgaatgacaattgacaaccgactttttttgtttatggtgagtaacaatcatcttgttgtgatagttgatagagacactgcatattgtctgcaactgtgctttttttttgcagttttttcccagtaattagagatatagttttactctctcctttgttctgccgcagattataacctgaaaggaattttataatttaaattcatactcaattttaggggttttcttcatgattcatcactttggttgctctataagaatccctttatggtacaccgtactacattatactattagaaaatctacctaagattatttttaaaaatcaaattctttttggattataatctgcagctgaactaaacggggtcttttgaactttggattccttttataagccctatttattcgcactggcaatctgtccatgaatggccccctttctgaaccatccatcatgcattcatgctgctaagccttagtcctaggacgattcttgtccatttcctgcctttacaccacagctgcttctttgcatggggccatcagattccagtgatgttgttccattattctactactagatttgtgctacatgatccaaaaaaagagcagagaaaacatcattgtactctgtgaaaaattgtgtatatgctgcagattccagtgatgttgcatattctactatacttgacttttgctacagaatccaaaaatgagcagagaacacatcattgtactctgcgaaaaattgtacattctgcaggcaaaaatatggccttcttgtcagcatttgcctttgtttcttctccctgattcaattggttgaacatgcagctcacagcaagaaagccaatgtgtgttcttttctaaggaaagcaagaaatacttcctctatatgagtttcttagaaaattattttaaatccatttttccgtttgtaccctcgaataatcgtcacaaaatcatttagctatttattagtgtggtgcttctgggattttgctcgcctaaccagatatctcatatgccattttctaacgctgcatcggacaatattttctgactatagttttcagtacacatcattgaaccaaaactatatggtccagtttaaatcttgggaaataaatatgtcggcatctagattgttccaagctccaaacattgcattgaacacggatagtatataggaccagagagaatccatctcataaattatgcagaaagcaacaaataatataaattaagaattagagataggcctgtacttaacaagtctgaattgatgatgaacgaggtctgtctatacaacagtctggtgatcatgttctggagcagcatgaacagaatcatttgtgagcaggaaagcaccttggatctgaggcttgtgacttgtgagatcttggaagtgttgcattgcattgtgcaatgaataataggtcaaagttttcagctagtatttcaggtcatctgtttttttttttttttttggctagagacaattgaactctgccattttacagctaaaaaataagttatagtaccaaactaattgttcagaaatctctgcactagtgcacttggtctgctatctgaagccagtgctatagtgttagtattatattagtactgcaagttggaagtctggtcccagtggctcaggtaagcttcacagtggagcaatctttgacttgcattggaatggcattagaccagaaaaaaattggacctaatccagattattggtctcccagtgcttcttcaccacttgcaaaaagtatgttactttaattaattccatcatgctgatgatctaagttgatgagcctccatttcaactcttgctgactattggtttagttgtagtaacatgcatgttcccatcattccagcttgcttcgtttactagttgatttctttgtgttcagtctttgtgcgagtctgttcaggaactggagtatctgcaaatctagcagcatgaattttcagctggattgtgatatgtgtgtgtggccatccgcctgacccactataatgaaaaattcattatttttcacaaatacagaaaagaaagaaaaaaaaggtccacggcgtcggtcatggccgtggtctgcatccacagtttcagagatgatagaaggcaacaaatctatttggaaatgacactctgacagtaacaaacagcgcctgcgggaagagaaaaacgccgcgggagtttttacggacaaataaagctttgatgaagtcttaaccgttgtgaattatttatggcctcgttatattccagttataccagatactccctctaacttaaacattttagaattttataaaaaaatataacaacatttatatcattaaattagtttcattacgcctagcattaaacatatattccgatagtttcttccaaaaaagtattgccaatttttctataactttgattaaaaaaaaagttgcagagaaaattgcgtcgtcgccgccacaacacctgggctccatctctctagtgggccgggctgagagcaccaggcttcaaccgggggaacaagttcacttagactcctttaagtagtggtcgaatctgattcatatctctgaaccacaataccggatatctcaaccccttaattatcaaaaccgatgcaatttgactccctcggtggttttggagggcggtttcgctgatgtggcggtgttgacttggtcttcatcctacgtggcgtttatgtggcactacaattaaaaaaatatatatggcggtgttgacttggttttggtcttatggcatagagagaagctagagagggaggaggaggaaggaaaggagagaggatgacctgtggccccctatgttagtaggtcccataatttttttttatcactaacaaatggatcccacatatatattttcttaagtctaatgccacataagcgtcacatcaccgtcacgtggaacgaagaccaggtcaacaccgtcacataggtgccaagtcagcgaaacctccctttaagaccgttgagggagtcaaattgtaccggttttaatagttgggagtcaaattgtaattcaggggtacgaattagattggaccactattaagggaacaccgtcacataggtgccaagtcagtaaaacctccctttaagaccgttgagggagtcaagttgtaccggttttaatagttgggagtcaaattgtaattcaggggtacgaattagattggaccactattaagggagtcaaagtgaacttattcctcgaccgggagaccccagcccagcccatattagccaccgggggccggggcctggaagccttagccctcgctcgccgggcgtctccgtcacgaacaagcgccgccgccgccgccgccgctcgccggtgctacggaagacgcggccgcttcttattcggaggcggcgaggagagggagaggggcttcatctgctgctgcttcggctaggagcctaggacgccatggcttcctctccgacgacaggtacgacgaactcgacgagctcccctcttcttgacttctttgcgcagcatgtctacctcagattgaaccaaaattcacaaaaactccagaaaaaaaaaatcgctagctttcggctcaactagtgagaacgaagcttacggcacaaatccattagcttccagctgcagattgtgaacttttcaaatcgcttagattgaagactatcaactcatatctttgtccttccaagaccgagtttaaagcttccagatggattaatttaacttctacattgcaattttcatgccatgcttgcattccattattattagtttatttttggggttcttatgatagtgtgatgtatttttagatggattaactgagtcagtggccaaaaggaagggctctccttgccaacaagatgatgattgccaagatgacaaacgaataagatcaggtgcagaccttctagaggtataaattactatagtgcaaagcctacatgcatgtgaattagttgtggctcgaataggaatttgtaggtaggagtaatgtggtgggcatgggaatgtgaatgttagtgtgaacccttcatttggcccgtgatatttaaagagaaaaattcattgctaaattcactctctacaagatataaagataggtatgcttatataattttaattcttttgaagataattttagatataattttaatgttaggtgtagggttgaatgcatcacattttcagtcgtgtttatatgattctgttactaatattctctgatcctagttgacgaactgcatctttggttataagttgtaggatttaatcacatctgattcaatattgcctataaagataaggacgattcagataaatatctgtatgaatttactcgtcattgataactatactcaactttgctttgacaatctccaaatcttttaaagagaagtactgaagaaaatccccagatattgttatgcacggttattcattcatctggtctactcattctatgttcttgctgcaaaacatccagatgcactatacgtatgctgtacagagtatacatgtttatttccggttctttgctattctgtcatccttagcttataatatcatattgcacagtataacaacatgattttcccgaacgcatggaaatagcatttgttgattgaacatacctatttcaatttttgctgatccttactaatcactgtctggaaaaagatttatgcaatattcatataaagatcccatgtctcagtccaccaattttttcgagggaaattctcattccacctaccacagctacataccagtgtattttcttcttctgtatgtgatgcagcacatctttgcattgctttcgtacttccagtactactgttctcacattgctttgcatgcaggacattttttggtacattcattccttaatgccacttcgagatgctgctcgtgctgcttgtgtgtctcattcatttttacgatcttggagatgctatccctaccttatgttcagtgaggagctactccgattgcaggagagtgcatttagtgatgatgagagaacgagaaatctcatcagcaaagttaaccacattttacaaaatcactcaggcattggcgtgaagaaactagagcttgttttcttggatagtactgatgtggacttaagttatattgacagttggcttcacaaggctgtcacacgagggattgaagaactcaccctgatactgcctataaacagcaatgcagaatacagcttcccatgttcgcttttatctgatggtaatggtaactcgattcagtatcttcatctctctcgctgtgccatccgccccactgctgatcttggttgcctgagaacattgacaacgttgcatctatattccgtgcgaatcactgggtttgagctagagtaccttctttccaattcacccgcattggagtggttgataatgatggattgtaaagagatagttcagttgaagataccaagttgctgaagcggctccatactctttttgtgagtagatgtcaaatgctgaaagtggtagagagctatgctccaaatatcgccacctttcacttccggggtcatgttcatgcagtgcgaatgttgggtttactgcaagtaaaagaccttgagatgtcatgttcagatcactctagcattctctgctatgctctcaccaatcttttgtctattgtcccaaatgttgaaaaacttagaatatcatcacaaacacaggtaaactctgaagcattacataattatagagtagcaattgtacataaaattgtagacatctattaaaaaattacataaaactgtagacatccattaaaataaaataatacgagacatctttatgcagattgtcagtacacaaactgtaccagggaaatatcttcgcctcaagcacttgcatatatctcttaacaggtccccaaactttgattatctttctcttgtttcttttctcgatgcctctccttcactcgagactttcatcttgcatgtaagtaactagtttcatcttgtaaagacaagtagtatatatcatccataaatataaccatcttttgaagtgttctctctgttttacaattaattttgatcctatatgtgcagatatgggacatatacataccactgggtcatatggggcatccttggactcttggagactctgaacagctgaggcagatgccaggacaccgccatgacagtctcaagaaattcgaggtcgtcggttcctgctacgcgaagggcttggtcgagctaacatgtcatatccttgagacgacatcgtcgctcgatcgtattaaactcgacacctgtggttatgttgggctttgtgcttccggcagtggcagatgttacccacattatacagaacaaatcatggaggcctgtaattcagtcttggctatcaggacatacatcatggggaaagttccacctacagtgaagtttgaacttgttgagccttgcagccgttgccctgtacagtagatgctaagttattaccggttaccatgcccatatgttttttttaaccatttttttaaaaccctacggattgccgacataacttgttgagaaaggatcattgcatcctagtcaatatctttaatatatttattcacccataaattactccagcacttgttgagcaattgttgtacaggttacatatttgttgtacagatctctagtcttaaaataagacatcactgaaaaactttacctctgagcaatggactgagcaactgttggacagctactttccaattcactcgtgttgaagtacaaaataagcagcagccttctcaatccaaaaggatataacaataacatggagttctgccgcctcagaagatgataagatagaaagcacctttctgtaaattaaataaattgtacactcaaatggaattaacttggtacagaaagaacggtggaactattcaaatactggttaatatcacaatattaatcgttttagaagaattaaatgaatatagagataacacatgtcactacagaaaaaaggcatcgttatcaaaaatagtggaacaataaagccaccatgtaagtctgaacatcagaacaggacagaatcatggaactaaaatgtccctaaagttgccgtagaacaattctagaatgttatcgtggcaaaatacagtgactatacggatcggggcagaaatttgcatcatattggggagaacatcagtataccagagaactggaaacatccagtctgtcctaatataactattagctggacattttattttattgtagcacaaaaagaactctgtactgaaacttacaatcaaacatgaagttatggtggtcacttgatgttaaattgttgatatgataatagtttttttttccttccatttcgtgagtgaaatacaagcagaaacatctaatgcaatgcaatctctgtataataacttcaaaagcttccacttacctggttttcagcaagcagatactacctccgtcctatataatataggaatataatataggaaggaggtagtatgattaaccattcatgttttgagctgggccacgatctgaagtatctgagagaagcttaaaattttcaaatttccaaactactgggaactaattcacagataatgaattaaacaagatattttcagggatcttcatgatcacaaggctgaaattagcgacttaaaaactgagtgcactgcaaataaatgacaactgatcaataaaggaagaacaatctgtacggaaccaacctgcaatcacactttcagaggtggaaactttagtgcgattttcaaatatatccagttagaactgagtagattggaaaatatccaatgtcaagttgtcgactaatattttatcagcctgtaatgaacaaaaaatcacatataaatatgttacctcatttagggaaagaacacactaccccccaaaagtcagatgcagcaactcgcaacttcttatattagacaagtacaacactaatagctagtggttttaagcatatagtacagtatattgaacaattgataactggaaaaaaaatgcatatcaactcttacacttggttccatgatgctatagagtcttcaacagagacatcagtgtgaagtgtaaacaacttgtcacctcttcagagtggaacacaatacatgatatgctacatagtaatgaaactaacattctgcataactcaaacatcacatccaacagaaagtgaactggtatagaagcatcaaattcaaacctgatgcaaataaaactcattcaatacactcaattattcttcaaaatgggtttcttataccatcactgttacagggaataaccaaactgttcttttccacaaaatactatgatactgtagaagctgcaagctaacataactttaacttgtgcatgaaaataaggaaatctcagtgaactcctcctaactattcattttgcaatttcattgtgacagttaagctcagcaccgcgcttcgaggtctagtttgctcatgaagattgctactggctcaccaggagaaggcggggtcttgtccagcatagaagcatgcacgccagctttagcacgagcagcctcatcagaagcagacaggacctctgcatgttcaaggcctacctgcctcttgatcagctccaagttctcctcgagaacactcatttcaccaaaaggaagcttcaaattcaaagcgtggggcccaacactcctcgcctcatcttttttcgacttgatgaaaggcatgcagagcttctggacttgtttgaagttagtttcctgtccgatggagcagttcttcaatgcttcattaatctcctcatcaggagcaaacaaacgtgcttggctatcaaatttagactggagaaccctcaaacattgctctttccatccataatagttctcattgacgtagaccagaccaacagtcagcttgttttgctcagatggaggaggtgcacgttcccttcttgggtttcttggaaccagattcttgcttctggagcagcttcctgaatttaactatggagtcctgtaaatatttgttagcaattcttagtgtgggatctggggttccagcaattggccagcctgcctttattgcaaatccttccttcctcaggatgtttcgccacacatgctcagcatagtgtggacaaatgggggtaatgagcctagtctgcacctccatgaaccgccataataattcacgattcatgcctgctgctccacaagagagtctgtactcatctctagccaactgtaggtcatagaaccccaacttaagggcatctctgaacatgaaggcattgtagctcttctcagtttctatcaccgcaatgtttatctcgttggcaaacacatggtcagcataggtagagggaggcccagctctcagagaagattcagcggctataacctcttccatccatgcaatttcttttgtaagcctcaaaatagcagcatttgctgtttcaaagacaaagtttgcatcatccataccatcaccggcatcagcaagggcaaatctagtggcatcagaagagaattcttcaatggcctgtcgaagagttcggaaattccctgtggacttggacatcttctcagaattaagcataagatgtccattgcagcggaaaccacgaggccaatgatgctctggaagaagtgctgtatgattgtaaatgctgaaagtcagatggttttggataagatccttaccagagacacgaatatcaaatggataccagtactcaaattccagcttcattttgctcaagagggcaggagggatgtcactattgggtgctggaccatcacagaacacataatcccagacttcatctgtcatttgttctggtctgatagaagatatttccttgccatacatgttgccattttgcaaaaggtgagcgattgtgtaatatgccatgtagagggtggaatcagaaagagattctacaaggaactgctcatcccatggaatgcgagtacctaggccaaaagaacgagagcaggcccactggttcagccagcctaacgtgtgttcaaaaccattacgagtttcagctgagaatgtattcatcttctccaagcattgaactgccttctgcttccattcagtctcaccataagtaatgtaccattgatctgtgagagcaacaacacactcatcaccagatctcgacataactttcttctcaggctcgctatacaacactgctgtgccttcttccaaaagcttgttctttatcagtggcttcgcttcttgaacttttctgccattgaactcccctacaatcattgtcccatcagtaaaacctttcagatatgtcatcctttttgcttcagcaagcttctccttgtcattctgactcttaatcttaagatcgaggcacaccttctcagcagacttgtctccaaattcaggaatgttgattattggtacaaccttaaagggaagaacccattcatctttgacaccatacttctgtctcaaagctggctttgcgactaaatcctgtagtgccatgaaatcatctggagaatcacttgggacactagtcacaatgccagtacctttatctgttaagatagtaagcatgggaagtgcatatatgatctcattgaaggcaagaggggatttcagtggtaaaccaatcagatcacaaccagataactccattaagcaagttggtttttctgggacccttgatagattctgatatgcaagattaagagcagcccttgatgtaacaatgaagacatcagtgtcattgatctcaaaggccccatattttccatcaggcaatacccaacagtttgtctgcccatacattgtctcaggtctcaatgtggctgctgccaaataaacatttcttccttccatggtcttcaacttgggaggaaaaggtggaacaacttccattttaattaacacatattcttgtggctgtacaccttcaccagatgctcgatcatggtcagcacaaggttgaccatccaatggagagtagattgtgtacctcatatctttgacaaccttgcccattttcttcagctttctcatttgccaccggacaaatgcatcatagaaggggttcatgtcagtagttatgaatgacctcctccaatcacagcccagaccaaaggccttgaggtcctccttcgccaatggaggg

SEQ ID NO: 5849 - DNA, 4426 bp, Oryza sativa
atctgctgaggccttgatgggcattcccgtacagtggaaagcaaatggcaaaagaacatttgaaccacgaagcctctgatatgcagcaccaaactcaagtttagacaaggagaacgcatggcccaaatgtagcaagccattcatgtaaggatatggaaagttgccaaagaacttttccccagggcccggaggtttattcccaggttcagcctcaaaaaccttgctctcctcccaccatttttgagcatctgactggatcttgagtaaaatatctctccgagcaaaacttctgcctccatcaggatttgatgacattttcctaatcaatcaacaaaaaacaagtggttaaggctttttgtttaataaaattgaactcagtccagtacttaaacaatgtttctacacaaacaagaataactaaccaactcatcaagcacacataaaaaaataagtttttaatgaaccattgttatgcaataagatttgattgaagtcttgtgctaaacatacctacaactcatgacagggcaagtcattgatatgaagctattatgtgatctaggataacaggatcataaatttataaccaaacaaacatcttcaagaagcgaaggggggggagaaagatcagaaagaattagttaatttacacacttaatagcttgaagagaagaaaattcacactaactcaagtgttccataaacctaaagactaggtggatcatgcatcctatggatactacagcatatccacaattccacataataccaaggcagacaaatgatggaaagaagaaatccacctccaggaaataaagtgtgaaaaatacacttcctaccaacggctcaccataacaaaaggaaaattttaggggggttttttccctagaaatgctcatgtaaaactacacgaggaagtagatccccaacaatataacgcaacccagtgacataagcagagaatcaacatacactaaacttccactcttgatcagctacgacgattaactaaaaatcttatcggaaaaacgacgaaccacattgagtaatgagcactctgcccaaagccacacgaaccaatacggaaaataatcaatccaccccctatcaactaaaacggcatgataaaaactaaaatccccaacactgatgtgctaacccacccacccatccagacccctccccgacccgtctacacaaggagcagagcacaaaccgcacagcaaattgcatagcatcaacgagaaaacaaatttccgagcagcagctctgcaaagggggaggcgcgggggatgggatcgatcggccggtcggtacctgacgacggcggcggcggcggcggcggcgcgcaggcgggggagcagcagccgcagcctcagcccggagagcaagttgggagccagcagcagcaggaggaagaggagaaggcggcggcggcggattctttctgcaggggattaaagccgattagggcatatgcttgggaacgacgtgggctttgacggctttgtgaaactaatgggccgagcttcaagtgaagcctctaatgggccatgctcatagagggcctgtctgcgttcgttctcctaagttgggatagcattccctccgcacgaaaaatagagcgacctattttcttataattaattaaacatttatttttaaaaaaattattaatatgattttttaaaaaaacatctttcaatatataaacttttttttacaaaaaaactgtaccgtttagcagtttggaaagcgttgcgcggaaaacgagacggaggacttgggaacagctagaacgagcacagccttaagtatgtactccctccgtcccaaaataaatgcagttttgcactattcatgttcaacgtttgatcgttcgtcttatttaaaaattttgtatgattagtattttttattgctattagatgttaaaacataaatagtactttatgtgtgactaaatatttttaaatttttcacaaagttttcaaataagatgtacgatcaaacgttgggcacagatattatccagtcaagtccatcggaaattcgatgtcttaggtacggccaactccatttttcgtacacatgttttccaaactaacggtggtttctttaaaatagatatgaggaaagttgttttaaaaactatacagcatttaattatttttttaaaataaataaatacttaattaattatgtgctaatttattgttttgttttgtgtgccggaaagatcctattccaaagtcggatgagtaaggatcattggtctcgtaggtggtagctgatcgcgttgtaaggtgaatgactctggatcgaggctgaatctttgcatgaggagaatgattacaacagactcaatccgaactgttcatcttttttttatgacatcatgaatccatggtgctaatcctcacacttagggaggtacattgcaatttgcaatgctcattctgtgcctcccatttctacaacgatcttgcccgtggcatggccttccatgctcttagcccaagcctcctgtgctctgctcagagggtacttggaatctatggtggtcttgagcttcccttgcttggccatgtcgaccagccactccatctcctccttcttgggcatcaggatcagcggcacgagcctcttcttggagaaggtcaccctgtgcaggaacgacctgacggtggcggcgacccccggcgtgaggtcgaccacgacgccgccggcgtcggccagggcgtccctgaacaccggccacggcgccggcggcgcgcagtgcgccaccgcgtcgtacctcctgcccgacgggctccgcagcgcggcgccgtcgggggtcctgtagtcgagcgcctcgtcggcgccgaggccgtcgcggacgaaggcgaggttgcgggcgccgcaggtggccgtgacgtggaggccggcgagcttggcgagctgaacggcgtagtggcccacgccgcccgacgccgcggtgaccagcacgttcttggggccgccggcggcggcggcggcgtcggcgtccgcgtcgaacctgactccggccgccttcagctgctggagcgcggagcccgcggccgccggcaaggtggcgccatcggccgcggacacctcgggcggcctcgccaccgtgagcgacgccggcgccaccgcgtactcggcgagcccgccgcagttctgccacggcgagacagatcgtcaaggcgtgcgaatcgagacgaaatggcttacaacgctgaagaagataatatatagggtggaaactacgtattaaacttgcaaattaccgttaaatcaaaaaataggtgtatttgtccatgtcatcacgagtaaaaattttactcgcgggttcccaggttcacccatactcatggtaacatgaacgaatatcagacattaatttttcaatccaacgatagtttccactgtatttgtagtatggactaaatatttttccctgaagaagatgctcaccgggaagctcatggaaacgaccttgtctcccggcttgaagccgctcacgccgccgccgagctccaccacctcgccggatagatcaccaactgttcgaccatggcaagagttcatggattagtctgaactttaaaagtggcatctgttaacagttgctcagtaatcagtatgcatctcgttcaacattttcaatagcttcttctacaaaatcaatgagtagttagagtacttgatggtgatttacaggagtaaatatcaatgccattttgttcttgaggaaatactccatccgtttcttaataattgacattttttactttctcgttgaccattaactacctttaaattattagaccaaagtgaacataagttactacacgctacttcgagtatcttagccaactactactgccgcgttgttgagcatccgaccatttcccaatcacgccgttttcgtgatgtaatgaactccgaaaagcaatcaaagggaaggaaaaggacgaaaatgtacatgaaaatgaagtgaaaggtagccgaatacgaaagggaagcgaggaagaataatgtcctcatttgcacgtacagatagcgatcgcattcttcttcttcttttttttgcagtcttaaacatacttgtatggacaaatcttcagatttattaaaaagaaataaatgtatcttacgattttctcatggaaaaaaagcattaggcgtcacccatctttagccaactgaagtactgaattagcaactctttcatactgttatacggaagaaaaggttgtggcttgatttcttgtgtagctgaacatgtatcagtcaaaaaaattcagaagaagagcatagattgttgacacctgacaggagtacttacatatcaaaattgccaggcaaaactgaaattcagttactactccctccgttttacaatgtaagtcattctagcatt

SEQ ID NO: 5850 - DNA, 9914 bp, Oryza sativa
atgggaaatgctagaatgacttacattgtgaaacggaagaagtaattaagatgcagtacggtgagatacgcgactttcagccgtcaatttgttcaggtttgtatctgaatttctgaagccaatgtcctgcgactgggagaagacagatactggtactagtactatatctaacctggaatgaaggggaatttcttgggcaggaagaggcggagcatccccttctgaatcttccagtcgatggggttgatgctcgccgcctccatcttgatcagcaactccccttccttcggcgccgggatcggcacttccacatgctgaaaatttgaaaatccaccagcagcaatctcatcagaattcagaaacaaacacgcagcatatgttcagttcttgtgaactgtaattatcagttggtgatgctggttttttttaccttgaggccttctggtcctccgccgtacttatcgtactgcacagctctcatcgtctttggagcagcgtcggcagcggcagccatggctgagacggagagcacgcaacaccgagagagagagagagagagagaggagatggaaaagctggtgattttggtggtttgtgtggcgatgttgatgttgatatggttggtgtcgtggatggaagtgagccgcttctgtagcatagcaccggcaaatatcagcctcgcgacaacgaacccgcgctgtaaagtttgcctggttgattaccaatatattcctttcgttaaaaaaatactaacctggagtatataagataagatataacctagtataataaatctggatataaacatgatcaaattaaagttagtattttttggaacgagggaatatgcatctcgattgttcaccaccgtgggtgtccatttcgggttgctctgaaagcatgatagtatatggttccgagatgcatggattgtttgttatttgttcatgtcagactaaaaaatatataaataaagctgaatctgaaatcttgagtgcagcaggagattgttgcggatcaatgcatcgatggagttctaaaaacagaacaaaaaaacaccaataacaccaatggacctccggcagttgtcagagcatcaccaacagtctatctattctatctccaatcctatttttttgggattttggttttaaaaaactgatccaacatattcccaaaagagctctggacgttttggagttaccatctccaattttctcggtacgtgtatttgagggcgagagaacgactcccaatcccctccttccacgcatttctcccctccttccgtgtttctcctctccttcccgcgtcggggcgatctccttcggcgcacgggaaaggaaaaaaattagaatttctgttggtagtttaatagaagggcccacttttagttttggggattgaatttaggctatctcttggaggaatgggttttttaaccacctattttcagtttaggaaacccaaaaattaaattttggggatagattattggtagactgttggtgatgctctaaagttcgctatcaccaaaatacttcctccttccctaaatgtttgacgccgttgacttttttaaacatgtttgaccgtttgtcttattcaaaaaatttaagcaattattaattcttttcctatcatttgattcattgttaaatgtactactattactcaagtttttgaataatattcacaaaaatttttgaatgagacgaacggtcaaacatgtttaaaaaaatcaatggcgtcaaacatttagggaatgagggagtaaatgaacaagccacttttcaagtgtcattttaaaatatataatttcctgatagtagggtcgcatggtcacaggtatgcgttcccaaggagtacggtggactcggtgtccctgacttagagaggatgggaattgctctaagggcgcgttggacctggttgcagcgagtttcaccagagaaaccttggctgggtctcaacatcccgtcctcgccgaaggagcgaagcttcgtcgccgcctccattttgtgctctgtggggaacggcgtgaaggccttgttctgggaggatagttggctgcagggagaatccatccgctgcaaggcgccggctctctatgctattatcccggctcgcattcgcaaaataagaatggtcacataagctctgtctgataggcggtggatcaaggacatctccggtgcccttggtattcaagccattcttgagtatttatcctagtggcaagacattcgtgcagtgcacctcatggaccagcccgatgtgctttcttggagatgggagggtcgggcgattactcttcccgatcggcttatcaagcgttgttcctagggagaacctggttccagtctgccccgatctggaaatctctcactccacctcgatgccggtacttcgtctggttagtggtgcttaacaggtgctggacgggtgatcgattgaggaggcgcgggctgccacaccccgatcgatgtgtcctctgcgatcaatgcgatgaaatcatcgattatctcctggtcgcttgcccagagtcccgccaactgtggtggatggcactgagggccattggacaaacaagttctctgccgatgaacgaagtctccttccacctctggctttgcgatagccgaaagagattgaccaaggcagctcggcatggtttcgacaccatcgcaactctcattgcctggacgatctggaaagagaggaataacagggttttcaatcagcagcaaaagacttgggcggaagtggcaagggcaatggccgccgaggcggaactctagagacttgcgcgagcagccattccggagttcttgccacagccaattgtcgagaggtcgcaacatcggttaggagaatagatctttttgggcaattgtattcctgcatcccgtccccttcacttcttgtattttctgtaattaaacttttttccatccttaatacaaagatgcgctctttgcgtattccattttttaatttcctgataaacttgtgaaacaaaggtgttctacaataaatcgtgggcaacagtgatcacatgattgaaacattaggttcaatctttcggaggtactcgtaaagatagagtgtgcgtgtgtgtttataggagtgagtgcacgcgtgtcatgaacgtttacgtttgtaccgtgtttctttaaaaaacattattttcatacaataacagttaaccgtgcgctgccactgaacatactgttccaacatccaacggtatctccctgcgtcgtgctcattcttcttctccgattttgacgacgaccttgccggtggcgtcgctcagcgggtggcacgagtcgacggcgggcttgagcttcccctgcctcgccatggccaccaggagctccatgtccgccttgctcggcgagaacatgaacggcgtcagcctcttcttggagaaggtcaccctgtgcagcagcgcggtggccaaggccgcgggggaaggcgtgatgtcgacgacgacgccgccggtgtcgccttcggcgaggacgcggtcgaacacctgccaggggaggtgcggcgcgcagtgcaccacggcgtcgtacctcctgcccgacgggctccggagcgcggcgccgtccggggtggcgtagtcgagcgcctcgtcggcgccgagctcgccggcaatgagggcgaggttgcgcgcgccgcaggtggccgtgacccggtggccgcccagcctggcgagctgcaccgcgaagtggccgacgccgccggacgccgcggtgaccaggacgttcttgggcggcggcgcgtcgtccaggccggcccccgcggccctcagcgcctgcagcgcggtcaccgccgcgagcggcaggcacgcgccctccgccgcggacacctccggcggccgctccaccgtgagcgacgcctgcgccaccgcgtactcggcgaagccgccgccactctgctcggataaatcacactcaaaaactgaactcaactcgatcgatcaaaagaagagaaaaaaaagagaaagaaatcaaacttctatcgtaccgggaaattgatggcgatgaccttgtcgccgagctcgaacctgcgcacgccgccgccgaccgccgcgacttttccggcgagatcgcacgctgctcgaccacgtatacacattagcgatcactagctcctgttattcttttagcttgctagctagtgcatcctactatataaaaaaaaaacaaatcctagctacgaatatagacacgcatatgtccaaattcatagctgttcttgaatcttaaaattttacttgctagctagtgcatactgcatactactatatatattaaaaaaagcaaatcctagctataaatctagacataactgttcttgaatcttgaaatcttaattgctagtacctggaattgatgggaacttccatggcaggaatggccggagcatccccttctgaatcttccagtcgatggggttgatgctcgccgcctccatcttgatcagcacctcgcctttcttcggcgacgggatcggcacctccacatgctgaacacaaacacatcagaaaaccagagaagcagaagctaagctgggagtgggagtgaaactcgcaggcgtatgtaaccttgagcccttcggctccgccgccgtagccgtcgtactggacggcgcgcatcgtcgtcgcggagggaggaggagacggcgtcgtggccatggccgccgacgcgcgcggtgtgtgcgtttggtgcgccaatgtcggcgtctgcgtctggatatgtacgcacgacggcgtccgacccgtggtggtggtggtggacgactggacgtgcaccgtccacgtcggaatctaaatagcatgtgcaccggagagggattgatgaacaatccactcgtttattgtaagttgaccaaaattaataagatgattaatacgaaatatagcgttccacagacagacaggttgaaaattcaacttgtataaattgcgagaatgctcaacgtcgggcgcgcgggggaggggaaaaaaatcggtcgctcccccctccccccatcacgtgcccacctggtcccaccacatatcccgtgtccccacctgtcacttatccatataaaacaaatcacctacatattttggaaaccatctattaaggaaatttggtttgttttttttcataaaaaaatgtttcacctagtgtattcgtactgtttcactatatataaacccaatgttgcagtgaagtgaaatattgcattgcaacaaaaaaacccacatatttttaaaaccccatattaagagaattcgttttattttttttccaccgaaaaatgtttcacctagtgtacttataatattttactatgtatggatcaaatgttgcagtgaactgaaatattctttcgctatttactggaacattgtttttatataagataaaacaacacccgatttaaacgagtgaaacattttcgatctacttagtgaaacaattccgatatatatagcggaacattgtgcaacattttaaaataattcaataataagcttaaaaaaattcgtcggaatatatccatgtgtggtcttgttttgaatatttaattgcaacgaatttaatggtgcaatcggatcatgatttggataagtaatttaagagaaaaatcagtttaaagtagttttgcacgtaaatcgggtgttgacggtagcgcccgatttttctccaaaccgatcgggcgcctgactcgtagactcatcctataaattatgacaaaattaacttaaaatatatgtatattagtacaagttgaatttaaaagttgcatgtttgtgtactaatttattacacactaaggacacataagagaaaacgagttgagggttgaaaactcacaaaaatcaaatctaaagtttaaactcaactttatttgaatagtaacgtgacactatttacctgaattttgtttttttctctcaaatgaagttgagtttggtgagaatttattttacatctacatttatctatattattttaaatgaacttacaaaacatattttttatgaattttcaaaacttttagacatgattttcacatttctaacacttgatatttctccttacacattaacctatcctgtccgttttttttttactatttagttgacatgaataatcgaatagatatctacccagatgattaaaagagttccgtgcacgttgacatacatttttcttgcaatgacttttactgaataatttaccgacggttggagagtttagattgggttcacctcatgtaaaattaggagtaaatttctcgaagatatttacgctgtgttaagatgcattcgtgaaaatttctacagtgtcacattggatatacggacacagtctaataacaaaacaaattacataattcgtcagtaaaccgcgagatgaatttattaaacctagttaatccattgttagcaaatatttaatgtagcacaatattatcaaataatggaacaatcaggcttaaaagattcgtattgtcgcaatttgtgcaattagttttttagcctatatttaatacttcattcaagcgttcgatatgacagggtgaaaaattttagtgtgagatctaaacatggccttaatttatcgtcataattaaatgaatataatccgtagtaataatcggcccaacaatccaaatgaagtaaaaaggagcccttcccaaggaaacaaaagcaatgataatcccctgggccatcctggactcctgatgttcggcgccaacacgatctcctcctcctccctcctcgtcgcaggatttgccaataaatagcaagagagatcgatagattagatcgaagtagaacagcggagaaggagagtaggagcgacggcgaccgcgcggagttgattcgattccgggtgtcgccgccgccggccatggggataacgctcgagatgaaccgggtcatgcccacccggcggaggcggcagcgccgtcgccgccggcgaaaccgacaccgctgtaagctaagctccctcggcctcctcctccggcttatataacttgttcagattgttcttttgcaacaaagcggccatgcccgtgatggtgtttctatccgggctagtatgtttctttgtaggatttctttaaaaaaaaacctgttttcttttcatcagggggttaaacctagtgcattggttggtaacaagattaagtgttcctcattgtttttgtttgagtaggctaggtatccaaactggcgtctttctgaacaaattttaatctacaatttattttctcatgattggggggggggggggattgtatgagatgtactccctcccgtcccataaaaaccgaatctagatgggatgtgatatattctatatgtccagattcatagtaataaaatgtgtcatatccaataggattggttttttatgagacggagatagtttttttttttataacaacatgagatagttgattcgttggtgaaagagtgatgcagcctatcatagcatggggcacttaactgaacatggcaaccagagctgaaacttgtgacttgggtttaccgaattgtgagggtgaggagaggagtggggaatttagggattgggaaagaaggatgtgatttttcactgattcgtctgctccaatgtattgctgttcagttggatactttggagtgcaggagatacacactttggggagactgcggtatttacaaaattttgcgcctgcgcactatgaattgttcttttctcttagattgctacaagttggaaactcaattggcattcaaaagctggataacagaagaaaattttgatttccctgtgcttgtttgtgtgcttcgatttgtccgcttccttctgttattgtttgaattaactataaccatgcatgatgtgcttgcagatagatcaattgctaaattgggtaaaaggaaattctcaccctcccaacaagatgatgattctcagggtgctaaaagaatgaaaaattcagggatgttgctttcaaaggtatgacatagaaaatgaatgatttacatttcaagggaatatcactatgactgctccaacacagattagtacacccgttacgcttgtttcattggtatgccatggtctaggtccactatttgctgtttattcttaccagaatcctctagatgcaagttgttcttagcctattccacatcgagcacattccatcttcattctactaaagaaagaacttttccccccaaaagcaagactcatatactatttacctacgaaggatatttacttgaattcgtcggaaattttcatactaatgtgcatttcattcttatatttcactcatgctacaatttttaggacaccatgccagaaggcctgcctaaattatatttcaacgaattacactgttagagcgaaacaattatatcgaatgcttaatttaggcaccacaattacattctaatgctcaatatgcctatgtcatgcagtgtacttgtgcaatcatgagtgaatacctggggtagagatagaatgataccccatatggttttgttctgctttttcacccaatcaaagtttatcacaatcacaatatccaaactttatcccatgatggtgtgtgcaggacatctggcgccgtatacattgcctgatgccaatgcgagatgcggctcgtgttgcatgtgtgtctcgtgcctttctaaattcctggttatgttatccaaacctcacctttaacaaggatacgctgggattggatgaacatgtttgtgagacagatttcatcagcaaagttgaccacattcttaaaagacactcgggcacttgtgtgaagacattcaagcttgaagtcccgtatgagctagatgtctgtgaccatgttgatcgttggcttcaatttgctattacaccagcgatcgaagaactcactcttacgctgtatggaactgctcaaaagtacaatttcccatgctcacttctatctgatgggatggcagattctattcggattcttgatcttggccattgcgccttctgtcccacaatcgaacctggttcatggagaagccttaaaaggctatgtttgtcttttgtgcgtatcacggaggatgatttagggtgccttcttttgaattcgttggctctcgaggggatggaactcaggcattgcgatgagatagttagcctgaagataccttgcacactgcagcagctcagctatattacggtttcagaatgcagcagggtgcgagttatagagaacaaagctccaaatgtatccagtttttactttactggaaacaaggtaaaactttcacttggagagtggttgcaagtgaagaaactaaatatgcgcagctcacgcattgtccgttatgcccgtgccactcttccatccatgatgccaaatgttgaaactctttccataggttcgctccgtgaggtatacaccaacactttagatgattatatagactagtttgttatccatattatagtactcataccttggagtttggttaatctgagacatctttatgcaggtgttcaacacaccaatgctacctaccaaattcccctacctgaagtacttgagtatttctctcattggattgaccaattcgccagcttatgattatctctctctagtttcctttcttgctgcttctcctttattggagactttcttcttggctgtaagatgctattcacttttcatttcatcctgcaaaactatctactttggtgaaagcactaattcaagtatattattacttttcatcttcagatatctcagcaacaagcagaacaggaatcgatatttggaagttcctcacttatgaggcagattccggagcaccgatatgagtacctcaagagtgtgacgatcaacggtttctgctccgcgaagag

SEQ ID NO: 5851 - DNA, 9568 bp, Oryza sativa
  unsure (1)..(9568): unsure at all n locations
aattcctgcagcccaaattattggggtcgttaaaagtttagttggagtatgctttcttggttacaatctttgtaagacttttgtggtgttcttataatatataaaatataactggtgggcgaatgcctgtcagttttcctggtcaaaaaaaaggtgagtgtttagttcttcagtaatttatcagcaacaaagcgggctgctaatagtgggtaactgtgctgtaaagttgtactgtaaaatatagattttgaatgacctggagttcggttggatgtgttgtgactacaatacttgtatgggtaaatttggctaaaatgttaaatgttgctcacttttgtacttccatttgataatgctgtgatctactgattgggtaacacggatgtgcagtaaggatttacaaattgcccattcatgaaaattagatttacataatgccaacaagaagcaacatgaacagtataacagatttaggacaaatgtggtaacttgtaatgtgcatgtatccaacaaaaatactaccacaaggccagaaacacaaatctgattccctgttagttcccccgcgaagctcccagttatacgatgattgagtggatttcacttgttagtcggtgtaagtttagttaaagacgtcacgttagtgtccgtgtgacatgccacatcgaatttcagaccaactaggataaccacataaaaccacaaaccaacaaggatctaaaaatataaccatatgcacaaggaacacaccatgcattttgtttttatatttttttaaatcctgcagggtgtatttgtattaaaggagaaggaaacactgtacaatagccttagtgcctaggaggttgcatcaagaaaggaaaaaaagaaagcgggtgaggcatgatgcagcttaaaaaaaaagagacgtgtgggtcttgtgactaggctaattacgtattgtcggttgcgctttcataattgtttggcattaggcattgaatgccctttgccctgcctgcatgccataaccaaatctcatcggtcactctatcaatgatttcgtgcggcagtgtctctatgtaactatgttccttaaaacctctctatttctctctttccaaatttcccaagagagtaggatgaggctcgatttgatgccctttcttttctccttagccatcgcacgaacggtttaagtccaccagttctcgagtagtgtcgtgtgaggccaattttgcggctgtagccgagggatgtctagccttgtcgatatggctttttttatttataaataaactaacaagtactggcagtatttactaccatgacaaccatgaattttttcttcttacaagagagagagggcttcgtgctatcgacatgttggcaaagagacggggtactttatattgatgtcctaatcgattgcccatattttctattaagataaaacagtttattaccataagaattaatttataggtaaaacttaaaaaatacatgaaaataccttaaaatcaactttaaaattaaaatttaaattttaacctttgttttgatttattaagacagccacatgggaggggactctgagaagataagaggaaaaaccgaaaaagaccagtattttcctggtcgagttgggtttcgtcacgctccgcttccccgacggcgcggcgccaacacgagatctccttctgctccgccccccgcgattcttcgggtgcgcgctctcgattcccttgcctcgatcgtcgcgcggcgccccgccatgggcatgctcctgctgagccggctcatgcccacccggcggccgcgccgtcgccggccacacaaatcccgccgcagtaagcgcttctaattgccctctcagttgttcccctcaaccctgaaactcattagcattataacgcaaaagtttggttaatggagacagatcgattggatttctctatgctcgtttgtgtgcttcgattttttatttttatttttgtttttattttcttctgttaatgcctgaatttatctgtaaccgcgcaggcggattgattgctaaatcggctaaaaggaagcgctcacactgccagcaagatgatgatgattctcagggtggtaaaaggatgagaaattcggtgccaacccttccagaggtatggcatgtaatgttgatataatcgaatagttatactgaaagtaaataccactatcactactctaacacagattggtacacctgctgtgcctaaagaacaaaagttatgaacagatgagcaaaactttcagtgctatatttacattatcaattatagtcttactgcattagtagctttgttttcttctagatatcgtggctttcgctctcgagctgcaatttgagtccttgataatatggaacaattttggagtaaacttcctagatctatctccctaattagcagtagctagagcatatcccttatttactcaaattcctcagaacttagagcttttcaaattaatatgtacagagggccttgctaatgtttttcagaaatctacagagggcaaatactacttaactaaattatattccaactaacaacactgtcaataaaagataactctatgcaatgtttcatttgcgtgccattgcattctaatgcatgcatagtacgcatatgtaatttagtgcacattgtgcaatcttgcacatagcacctgggttgaaaaagaatgatgccccatatggttctattttcccctctaatcaaataacccaatccattgaaactctatttttccccctctaatcaaataacccaatccattgaaactcacattgcaatgttgaaattttatcccatgatgcaggacatctggtgtcatatacattccctgatgccaatgcgagatgctgctcgtgttgcatgtgtgtctcgtgcctttcttagttcctggagatgtcatcccaacctcacctttaacgagcgtacactgggattagatgaatatgtttttgaaacagatttcatcagcaaagttgaccacattcttgaaaaacactctggcattggagtgaagacattcaaccttcaagtcccctatgagctagatgtgtgtgatcatgtcgatcattggcttcagtttgctattacaccacggattgaagaactcaatcttatgctgtatggaaccgtgcaagagtacaacttcccatgctcacttctatctgatgggattgcaaattatattcggtttcttgatcttggccattgcgccttccgtcccacagtcgagcttggttcatggagaagccttaaaaggctatgtttgtcttttgtgcatatcaccggggatgagttagggtgtgttctttctaatttgtttgctctggagtggttggaactcatatattgtgataagatagctagcctgaagataccttgcacactgcagcagctcagctaccttaaggtttcagaatgcagcaggatgcgagttatagagagcaaagctccaaaagtatccaatttttacttcactggatacaaggtaaaactttcacttggagaatggttgcgagtgaaggaactatgtatgctcagttcacaccttgtctgttatgcctgtgccaatcttccatccatgatgtcaaatcttgaaactctttctatatgttcactcgatgaggtattacacaccaacagtttagatgattatatagactattgttatgcatattatagtattcatgcattggactttgattaatccgatacatctttatgcaggtggtcaacacaccaatgctaactaccaaattcctctacctgaagtacttgagtatttctctctctggattgactgtttcgccgtcttatgattatttttctctggtttcctttcttgatgcttctcctttcttggagactttcttcttggctgtaagattccgttcactgttcatttcatcctgtaaaactatctagtgactatggcaaaagcatcaattgatgtatattatttttctcatctctagatatctaaggaacaaatgaagcgtgaatcgaaattcagagattcctcacatatgaggcagattcaagaacaccgtcatgagcacctcaaaagcgtgacgattattggtttctgctccgcgaagagcttggttgagctaacatgtcatatcctcgagaacgcagtatcacttgagtgccttacactgaacacaacccttggctttgctagccgttctgaacacagtcctggtacatgctttccaatgggcaaggctgttctcatgggagtacctaaggctctctcagctatccagacatacattgtggggaaagttccctccacagttagattaaatgttatggaaccatgcaacctgtgcaatggtattgggcattaggtgttatccgaattgtccattgtgtaactcttctgatgaaccattctctgtttcctaaattatcagactcgttaaatgctaaattgtgtagttatcaacacgagtggtttgttctccagtaatttttcagtaacagagtggtctgctaatagggtgtattgctaaactgctaaagtgtgcgctgtaagttgttagtaaaaatatagagttatcctgaaggttggatgtgttgtgttgtgcctacaaaattagtatgggtaaatttggctgaatttttttcgtgaatacgcaaggagtgcatttttgtattaaggagtaaaaagtctatacaacagaacctaagagcagcaggggacaggagaactggacacgggggaactaaagcctaatctcaggggacaggagaactggacacgggggaactaaagcctaatctcagggtgcgacctaagagctcctagctactagaggcgaatcgtcggtacagcagcgttggctaaccgccacaacgccgcctcattagccattcctctggccacctgcacccaacttctttgttgctggttgaagactcggttgttttgttctttccaaatagaccatgtcgcaagtgctacgatggtgtcaaagccacgccgaaggggttttgcaatctgctccctgctgtcgcacaaccaaacgtggaaagagtcttcattaatgggcaagcattcaggatgccctatggctgagagaagcatccacaagagttggcacgattcggggcaaccgaccaagatatgatcaatactttcctcttgttgatcgcagagaacgcaaaggtttggatgaggaaaacctttgggtcacagtctatcaaccgtccagcaacgcttgaggcgaccaaccagaggaaatattgacaacgcaagcgacctccagattagcaccgactgaaataggatccgaccgagaaacagggcttgataggctgaactagaggagtaaacaccggagctctcccacttccgaacgaaacgatctggccgatcctcaagctggaacgactgcaccctcgaccaaagaaggaggtagtctaggatggggagtcctactcggcgcgtgtgcgccaagggcgcacacgacccccctccttttccacgctaaggcagttagtaatctattagtataattacatttagagataaatgacggtagtagttagaattttttttgtgagatttttttcaattaacaaattcaaaatgaaatttatatctaaagtcaaattttcaaaattttaaacccatatttgaaaactttcaactcgaaatttgaattttttaagtcaaattatgaaaactttcaacttttcatgttaaatctgaaaaactttcaactcaactttgaaaacttttaacccagatttgaaaactttcaactcgagatttgaaaactttcaacccagatttaaaaacttttaactcgagatttgaaaactttcaactcagattttgaaaactttcaacctagatttgaaaactttcaactcgagatttaaaaactttcaactcaaaatttaaatttgagagaaaaattttggaaactttcaactcagattcgaaaactttcaactcgagatttgaaattttcaaatccagatttgaaaattttcaagtcaagatttaaaaactttcaaatcaataacatttgaaaaaacacgtgtgctaaagatttaaaaaagtaatctgaaaaaaactgcaaaaaaggaaaaaaaacgcgaaaaagaaaacggaaaaaccggcatgaaggaggggaaaagaaaaaaggtgaaaaaaagggaaaaaccggcgtgtggggaggtgacagctggcgcgtgcgcgaattagcaaatccggtctaggatagcctgtgtcctcagggcaccctggatatcatggatccatcttctgttgagcagaccttccaccaccattctgcggcaccagacgcgcactggaacacagtcatacaaagccaacgcaagcgagcgaatgcacgagccatccagccagcgatcttcccaaaaccaaatcaaatccccattgcccacctgacaggaaatcgaggctgcaacaaagataagttccttctgtcaactcgggatggacagaccttgccaaggtttatcctcagcagtgcgctgcgaccagatcccacgagagcgaagagccactcccatgagttccaagttagcacacccaggctgccataatcagttggggagcaaaccttggcccaggtgaccctgcaatgtccacctcgaggggaggccctgcccccccaaaggaagccatgtcaaaatttgtcgatccctttgatcacccattttggaggatcaatggtgatgagaaagtagatgtgaattgagctcagtaccgatttaaccatggtaatgtgcccaatcggtgccatctgttcagcctttcaaagaggtaagcggttggccactttgtcgacaaggggttggagatctttcctttcttagctcgaagatggatagaggcagccccaaatatttgcacgggaacaaagcaacaggacaaggaagttccctcaccaccgaactgagaatttcctcggagcattgaatcggcagagcagtgcatttggcaaaggttgcctttaggctagaggcttccccgaaggtgttcaagatctcgccttgatctcttccactgaaggttggataaaagcgaccacatttggctgaaatgttagatgttgctaccgatgtgggtcttgctccgttgcattttttgtacttactacatctgataatgctgcaatcttctcattgggtggtacaatgaagattgctaaaaagaccctccatttttggctgcaatctatttgcaactgctgcctttactatttcaatatgactgactaataattgatcgaaatctatcaggactgtcaatgcattactgatcactgataatatatatgtggtccttcaacctcggggtttagagggccttgggaggcgaggcggcggggacgctaccggagccgtgggaatggaagctcagcgatggcgaatatgacggcagaagagagagggggagacgtatctcacctacgccattgacggcttttttttagccgggccaaaggttggacccaaggaaggacttggagtcaatggttttaagaaggaagaggtaaatatttcccctggtgagcgcgctcgacaagggtcgaacccgggccagcggggtgcatgccagcgacccctgccactgcgctactagcgcatctcgttgacggctttcggccggccaccgaggccgagcgtggtgcagggcggcgccggcgagcattcgtgcggttgtgcgtggggaggtgtaatggcaatctcgaggccatactggccgtctaaaaaattgacttgagttttttttttctgccacgagaattagacccttcgaacaatgataaataattcaacgaaaacaggttaagatgttaccattctttaaactgcagttacgagtcgatgttatgctatcattcaacgaaaacaagtttgtatttgatatactcctttttttcattagctaaacgagcaaatcttacagaagtactgcaaggaaatgaatacagtaaaatccagtgatgtgatgttgcaacaatatattaccatcaatttctatcgcaagtggagtttaattaggcagctagctaacatctcaggtattaaccaaagatttatttgtggacgaagacactaacttatgaaaaaaaaaacacaaactggaactacaatactcccaaatgccaatcagaactaacattagagtcatcagaacttgtcctactctagcttcagtcacaaccttgagatcttcttcaaataaatacgatgtgcgaagaacatagcacttcaaaacctcaccaaggaaaaaaaaacatagcacttcaaaaagggaatttagtagattcttgtccagacaatttttttttatgaaattgtcaaaccaacttcatttcaagatttacaaactgccggcagcaagcaatggagaacagtataatagatttgggacaaatgtggacatgtggtaatttgtaatgtgcatgcatccaacaaaaatactgccaaaggttagaagcataactgagtccctgcacagatcaccagcaaacgccccaatttacttttgcaacttcacaatgaaaacaaattttgagccacttactcatagcaaagggcattgatctgcaattaaaggatgatgagcctaaaccatggaaacagctagatcaacaaacatattcttaaaccacacaattgcccttaaatgttacagtaatacagctacagacactgctgcgttaattaactttcaacaggattcacattttgataaataaaaccaactgctacaagtaaagtttctgggttaattagcagttattcataagggtaggaatggacacacttccatcaaaatcattaaccgagtatgacaacttttggatgcaagcagagtgctaactgctaagaagttgtaatcagggcgtgatgttttcataggagaaaacatatcctccattgctggagtacaaaactggattaccttccaaacttttcccataagacataacaaaaacccatgaacccttcccaacagatcattatttaacgaaccccagcagattagtatttagcatgacaagaaaatggaattcagtagctgcgaatggggcacacaagaacaagctggtccaatggcgtattcactgatcctaattaagaggcacaacctgggggtcaaagctactacaacaatgcactaccactaacaaccatatatgctccaatgcatctacacctttcagtcagtattggtcacaagtgagacaatgcttatcacaattaccaattttcagtatagtatggaactatcaatcagaagttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5852 - DNA, 9295 bp, Oryza sativa
  unsure (1)..(9295): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagtaggtgctcaaaaacatatttcaggcactcattctatagtctaaagaaataaaataataacgccactgcatataaatgtggataaattgtagaatatcttgacatcttgactcagttggaaagtggtcagcattttttttactttttaggataagtggaaaatggctgagggcaaaacgggcagagagaaaatagaaatgtaaacattttgcaaaaagaccccaacgtgacaaatgctagagatgcgctctttaacagtggtgattcactactcattgggagtgggtggcatatcctacagtagtacagtgccgaggtgacaatcgttgattctcactctcctatcaggtcttgctttcagaaactactaataacctaattaacaacttctgttttaagtggagtagatggcgattccatgctaaaattaaaaaaaaaagtgctatacaaaaatgagaacaactctctctcagaaattctaatctccttccgatgacatcttctcactagcttctcttcttcaaaaaactggagaatgcggcgcagttgcttagaggaaatctttaatgctttagccaaatcttcctctcggacccactggcgccgcctgcggtaaaaaagaagggtatcacaatttgtgcattgacactacatataattagttaacacgaaaaaagatgaatattgaaacgagagaaaaaaatgttttagagagagagagggggaagataatagatttaagactaaattctttgtgatcataattggacaattgaagcagcttctccaattgctgatttccatctctagtaatcaaagttttcttatttacgaaaaggcaagggctctgcctcatgcattaaataaaggaagaagagtcatagtaagagagagtgaggagtggaagccgccttctcacacaagcccgagcatatgcacgctaggaaaaactcaatagacttgacagatgtacactccggggtgcaaaagataggattaaaggaggagaaaaaaagaatacagaggcaagggcctagtagtcaaaactgcacgttcaaaactgagcaagcagcattataaaaataaaatgtgggacatcaacgagtaccaagtaacactacaatatgaggaggcaaaatgttctctcagcagttccacatggataatgagtcataagaaatcataaaggagtactcagtatatttgtttcataatgttgtgtacaaacttgatccagttggtgatagtgttgattaaccattatttgccatagatttgataaacgacaaaccatgagtagcagttactccaaaacagtccctcagggatcataacaaaattgctcatcactcactctaaaaaaaatcttcaaatgcttgtttgagcacttaacgggacgttgtagccaaccagcaagaaacgaaataatcaatttaaccttgaaaaataaatcctagaccatgccataaatttgaaatgcacaggcacaaaaggtctgcattaattatctcggtcactgtaaattctccttgcctaaaatcacaagaggccaagagggagcagtattcaacatggaggtttcctcattggcactagcgagtagaaactagcatcatcaatcaatcaggtgagtgaaaccaacacaatagaacaggtcatgaaacatgtacagaaacacatgcaacagggcacattgatcattgatcagtgacagcaccgaggtcaggactttggttgaggatttaggtttggtctcacctggtgagggcgtcgaggacaacgacggcaagcccacagttgtcgccgcgagcggacttggggtctctggccagcgagacgttgtcgtagaatgcgcgcgccaccatcctcaccatcctgcaatgccagccaaaaattcccaaaccaaaaccagtaaaattacacctcccgcggatgccagctatcatcaatgcatcatggatacacggaggggagcacagcgggaggatccgcaccggttcaagggctccatggaggccatggcggcgacggcggcgatggcgagcggcggttggggtttcgcgggttttcgccgcgatcaggaggttttagccgctgcagcgcagggcgcaaggcttgagggcaaagaagaaagcagcgaccgcgccgagttggttgggttgggtttcgtttcgtttcgttctcgagtgtaccgactcgtgtgggtcggacccgagcccgacacgatccccctctcgttttgagcggtttggactcgaacccgactcgaccatctttcttcttctaaccttcttgtggtggaaggaaacacgggcgactgagcagctgagtccaacatcgccgggagagagatggcggagacatcgtcgccggcggccgccgcggcggcggcggcgcagaccgacgcggagagggaggaggcgctggaccggatgctgacgcggctggccctcgccgaagacgcgcggctcgcgccgctgctcgcccgcgtcctcccctacgccatcacctcgctcgcctcccccgccgcatccgtccgcaagctcgtaagtataccgttcctcaggtcctgaatctattgaagtttgtatgtgagacatatgtgtaggtgtcattattctgcttcggttggtttagttggtctcttggttggtgatgtttacaatgttcctgcttcaatttgatgaaattcgagcaacagtgcctattatactgttttagtgatttgttcatgtacacataatcttctaaacgacgtaattagagagactattgtgctttatgttgcaagaattacttgcatttgttactgtaacctgaaccagttcagagtagcagagtgccagtcctgttttccttcagttctttgcatgattctatagcataatttccatgtcaattagacaatggcatgtaatggaaaataataccatttttggactccattaggttatggaaattctcagccacattaacaaacgggtgaagcacaggcctgagatttcactgcccatgctggatttatggaggatttatactgaatctacttcctccacaatagtccggaatttttgcattgtttatattgagatggcatttgaacgtctgctaagtgaggtatcctattctgcttcgtttgtttctcattttctctaggctgttttaccttttctgcaaagccaacaacatgaagttaacattctgtaacaggacaagggaagcatagcacctgatcttttaatcaacatatcaaatgttacagagcagcatcagggaatcatcttgagacttgtggtgaaggtttgtcacaatttaattaagactgctgtccaccacagagtttacacgattacacatgatcagcaaaaatatgtacattggtttaaatggtttccattgaagaattcaaggaaaggatccggcaaaattatgtagtttactaggttacacatggactggcaacaaccaaatctcacccttccagtcaaaatcataaagttgatgcacatactaaattgatcattatcagcttttttctatcatcagcccatggcattgaatttagtcaagtctataatgatttttgataagttactcatagttttcttttcttcctttggtgtatctgcatcctaaaaagcttgctagtttttctctgtttttttaaatcttgttgtcaggctattggtgaatgtaacacacataaggtgggtgacaatgttgcttcaaaatatcaatccataagtggatctaatgatgatctagtcttcgctgacttctgttttcacacagtagtgtatcaaacaccacctcaagggtaggtttccttgctaaattaggtacaagtatgaaactttttttgatttatggagagttgactgctagtattcttcagtgttggatgcccggctggactttcggttgctcaatcagatcgtgttactggaaagcagccactaaaaggtgacacacttacatcaagaaaggtaatacagaaatgcatgtatcatttattcatgctatgcctgtgtatgcaatcatgtcagcatatacattcgcacattttaagtccttgagtatagtaactgcaccttcttcagttgaatttcacttgtgatatcttcagctaggaatcttgaacgtcattgaagctatgcagttggcaccagagattgtttaccctctttatttagctgctgcttcggataggtacttttttggaattatgtttacaatccactgaaatgtttgtacggatcattaatcatgcggatcattgtttcaatgaagtcaagagtcagttactaagagaggagaggagttattaaagcgcaaagcttcagctgtgaacctagaagattccaaccttatgaagaaactgttcacactgttcaatggtatggattaaggattttgtagcatgctaactcaagcaaatttatatttcaatataatactgtcactttgttcttatgtattgtcatttttgttgggtggcatatgttattctgtccttgaggtgactaaaatgcattgttgaaatccagttccttacataaagggcaaagctaaaattaaaattatctagtataactttgcctccacttcaaaatatatatagaaggctttatagttttttcgagctttattgttgcatggtcaaaagatgggtgcggatacctttgttgcccctcatcttcataactctagcaaggtccttttggtacagcacatgtctattccatgaacatatttcctctagcctagtcccgaagcagtaggtcattgggggtacccctccaacaagtttcatttaaaatatatcactcatgagaatttactgatcctttttacaccatcttctctcaccttgtaattataactaatgttctaactaactgttctcttccgtatttttaactgagataacaaggtcatgtcctctccttctcttgttttcatacccttcttaatccttgttcccatccaaagtaagccttacattttgtaaaggtttgtgtatgttagcaggccagcatttgcacattgcactctcctgtaccaacatgtacacaatgcttctctttattttgttttgtaaaaatctctttcttgtttttatcagtgcaaatctgaatatttgtggtttctcatggtatatgatagatactgttctcttttgcctcaggtactgcaagtgcagaaaatatagctgcagagctgaaagtcgccccagcacatagttcactgcgagtccgccttatgggtgttttctgccgatcgattgctgcagcaaacgcattcccgtacacacttcagtgcatctttggctgcatctatggtattctgtttatatatatttttactttgtgtatttattttagttttcttatttgttgtcatgaccaataaaatgaaattttaataagctgtgtattaacaaatgcactcttttactagttttgattatttacatcaccaaaccgcatctttaagtagtacatagaaactgatttggtatgtttgtcattttgtacaataatctttcttttaagcatcttttagagttttatggaatggtaggagctgcagaggatgatcttctgaaaaactattaatatcaaattaacaataatgtacagcatacattacaatagaatgataaaagataaaggtgggcctagaaatttatatctggaacaagtgaaagagttgaaagatatgggctagggttcatggaggataaacaccattaggaggatagcaaggtggcagcggctccctgggatgagaagtaggcatagactgggatgcagaacattgaggaaaatggattgatattttttcttgctaacagtgacatccttatatagaggtgctagagcccaaatgatagaaactaaataaaatcataccttggatatagccatctacttccatgaaatatctaacatagaaactaataatctttatccccaaatcaattgcgcagcccataacacatatatgcatgacttcctttaaagagggaaatgcaagatgagcactccatttgctttttaagtgtctatttctatgatatggaacacattctatgatatttcttgttatgttgcattcaattcattgctaaaactactcaattgacgtttcagcaaggcaataactcaacttcagcatgccatgtatcgttactaaactcatatttgtttctgctgtgtttctatgcctgaaggaaacgggactacttcaaggctgaagcagttagggatggagttcactgtctgggttttcaaacatgtaggtgcactttgtatgttttcagttcaccaacattgattagcttctagcattctttacttgtgctcttccaattttagctttttcacttggagcagttctgttcctttctgtcaaccttgtttcatggtctcaaacttttatcaattatcattgtttccttattgatttaggcagcaaatgaccagctaaagttaattggtccagtcattctcagtggaatattacgttcacttgatggttcttccactactgaagcaggttttgcacttgtcatcgactctacttgtttaggcatgcatgtgatttatcttcacattcctttgctttgaattacttgggttttaacacttctttgacttcctattttgccatgtcaaataagttgagaaacagtgaatgatttattgatttcctttatgtccagattcttccagtagggatattaaaatatttgcataccaggcaattggtttgcttgccactcgcatgcctaatttattcaggtatgcccttttcttactcttctgctttcttgcctcatgattcatttctgttatggagactgattttttctactttttatgaacattgcagcaacaaaactgacatggctatacgactctttactgctttaagattagaggagcaatctcttcgtttgacaattcaggaggcagctactgcccttgctacagcatataaggtacttacttgtaggatatgctaatttcccccaaaatggtgctgtactgctgtcctgacctgttaaaatgttggcaaaagatggttgtgaaatgtgtttcgagggtgtagtgatttccctagggtgctgtacttctgtccttgacatttctcattattttgaatggtcagatatttttacgctgtagttgactaatgacttgatgcggaacaaacttattagttttgttgatgaagcacatgaacggatcgtgacgccccatggtccaaacatggtacaatctatccactttgctggattaaaccacatacattgcaattctttgaagcttttgatctcgtttgctgcagttgggttaacctggaattgccttcatacaccaagttttgtatgctgcattgtcacactcacacctttcacagccaacataaactgactaacccacccccatccattcacgcacacacgcatatggacctccaagttctggcttggctagatgctaaaagatgccttgtaaattgcaattttgtattcttgctattattttacggaaagaaaatcttaacatgtgacttgaaatagttattcgttgaatgtgttcttcgttctaattataacagcgtgtatctaactcatttcctgacatcaaagttagtaccgcctggagtgtaacagatacgtgctgaggaagagccttggcaagaagtagaaatatagtgctcacaagttccatgaactgagggagggagggtgggctttgcatggtatggggtagtggtaagtaggtacatgccatgattgtctagcagttgagggaggattggaggagattaccagttcagcttgcaacagagatcgacagataagtccttgggtttggttaagagataagtttaatcaggagataatcattagttgaggtattcttcttaaattgttcgggattcttgctgtctgatctataaatgcagccactagagaatgtattcggcacagagggaagatacaagaaggcaaatgttctgttgagtgttgacatttttgggttttacatacttgtgacttgtaatatttattgctttgtcctgttactgcatcatgtcttcagtcagtgtcattcatatgctgttatgttactccactttttctggaaatatatttgtgatttccttttttcttaccagggtgcttcggttgtaatattgaaggatcttgaggcacttctcttggaaaattctcaaatggtaagttcccattcttgtcattgtagattcttaaatactcaagagcccacagctgcatcaaaattttcctatctacagttgaatttgtgggtgttacttctattatttttctcagactcatctagatatacgtgaaagcaatagtttgaaaagatggaatattttattgtttatatgttgttgattggcctgatgagaagttctattggaatacaactatatcttcttacttttgtgatagttgaaagttgaaccctactgttcgaggaatgcaagtacttttagtcatttagattttgcatacttttgtgattttacattttttatcctattttttcttcaaggagcaaagtgaggtccgattttctgctgtaagatgggcaacaacactatacgatatgaagcactgcccaagccgatacatttgcatgcttggtgcttcagatgtaaaactggacataaggtttgttagaaaagatcttgccgagttgttgacatcttgtttcctttggtttctatttattttttttaaaaaatataattatatgattatgtttgtcatcagggaaatggctttaactggtctgaatctgttaaatgatgaaagggagtcatctgcaatagcaactgattccaactatcctgatattgcagacatggtaaattatgtatacagccaacagcctcagttgctacactgtgatgagcagaggaacggaaaattgcttttcccaacaaaaacatttcttgcaatgataaagtttctaatgaagtgctttcagaaaagtgatggctcggattttcttcaagaagatctatctaattgtccagtatcaaaattgtgtatcattttagaacatgccatgtc

SEQ ID NO: 5853 - DNA, 2323 bp, Oryza sativa
gtttacattagaattgatacaccataggttgtgtgaattattaatctgtcctaaaattaaaacaatgccagtatgctggacagggcacagaagccaacaactgttaataattgtgtacctttcatctaaaacatgtgcttgcttatagtataattcagagttcctcagaggtttcagctgtcaagctgtcactgaaaaatattaatttcagtactgatacaatcacctatgtttagacttgatccatgtccaagtgcacttctttttaggttttatcctcaatggtgtttacgcatttcagttgaagaaaaccagaaactttgagtatttgattctacaaattgtgcatgcatatactgatgtagtgtagtgttttcagttagtggggtccctgtcttggggtgaaagagtgtcctttaatgttgagctattctcatattcaaactttgtcttttgctgtcattatatgtttctcttctaaatgtcttctatcttgtatcattatgttcattccagcgtataacagtttgctctaggtttctgcttaccttttgaagttcattccttttataggaagcccttacccaccttcttggtgatcagaatgatcttacacaagatctggcatcccaaggcatgagtattgtatatgagcttggtgatgcatctatgaaggagcagctggttcatgctctcgtgaatacactgtctggcgcagcaaaaaagaaaagggccatcaaggtgcacactatgtttccagtttccattttgagagaacctggaatacccccgaacccgtacccaaaaaaaaaactgtaaaatgattaatgttttctctgtctgcattagctgatggaggattcagaggtttttcaagaaggaactattggcaataatcctactggaggaaagcttagcacatacaaggaactttgtagccttgccaacgagatgggccaacctgacttaatatacaagtttatggatctagctaactatcaggctgctatcaattccaagaggggtgctgcttttgggttttccaagatagccaagcaagctggtgaggcacttcagcctcatctgcataccttaattcccaggcttgtccgttaccaatatgatcctgataagaacatccaggtattgaactatacacttccattatcacatatgccgtgttttgttttctgatttttgtgtttggtttaagttcttaaagtgtttgtatgctataaccttatgatccttcattgcaccaaagtgagtatgaatcttgttagctatggcctgcaaaatttcagcaactccacagctgaggtcgtatgcatgtttgtaatcttacctagagaattattggtttgttttttccaatagtgtatagatataaaagtataatgcggtcttcttgttcatatagaatccaaggcagtcaggaagtactacagtgcatcagacagctcagattatctgattttgatcacttaactatttcaaaaatggttcttcctagctaactgacactttgtatttcattctaggattctatggcacacatatggaaattaattgttgcagatccaaaaaaaacaatagatgaacattatgatctaatagtagaagatttattggttcaatctggatcgaggctttggcgttcacgtgaagcttcatgtcttgcacttgcagacattattcaaggtcgaagatatggtcaggtagttaatttgttttgctaattttgatttttttaaaaaaaaatttatgtaactatgttgttttgcataagctatgaataactggttttggatttattttgagaataaaatattgcttatctttccctttgttaaggtttctaagcatttgagaaaaatatggattaccaccttccgagcaatggatgatattaaggaaactgtgcgaaatgctggtgacagtttgtgccgagctgtaagcttgttgacagttaggctctgtgatgtgtcacttactacttcatctgatgcaaatgaaacaatgaacattgtactgccatacttgctttctgaaggcatactcagtaaagtttcaagtgttcaaaaggcatctataagtttggttatgaagcttgctaaggtatactcattgtcaaattcaaaaaaagttatctgcattaacattttagtggcaattttttgctccactgtaattttctttatgtatgctgctgtcatgaattgaatgacatgaactaactgcccgatgttcacagggggctggccctgcacttaagccacatctgtccgaacttgtcagctgtatgctcgaatgcttatcaagt

SEQ ID NO: 5854 - DNA, 40380 bp, Oryza sativa
atgcacatgttctttgaactgtactctgcaataacaaaacttattttcagatttgatgatgacaaagacatcggtgcattgtatggagaactttgggaggatattcctagtagcgaaagagtaaccctacagttatacttaccagaaattatctctcttttgtgtgattccatgtcctcgtcatcatgggctgggaagagaaaggtgaagcctctatttcattattttactgtctatacacataaaagtatcatagcttggaatacacttacgatactgtgtgctacttgcagtcagccaaggctataaaaaaactatgtgatgctctaagagaatccctgtctgtgcaccacaataatattcttgaatcacttttgaaagaactacctggtcgattttgggaggtaagtagtactatgatttttctatctgtggcatatcagtgaatctttccttttattcatggaataaaataggatggaatgcttagagattttcaagaaacattatccatgactaggttcataattcatttttttcgccatgaattaccacagggaaaagatgctattctggatgcactcgctgcactttgttcgagctgccatactgctatgagtgcagaagactctggcatgcctagtgttattctaaatgctgtttgtgctgcatgcagtaggaagtcaaaattgtaccgtgaagcagctttctcgtgtttgcagcaagtaagtatctctcttctctaccctgatctctatgtgaaactgaaatttgtggctagtggatactctaaagcattttactgtttgtggaccagacttttctttgataaaaggatttttagctgttagatagctgtgttcttaacctagtgctcaaaaggtttatgatcttagatgcaacaaaattgatgagaaaattactttcatgcttaatactccctccgtttcatattataagtcgttttgacttttttcctagtcaaatttatttaagttagaccaagtttatagaaaaacaatattagcattttcaccacaaaacaaacatatgaccaaaatatattcaatgttagatttaatgaaactgatttggtgttttagatgttgctaaatttttctataaatttgggcaaacttaataaagtttgaataggaaaaaagtcaaaacaacttataatatgaaacggagggagtgggtatttagtttgaagatctttccggaaatattgcaaacagctctcttctcaaaatattatggggagcaatctagattgtcagtgttatattttcacaaaagacattcatcgggtttaggtgttgtgttgggatggcattttgacattttctatatattagaatttacttagttttctttttctttctttaccacttttcaggtgattacagcattcaaagatccaggattcttcaatattgtttttcctatgctgtatgaggtttctaatcgatctgtcatttgtaaaacaaggaactcatcttcactcactgcatcctctagtgctggtcagtcattaattccagcccctcactgcattcaactaatgtcaatgctggatgaaacatcttgtaaatgaatactagaacttctattttattatctcattctttatcacataaatatgatatagtactgatagttgccatcacaacacaatgtttgaaaaccttgatgggatcggcttaacaagacaactttagaactatacattgttgcccttaatgcagcatacgtgcatgacttcaaaagccacttatcctcctttattttttatgtattactgtcttctgcagagcaagatgaaactgaaggtgtttctgtttctcttgataaggtgctcaactgtgtagcatcttcaatcactgttgctttcctgcaagatattatcaaccaaaggaagaatatcctggaaattattttaaattctctatcccccgaggagagttggcagagtatgtatcttgtatgcaagatctattataattctatgcaactgtttttgaatctcacttatttgatacatcaccactatcattgatgctttttttatggatttctatgtgcagttaagttgtcatcgttcttgtgtatcaaagagttgtgctataaattccagaattcagatggtaataacacttggcctgaggaaacaacttacttggttgaggaggtacatcacatagttgtttagtcctacacaactgtactctttagttcagtatttggtttcttcattttcctgacaaatttcttttaatttgaccgttcagttatttcattcaacagcaccaaaagttgtggatgtcatacgcttagttaagattgctcaggtaatcatcagtatatctagccctcaccaattcatattatattgtgtttgctcatatttattacaatctcatatagcacttttaaagtttcaccataagataatttgttgtcttccttctaatgaataaacatattgtagtttactacttgtatgttttatggcaatgggagcatgtgaactgaaattgcactggacggagctgttgtgggtgttatactaaatttgatgattgcataacaccatttggcaccagtttttttatagattatttagagatgatacaaaattattcatcaaatattcagggaaaaataagaacttgtctttagaaaaaaaaaaggtggctagtctggtggtttgatgaaccctggtgcacatggtttacagattactgctttgcttctttatgtaacagttcatatgcttgtttttggcttcactgattttagaacaaacagttacaaggtttcttgcactgactgtaacatataatttatatcttgaaaggacgagctatccaagatttatgtaaaatataattgttacatactatgctagagtatattagactactgtatattgcacaaaccagcagtttctggatatgcaatctgagtttgaattgccccctcatgactaacttcttctcaggttcacaccgctgcttccgagtgtctccttgagttgagcaaattgtatagagactttccattggttgacagaaaagggcccaagttctcaggcgaacttgctgaactttgtgagtcggaaaaaagcgagcaagcaaaggcatttttgaagcaatgcatggatattctcaaagacttcgaagatcccactggattagccatggagatggactaagtgaagctctcgaggttaaatcggcatagtaaatatcaaaaacaaggctgcgcatgtataaagggcgcgagcaccagggaaggtgggttattctcgcaaattggaatcaccatgtaataggatgagcgtttcattactggttgcatccgaaggaaattctgaagctttgcatccgcaacccacttgtgcaacatgccctgccgctgttacgatttaatgtttttctcccagaatgtagtggtgagctaccagagattggtttcatgattctttcaagtctcaacttctcctagaccaggcccgcttacatctggcagctttcataggtcataaactgccctcacagaccaacacatgcccacacatgcttgcgcaactgcgacacacgcgcccgtgaaaactcgggaagaatttcccgatcggtcacccatccctaaattgctccaggccaagcacacactttgtccacactcgtgcacactcgggaagaaattctcggccaagcacacactttgtcctcactcgtgcacacttgggaagaatttcccgatcggtcacccatccctaaattgcttcaggccaagcacacactttgtcctcactcgtgcacactcgggaagaaattcccggccaagcacacactttgtcctcactcgtgcacacttgggaagaatttcccgatcggttacccatccctaaattgcttcaggccaagcacgcttaaccttagactctcatagttctttgaagattggcttccggaaaaaagttgcaacttgttgatatgagtattctattaattatattaagccttagaccaggatgtcaaaaaaggaaccaagaccttattatacccgagagtgatacttatgctaggaaacatatactcatcctaaagaacgatttttgtatgaagggcattgattattcaatccaagaacttaaacacaaatgtgtctatacatatatggtttctgtttactttcacccatattgggactaaattgagacggtttacaggttacaatcacatatgacttgtgtaaaaacattaaactgacgccaaccgatgtatcttcggacttcttttctgaatccctattatgatcatcagggacttaagtggttagcttgcggagagcagtggtggtcttggagcctgactgccttcccagatgcttggagatgtaatctccagcatccatgagcttgttgaggtcaacattggtctctatccccagtccatggagcatgtacacaacgtcctccgtcgcgacattgccggtggcgccctttgcatatgggcagcctcccagtcctgacactgatgagtccactatgttgatccccagctggtaatacaaaaggaaatgttagaccaacagagcatttctggttgttctgtgtctgtttttcagtaagatggtttgttcattggcattggcaggatgtgaagtgtggttgcttacttggagagagaccagtatgttggcaagggcttggccgtatgtgtcatggaaatggacggcgatcttgtccactggaacaaaagacattacagcttcaagcatagcaagtacgctacctgaaacaaataagataacaaggagcaggaaattcccaatgagaagtggctcatactatcatgtagaaaagttcgaacaattgaaatcacatgattagcaagtaatgtgtcggcatgttttatggattaggactgcaatgctttcaaaaaaacgtatcatcgcttttgaaagtagttttaaatgcgcaaaaatatataaaccaggaaatgacatgctgaaagcagtaaaggcaacaaaatcaatacctggtgtaccaacaccaatcgtgtctccgagtgagatctccgagcaacccatgtcataaagctccttagctacatatgctacctttgatggatgaattgtgccttcaacagggcaaccaaccacacatgaaacatacctatgacaatcaaattttgcaaattctcagatcagattgctgtctgttcattttaactttcaggctcgatagatcatcaagcttatgtgacttacccacggattcgtattccatgtttcttggcagaagttacaacatcatggtaccgaacaaggctttccttgatggtacaattaaggtttgacttagaaaaggattcagaggcagatgcgaaaactgcaacttcttttgcaccagctgcaacagcagcctcaaatccctggataagtggagataaggttgattcatcacaatagatcaaaagtcttcaaaaaacgatacgtatagatagtctattggtgctatggtgctagtatattgtagagtctcccaataatagaacagaaccagacatactctgaggttaggagttaacactggaaaccgcacatctggcacatgcttaatcccttcaaccacatcctttgcatctgctagctgcaactccaaattgagtgataaaggttagctatttgaacttgaactgctaccaattttatcgtgtttttgttctgcaatgaattttgcaatacaagttttacaagctaatgtcccaattttaacattttttgttatgtaataaattttgcggtacaagttttacaaactaatgtcatacaaaaaattgatagtgaaagaagttagatggaattatcagtaacaacttctgatgagaaattaagtgctaccagatatgcatgagtttctcatgcagcatgacatgctaaattcttagaaaaggcggttcgtttcttcacctaatctgagtaaatactgacaaaaaacaaatcaagagctatcgtgacaatctctcaaatgtctgtgatttaaattaatgtatgatactagtacacgccttcacctaatctaagtaattacctgtggcacccattttggggacacaaaacttgtggcttcaactactgatagaccagaagccaccaatttgtgtatcagttcaatctttacagatgtgggtacagtattcttctcattttgcagaccgtcccgtggtccaacttcaactatcttcacaaaccttggaaggtcccataaaacctgaaaaccagttaatcatcaattgagaaaaggagtaacttgtggtaatacattacgatcactatacttcatcagcggccattttcacttatttagttataaaggtaaatagagaagactgacatgttgcattgccacagtcataatgctacatgtgagttcattccttctatttgaggtggtctgatgaaacctataacaaggaaatgaaattgaatacacccaatcacccatgagccatttcagttacacatgatcaaactaccttccgtggaagagctctgaactccatatccaccccattgcaggatgaatcagtatattggccttgcatatgccatgaatgagcactgctgtgaaagatcgtctgattgttgccaccattgcgatgcttgtaactgaaagtaagttcacatggtcatatcatacgagtttcagggcatacttcagtaataaaattctactgtcactaaagtaaactaacaagttcctgaagaaaaatagaagtgttgcaaaggtggaaatgtacatgatttgcttaaacctctggaaatactggaaaaacattccgcgtcaaagtaaaaataccgacaaagcaacaactaggaaaggaagaaatgtagcacggtaaagtttgcaacagtagaacactagaacttacttgttggtgttgctgtcatcaacacttgctctgcaggcacttggagagaacctttcaagtctgttaatactcaactttggcaggtccccaagaccaagtggctcctcgaggcttgacattctgtgaagcaggaggcgttacaattttaacaactatgttgagatgaatcttgatatgttaatatataaaggacacgcccggggtgggggagttgaggaacatagtcagaaatggtgcactagtccgcatggaaaggaacgtttgaaatccaatccaatgggactcgcaaaccatgtccattctcccggcatggtcaatgtgcagtgtgcaatgcttgcttgcacaccggaactcgaacttggccagacttcttctttagatattgaattgcacatgagatactcaccctaattaattatccatcaagcaggtctctttaaccattcaatcatgaaatgccatgcttgatgaactaatatatgatgatgcccagtaactagcagcaaaaatggaacagcgccaactgctctgtattaattcattttttttccttgtaaatactcaaagcaaaccaagatactacaaacccacactgcaacctctccatgaaaccaaatcaagcaggccaatcggcaacatacttgctacgaagaacagggaacagaaaggggaaagaaccaagaagaaacaagaaatcacatacctcaatcgaacgacgaattcgaagcaaacccgatcgaatcgcacccgagattgagggatatggggcaccgaactcaacaagccttacttgaatccgacgcaaaggagagagcagagcgccgaaaatggaggccgcggcttgcgcctccgcgtctccgccaagggaaaggaactggtcggcgaggtcgcgcgtggacccggttcacggtgagatccgtggtgcagcgccctgggccccaggtgtcagtgggagttggctcacgggacccggtccagggagttgagtctggcgggctgtgcggacgcagtggcgttggtggtaggtctcgttcccgttttctagttcggtgagcggccagccgaccacctaaaaaccccggactccttatcggattcggtttttggataattgtgcattacccgttaacacttagcagagcctggcattgcatttgcatggtcatgaacccatggtcttcatatgtagtagtagtagatttgtagcgaagaataatgatgatggtgattatgaaaaatattcatggttgtctatatgttcagatcagaatgaatcaatcagctgatacgatctggatttgtggtcttgtctcatgacagcaacgagacccgattcgcaaatttgtatttaatgatctctgttagtgcagacgtggtcagctgagttccagaagaaaaatcggattggaaggagtggtggccatgattttgttgatgtatttcctcctcgtgttttataagagtaaccatcatccgtcctattcaattcaatttatggttgaaatagcaatcgtcattatagcactagataaattatacatacgtgttttgcaacaaatataaaaaaaggacaaataatatcaacgtatatataaaaaaaaggaaaaaaatcaaattgaggccgaaaactttacacacctcaactattattctaaataacgcccctcaactttaaaaccaggatacccaatacccgtcaactattaaaattgtctggctgatttaccctctcaaggttgttttcactagattaaaggggccttcatgcatgaccagtcagccaaatcaaaattaaaaaaataatatggatcccacattcatgcgttggaggagcaattagttatctacatgatttgaaagagctcaagcaataaatctcattgtgcaaattacaattgctgtggaggaagattttcagcgattcgagcattgtcgccagggagaagataagaggacactaccagggaagaaaattacacaggacttctttgcgtgacagctgtataatacgaatctcaaagcaacatgttttcttccctgatttccccagagacttgacgagtaaacgtgttctcctgctgtcgccgcacgccggtcccaagtggtctcactgcgtcccctgcaatccttggcggtgccccctcactctggcccttccttgtgtccttgtgggctgtggccctccgtgcctctcgtcgcgtggccaacggtgctagctgcagctcagtggcttgcacgtgtcgaccagctgactctttgttagactgactatgcaggtggtggggattatcacttagttctcgccaacacttacgttgtctcagatgaggcggaccaggaggttttttcggagctgtcaattggaaagaagttcgacacctaaaagataatagagtaggcatacctataagacttcaccatggtcttggtgatgtgctaagcaatggtggttgcagggctagagattggctcatggcggagccaagagcatctcactaacactagtatcgacaattacgagtttgcgacgatgccaagattgtgcacaccttatcgacaaaatcatcacttgggtgcttgatagagctctcgacactttaatttcctcatccttgtggcatcatttttgcagtttcgtccatgtccgacgtggaggataaggcaaaaataccaaaatgaccttgtagccacctataaggtggtagcgctcttgttgttgctagtccagtctaacttccatgttgctagaggcccaaagggcacctccgcataaacaaagctagagcacagctctgcatggcatcctccctatggctctagttgcctagagtttggtaggtaatctttcctgcacgcccccctgactttgcattgcatccttcggtgagctccgtcccctgcttttgacgtggcatccacctttgagctctccaccgttgtttgcatactcccactgtcccacatctcatcgtcctcgacgtatccaagaataattacatcatgccaaaaatatctacacaaattagatgagttagcaagcttgtcctctaatttgatatgcataagttgatataaatgaaattggatggatgccaaacttttgagctaatctaattacatagtagtagaagggaaaaaaaaagaaataacaccataaagaaatcatcatacttgtttctggtttcaatacaaacttttttcctctaaacttatacttcctccgtctaaaaatgttgctaactaggatgagattctgaacggttaaattcgaggacctatattttcaattttctgcgcttgagaaaataaaagggaaaatgtcatgtctcctcccgttaaaccctagcttaagcccccttcctcttctccgcgcctccgcctccgcctccgcctccggtctcccctctcctcacacgctccggctccgacggacgattcccacccagtaatggcgatggatttggacgagccgctcgacgcggagaagggcgaggcggcgctgcggcggctgcgcgacgccgacccggccctctacctctccccctccgccgacctcgccgccgccgcccgtgaggcctccaagcacctctacgcctcgctcgtccccttctcccccgcgcagccgcccccgctctccaacctcctcgcaggccccgccttcgacgccgagcagatttggtcccagattgagctgctctcccgccccctcatcccccacctgcgccgccagctccgccgcctcgagaagcaacccccgtctcagccgccgcctcgtacggaatcgaagtccgctgatgccgaagagaagtcagaggaggaggacgaggaggatggtgaaggtgacgaagaattggaggagttggacgatgtagatgatgaagaggagtcagaggaggaggaagaggaagaggaagaagacaaagaaggattggaggataaagcagggaatcaagtggaggacgagttcttcaagataaaggatctcgataagttcatggtaaagggggaggaggcggaatatggtgggggtgccaagcaagggaagaagaagaagaaaacagagaactggatggaagaagatagtgatgaggaggaagaggaggaccttgatgaggatgaggacaatgaggatgaagaagatgacgatgaacacttggacgtaagcatttcgtaatcacatcccttgttaaattcttagagaccagtattagctctcataaagaagattgatatatagaaccactgatctagaagtatctcaggagtagacaccggaatttctgtagtcgcaaaagatagtatctgtattacctcaggaaattgagcatatggattaagttttaaaacagtttcccgcttgagctaataggcttatattgggagctagcattgggtatggtttaatgcaagatgcatgcttgctaaatgtgattcttaagtatcgttttttattaatatagttggaagactttgacgatgaagaagaagaagaagagggtgcagttggagatataatgtaagcctttatgctattttctgaaaatgctcatatcatgattgatagaatcacagaatgcgaaacagttcgggtttccgcacagtgtttttttatctttaagtgattatatactgggatatcaaatggttttaactacatttgaattgcttttttgaagatcggtatgatattcgtagaaatggaaatggtagtcatttataaatttgaattgtagaatcacttgaataattcttcacaaccttttcctattttatcattttcatgctcgacacataatttgatctgtttaagttaactgtcatacaatatgacctgtttagctcagagaagggcatacaaaggcaaatggagtaggaaaacaattggctccaaataatggcatggaatggactcaattaaattagaaaacattaagtatgtaagacaaacatattacattttcatgtaaattgttaaaaaaatgatgatagcacaagaaaatggatttatgaaaaaacaattagattaagcataaggcaaagaagaagtttgttgaacactaaaatataggtataaccacgtgtggcaatgtgggaatagaatgctgtgaaaaaaactgccacattcgcataactcataggataatagcaaaggatacctacaagtttatatgtcatgtacaaaaaggttgagacacaatatcaccctaaaaaacacagctttttagcatataacctaggcaaaactgagctgtaagttctgtctacttcttagccactgcaaatgtccctggaaggataagagatctgattagacaattccaagatctcaccatgcacataaatgcattacatcattctttcctgccttgtatttgtccagtggagcctttacagaagtttccatatgttgtattgactcagcaaagcttaatcgttatgcccagacttcggttgtatttaatatttgttcatttatagtattatgctttgaccagcaaagatgatttttccaggtataaggatttttttgaggaagctgatgaccaaaaagtaaggaagaaaggtggctccaagaaagttcaattcaaggatgaaccagatgaaccagaagttgatgacaaaaatgatgatggaaatgttagtcaagtactacacttactcacttcaatataaacaagttaggcacatgtatattatcagcatattcttccaattctgcaggatgaacagggtttgtcaactcacgagaaggcgcgcctgaagatgcatgctaaaatagaggaaatggagaaagctaatcttgaacctagtatgtggaccatgcagggagaggtaatatataatatgtttatccattcattagtttctagaacaaaacagatttttaactttgaaactgttctggtattaaatcatcagctcatggtaaagaaaccacttgaaattttcttgtaggttaatgcttccagcagacccaaaaacagtgctctagaagtggaccttgattttgagcacaatgtaagacctgccccagtaatcactgaggaagtcactgcttctcttgaagagatgataaagaaaagaataatagaggtatgtgtgttgtttcctttttggacatggcataatgggcagttttgcaacttggttaactttgttacagtgctggagaataaatttattctggacatatatttttgtatttgtggccttgtgctacttatactgagggagctttacttgttgattccatgtagggtcattttgacgatgttgaaaagccttctcccttgcaatttaaatccccaaaggaacaaaaggatctggtatacttttagtcttgtccaagaacataactcattgatgataacaataactaatcatgtaattgttgtcttgccgttatcaatattatttcaacaggacgaaagtaagagcaagaagggtcttgctgaactatatgaggtttgcactatcagaatacagcttttattttttatattcaaagaagttgctacttaagatcagtttaatgatgatttattgagggctggtgtttgtgtttgtacaggacgattatgcgcaaaaggctggccttgcacctgcaccactttctatttcagatgaacttaagaacgaggtgagtttagtcgctttctattataatatgactattggctttcatgggactaaggctgtactgtttctattgttaaggactttttttttcttttgtttaattgctgtgtgattgcatgtcatttgtttttagttaaaagcaagctgcaaaaagaagaaatcctacatgtcaaagaggaaatcttgagttcttctcattgaatacatgtcattctattatgacctccccccaccacacacacacactcacatgtaaaaaaaaaaaaaagaaatcttgtatcaatgcttgtcttgattgctagtgttgctactttattcaatattttcttctgtgtgtggtgatggtggcaaaggtacttgcaatgtctttgagaaagatcttttgaaaggaattgataatgctgtacctcatgagcatgcaattgattaaagtttgttttttttatggtagaagcagacatcgatttcttttgaaaaatagagaagtgattacttgtgatcacattgttgttaacttagtactaactatgtagcaataagcatgcaaatgggtcataccgtcatactcggtgatttttaaaactgtaattttttgaggtaccattatcaacttggtggtctttataaatttgttcccaccatttcattggtgctttatgcatattttttcccctgtaatgatattggaggcttgctgcattgacctaacttttgtttccacttaggcaaataccttatttaagagaatatgcttgaagttggatgcactatctcatttccactttgctccaaagccggtatggaatagtgacaagatattttacttacatttgtaatttctttcagcgaagttaactaacaaggtaaatattcacttttcaggtcattgaagatatgtctatacaagcaaatgtaccagctctagcaatggaggaggtaaataaaatccttcatttctccatgatgtttatacggttgagcatttcatgtcatgatttctctctctttttgcagattgcacctgtagctgtttcagatgctgcaatgcttgctcctgaagaaatttttgaaggaaaaggtgatgttaaagaagaagcagaacttacacaagctgagcgcagaagaagaagagctaacaagaaaaggagatatgcaggtaaatgtccttatgttttttaagatacattccttctagcttttagtataaatattctgacctgacatggataatgctcctacttcctcattcaaaacatttcattgttcattcaaacatggaagtagtttgagcaacacaaattcaattatagctagcaatatttccaattgcaaagttgggtacgagaatagattgaggcctgctagtttttcatacttttgtaccatacaggatcgcataaggagaggccagccaagatgcagaaagattaactcaatactggggaaacgcttacattatgaacaagtagtcagccatttttactgttcagcattacctcctgacccaaggatccattcatgatgagtattgtgcaaatggcaacgcagcattgacagacatggaggcagagagcaggctaggaaaggtagggtgaagggttgggctccaatgcttttgatcacaggatctgtactctggtggcacaacagacagacagctgttccaggtcaaagaccctgacgtaacccatctcccgtcccacaagaaaaggcgagcgaacgtattggaatgtgggatgggtaaaagaaatcttttgtttcttgttacactagtcgtagtagtagtgtagtaatgcaattttacaatatcattttttacactatagagtatcaatggagtgcatgtattcagaggcatatgttctgtttttgatacgttagggcattggtttgcagatgtctgaaatttgcgtgcggtgtattagtatcattttgatcctttgctttttttgccacattgagggattagattgatctaataaaggtgatgcagctatagactatagcatggcaagaaagcaaaataaacatgggttatgggggattgtactatcagctacagtagcaggtagagatgcctgtacgcaggtcaagcttggacccgagaatgaggacgtagagttgggaatcaaaaatcatgttgtagatactctgccatgcgtcgtcatcttcatgcacgttacaacgttatcatcttccagtggagtacagtacacgtacatgtagagggagtagtatacgttttctgttcgttccgggttcgcaagactggagaggtagctgaacgagagtgacgcaatgagctgcaatgcaccacagcagcagcacaaactctgcacatgtgctgctgcgaatgcagagttggccgtagagcaatgttgtgctgtactactactggagactggactggccgtcgccattctagcaaatgtcatttgtaacaacgatacactggagtatgcacagtggtgtaccgtgaaccagcaaggacgtgcgaatgcacagtgtgtaacagcaaatgtgccccaggcagaggtagcaagccagaaagtccaacactacactgcataaagttttggatctttataggattctcccaacacatgatgagtcgcacgcagctactactcctacagtagcagctagggacaatttcttcttcagctcaggctcagctgctgagccggtcgcgcctcccaacgcataggcatgctcccgccggccccgtctttcttgtccgccattacgccaaccagccgcagtaactcagcgtactactctactcctactccttttctttcgtttaatagtatagtcaactactaactttaaatcaccattaacttaatagctacttcataccatacttagagcagtcccaacccttcacttaggatagtgtttatggcattaactacattgcaatgtaggacttttagcttatgtgacactatattaattaaaagagagagtgaagagaggaagaaactgggtctcatataggacacagcttcaacacgagaatatatgcactatacactatcaagttttacattgagagataatagtgtctttataatagatgaagaataaatatgattggtagagaagagagatgatgtatttattaatggcccattttaagaaaccatgggttgtagagtgtagtttctattgtaatgtcttattaacatggcaccatagacacggtttatgtatactatgggttgtgactgcctttatatactacactattaatacttgatcctatttatcatacacacattgcgtcttgaaattcgtgctacagctggctataaatttatagccctctgctcatctctcttctctattatcttcttaaaatatatttatagctggcttatagcctgctattatacctgctcttactcgctgcagcattgctcactactgtactctcttcgttaaaaaaaaaattaaattctggccgtaaacctgaaccagcgtaagccacctatacgtataccaggtttactaaggcctgcttagttccaaaaactttttttaaaaaatatcacctcaaatctttagatatatgtatgaattattaaatatagataaattaaaaaactaattgcacagttggaggagaaatcactagacgaatcttttaaggctaattagtccatgattagccataagtgctacagtaacccacatgtactaatgacggattaattaggctcaaaagattcgtctcgcggtttccaggcgagttataaaattagttttttaattcgtgtccaaaaaccccttccgacatccggtcaaacgtccggtgtgacacccaaaaattttcttttcatgaactaaacaggccctaaaccttgaggtgaggtcattgccacctacggagtatgaggtatgatttaacggttaccacgaaatatatcggttttaaaaactaagaagattatcgcacgtgatgtcgtgataattgtacggttttataaaccttgtatatgactctgtagtacaacttatgtacaattaaagacatgtaattatagattaattaaaaaataacatgttcatatgtctgtatagttgtttataatcgttaatcaaatttagtgataacgtgagtcaaacagttagaccgtatgcataatattttttttttgaccgaggatgtactcccaacccagacgagccaccaccatgctagctgctgctgctgctagcgttgcccagtgaccttgcagctcgccatgctagctccgctgctgcttttgcccaaagctgcaccccctgcattgcccctcccctgaccaccttgcctcatctgtatctccgcccccccccccccctctcctcaacctctcttgtgcttgcttctccattgcagctcacctccatctcctattctcctcctccttgttgaaggagttcgtgtgcctctaccaagaacaataagaagccttgcattggtagccatgatcacggtggtggacctgtaccacgtcctgacggcggtggtgccgttgtacgtggcgatgacgctggcgtacgcctccgtccggtggtggcgcatcttctccccggaccagtgctccggcatcaaccgcttcgtcgcgctcttcgccgtcccgctcctctccttccacttcatctccaccaacaaccccttcgccatgaacctccgcttcctcgccgccgacacgctccagaagctcatcgtcctcgccctcctcgcgctctggtgccgcctctccgcgcgcgggtccctcgactggctcatcaccctcttctccctctccaccctccccaacaccctcgtcatgggcatcccgctgctcaaggggatgtacgccgccgccggcgccgcagccggcgccgactccggcagcctcatggtgcagatcgtcgtgctccagtgcatcatctggtacacgctcatgctgttcctcttcgagtaccgtggcgcgcggcttcttgtcatggagcagttcccggacaccgccgcctccatcgtctccttccgggtggattccgacgtcgtctcgctcgccggcggcggtggtggagccgcggagctgcaggcggaggcggaggtcggggacgatggcaagatgcgagtcaccgtgcgcaagtcgacgagctcgcgctccgaggcggcgtgctcgcacgggacgcagtcacactcgcagtccatgcagccgcgcgtctccaacctctccggcgtcgagatttactcgctgcagtcgtcgcggaacccgacgccgcggggctccagcttcaaccacgccgagttcttcaacatcgtcggcaacggcaagcacggcgacgaggagaagggcgccgccggtggcgggggccactcgccgcagccggtggtggggaagaggaaggacctgcacatgttcgtgtggagctcaagcgcctcgccggtgtcggagcgcgccgccgccgccgccgctgccggcgcggtgcacgtcttcggcggtggtggcgccgaccacggcgacgccaaaggtgacgacaccttttttatcatcttttcgtgcactttgacttccctttttgttttgcccgcgtgtattacactgttgtttgcttctgcacaattaatcactcttgtcttgtgctcttgaccatccgatcagtataatcaacggtccagatcacactggtctgctgattgtttggagaactcaactgcgtatactgatttaataccacattcttgaagtgattctttttcacaaacttaccttcttgaattgttaattcatgtaagcttttctgatcttaacagtgacattgactgttaagtagagttgaattgtacagttaagacaaaatcttaacagtaaactactgatttgacaaaagaaaatgttctttgatggatgcacaggtgctcaggcctatgatgagtacagcttcgggaacaagaatgagaaggacgggccgacactgtcgaagctggggtccaactcgacggcgcagctccggccaaaggacgacggcgaggggagggcggcagcgatgccgccggcgagcgtgatgacgaggctcatactgatcatggtctggaggaagctgatcaggaacccaaacacttactccagcctcctcggtgtcatctggtccctcgtctcctacaggtcaattaagcaaacattttactcacacttttcacattgccatgttcatcatcagtcatctctgtttgttgcatgtgttgttaatcttgtgaacaatgtgatgtaattcaggtggggaattgagatgccggctatcatcgcccggtcgatttcgatcctttcagatgcagggctcggaatggccatgttcagcctaggtttgtttgtgcatctctgatacatgctgcattgctgtaatcttacatggttccatgtctgattgcaatgactgaactatgttctggtttgcaggattgttcatggcattgcagccacggatcattgcctgtgggaactcccttgcttcgtatgccatggccgtcaggttcctcgttggtcctgccgtcatggctgcggcctccatcgccgtcggacttcgcggggtgcttctgcacattgccattgttcaggtaagctgcaagttcaggcttctgcaccaaaatgcatccttaactgcaaaagaatctatcgtaactcaacaattgtcattgaactctcaggccgctcttcctcaaggaatcgtgcccttcgtgtttgccaaggagtacaatgttcatcctaacattctgagcacagcgtatgatctctttaccaccatttttttcagtattggagaaatgtccccattttgaggtttcttttcttttatgccctgaaatctctcgccctgtttcccggttcccttttccattgtatcacaaacgccatgcactgaattttctgaaaaggggcgcatcttgcagcttttgatgattcctaatcatattgttttagactaagaaatccatttttactcatgatttatcatccacaaaggcagagtccataacaataccattaaccatgattctataacactatcattgtatctgacatgaccatgaactcttgttctgcagcgtgatattcgggatgctgatagctctccccatcacattggtctactacatactgctggggctctgaagagctctccaagtctcaactcaactgtgcaagaacttgatgttactgacagtttgattaggatttatggtctgttttagttgctcagattttgtttggatgataggtcagcttagtgatgctaggtggacaattatccgagaacttttgggttcaagtgacggccagccacggtttctgattgaagattaggaacatagacatcacattagtgataacaggcatccaatttgtaagacattgagaaggtctgtttcaaattactgacaatgtagtaagacattgaacagtgcttatttagcattccaataactgatggtaatgcgcttacttaaggagctactctgaaggaatttatttttaatctcttgagagattagctccggattttccttttcaaatgtttctgagtttgagggctccttcggaagacaagattctgaaaacacgggaataatcgtaggaataggatgtcatgctataacaaatattataggaaataaatttataaatttataggattctataaaaagtattgttttgtagtaccataggaaaatcaagaaactttaagttacaaggatgagaaaacatgaggtctagtctcatgttagttttctgtcaaaattcctacaaaatgagcaataggaattttaaaggattttggggaagccatttctatgtttcaaaagatcatatggggaaatttttcaatggattttaggggttgaacgctttatcatcacttgccaacaaaagttattacactttgtttaaggtgaggtgaataaattcttagacataacttactaagggcaacaacaatgtatatagcaaaaatagtccatataaataggacctatatatgtgggttttaactattataacattcacaatgtatataaatagcaaatagtattaggaggagagaaagtagagacaaaaaatatattttatcctatatgagaagcccatatgcttatgaattttttttccttactatggactagttccacaatgttgttaggtgactggataaaatattgtattagttatgaactagttttacactatagttatgaactatattgtattagactgaataaaataagtctaagggaatcttgccacattttttaagttattaacacatgagactgactccctctatttcaggttataaaacgttttgactttggtcaaagtcaaactactgtaagtttaactaattctgtagaaaaaaaagtaatatttacaacaccagcatagtttcattaaatctataattaaataaaatttcataatatatttgtcttggtttaaaaatattactacttttttctaaagaatttatcaaacttatagtagtttgactttgatcaaattgaaaacatattataacctgaaacggagggagtagttagaagggaatcttattaacggtggttacaatcaaacacttaccaaattgattaaatttgtctaaccttaggtttgcagactatggtaaaatgtagcttacaaccaaacattctctaatcctttaaaattttctctatgtttctttttatctacttttcctttgttccaaagaatcggaaagatggaatctttttgccacttttttcaagtttcaaatgaagaaaaacatgcgtagcattttgagcatcttttctagtactactcccaagtataacaaaaagtttgggcccaaaattaaaaggctaatggctggcctgtttgctcgaaacagcaggacagaaaaatgattgtgttgggagtcagacaaaagtgttggctttaggcatgcgcacttgaaggttgaagcagcaaccgacgattatactccactcttctcgtcctgtgacagacttgacacggttggatgtctctgaagcttataaccaacggtaattttatcatttttgccgagacatatttcttattataaaatttggtatattagcatatcatgatataaaaaaatttagtataaaatttatatacttataaggaccgtaaaaattctttagtaccaatgcatggatcttgtgaagaagattttttttactcttcatcacactcttttagatcatctgatatagtacacggttaccatgggttcttttagatcatctggcatagtacacggttaccaagggttattagacatatccacggacctaatttacaaaatcgtggaataaattggtcaagtttaagagaaggtaaactcaaaatatagataaaatttatacaatttgtcaacgaaattgcaacggtttttagagcaagtagtttttattattttttcggtttagatcccaacctatgtattttgaatttgttttatatctcttctatagagctgggtattctttttacattaatatactcccttagtcttgtagtatagcaacctatgattggatgagatattttagacctattcaaatttattataccgtgaaatgttccatctggtcctaacttggataaagggagtaggggtgaaaacgggatggatatttatatttctgtccagtcgcccgctcgtattattttggagcaatttcgggtaaaaaatccgggtactcgggtgtttgtacagatatcgaagccgaattcggatacattttggttgatacgtgatcgggtttgagagggtggtatccgatggatacggattatccgataaataatacagatattacacggtgtctgaattgatacctattcgttccgtatttatgaccgatattatccatgtttgtatctgtattcgatactatctatgtctgacccgattccaattattaaatatgggttaggatatgggaaggatgcgatccgacgaaaacaaccccatttcacccgtaggagggagtagttggtttgattgttttttcgattgtgtagaatttgatttttgtaaaagattgttgtcagggtctcgggtgggccacacatgggctgtcagcccatcaccaagaagtccaagcaagccccaacctgaagtaatacatagcagcaacagcttacaggagaggacatcgatcgatcaattggccaaggcggcaaacggcggcggcggcgacctggaggcgggcttgcctccttgtcgatctctaccttccctcttcctctgcttgtctagaagttactagacctttctagcccttgtattcctccatcttccaccccaaaaccttccaatattgtaacagattcactagctccttgtgttggatttgataccactacttctgaaattgcattgttgaagtgggtcgctaacaattgtaaaaacgaaaaaaccccttgtcgtcttctccattgcggcactgaaactcaggcggcgccaccagccagcgtaccacgacgttgctctgctagggtttgctccaccctcctcccacctcgcgccatcggattccaccttcccaggtctccctcccctcccgtcgccatgccgcacctcgtccgcgagcgcctcttcttcggcgacatcaacgacgccatcgccgcgctcaccaccaccaccgcggaagccggcggcttcacccacctcctctccgtcgtcagctccgccttcatctccttcatcaccgactgccgcccgggcctctccatccccaccgaggaggtccgccgcgtggtcgccggggaggagggcgcgccgccggtctccgccgtggcccccgggcggctgatgcgagtggtggagcgcgctggggtcgggctgcgggtcacgcggatggccgtgccgctgcgggacaccgaggaggagaacctgctcgatcacctcgagccgtgtcttgatttcatcgatgagggcaggaaggaggggaacgtccttgtccattgctttgctggggtctccaggaggtacgattaatatttaccaacactaatattccgagtaatctgtgcttttttgtaatctttagtgtcgtgtgctaatcaaagtgaagttcattagatatttttagttctggaatgttacatatatctgttaggcatacttccgttttagccaaatggacattgtgaattttgttccaagaatttatcaattaatcataagcatatgatggaatgtgaatccctgtatcatgctctgttttgacaagttggatatttttgcctgtcctgatgcattggttataacaaatatattggttaacagcgatgtatctcctgttcactgttgttcatttgtaagaaaattaaatacttgtaaatttatctgtatcttgttgcagtgctaccatcatcgttgcttatcttatgagaacagaacaaaaatctctggaaggttcgattatttcaacaaaatgggtgatttttcagtcgttgctttggttattactccagatgaatacctgagctgtctttttgatacactctggtgacatgccatgcttactgtcttgtttcagaagcactagagtctcttaaggaagtcaatgagtcagcctgcccaaatgacggttttcttgagcaggtaaccctttgtgatctgtttgcaccctattgctcttagctttcttttatttatttgttgaatgtgttgtaaattgcagttgaaactgtttgaagaaatgggcttcaaagttgatacttcaagtcctctatacaagcgtttccgtttaaaattgctaggttagtcataattcatcttggattctttgttactgttggacaggttgtgtggttattatgtcagggaaactgtgaagattctggccactggttagcatttatttaaaaaatggagatgtaaattctttgttttagtaaatttcaacattgcatgtctgtgaatcatgatatatttgatgttttcctgctttttttttaattatccatgactaagagtgctattcatgcagtcctgttgaaaataaagcagtcatacacttctcaatattgcttacttttgtttcttacttatgaaaaatctttgacaaatggacagatttgggtactttactgtttcacctttgtcctttctcttatgcatagtctcttactttgccacttttcactaaacttgtcaattttttttacttctcacaggccaatcctacaaaattggagagaaaataggaagctatgtatttgaagatgatcctggtctttctggacagcctaattcttctactcagaatttaccaaacaagcaaacccaacaaccagcataccgctgcaaaaaatgcaggagaattattgctgtgcagggcaatgttgtgagccacactcctggtgagggtgaatcttgctttcagtggcaaaacaagagaaaaggagagcgatcatatagcaaagaacaagattgctcatcgttgtttgttgagcctctgaagtggatgactccaggtaattcaccctcgtaattcagccctttgcagttacctacggtcacaaatgacttctcagattgatctcctattgatgtggctcatagcaaatctgtgtttactgctgagtgttcgtccaatctgttatgtaattctatttgttttatcatttctaattggtgcttttgttattgatggaacagtggaagatggtgctttggaggggaagctatcgtgtatccactgcggagcacggctaggatatttcaactggtcaggaatccagtgcaactgtggcagttggatcaccccagccttccaaatttccaagagcaaagttgatattagtaccacttagatagttgtcagaggctagtagattatttcaggaccatgtgagctggtgtaaataccgttttatcagaaggatttacgaactcgaaggatctcgaccgaagattttcagatccattgtgcactagatagataccatgaagaaatatagtctcagaaaccaccacttgtattgctacttgctgttagactatgccatcaattgtaattgttggttctgatgatctgaaatgctatcagcacgaatttcattttttttcttctcttttttcgagtacgcaatgcatcgtagtacgtatataaatccgtaatgcagttttgttgtacatgagtgcatccattgaaaacaatactgtgtttctcatgttccgttttatgccgctgaggtggcgggttcggagtttttgcttccggcccagccaataatgctctaagatgggcttgctcaccaagggtgtgggctcgacgtctaattgtgggccttgtattcggcctcagccacgtacgtgggctttatattgggccgcatgttccttgaggcccatgtacaccatcaagtcaggaggagaaatccccttccacgccgcacactctgtcacacgccggcgcgccggccagcggcggaactcgcgacacccgccggcgaaggagcagcagcacaggaggtggacggcgcgccagcgaggtcgcccatccagcctctgcgtttagttgtttgaccaatcgggaaagaaggcgaggaagggaggagaggagcggagaggaaaggaggaggggaggatgccgcaccacgcgcggccgatgacggggctgctgctgttcacgggagtcaacctggtgctcctcaacaccatcacccccgtctatgacttcgtctgcttccacccctactgggaacgcagggtacgccgcctccctctttcttcttcacccaccttatccccccattccgatctcccaaggctacgctttgatcctgtcgccctactacaccctggccaagccttttccccacagttcgatccgtgcatctgttgattgtttcttgtctcgagcatgcgcgccagctgtttgtggaaatgcctcgcgtctgtgctgcaactttcttcaattttatgatttcgggaacgaactatccctaacacttcctttcgacagacaatttggtgaagaaattccatattcgctagccagaaatttttacaattgaagagtgctcttataggagcatctttgtgctattatgatgtttttcctttctatactatgatcttgatatattgcatacaatttgaagttttgttgatgtgtaatcttgtgaccaatttagagagaacgtcgtcaaaaggagcgtaaagcactacaagccaatggttctctacaaactgctaaatgattttattcctaggtatgtgcgtgacactccttgagaaaaatctgtttgatggaagtgttcatttttataaccacttcaggagtagcttcacaatttggtggatgtgaaaggaaggtgagaatccccaatttatctggtaaaaaacttgagatatatttttgttcatcctagtgatagtgaacttgcttttggtatgctttatttatgcatgcatttgtttaactttgaattgacatggtatattttaaattttcagttgttttactacttggttagttggatgaaaccctggattcttcattgatatggagtgaagaaaattttataggcaggtaatattgtgatgctcttcagatatgagtagatctccgcactccaggtcttgctttcataatgctactcaactgcatcatcacatccttgtaaaattaccgaggaaactagatctgatgaatattgtttcttgaaactacctttatgtatctcttatcttctcatactcatctggctataacatagtaaatgaaaaccactgtttggctcaagccatttattctgatcaggatcctattaacttagttatttcctggggtggaaggaacatatgtttaacaactgatcctgcagagtgcttcattacgtgtttgaaagttctgaaaacctccaaccattttactgttcttccctcaacggtttatctgtcaacaagcagtagaggaatgctttctctgttcttgttgaatgtaccagtaatcttttgggctttctaatcaggtaggattcaatcatgtagtgtacaagatgactgaacagaaagaaggaacaaatccatcttcccaacaactagccaggacaatgtgcaagaccaaacatgaacctgagcccaacctgaaatgtaaatatgcaattggaaagaaaattccattgtatacattacactcgtggtaaatgcacatcatgtttgaaattgtgcacaaaccagccactatacacactaccctgtttcgctatagaactagatctcgcctcttcttctttgggtttgttgcttctgcacagcctgatcctttcctcatcatggccacaaactctgaataatctatcctcccatcctacatgtgcaaaatgcattcagcgtctcttgataggacaaatattttcagctttatcgatttcatctgttttgcatgaacacaatttaaagagcatttcttccttacattattagagtctgcatctgtgatgacatccttgatctcgttggcgtcgtataacccttgttccttcaaggcttgctcgagctcttcctttgtgatgtacctgcaagagggatggaataaatgtgtacaaatccctgaagttcagaattcagttatatcagtttttgctatccttaacttacccactattatccttgtcaaagtactggaatgccgtgtaaaggtgctcttctcgatccattttgttcatgtgcaccgtcgcggtgacgaactcctcatagtcgataattccattgccatcagcatcagcctgaaagttgaaaggaatttccaggagtcctgtcagttttagcatttcatctcgaactgaactgaagtttgtagcttcactatgaggactcactgcttccataagttgctcaatttcgttgtctgaaaacttggtgccctgctttgctaacccatttttgagctcctcaagcgtaatggtcccactattgtccttgtcgatgttcttgaacatctccttcagccccttgatctcctcctctgacaggcatccggctataatctacagaagattcaaaacaacaattaagatgcatatatctaccctgatgatgtgattaagagtaatatttaccctcagtgcagctttcttgaactggttcatggccctgaactgcttgagcctgttgagaacaacattgtcaagtggtacatcaggagcatccccatcttctttgatccacgggtgatctgcaaatccaaattgatccaaatgaatccaaatttaattctgacaccaattaagggaaaattaatccaaactgtacctctatatgaaaaaaaggagcagatttgagtaattaatctgtaacaaataaacttactgagcacttggaatgctgtaagcctctccttggggttgatgttgagcatcttcctgacgaggtccttggctccagaggagatcttcggccatggctcactggcgaggtcgatctgtccgcgaaggatggcggcgaagatggcgttctccgactcggcccagaagggcggcacgccggcgaggaagatgtagagcatgacgccgatgctccagatgtcggcctcggggccgtacttcctcttgagcacctccggcgcgatgtagtaggcgctgccgacgatgtcgcggaacacctcgccttccttgaagaagacggagaggccgaagtcggtggccttgagcggcgcgtcgtcccctttgctcagcagcaggaagttctccggcttgaggtcccggtggatcacccccatggagtggcaggtgtgcacgatcccgacgatggcgcggaggagcgccgccgcggcgcgctccgtgtagtggccacgcgcgatgatgcggtcgaagagctcgccgccggcgcagagctccatcacgaggtggacgttgtgcttgtcctcgtaggcgccgcggaggtcgacgatgttgggctggccagagaggtggtgcatgatctgcacctcgcggcggacgtcgtcgacgtcctccttgttcgccagcttccgcttcgcgatcgtcttgcacgccagcttctcgccggtggccttgtgggtgcacaggtgggtcacgccgaactgcccgcgcccgagctccttgccgatggagtacgtcgtgcgaacctcctccatcggccgctccagcacctcgccgatggggcctgccggcttcttggacgacgacgccgccgccgccgcttccgtcgccgccgccttggccgccggcgagcacggctgctgcttggcggacccatttttggaggaggtgccgcggctcggcggcgccgccttggaggtccctggctctgcctcgtcgccggcgacggccttcccgccacccgtgcagcactggcccatggcgtcgggggatgcgcgcgtgcctgctccggcgacggagaggcacggatcggagagagaatttttggtagaaggaagaaatggatgtgtgagtttgatgggttgagaggaaatggcgggaagaagtgagcggtagttgtttcggtttggattttcagcgtctcgtaggtttggtcgctggctattcttggctgctaataattgtttctggttagattttcctgtgaccaatcatcaatcgattagctgctaatagttttttctgattagatttttccagtgaccaatcaacaatctgcctttacaattgcctaaaaaaatgcgcctttgcaaacactaccaaactagtcaaagcttacaatatcaagcgtctcctctgttatgaaagaaaaaacaggccctaacatcttaagctctcatttctgcagaagcaccgagagcaaatacaaggatacttttcctaattttggtgtgctatgtatgtattttaactttcaggatacactcacaatttgttgattttagtcctgcattagtatgtcaccgcaaaattcaagaagaccatttaatcatgtaactgtataaggtgttccactgtcaatagagtgaaagcttcttctggaatttctattgccgtatgcaattctccctcctgaataaccacatcagataatgttctcctgaagctgtcaatagcatcctctggatgccctttcgcaatggatgcctgcagtggtgttgataaccgtaagcaaataacctatcacaagaccaaaactagaagtacaagagccaaagtttaggcactgtagatgatgcgaaaaattcagacataccaaatgcatttcatcaatcttgaaaagccaaaacatccatttcctagcctcttctccatcaatacagagagaaatattagtccaattcatatggtggaattccaaacgttgcagcccgaatccaacgccagcacctgtagctttgacaaatgcttctttaagacaccaatacctacagaaacagacaattgttaactccacaaattttggcttgtaaacatgatcagcaccctgcacttgttctgaaaagaaaaaaatgaacaagaacaaatgcatacctgtagaactcagttagcataccatcatgactgtctgcagtaacaatgcagttccactcatgatctgtgagataggaagtgaaattgttgatgaactccagggcagtttctcgttggggcttggagatgcacacaatgtccaggccaacgaggcagagaggctcagatgctatgccaacgtactccccctgatgcgacgtgttgaagttgaagccaggaaggttgacatttttattctgctgcaacaacaagacgtgatcgattccaatttgggcttcagaaactgacagaatgtaaacgtgaaactgaagatatggatttgggatgaattaattgatgagaatatctactagactactactactaccagatagggcttcccttcaagcgtgcggttgatgcgaatttggtggaatggcattccaagggcatggtgcacgagcgagtacttgagcaggcggctgacgagcgctcgtttcctgtcttcttctctgacgaacctgcaccggtgaggtcgtgaggacgaggagaaaaatctagaggctgaattcaattgcagtagtgagtgggtggaatcaatggggagaaagaggagttggttggaaaaacctgtggatggcggggcggtcgtgcggcgggaggacggcggcggcggcttggaactcggcgggggaggggcgccaccggccgacgtcgacgagccacctacaccgccaccgccccccgctgctctgcttctctccttcctccatcatcaacaactcgatcaacggacaacggtcaactcaagagttaaggcagagaaagccgtagaccatggcctggccggccggcaaggaaaggaaaggaaaggaagagggacgacgacaacagagaggggaggttaggatgggcctttctcacgaggcctgtaaacttttgaagctaaactaggcccaaattgcatatgtgcatcttgccatggtgccatggcagagacatcagcaaattaaacagcaacagagacataaccatagccatcagtccatcaccatctgccaatctctcacattcaataacagtcgccattgatacgctgagtgttgtgcactacattgattttttcgtcagactcggaggagatggagattaattgagctcgagtgtgagactaacagcaatgctacgcaggctaaagatcgcaatagtaattaatggcgaatcgagccaacgtcagttcgctatcgaccgacataataaatcaggttggttgtgaaccgagacatctcatcatctcaccctggagtcaggagctcaggaacagcaaagcaagaggaggaagaagcggagatggctgcaggcgacgctgcgacgccattgctggagatggcgtaccaataccatgagggctgccccgcctgcgccgtggagcgcagcaaggcgctcaaccccggcatcccctacatgcgcttcttccacatctggatcatcatcctcgtctcatgtacgtacgcgcctcctatatatcgatcactgcttcatttatacgtgttcatgcatgcttcgcttcctgctctgcttgactgcctctccagtctccttattatctattattaacttatgaagtctcatgttcgctctcatggcctaaaaattctcacattaatcggagaaaaaaaacagtctatataggaatctacctatattattttactacttaaagttcaaaatatttccatcgtcataaaaaagaaaaaaaataagtcggactcaacatgcgagaaaaaagattctctcgtcagtaaaaataggaaaaaaatatttcgtagtaaaaacaacgtccgactcattataacagaaaaaaagaatctcccccataaaatacatccgattccttaaaaaaaagaaaaaaatatcgccagtaaagaaaacgaaaaaaaaagtccaactcccatagaaaggaaaaaataacttctgacatcctactcccataaataaaggaaaaaaacatgtcctactcaaaatcgagaaaaaacacatattataaaaaatcccgtttataaaagaaatcgattcgaaaaaaccacccgactagataaaaaaccgaaaaaacacagattataaaaaatcccgtttataaaagaaaccgattcgaaaaaaccacccgactagataaaaaaccgctccgaaataaaccatcagaaaaaacattgctgaaaaaggatcgaaaaaaccatccgaattcacacgagaaagaaccgccatatataaaaaatactaccccgaaaaaactgtctgacccaacacgagaaaaatcccgcgtttataaaataattccgattcagtactgtgcaatgcgaaaaaaaactgtctaatttcataaaaaaaatccgatttcatgaaataagatccgtattgtttgtattgtccatcgtctaccatgtcgttttggtttttccatagcgtcgtcgaatgttcagacgtgtggatctaaaacaagtcttgcttaggcttgtttttctcggaacaagatcaaattgatcgaggctttgggtcagataggattctcgatttttccatcatctaaaaacttggtttgtgttccacgattatattctcctctattggagactctacatgtctctgtatgcaattattatactactggtaagtatagctaatattcttgatagcttatcatataaaaataataataataaataaacatatttttaattgttattaagagaagagtgcactgaggctctatttatttagacttgacaatacaagacaatgcaggatttgattgatcctattattattgcaagaatgagattgaaagattattttagattatatgtgtacaaccacataaataatccaatttgtttgggtaaaacatgcattgttaaggttgtcatagtcaagattgggtcattatattacagatgtttcaattttccttataatatgtcttagcaacaacgatcgatacgattattatcatgggaaaattgaaaccatgccattataattttgcaaaatttgagatatgacatcctgacccacatgtcattgactcatgtgggtcctacatgtcattgagataccgatggcatatcttaaactttgcaaaattataatggcatggttccaatttaccctatcatcattgacataattatagaatatagctgaaattcggaatttaaaataaggaacacaggaagaaaagactagagtccatactggcataccatagaactaatggaaatccggaactagaaaaataagaaaactaaaagtagaggttagagtccatatagaaatacaatttagctggaatttggaattagaaaaataacaaaactgaaagtagaggttagagtccatatagaaatacaatttagctgaaattcgaaattaaagataaggaatataggaagataagactatagtccataccggtatacaatataactaatggaaatttgggattagaaaaataagaaaatttaaagtagaggttagagtccatatagaaatacaatttagaaataacgaaaattcaaaattttaaaaaataaggaatatggaatgaagtatatagagtccatataaaaatacaattttaaaataattaaattcgcaattagaaaaaataaatactaaaagataagtttagagtccaaatacaatttagacataatagaaactaggaattaaaattaagaatattggaagaagagtatagagtcatataggaatttataattaactaaaatttgaaataaaaataataaaactaaaagtagagtttagagcacatgtagaaacacattttacaaataaataaataaattataatgaaaaaaagaatattggaacaatagtccataaagaaataatattgaaacatgagtccataaagaaataaaattagaaataataaaaatttagaattaaaataataagcaatagtagaaaaagagtctagagtccatataaaaatacaatttataaagaaaagaaattcggaattaaaaataagaaatattggaagatgagtataggaatataatttagaaataactaaaattttgaattttgaattagaaatataggaataaaattataaataatagaaattcatgattaacaaaatgaagaatgttggaagaggattctagagtccatatagaaatacaatttagaaataactaaaattcgctattaaaaataattaataattgtcatttatatacaatacattacgaatattacacattggttagtttgatcaagttagtacaaaatttaaaattatgttgtccttttaatatatttgataataaaatatgaaatatgctattatatgagagaaaatataagaatgctagctgcgcaatttacgcgggccaccatgctagttcatgttatgttcgaaaaagctaatggacgagcgctcgcgttcacctgcccccacgcgatcaatttactctgaccaatcccatgccacacgaagtatagatggccaatggattgcccggctccgcatggcccaagcacggctgtgcctgggctgaggtcagtcaggcaagcacggcccaacctacatgtcaggctgtgtcgtgccagctcacgggctgcacacacattccaggcacggccctatatgactcgggtcatgccgtttcggctgtaaggcacgataacccatcgtgcttcttcatagaataagtctatttttcatcctcaactctttgggctgtcttatatgactataaataagtctattttgtattcctcctctcttttggcattgccttatatggttgattaagtctattttggatccctataatattttcttcgatcgtgccgtgccgggccagcccaccgtgccaaggcattggcctaagcacagcccaactgtcgggccatgccgtgcttaggcccggccaaatggtcgtgtcttcggccgggtcgttgggccccgggccatatggccatctataacatgaagcgtcatattctttttggctctaatacgaatatagccacttcttccattttcggctagtcctttttcttttcggctttactctttcccatttaattttatttgaccaagttgaattttaggtgagaccaaccagttaggcctcacaacccgcatgcatgatttttctttttttattctatgaattcattttaatttgtatatatgatacaaactttatacgtatgaagtttctatacataaagtttatatgtataaaatttattgcatattttttttgggacagattaacatgtcgttgaattcatttgaaatttatgtttataaaaatttacatgcacaaatttctatataaaaaatttctctttctatatatgtatatatattttagatatgtaaagtctatatataaatatattttctttactgggccatgttgcttttgttgggctgaattctagaaaagagagaaaaagatgcacgtggaagcctacgagcgtggaaacatgaccgagaaatctgagtcgtcgcgctcgcgccttagcaattccttcttaggtgtgtaaacgtaatcgtgcacaccgtggacccatggttgctaagtattagacggaccctattatgtttgcatatccattttttttccatttccaccagcattgcaagatgtgaatgctttatcagtcatttctagttcacctgaatttatcttatagaggattattttgtactacctccattttttctttttatatagatgactcatttgacttttggcataatgtttaatcattcgtcttatttaagaatttagtataaatatgaaaaaaatatgagtcatataaattttattaataagagaaatggtcaaatgtcacgttaaaagttaaaaaaataaagagagtattagtgtctaaaattaaggggctaaaaggaaagttcaagcttgtaatcgttggtcgaactattgaagcaaaattctaaattgttgtttcttgcatctcttttgcatctttatttatcttgtcattggcttagcttgttccattgatgcgggcctgtgagcttttcatggtagatttttaacctttcatccttacaatattttttttactgaattccatccttataattgaatttcaggtttgccaatatcatcgttatttcccttcttatacttcatggtatgtatttatgattgtaaaatttacaatagcaccaaaagtatactctacattgtataagttttagtgtaaattagctgtttctatttctcattagcggaatttgtaccttgcataattttatcatttggttccgtgaaatgttgttcatcattcatgtagcaattcaaatttctctagtttccatttatattaactagttttttagtcttggaaacggaaataacagtaaagttaccacctaattcctaattcttcaagctatgtatagtcatatatatgttgctatgtatactcatactcatatgttttggctaatcattgtttgaataaaaggtaagctcatagtttaattctcttcttcacaatatgtaagagattatagcatttatttttattgtatatttctcttgtccactacagataagagacttgcatgttgcaaaaagagtagaggacattggattctatgcaggttttgtaggtaagcaattataatgtctgtaataccaaaggtcatgcttttacttagtagtgacaaatgttttttacacctatttatctatcgcaaacatggcatattataattctcaacctattaggtgcgtcatatatgtttggtagagctttaacttccactgcttgggggatggtagcagatcgtattgggaggaagcctgttatcatttttggaattttttcagcctaagtactttttagttcagttccgattgaaccaagtaagtaatgatttgtattaccttctttatatccacctatgattactttaccttgtgttgtgaaatcagatttgtattcaatactctctttggactaagtacacactattggatggcgataactacacgatttcttttaggttcattgaatggcttacttggaccaataagagtacggtgattaaattatctaaattcatattttctatccactattgaaatactataactagctagcatactgcaaccgggctttacaggcttatgccgttgaagtttgttgaccagagcatcaatccattgggttgtcattggtatactacaaagttctataatattttttactatagttatattgcactttagattatgacactctttttatatgattaggttagcacatcatgggcaataggtctcattgttgggccagctatcagtggatatcttgcacaggtatcctactaaattttaataccatatgagttgggtgcatgcttaaacaatgcattgacgctattatgatgcttttgtttcatttgacagccatcagaaaaatatccaattctatttttagcaaactcattatttggaaggtatcgttgttataggaaatataattgttctagatggtataactccttaaatgactgattcttgaaaatctttccttaggttcccatattttctaccttgtttatgtatatcgatcttctgcttcgttattcttataagttgcatttggctcccggtaagtgcacaactagccaattttattcttattgatattaatttgggcacacataattcttgtttttatgcttcccttagctaaaatttatcttacctactaaaatacaaaagttaattaatattttgctaatactttcaggaaaataatgtgttttcatttcaaaataatgtgtttcataaaatttcaggaaacactacataaatattcaatagaaagaactgagattgtaaaattggatctttgagtacacatttggttgacttcgaagagtttgtcaagcaacacactggtccagctaaagataagagcttatttaagaattggccattaatgtcatctattgttctcttctgcattgtctccttcgatgacatggcttacacagaggtatgtaccaagtatgtctaaactaatggtgtagtatttcttagctaaatgagtctagatgtttgaacccaataatgggacaattgaaccatgccacacaaattttgcgaataattgaggaaaagttgccctgttttgggaaatatcgattaaacacttcacccaattacaaaactagggtatagtgttatcactataaataatgcttctatgtttatgta

SEQ ID NO: 5855 - DNA, 23747 bp, Oryza sativa
attcctgcagcccctgtttgttagttagaccctgtttagttcccatgcaaaaacttttcaccctgccatatcgaatattgggacatatacatgaagtattaaatatagacaaaaaaaactaattacacaaatgcgtgtaaattgcgagacgaatcttttaagcctaattgctccatgatttgacaatgtggtgctacagtaaacatttgataataatggattaattaagcttaataaatttgtctcgcagtttacaagcggaatctataatttgttttgttattagactacgtttaatacttcaaatgtgtgttcgtatatccgatgttacacggcaaaaattttcacccctagatctaaacacagccttagttagattagatttcctcattaataatagtaagctactagtatagtaactagtatagtgttttactgtttgatgatcacttatttctagcagtagtgggctgagactaggggtgaaaacggtaacggtaattcctggccgaccgacattcgtttccgactttctagtggctgagccatatggaaatggcaatcgactggaaaaaaaatgaaaatggtaaaaaaatatggaaatggaaatggttttgctgttataccgattgtttccgtatttaccatattcctgtggcaattaccatttcctataatatggtgattactgtatttctaaatatatcgatatttatagggtatgtctgtacttgacccacagtttagagattgactgactcttcaatcaaattcctaacctcaatatacttatgtaaagttaaatatatgtattctatagtttaatgtttccgtatttgttatcagtttccaatatgtactgacatgtttccgtccgtattattttgtttctggctttccaatatttccgatattattttcgtttccgactttaccatttttgatttcgtttctgagaaaaatatgattatggaaatggttgaggctgtttttcgatcgtttccgatcgttttcatccctagctgagacgtactctaaacacacacagtttcggttgaaatttatggaactgctgggtttaggctgcagctggttgactttagttaacagcacacaatttgcctaaaatttaaggaattactgggttctggcagattaattagttctcttacaattgcagcagcaatggtgcctccattaagtttttttttaatttgtatgtacgtaatctgtcaatgggatgtacgatagatgaataatcttgaactacttctactttttttaaaaataaacttcaactaaatatttttaattattattattattattattattattattattattattattattattattattattattattattattactactactactactactactaccatatatatactccagtttggagtagtacatagagtaccgttgaagaagattggcaacaacggcaggtgacaattccgacttggaatggtgcagatatatacatgatgtatacatgatgaagaaatcaagtcagtgaaacctgcatgtcataatcttgagtcaatagttatgcacctgttcactaactttggatggagattcacaaatagaattcaataatttttatgatctttttatgctgtgagttcttattagttcgtgtatgcttttgtttattctagtgtgagtttttgttgaattggtgtaataattggttgtagctctttgagcaaagcccgggattatattccattatctaaaaaaaaggtggaaaagtctattcgtctcgagggaacaccctttatttttatatatcgtttacaaatcataaaaaaaataacaagatgtagatcaatatacaatatattaataaataaaatacaagctcaaatttaactagaaatagaaataataaattgattccgaataaaacatgtcattcatattgaaatttattttttaactatatatatctaattgaatttacatatttgttgagtgacatatcacatatttaataaatcttattatatttttattaaatttattaatgatattttaagatgacatacaccgacatgcacaagtaaagaaacatagcaccgatatatatatagggtttagggttagagttagaatccccttatctctaagaaggaaggcaacactatgatatgccttggtaaggaactaggcataactttgagtgatcaaagagaatcattcgaggagctaagctatgtttacattttcaaaatcaaatggaaaaacccaagtttctgaactgattgatgcaaaagggaatttgaatccatgcttttccattattcaatcacccaagataatgttcacaggttcatgtgaagcctggaataacttgtatgcatgtttcatatcaaggagatgacccatcttggtctttaaagcttttctcgaggacgagtaaaggactaaagtgtgggggagcttgttggcggtccttaactcatatttccaactgccaactctcacataaaatctgcataaacaaacaccaaactttgcaagacttacacataaataactaatgaattccacgagttttggtgattcaccattgtttgcaagacttatacataaatatggtggaattataaagaaaggcacattccgaaaagcataaatgtagaatccgtgcaaaggaacaagatgaaggcccaagtatcctacgaacatgggccaaccaccgacgtaggagaggtcctggctgacgcaacagccctccacgtgaacatggtggtgagggggagcccatagaggggcagccgcacccctggtgcgccctaccttctcagccctccttcgtgtggcagtgcattccatacatgggttttccatgtatatttctcctatataccgacctatttggactataaaagaagagtagaacatccctcatcatcatcaacatccaggaagaagagctactagatattgagcaacactccaaagggcgactgtagcgaagaagagagatgtgagatgcaaagaagagagcgactgtagctgcatgagtcttctactcggtctactatgtacaccaaagggtaaaaggagtgccgggcctgtcggctccctacaacttatacctctgagcacttgtgcttccatgggttctcctgttaagtaagtgttcgtggttcttatggtattgtgtattttgattagctaagctatgtttttgtttgtttgcaggttcatcgttcgttcttgtaacagatgttctagcgtaggactacgatcttctcggactccacgatcaacgttagaatagtaatcgatagcatagatatggtgtctaggctagaggttaccttcgttttcttcgtttccccacggtagaggggtaggcggcaagtggtgacagccctatccgtccctagcactcccccacgtacgggttggaagtagagctataagccagacatctacctagtggactaggtgctggccggtgcatgaagtaaagatctgttcttagacctctaaaaccgtaggaatccatctttgccctaacctttcctacccttgtgttatccttgcatggattagctagaagaataccttcgttccctgtggaaaatacgatactttgaatacagcttggtgaagtgctacgttggtaattccgttacgctttcagattatttctgtttgcgttaaaaaataccaacaagcaaaggttcaaccccattactgactaagtcaagcctgatgattatttagcgtcgaactcggcactaaagtggaaacacttcaccaagaatggagaatttaaaaaaaattacttggagctccttacatccttatggcaagccattgattatgcaattgaagatctatcaagcagtttaactatttggattcccagctaactggttcgataaccagttgaactggtcggatcaccagtcaggctggtctgctacaagtcagcttgctctgaaatgctcaagacggtgttgctcaatggatacaaggcgcttggggactagctgtggagggtataacccccggtacccacaacaaggcgcatgggccggcccaccaggaatggcctgacctagtacctgaagacctgtggcgcacggcagcgctcggaggcgctcggcgtgcactgcaagtctaccataaggcaattagcagatagatagggatctgatctgataagctagatatcagatcccttgattgatgcttatcattgtaaaccaactagattagatcttaaccgacttgtaaaccctatctcccggctatataaggagggcatggtaacccctcaaaacccgataactacacctcatcttgtatcaatatacaatccaccagaacacatgacgtagggtattacgtcgccttgatggcccgaacctgtctaaagctttgtcacagccagattttcgttttaggatttataaattatctaataaattattaatagaatttatattaaatgttcattaatttacaagtgaagttaaatgtgggaaataaaatttcctaaatttaaagcatggatggatttaatttttattaaattctccatgattaattatactctctgaaattttctcggattttttttcagagctcaattcctaaatgatacaaagaacagttcagtaattatttaatcattaatgatctaattataattatgttaagtgttttttttgtttaaaaatccttaatttataaattgttgtctaaaagggaattattagaaatgatcttaaaagcctagaagagaagatctaattttaatttgttaaatctcaatataaaattgggctagataaaattttgttaaatacttctcttgattctttagttcctagatttttctaggacttatttgagccaaggaagtatttttaataaatggaattgcatttcatgaataatttaaatagaaaaatgtttttaaatcctccttttggctttgggccgaaagtcggcccaaaaccgctctctctctccctcggcccaagtcggcccaagccgagccgcccgtgcgcgcgcgtgcgaccgccgctgacaggtgggtcctacccgtcagtcgtcatcttcctctcgccgaaaccctagccaagctgcgctgccgccaccctcgccttagtctctcgtcgccagtagagctctagcgccgtgccgcctcgcgccgccgtcgccgccgccgctcctaccgtgcgctgccgtcgctccagtcgtcgtcgtcgctcggggatgtcatagccgtggtcgccgtcgcgtcgccgtcctcatccgccctttcgccgtccctgtcagccgccggagcaccgtcgccgctgttgatccgaccgttgccgccgctcttcctcgtcgccgtcgtcgtccgttgatcttccgccgtcgttttggtcaccaatgagttcgccgtgctgtccgctacgtgtaggtgtcctccgtttgggccgccgcgccgttgttcgctggcgagcacgcgaggccgagccgtcaccggtgatgacgtcatcgccaacgtcatcgttgccgtctgccgtggtccggtcgtggaccgatggatcttggccgtccgttttggatggatgaatctcggccgttcgttttcgtgaaccgtcgccatgcacccggtcctccgcgaaccctagccgatgacgcaataattcccttttccttttcaaaaataattcattattgcgtcataattcaattaaaatccatataaatgctttaatccggtttaatctttaaaaattcataactaattcattgtaactcagtttaatgtggttcaagttgcaaaagttgtataaaataaagatctacatattaaaattatccataaattgaattaaatttatttaatcctttttaaatgggctttaattagatttaatcttgtaaaattcgtaataaattcatatgaagtcagaatgaggccgttcaagtctcaaaattcatctaaaattatgatctacatgtttgtttactttttatgtattgtttatttggagtttcttagtctttttcctcgttttgtgtgttagcttgtcgtttccgtcgtttcgaaagttcgcgagtgcgccggaagtgttcaagaagattaattgaagaccctttattgcaaggcaagtcacacagatcccaaacacaattcctttgagcatgttgatcctatatttaaattctctatttatttcaactgtgcatttatttttgaatgtcaccgggtggtgtgaacctattcctttgttatggctagtttgcattgattaccctatttcttgattacctcgggttataatttgactggttggatttatatattggttcaactagatgttagacataattgcttagccatgcttagaaacattagcacacaattgggataactaatgtttcactattacttaatgatggatatttaatgatagctcacgatggtcaatcgtgattggttaattaattaatgtgccaactaaaacttgataatggtgggttgtgagcacatggttttgatggtcgtgctcatgacaattaaggaccggttcacgattttcggttgtgaaacattaaccgtgccaaccacaagccagaatgggcaacggctggacacttcgtataacaaggctcattgcggagcaccagactgagaagtggcggagataagcccacgggggtcgctggggagtccatgccttgtttataagggggtgactatgatccgggaacggtgcactgctttgagttgagttatgcgaggggtcttgtcacaatcactcaacatggtgacgtgtctgcgcggacacggtaacatgctggtgggttgtgtcttgtgggtacagtggtacacctctggccagagtaaaactattcgaatagccgtgcccgcggttatgggcgggtctaacaatgtctttcgtgattagtctcacacttctcaccataataaatgatgctataactggtaataatttgattagctcctggtttggaatggtatattcctggtttggagatagatctgtgcagccgggtatggttgttcagaatggttgggcctgtgtagcatgggtgtgctgttcagtgttgattaatattgatgattaattactctattgttttacaaattctcaaatgtttgctaaatgctgtttttgcaaatgagccctatattatgccatcctttggtatccttgtgcacttgcatatttgttgtgtggcttgctgagtatgtcatatgctcaccttgcaataatcaatcaaaccttagttgaagacaagttgcgaaggagaagacgtttggcttataccccagttgagctgcctgtgggagtggagccggagcttcgctagattttattttccgctgcagttttcttcatggtgaggactaagtgcctcttaagtaagtatttatcgttttagttaatttgatgaatctgtatattaaattgtcagtttgtgtacctcggctgattcctggacgaggattttatgcacaaataagttcagaaattactagtgaatttctgggcgtgacaagcttcatgtccctgctcttcgtgttcatcatctggttctgatcatgcacgtccctccacgtagttaatctaccatcgtggttatccccctcagtggactgccgaccatatttagtcaaagtgaactataggagcctttgagcaagtttaattgcatagccaactactaaatgcaaatcatctatagccaatctaatagctcattcatacaatagttatccataaaccattaatacatggtcccacctctcatacacacataacgtattggagtttgtgctacagctggctacgaatctgtagcccgctttccttctctctcttctctcctccacatatgcttacaattgacttgtagcctgctattgtactcactcttatagattactgtaacctgcccttaacaactaattaaggtggaattaaaattccacggtctcataacacagtaacacatgagccaaattcaaataggctgactgtcacctaatttaaggtgactaaataaaagggctaccatgccaaaaacaaaattatagttcttggacatgcaaagctgccgagcttgtcaacatcgattctttggcctgatctgttgtagtatgttgttgctctctggggtagatatgtgtagatttctcaatatcgtcatcagtgacatcatcagtctcattaccctctttgctcttaccccacagcatggtgtaaagacttgcgaccagcaaaattccacccaagatgctgccaataaaggaagagaagaaaaggaaagtttgtttatttcagcgtgtttttagaatattgcacctttgatcagctgacagtgagtatatatatatatatatatatatatatatatatatatatatatatatatatatatatatatatgatttaatttacttgccgaggtgaacaatctctccaagaaagaaggatgagcaaaatattgtgaacacgaagcagagtggcgtccaggaggcgaagaacatggggcctctcatctctaggcaccacgtttgcaggtagtaggacactcccgtcaccataacaccctgaagcaaaccaccagtcgtctaatagtcagatgcgtgtgccgaagaacatgccaatagtgaatacactagtggaagaggatgattgaaaattttatgtgcacaacttaccgagtataggatggcgagcaagctaatgtcgaatcttagcttccatctggagaagtcgcgctctgcgaccaccgcgacgacaaacgactgcatcgtgctgaacaggcaccgagtcacagtcacaaccattttatctggatattccttttgcaccgcagcctacacagtcaatagacaaggagtagagaccccgataaatgtgtcagcaattgcagctgtggatcgatgtagacaagcatgcaagaacagctcagaattttttttggtaaataattaaatatgcatgcatccgaacttgaaaaatgatccacaaagactagcacatgttggcgaccaccataaggaatgtccatttgatccacacacccctcggaactactgttttcgagcttgtgtcagaggcgaaggcacggtgatggttgatagggcttatggatgggccggtgaagaagacgatggtgaagactccagctaggcagagtgctacacttgtgaccttggctatgcctgaagagctcctcagcttcacatactccgtcctgtcctggcaagcaacattccaatcttggtattatctactactccatccattcaaattataaggcggtttggttttttatgatacattacttttattatgtgtgttgatatggtgtatatctaaatatctatatcaaaatttatgtgttcagaaaagtcaaacatcttataattaatattttcacaactaacttgaatctatttatgatacattctcaagttaggctttagtgatatcgatgatgataaacctcaaaagcaccgccaagaagaaggtgatggctgggagtgagctgtctactgcagatgccactgttgcagaggtgaacttgagacttacatggtacagatttaccccaagcgtaatcctgaaaagcaatttccacaagtaaactagggactaattaaactcttaacatggcatgagtatacaatcgattgttttgttttgttttgttttgttttgtaccaataaattagagtttgcaaagatgagcgtatacccgattaaggcacagaagaagagctttatgagcaccccaagtgtcatggcaggccgtgcacttctcctacaaatataatcaaacggacctgtatttctcagctaatcaaacaatatagcaaactaagcgaagtagcaatataacaatataggaaaatgattctatactctcaggagtacgtactccagctttcatagattactatcggatctacactttatacccgttttgtgttttattttttaaaaaataatacataattttccctcattaatcggatcagcaaacggcccaaataaatcccagaagacggcagatcgctctccccagtccccaaccaattcggcattcgcgagcgacggcaagccgacgccagcagcgtgaagtataagcggcaacggtgcaaaatcattcatccagaccttggcgtgttctgcacctcgcatgcactgttttcttttctatcctattttctttgccttctcttgccgatcgagcatatccttattttttcctgttggatctataagggaagagcacatatgttggatgcatagatgtccagtgattttggtggtttgggaattgtgatgtatctttttttcacggtaattcaatttattctttaattagttacttgactgattaaccccctataattgggcatgcagacggctgtcggccggcggcagttctgttatttttttttaatcggaactaaaaataaactttaatctgataaaaagttttaaatctttagtcccggtttataagagaaccgagactattgtaaaatttgacggaccgatcaaagatcgtttctctagtagtggctctcaacccagcggccagtggcactactatctgctgaatgtattgcatgttttgatcggcgaaaagatgtactgatactctccattcagaatttagtttgctgctacagcatcaaatatatattttctagtgattttgtttgtgaatttgtcagtggcagatacttctcatggtgatactcatgtcctaatgtattatgattttttctgagatctagtgtgttctgtgattcatatctaagcaaccccataccaattaatatctttaaaaatagcatatactatatttatactaactaaaaatagataaaaattagtacataccgcaactaacctaaaatgtggagtagtatatactgctactttataaaagcatatactgctattaacttaaaaattagtatataatgctacaaagttaaaagcagtacataccactactactattgtaaaaatatgacatataatgctactggtagaattcagtatatactactactactactaagttaaaaattaaacagtatgtaccactactactctataaaatagtatatactgctagtaactaaataaacagtatatactgcatgctactaacatttaaaaaaaagtatatactgctactaagttaaaaatagtatatatatacctactacattacaaaatagtatatactactattaacttaagaaaaggtatatactgtactaactcttcaaaggagaagaattcagtacatactctttcggagaagtaatcagcataactgattaagaaaaaagtatatgctgctctaattaagtaaaacgagtacaatttatgctgctactacttaaaaaaaaggtatatacttaaaatatttataaccctttttttaatcagtttgaatggtagaagatccatctgtttagaggatggtacgttcattattcaaatttaaactaacagcacactccctacgttcaattgtgcaccaaatgcggtctgtacctgtgcatgcatgcaccatgcagcgattagagaaaaacaatattttcattctcttcccaccagtttaattagatgctaatggttatccactaaggggagagagtatgtactcccgggagtacataacaatgatcctataaattaaaatggttctatactaccgtccatagaaggcagccccgatgaagagcgctattggattcacatgtggacccgttttgatttctattcgagaaaaaaaaaatccgtagtacgacataactatcccacattaatcggtataccggagtgttcctgacgcataaatacctctctctcaaaccatcctattggtaaatcgggtcctcggtgagagcacgatctaccggcggtgatccggacggatcaatggcaccggccgattttacggcgacatcggtgtccatccgatactaggttttccttttttttttaatttcacgatcttgtttgatttgatttcagatgcatcaagcaagagagagagatgggttgttacatacctttgtagaagagctgcagggagcaagatgagggagccaactgcctggcgatagaagacgaagatgtagatgttcatcccgtggttgaaagcagccttggatatcacaaacatgccagtgtagatcagttggacgacgatggcgacaaaataaggcttcatacttgctttcaccatcttgatcgatctagcaatggcaggcgtgcgtggtgtttgtgcgagtgcgttgtcttcagtgtgcagagtgtgtgttgtctacagtgtacgagagcgcccgtttagtttctctccatcaacctggcactatttctatatatttatataaaaaagaagcagtcagtatgccaagtgtaaacgcaagagcacggtaggtactgtagctttgattttgggtaactgatcaacacgccagatccacacaatctgctatttttagtctccacagataggagacccacttcgagtgtacattggcggattcggcggcggccagctcgagaggaccgacgctccgtggctgaccgtgccatgcagatgcctgttcgtaactaaccgagtggtggcctgcgttttctcctctcccgtaactaacagagtggtggcatgcatttttttcttctcccataactaactaggttagtttagaataataacgataattaagaaaatattcttttttagattttgcttactaacagattgaaaagaaatctatatatgaaataaactttcaagtaaaatttaaaactttctatcgaaaaattaagggatttgctagatgtctattagattaatgggtaggccaaattaaatcccaataataccatattggaaatttagtgctatgggtaataataccatattgaaaatttaagtgaagagatcttaatttaaatatggagctagtggagaatctctgttcaccggttgagatggtggatggacagccacactcgtgcacagagctgtgtattaactcgggttaatcgcacggattgaattctccgaatgtaactctcacatgtgctacaaatcctctgcgattaatcgcgtggatgctctccctctcttgttctgtatcggaagatgattaattctggtgtattaactcgggttaatcgcgcggattgaattctccgaacataactctcgcatgcgctacaaatcttccgcgattaatcgcattaacccgggttaatcgtgcagattgaattctccgaatgtaactctcgcatgcgctacaaatcctccgctaacggggttaatcgcgcgaattgaattctccgaacgtaattctcgcatgaggtacaaatcctccatgattaatcgcattatattctagtgtattaacttgggttaatcgtgtggattgaattctccgaacgtaactctcgcatgcgctacaaatcctccgcgattaatcgcattaactcgggttaatcgtgcggattgaattctccgaaagtaactctcgcatgctctacaaatcctccgctaacggggttaattgcgcggattgaattctccaaacgtaactctcgcatgcgctacaaatcctccgcgattaatcgcattaactcgggttaatcgtgcggattgaattctccgaatttaactctcgcatgcgctacaaatcctttgctaacgggatgaacagacacaacgctcgcacttatgttcttcctctctcgcactttctttccggctgttctcctatttcggaactccgtctgcttacgtacttgcacgggtaggcaggcaatcaagtctttggggagcgtctcggtgcaactgctcatgttctgcttcgacttcttcctctacatcgcgatggcttccactggaaatggcgcaccaggagctggagggaacggcgatgctccaggagacaacactaacggaggcaatacaaatgactcaacctccttgcaccgttttctgggtatatggttctatctctaattgatgttcttcatgttacttatatattaatcatgctatccttaggattgcaatcctaggtgaatgttgatgatgcttatgcttatgttatgaaaaacatgcccatatttctatttagtcacaccactagattattactattgtgaatgttatgtttattattgtgttattttagattaaaatataccgaattatgatcaaatttacaaaatgccagcctgagggatcgacatctcagcgagcgagattggtgaattgaaaagtggggacgaagctgatcatggacgtcggcggcaggtagaggcgccgctgctggagaagaagggcagcaccggcatcggcgatgggtactgcactgagaggtgcccgggtgcggcgtcgatcggcgtaaggccgcgagctccggcatcccctacaggagcttcctctttgtctggatcatcacgctctgcacaggtaaccaccacttcattcttctctcttccactcacccacatgcatcatcaatcgcgcgcatctgcacctgattcgcttccccctcctcttaattgatgtccacatttttatcgagttatatcatgagtttgtgtttaatttctcctatatatgttctccattgatcatgccaccttggagtgctatatagaagtatatacatactgatgcagccccttcaattaatcaaaatctttaaattaacaattactactaattttatgaattgctttgagattcgtgcacctcaaccaactattgaatttgggcatgacactaagggcttttttggagagattctgaatagcttctctcataatcagaagctctccaaacaatttagcttttcattgatattctaataagttgtagttgtataatcttaggcaataaaatagaagtcagaagctagaaaatctaacttttttatattctaaaaagactcttcaaatttaatctctggccagatctaggagcggagggagagaaggggagccgccgccgtcgccccgtccatgcggccgccgtcgcaccccctcctctggccagatctaggagtggggaaggagaggggggagccgccaccgcgtccgcgccgccgccgtcgctcccctcctccggttggattgggagggagggaggggaggggaggagagtgacgggccggtgagagagagagagagagagagttgagagggaaatgagtggtggccggtggggaggggtggaggagaagataaggaagacttaaagatatttttttgggtaggtatgatttttgcaggcggaccacataaggttccacctgcgaaaatcaatttttccaagcggaccacttaagaggtccgcctgcgaaaataaagttatttttcgcaggcagacctccacctggaggattttcgcaggcggatgacgaaaatccaccccgttttatattttcgtaggcggatcatatttggttccgagggtcatacccgctttgaaaaataaaaggccaatttcactaaaaatccttttttaagtagtggtggctattgattaattgtagcttaatcaaatacgtgaaatttctatatgttacactaaaccatgattgcaaaagatggctaaagaaatgttagtatacatgagaacattcttcaattgatcagcatacaaagtgatctactgctaactgacgaaaacgagacaacatctaattaagccactaattaaacattattacttttgaccaaggtaaaataatgagtatagtactggtttcgtttacacaaagatcgagggttgcactctacgcgtacctgtttgttaagtagttaatcatgagtgatggagaagccgggagttaatcatatttgccacacaaaatcaatatgcaattattgaattcgtacggacaagctgacgatgtagactgataaataaaatcctgtatgcatgcatgcatgcgccattttgtactccagtaatcttttgtttggcatgcatgtcagcatgtgtgcgtggttcaggcaatgtgatatatagtgaattgattggcaatgtgagagtgagttgattgaagtagcaacaacctgtcgggcctagcggccggccagcctgactgactgacgtaggagctgacgatgccattgcacattgttggtgctactgatgctcaattagattagatatcctcattaataataagctattagtagtgttttactgtttgatgataacttatttctagccgtactgggctaaaatgtatagtaatactgaaattaaggaactgctggattcaagcagcagctggttgactttggttaccagcacacaattaacctaaaatttaattaactgttggttctggccgattaattagttatcttacggttgcagcagcaatggtgttaccattaatttttttaatttctacgtaatctatcggtgggatgtacgatggattaataaacttcaactaccttttaaaaaaaaaacttcaactaaataattgttattactgtcatgtactctgacttatttttcgaggggacaggcagggagttcctacaatttaatccagtttataaggaaaaccggaccaaaaaattttacaacagcacggttaatttatgaaaaactggcgaaaaccccggcattgacatactgaacctaaaaactaagaacagcagtccgacaagggataaaactcctaaaatgaatccttcaagaaggatacgccgacagaacaacgacatcgtccgatcctaacgaatctaaggttttcatccggagaaatctcttgaagtggggtttgaaccagggctccaatagcaacgccttcaagaaggtaaacggcacccaagggtgtcgccgttgctagcatcggcaagttgagcaaggctttcgcctcggagtcccatccaaacatagcatccgcgacggaagccaccaaataccacctgcacaccgggtactgtttaagaagattgacagcaactgcagcaggtggcaattccaacttggattggtgcagctatacatgatgtaacatgggaaagtttattcgtcgctcgaggaaacactcctttaattttttatactatttgaaaaatcataaaaatattaataaaaagtatatcaataatacaatatattgataaataaaatacaagctcaaatttaactagaaatgaaaataataaattaactcagaataaaacatgtcattcatagttaaatttattttttaagttatatatattaaattgaatttacatatttgtcgagtgacacccccacatatttaatttattttattatcttttttattaaatttattaataattttttaagatgacataaaccgacatacacaagtaaagaaacatagcctccaacaacaaaagtccatcatataatcatatactatttggacaacggaaagcctgtttcgacttgtcttctcccctccggcttttctgttccatgcgttttctgctctgcaactgcaagcaagtccctctgctagctgcgagcctcacgtgcccattcactctctttatttattgctgattcccgatcgatcgatcgatcgatcgatcagcaggcaatagttaatcgatctcaacaactacccatcagttattcaatacaatacagccattcagacagaagcaaggtctatcgagtcagagagatcgacatctcggcgagcgagatcggtgaattgatgggtgatcatggacgccggcggcaggcggcggcgccgctgctggagaagaagggcagcaccggcaccggcgtggacgatgggtactgcattgaggggtgccccgggtgcgtcgtcgaccggcggaaggccgcgagctacggcatcccctacgggagcttcctctttgtctggattgtcacgctctgcacaggtaatagcctcccttcatttattctctcttccacccacacccacatgcatcatcaatcgcgctctcatcgatctgcagctgcagctgattccgttcctctctttctcatttgatctccatattttagcgagttttatcatgatgagtctgcttaattagtttctcctatatatatatatatatatatatatatatattctccattgatcatgcagccacattggagagctatatatatacatacagtcccttcaattaatcaaaatcatcaaattaataattactaattttatgatttgttttaagatttgtgcacctcatacaaccgttcaattttagcaatggcttattcgaggggtttctgaatagctgtagcttcttatgataatcagaagctcttcaagcgatttaacttttcgttcgtactctaataagttatagttgttgaattaacaaaataaaatagaagtagaaagctagaaaaccaattttttagctctaagaaataactaccaaggctgtgtgtttagttaccttcatacttttaacttttctatcaaatcaaatatttgaacacatgcatggagcattaaatatggaagaaaaaaaccaattgtacagtttgcatgtaaattgtgagacgaatattttgagcctaattacgccatgatttaacaatttgatgctatagtaaacatttgctaataatatattaattaggcttaatagatttgtctcgcagtttataggcggaatctgtaatttgttttgttattagtgtatacttaaaaaaattttggacggggaactaaacgcagcccaaattagctgattattactactccgtcccataatataacaactttttgttgtctagatttatagctaaaaatgcttatattttgggacggagggatacaattttaagcttttttttttacagtccatagattagatttctagaggttgaaacttgaaaccgccaatggcagggtgcgtgtgcatgtgtagcagacggtcgcacactcgcacatgacctgacctgctgagattaaattcgtgagcttaatggttcattcattgcttttgtactacctatattctcgtttcttgattagcacaagccaaccattgctccatgcatgattagcgcttactcagacttcacttcatccacgttaccttctgtaaatttgttttttactttattaacctggccgtatggtttttcataatgtctcccatattttgaaagaaaaacaagatagcggctcatacgatatttcaatttgtattatactcgtataagtagctaacggtaatagagacagtagcggtggagttcacgcggccgcccaacccgttcgggaagtgcctccgccgttggctgcatgtgtgcaacaataaaatgagttgtttaataaacttgctatattaagggaattgtatactagtttatataaccggctcatgatcgaattgagaacaaaagcatatccagtggagttaaaatttttaagtagaccatcaagttttaagtgaagtctacgtaagatgatatctctactacttaaaaagcgaaccggttcgtttgcactcttttcgtacgtccttacatgtgtgtataagcactatctctttaagaaaaacccactaacatgtgatttctcactgcccacaccctaaagcctgttcgcccataatttcaatcatgttctatgataaaggtgcacttttcgatcggttaaacaccatgacttttacaaaagtctcctatatagaaattccatgatatactttctataatctgttttatcactttttaacatctaattattggtttgtgcccttaaataattattttcacttttcgtggtataatgtgagtttatagcattgcatgctaattccaaatatgcatggagctatatgtgacgtggagctccaaccacccaagtcggatagagtttttgtcgctttgtccaactgttggtggctcatgtgaactttggcgtgtatcacgtactccctccgtattttaatgtatgacgtcattgactttttaaccaacgtttgatcactcgttttattcaaattttgtttgaaaatatgaaaatatttatgtcatgcttaaagaataattgttgatgaatcaagtcacaataaaataaataataattacgtatttttttaaataagacgaatgatcaaacgttcgataaaaagtcaacagtgttatacattaaaatatggagatggtacaatatacgaacccatatgtacatgcatgtgttaagttcgctttcatcaaatatttactattgctcgatctctgaatattctgagtcttgaaatccacagaaaatatttgaagatgattgtgacggtactgtttgtacatgtctgggagacgtaaggatctgaatgtgttcgtgaaaaagttgaaggaaaaaaattcaagtctaaaaaatatgttcaaaattcgaacatacaataggaacatacacagatttgagtatagtgtacatatataggcataagtagtacaaattgaaacacgaaaaatgccaagtccaaaaaaaatattaaatttgaatatttagaaagtttcagaacgagtatgaagttcggaatatgaaaaatgcacaaattccacatcaagccagtgtgaggttgcaaatcttttgttttcttctcatgctgatgtgctgatggaacataataaatgagttgcaaatctgttgttctcttgtgctgatgtgctagtaatcctaatactagtattaataaatgacttccacttccacccacctccatggagctaaacatattcttgtgtgtggcaatgcgcgccgtggaattttagcgacgaccacggcttcgttttggcttcctcttccacctcttcttgttgctggctttccttgttgggttggccattggccctctccttgtttgcctcctcctctcctctcaatctcaggccctccctccctcgccgccgagcttctcctcttttgccgattgatagccgagggtgagggtgagcctccctgtttgttctgggggggtcgcattgcccttgccgggcgggagaggaggggatggaagaggaggtgccgttgctcaagggggactaccaccaaggttgccccggctgtgcctacgatcgcaagaaggaggtctacaggggattgccttacaaggaattcctctatctctggatgatctgcctcaccgccggtatgtatggaacattccccccctttttgcaacctgtgacattcagggtgtgtttggatccttggctaaagattttctaaccagtcttggtttttggtacaagtaaaatatcctagctttcaggagcaagctagccttgatgggctagaaaaaccttgctcagcaggacagccgaattggctctctctctctctctctctctctctctctctctctctctctctcaacagcaacaagcgcatgcgtgaggggaaaaaaaaatctggcaactgtttctcattgtggggtaaaagcaaggaaaccaaatgtggtgcttgggcaagagcagcatagctgaaatgagctagtttgcacatttcagctatagctcaacctagctgaacatccaaacgtaccctcattatgcagaaagttcttgtttttttttttaactcatggttttctaggatttttctttttctagtgtagtacgaatgagttgactgaatatcgccaacaaagagaatcttggtaccacgtaggaacatgacagcatgtcaacattggggatcttggtacctgtaggaacatgtcttctttcttgcaaatgctacatgttactgcaatgtccatgtgcagttccatatgggtttggtcggtgttcagtcatgtcaatgattcctgttcctgtggggaaatcgctgattctctataatagtagattaacaggaccaagttagttaagccaattgcctcaacaagatttctataatagggggatgttgacatgttgttgctgtttttactacgcacttctccatatttgctttcagtgctgcttacaaccgttaattacaatgtgctgtgatgctccgactcatactacacacgacgaccgtttacaccggtcattacgttgtccatggtgttacagttgcaaactagtaatgccacgtcctggttcatgtgatgtgggttagctggggggtctattatgttaactagaaaatttattgtttgagggagatcactgtgcgaacaatattagatacgcaattaattcctgttatgtcatagtgccagtcatccaaaccttattgggcacataattaattcctgtaatctttcattgcaccaatagcaacttcattgataggatctccaatgatgggactgtaggtgatgctgattcagaccttgtagatctttaggttcttcgttgtgtttgtgatcttttttacctacctcggttgctgaaattttcacaacactacatggcatctatgtcaacagtcagcagaagcatacactgaaatgtcctactccgtgttagatacatagcattcagtctgcaatgcaatattgatatgcgaaaatgccttttaactgattttccttaatgatgtaatgttttttaacagatttttttatactgctccaaatcgtgataaaggtcatttatgtaaactgtaaacttggaactgatgcatgacttgtttcccacgtgtcctatataagcatatgtaattgtgcatatttttaggggtgaagttccatgtgctgttctggtgttctgcatgagctccttcatcatggttgcattgaacagtagtctttctcttttacaatagtggaacatgaaattaatttgtctacttgaacactgtgtcctatctgatgttgaggatactgagtgctatcttgtttccttgagagtattgcttaaaaaaatgtgagtggaacagtcaaaatctgagaagcatctagcacttcaaattttcttcatttcaagtgcaactagctctatatctagccataataccttcttttattatccctgttctcaccagcatcatgtagttgtttttagagaagttctcaagtagtcccctgatatcatcatctaagtaataatataataaatattgttatcaccatttgtatctacaaaagttttaaatgtatttatcgtaaccacatatcccatctattcttttttttacataaattttcagtgcatactcaagatttctaattctgtccctgtccttttcagctttaccaatatcatcattgttccccttcttgtacttcatggtatgtctattttcatgtcttcttttgatgactaaaactagattttttttttcttgtgggtagtttatctccttttttgacgactatctctactctagcaattaagtcttcaagacgtgtcttattacacagataagagacttgcatgttgcaaaaaggacagaagatattgggttctatgccggctttgtgggtaaatttctcatgaattgcttgttcaaatttaagattaactctggctctcaccttgactgattccttatttacttaccttataggtgcttcgtttatgttcggtcgatgtttgacttcaactgtttggggaatagcagcagatcgtattgggaggaaaccagttgttgtgtttggcatttttgcggtgttagtgatatttttcctcctctatatgaaataatagttgatatctgg

SEQ ID NO: 5856 - DNA, 876 bp, Oryza sativa
aacattgtagctacatttaatacgatttcttttatggcagcctgcagagaaatttcccaatgtcttttcccctgactcactgtttgcaaggtattctttcttgtgtgccaacgcccaacaaaatgttttttatgattcatctacagaatacttacttttgttggaaaattttcaggttcccatatttcttaccctgcttgtgcatatcagtctttgctgctgttgttctcataggctgcatatggatgccagtaagtcagattccattattgctagcttcacaaaatatgcaatcagtgtaatttgtcatatatttagttgtatttgatatatttgcactgtggaagatcttatgacatggatctgaaaaaagaaatcaaaagttttgctgcatgcttagcaaccaaaatcagttactggtaattataacggagataatctgcattttatcctaatgtggttgttccacttcatcaggaattaatagtctcttttgttactttttgaagtcaaatttatatttcctctcttaaaaacttgtgcattagcagaagtatcaatatttagcatgactcatagtgagaaaggataattcttcggtaccttgtattaattctttttgtatagttgtaaagtaacttgaaatgtattttaggagacattacacaagcataaagctgatgcaagtagatcccaaactgttgaagctttggagagccatttgattgatccaaaagaaaaggctgaccaaaatggtagtttggactgcaagaagagcttattgagaaattggcccttgatgtcctccataattctctattgtgtcttctcctttcatgatatggcttatacagaggtatattgttcttgctatta

SEQ ID NO: 5857 - DNA, 203 bp, Oryza sativa
  unsure (1)..(203): unsure at all n locations
aggaggaagagaagaaggaagagcccgaggaagaatctgacggtgacctgggcatgagcctcttcgactaaagcctctgatgccatatctttgcaagtcgaaagttttgtttcagttctaaacatcaaagtctgtctataatctttagcatttnnnnnnnnnnnnnnnnnnnnnnnnnnnnnnnnnnnnnnnnnnnnnnnnnn

SEQ ID NO: 5858 - DNA, 1471 bp, Oryza sativa
cctgtgtttcttttagctgggccggctgaagataagccaaccatagcctgtgtttttagtactaattctatttgggatcaacttcagatattctctctatgggcagaaagtgacaggaagtacgggggctgagtttgtcatctgaagatgtgggtcaagtgcttgcaatcacaggtagcattttcttgtgcttttaccagtgctattgatgatagtatcctgcagaaaatgatgcatgtattttcttgtactttcttcctagacgaccaaatcttgtttgctgattaaaatagagtgccaagaactgaaaaggcttgagcttagacaaaaaccaaccagaaactgaatttgaacgattctaaggtttctaactgaatttcacattcttccgtgtaaaaaatgcttatatattactatggaaaatttaacttgagttctgtggattgggagtagtctgctgaaaagtgttattagccagtgcttgcaagccagatagaacatccaagttctatacttcatctagtaatgtttttgtggctcaactttctgttatttgtaatggcaatttcttttcaggtgtcagtcttcttgtgtatcaactcttcatttatcctcgtatcaataaggttatagggcatattaaggcttctcgaattgcagctgtgagtaaagagtttccattatattgttgggaagtgtatcactttttttctgaatgtcttacctactgttctttatcttgcagattctgtgcatacctattctctttgcatatccttatatgacatacctatcgggacctggattaacgatcatactgaacattgcgtcagttataaaaaataatcttggtgtgagtatatttccatgtcaaattttaggaatctatgtatgcgattttcagggccgatttgtgcaagaaaaaggtagctttgatatttaaggactgcagtttgccaagtgacagacattaactcagaaatttttatacgacaataggacaagataaatatgatatacatctattattattatccaatctgaccttttgtggtgaaaatggagttgattatacaagacaagacagcacatataaaattattttctcatcttatgtatttgcaactttgatgaaaatttatcaatgttaatgtataaataggttcttgttacactctcttctaatttatgctatactatgttaggttaccatcattacaggctgtttcatcctacaaaataatgctgtggtatgtacccaagataatggttaatttcgacaacattttatacaaaattgcttctgattgatgattgtaaaactgcttacagcctcaagaccaacgaggggctgctaatggcttggcaatgacaggaatgtccttttttaaggcagtggctccagcaagggcgggcattgtgtgagtatactttatttagtgtaaccatgtaaaatgttttatgagtatac

SEQ ID NO: 5859 - DNA, 5168 bp, Oryza sativa
  unsure (1)..(5168): unsure at all n locations
tttatgcattgtactgttattgttatagtatggtccaggagtgtcatgattcatgaacgacaactttgaatacagtcgcatgttattttagtgagatggtctatcaaatcagcctctgaactatgatacattccaagaaattttaaaattgcgagacattttaaaaaatatagcactaggaattttgtggctccatctcaataaatttccgttaatgcaggttctcgtgggcacaaaaacgccagcatgcttccttccttccaggtaaattttgttgtcttgtgaaaactttgcatggcatatgcctttgttgtcaaaatctgaatgggatgatgtgtaatattctaaatttcagaatagtacagatcttgtaagaatttatccttgtctaaattaatttcttccactcatacaggtgatcagatggtgttctttcttttgaatctcttcgagttgcttggacttatcctcactttcaaaccctttctggccgtaccagagcagcacgatacaaattagactgttcaggtatactacagatctagattcttcagaacttcagatgttggcaatttcatgagccctgcagcccgctgtgtgaagcaaaggtataacatatgctcatctggatcccccaggagcaatagatagaagcgagagtactactctgtcccaaagaatcaaagctagggtttgattatttttgggacggaggggtaggtgccagatatgcaattgcagcatttcagcgaaaggaatatatatagttggggtaaatggtggccactgatggctaggtttttcatggccagccagcatgtataccgagtagcattctaccagtataatgaatatagtactatgtacattgtaactagtaaaactctgtaagtgacatcagcttgagaatgaaattattgctggaatcgagatcagtacattgctaatattattttgtccctttttcaattggaagttcatcatttataataaatccacacgtgagccgtggagggtggatcccctacttggttggagctgctcttctatggtagttcaaaaccgatgaagatgatgctaaacgagaaaacccgttagtgcatgattaattgaattttaattattacaaacttaaaaataatctttttatattttggagtaacttctatatagcaaaaactatatgcattcttaataatcacaaaagaaaaacgaattttctaaaaaaaaaactttcgtaagttttttgcccccaaaacttttagatttgtgatcatcggatcatctcgagatctttgcatgaaggaaaaaaaatgttagaaattttcacacatgtcacgcgtaccatcctaatactaaccaatctatagttgaatgcaagatctatataagttatagcatagttatagtgcaattataatgtagttatagtacaggtacatgtaattacaatggacacaactacaccgagagtgctagctggatagtgctaaagagagacaccattctttccaaaaaaaagctactagtacactcaatatctatggttttttttcttcttagagaagtttctcttaaattactcatccgatttataatccgattacaccgttgtgttcgtaacaattaaatctttacaacaagatctcacatgattatattttgataaaaaatcacatattacttttatgatatgtctaaattacttctagatttcactaagtcacttcttagacatataaaagtaaatttagtaaagcttaaaagtagtttacatatattatagaagtaacttataacaaaaagaaagtaactttaatttagaactatatctagattcattaacatctatataaatgtgggcaatactaaaatgacttacattatgaaacagggggagtaactctctgtagtagaaataattatattgtgagtgagcttaaataagaaactatgtagagtgaattcgcaagtacagtgtagagaagatttataaagtccacaaaatatagaattaactaaaaataataataataataatcaacttagagaattatgaatgtacagaagtaatttagtcaaatatgaaagtaacttatatatattataaaagtaacttagtatataataaaagtaatttataaatataaatattttttcatcgtaatataatcatgtaagatcttgttgtgaagatttaattgtaacaaacacaatagtgtaattggattgtaaatcggataagtaatttgagagaaaactttataagaaggaagaaaaagacacacatgtctaagaggaaaaacagcgcgcacatcagcacgtgtagcagtaattcttctcacaattggatcgtcgttggttaacactaaaccgagaggcttctcggtttagattttaccaattacaatgcagttacacttcaattatactataattatatctaaaagttttttattaaaaaaatttgcggtaatttttttagatacaatcgctcgtattaggccatgcctctggtattcctttgcatttcgatcgtgtagcccaatacgacggcccaaacccaaactccaatcccagcgggcccagcaagtcagcctcacatcttcttcttcatctccctgtctctgtctctgtctctaacctaaacccacacctcgcgcgccgccgccttgctctcctcctccccgaccccgagtcctcttcgtgtgagctcgcactcgcagtcgcagcaatggcgatcaagcggaccaaggcggagaagaaggtggcgtacgacaagaagctgtgccagcttctggacgagtacaccaaggtgctcatcgccgtcgccgacaacgtgggatccaaccagctgcaggagatccgcaaggggctcaggggcgactccatcgtcctcatggggaagaacaccctcatccgccgctgcatcaaggtgcacgccgacaacaccggcaacaaggacttcctcgagctcatgcccctcctcgtcgtaagttcaccttcttcttccatgttcatacctaacctcgagtccactgtttttcctgacctgtttttcttgttgtttgtagggtaacgttggtctcatcttcaccaagggtgacctcaaggaggtccgcgaggaggtcgccaagtacaaggtataatcgatagccaagtacaaggctatcgatctctgttcaatacatacactgcaagaacataacagaacagtgttcaataaactgcaagaatagaaaacataacagaatagtgttcaataaactgcattgggttgaaggggcataatttgttctgtaagtgaaattggtggatttagtgtgctatcttaaggtgatcatgctgagttatgaaaataataataggatatgctgggttactttgaatttagctctatgttgtgccattttatccatatgcgttgtatatattctctgtgtgtggtattattagatgttctgtgagatgtgaaagtacaattttcaaccttatgtaacttttccaatgctatttatatctcaagtattccattgtttatatcatgatgtgatgccatatataatgatacatatagatatagggtttgatattagctagtattggctattgggtcatgatgttaaaagttgacttgttatggtgtgagtagctcaagtctctagctggtttatgtttttcttttcactgcaatctttttctactacaatgtagtttgtactgactgatctctgtaagaattctaactaggtcattatgtcgtgaacttgtgatgctatccaatgagtgaataaccatgatcttgtttttgttataaaacaggttggagctcctgctcgtgttggtctggttgctcctgttgatgtggttgttccccctggaaacactggtctcgatccctcccagacttctttcttccaggtgatcatttgtcgatgtgttaacatattgtttatcctcagagtcaaatacaagttctcactgttctatcttgttacaggtgcttaacatccccaccaagattaacaagggtactgtggaaattatcacccctgtagagctcattaagaagggtgacaaggttggctcctctgagtctgccctgcttgccaagcttggtatccgccccttctcatatgggctggtgatcaccaatgtgtacgacagtgggtcagtcttcagccctgaggtgctcgacctcactgaagaggacctgatggagaagtttgcatctggtgtttcgatggttgcctcagtgtccctggcaatctcatacccaactatcgcagctgcgccacacatgttcctcaatgggtacaagaatgtgctcgctgttgctgtggagaccgaatactcatacccacatgctgacaagatcaaggagtatttgaaggtaacctagtttctatttcataatttccctttttgatgtctaaatgcgtaagaattgtctgaggtagtctgataattagattgcggtactaagctgtagcatgcccatgtcttggcacaaacttatttgttctggtcttaacaatcaatcaatcaatcattgagaatttcatggtttagtaagaaactgaattatctatgatagctatttcacttagtttgatatgcctttagtgcttttagcactttcttgagactgcagtttacttttcttattcacgatgaagactcagttaaatattgattactactggaagctaagttaatgctgatttttgagaacttgggcatttcaccaccacagtttcttacatatttgtcttgcctattcttctcaggaccccagcaagtttgctgttgctgcccctgttgctgctgctgacagtggcgctgctgctgtagcttcttccaaggaggaagagaagaaggaagagcccgaggaagaatctgacggtgacctgggcatgagcctcttcgactaaagcctctgatgccatatctttgccaagtcgaaagttttgtttcagttctaaacatcaaagtctgtctataatctttagcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5860 - DNA, 1161 bp, Oryza sativa
attcctgcagccctaactagagatgaactgacaaaggcgatctaccatgctggcaaaataagtccatagctcagtaaaccaacgcattacctattttgttgtgtccttcctcgtgtttagatggtggcaagaatggtgctttttcatcagtcttcgataatcctttgcactgtaaaaatatatgtaatgaatgcaactgagggctactgtgctgttattttttatgaatatgtacagataactgaagaaatagtgcagaaatcaattgatgttcttgtaaaagttgtcgagtctgagggttcagcattggcatccactgcgatggaagctcttggtcatattggtctccgttgtttattgccttctattaatcgaaattcctctcaaggtaaaatgtgtttcctcgcacttctgatagacgtgaactgtgctactcaccagcttcctctactatgtatttgtttaagctaatttcgtttgacttgcagctgcacttttaacaatcctgaatgagaagctggctaagctgctttcagaaaatgatactaaagctaaacaaaagattttgatatcgctgggacacctatcttggaacgagttgtcatttgcacacctgaataatgcattggacttaatttttagtctttcacgctctaaggtagttcttttgataaattcaaaatttgtggttgaaaatattctatatttgacaatattctattcctaaatatcattattcaggtggaagatgttctttttgcagccggggaggccctatcttttatatggggggaagttcctgtgaccacagatgtaatactagaaacgaactttgtctccctttcccaggccacaaactatcttactggtgatgcacccctacttgtctcgagtaactctaataaaggaagtgattgtgaagaagcacacgcaatggctcgagaagaaattataaaacggttatttgatacactaatttatagcagtagaaaagaggaaaggtgcgcaggtactgtctggttggtctcacttacaatgtactgtggtcagcatccaaagatccttgaactacttccacaaattcaggtctgccaatcaataataacatatatttatcattgtagaagtactatatcttaggacaaacaagagtggtgcact

SEQ ID NO: 5861 - DNA, 672 bp, Oryza sativa
atagtgtatttagctaccctgaatagaatgcaagaatgttgaccaatttgataacttgacatgtacctgtaatgcaagaacttgaccaacatcctcagacgagaaatttagtccgccaaattgtttgtcactttcagaccatagagaaaatatctaaaatttgatttcaattatcatcaaaggttgaaaaaacaactttactgaaaaaaaattcaaaataatgtgtgcaccatatttttctatagaaaggatgctatgaaattaatcatcgtaagaagagaactcccaagacaaaggagaaaaaaatgcaaataaaaaatattctatacagttataataaaacatatagtagtagagatatattaacatatccatgctatcctaatctaatcattcaatttatatgtaatttccctatgatttcattggtggagaggaacaaaattgaaatcgagtaattcatttgtctatgttcgtattaatgacaagatgtggtgaaattgtgaccattggtaatttcttaaatggttcattataaaaaaaaacaaatatggtatgtgtagagttgcctttaaaagcacttccaaagtattataaacttaatagtttttataaacttgctataaaataaaatcaatgctgtagttttaaaagtttgactgaatgttaagc

SEQ ID NO: 5862 - DNA, 4017 bp, Oryza sativa
cgtcgggctggtcagcaattgcgttcagagggcaacgtcttagggctttctttttcgatgaataatttatctaggtattaatataattccttctgtcttgtgcctgtttaattccaagagacatttagcatttgttgtttgttcctgctgctagctttaattactctgcatcattaatacggtcccagttttgttggcaacactggtattaatacgcatctctgtactctatgattctctctatctttgcactgggattaattatgagagcatttcctgtggtctaggggctgagtataaactctcagcaaaatgtcatgaatttaggagggaaaagaatgtaacgaaggctttcatccactagtcatcataaacttcagcaaaaacaaaagaaaaagttcccctaagaaattaacccgatatgaaatgggaaaaattttaactgcagtttaatttacagcctcatcgtttgggataagccaaatggcatatttgtaaacgaaaaaaaatttatgaataaaaattttatatatgtgtttttaacgatctaaaatcaaaggttgaaaaaataaactacgatgaaaaaacccccccaaaatcaactttaaatttaaggttgaaaatttaaattttaactgatgagcatataagcataagcgaaaagatgaggctgttattgattttccttgcacaagtcatgaatatacatttgatttgattttttttcctggagttatagatgtcgcaattatgcattttaccaaaattttgattactcgctgtaaggtatttttatggttaatttagtaccctgttgaccatgcttagttacaatcttgttgcagatctgctctatgatgtgctaacctaagtaggatgcacccacatttgggtttttgcttggagacctagcaacattgaaggaaaacaaaattgtggcagtgtccaatttctcaactcatggcccatggtgtccacgtagacaaagaaatatataaaggctgtgtttagattcaaagtttggatcgaaacttcagtcatttttcatcatatcagcctatcatacccacataatttttcagtcacatcatctttaattttaaccaaaatctaaactttgcgctgaactaaacacagccgcaccgtccaaatttctcgacaaatttggagttttggactgtcagtccatcccatttttgagtctcacacggcatgggcgaaagtaaccgaccgaccagcagcgctcaagtcaatttaagcaaaaacaagacaaactgtagccatcaggccatggcgtgccacgtgccacctagaatggcaaccacgtcatcaacgtatatgcagtgacgtgtccatatacagttgatttgcacgataagagtctcatatacaagcaaaactaacgaatatgtttgtttgcgtaaacatcatacactgaccatttctattaggcgtaaaccaaaatcaacttccgtgtacactgatgaagagaaaatggaatcaaaatctagcaatgtggagtacgtacggtaaatagatcaaattcaaggacaaattctttcgtatactagaaaaatgtccgtgcgttgcaatggatgaatgttattttaattttattattgttatacggtttaggtagaatgaaatttactgtgttaaattcgcttggatagaaaatcatgagctgcaactaggagtccgatcgtctcaagttagcatgcgaatttttttaatgagatttcttatgcgactccttttgtatttacaaaagtgaacgaacttaaaatccgactcaaatatggatctgtgttttcaaaagcgaatgaatttacaaaccgattcatccacatatgacgtaccaaagtaccaataaaaatatcttcaatttttataatagcagagattcgtatatatagttcctatgataggctatttggttggtgtttatagattcttcttttataatcctaccaatctagcctagaagtaaaatttactactccttccgtttcatattatgaggtgtttgactttttttagtcaaacttctttaagttgtctaagtttgtagaaaaatatactgatattttcaatacaaaacaaacatattttcaaaatgtattcaatattaaatttaataaaactagtttggtattgtagatgttgctattttttttctataatcttggtcaaatttaaagaactttgtataaaaaaaagtcaaacagcttataatattaatcggagggaatagttaagattgtttatgaagtaaacatgccatctttgggcaatgcacaacacgaactaagtgaatcctaaccatctagaagtaaaattgattaaattcaaaattgctcaagtaaatatgtcatctttggacgaagcacaatacaaactgaatcgtacccttctagaagtaaaagaatttactaatccagattgcttaccaagcaaacatgtcatcctcagatgatgcacaaagtacaaactaaatggatcggataaactgtaccttttgaatccgtccataattaacgtatcacctgtcgctgccatcgtctctccttgtcgctgcaattgactttcagcatccttcctaacgaataaccatgcatggttacaagaaattgccgcgtgtatgtcattacctttagctaattaagtcccttcataagctttggtaaattatggtgaaaaggtccagcactctgaaaaattccatcaagaacatcagtaaacagcatttgaatacttaaaactgaaatatgggctacattcacactcgatttaactatgttgacggagattaagtcagctgataagttttgccagtcaaagcgcaaatatttcgagacgaaaatgactcatgactataaataatcactccacaagcagagtagtagtagtagtaacattatttgaccaaaccgaccgacctatatgctgattcagattgcttgtgtttgtcattttcctcgttgctctgaacttctacgtgtaaaatccatcggcattgccatttcactttcagtgcattgtagaggaaaaacaaaatcaatccaactttaaaacaggtcctgcctgaaaacgtcaagaatttgcaaagaatgtgtaagcagtaactgtacagaggcaaatattcagacattccaagcagaggctcttttgctgtacaagcaataaccgtataccagatcagtagaaattcagacattccaaacaagctagtatttgcagtaactaagaattttcagaagaaagaaatagtagtaaaaaacacgagcagatccatggctagagaagaggagacaggagagaagaggacaccacctacccaaacagcgtcgtcgcgtggtttgatacacgctctcacctcatctcatctcgtcgccattgacagactagcgccggcctgtccagtgccgatgccgagtgacacacctgcctgacaacacgtacgtacgtggaaatcataaacctttttttttattttatttagtttcttctcgccaccgctcgccttcgccgagctccctatatatcgccgtcgtctcgcactgcctccatcggatatccagctcctgcagccaagaaacactcacacgcacgcacaaagcgatcaggcaccttttgttttgttgctttagaggttaattacaaacaggaggagaagatcctagttgtctagttgaaagtgaggtgagttcttgtcgttttgagtttttgatccaatcttgttagtgaagtcgtgagcttgttgtttgtttggtggtgtttgttgctattcttgttcttgaaatctgaaggtgttgtgtttggttggattaggtggtagagaaagagagagatccgggctgcaagcaaatgggcgtcctcttctcgtgccccgtcgatgactacgacgcattggaggagagcgcccccgcggcggcggcggcgtcgtccgagtccaactccggcggcggcaagcccgcggcgatcctgaaggcgttgggatcccggaagctgctcatc

SEQ ID NO: 5863 - DNA, 8465 bp, Oryza sativa
cggcggcggtgaagctgcagaaggtgtacaagagcttcccgacgccgcggcagctcgcggactgccccgtgctggtggagcagagctggtggaagctcctcgacttcgccctcctcaaggggagctccgtctccttcttcgacatcgagaagcaggagacggccgtctccagatggtccagagcaagaaccccagctgccaaggtaacaacactgcgttttctttttctttttctttttctttttttaccacctgcagtttgtgtctctgagtaatttgatctgaacatctttttgcaaaattgggctgaatttcaggtcgggaagggattgtccaaggatgaaaaggcacagaaactcgcattacagcactggctcgaagcggtgagtactgagttacaagttgaatgtgtgcaaattattcagtttttttttttttaccgctgtgttatcgttcaatgagctaatgttgcaaatgttcagattgacccgcgccaccggtatggtcacaaccttcactactactatgatacctggctccactgcgagagcaagcagcctttcttctactggtcagtatacttgtcactcagatatcacagtttcagactgaatagaaatgttagttcatggatcatgatcctgatttgattatgtaatgcaggcttgatgtgggagaagggaaagagatcaatcttgagggcaagtgctccaggtcgaagcttttgagccaatgcatcaagtaccttggtcctgtaagtggttgcaaacatgatgctaagaattgctagagttagaacatcacgaagttgtaaagtggctaacatgaaaaaactgaaattattttgtgcagaaagaaagagaggactatgaagttatacttgaggatggcaagttcttgtacaagaaaagccggcaaatcctcgatacctcttgtgggccaagagatgcaaagtggatctttgttcttagcacatcaaagagcttgtatgttggccaggtaattttcacatatcttgtgtcatattggctaaaactattgccagccttagaaatgtccgttcattgtgtaattttgtttttgtaatctcaaatgcagaagaagaaaggcaaatttcaacattcaagcttccttgctggaggggcgacttctgctgccgggcgattggtggttgaaaatggaaccttaaaggtatgtattgtttatagtcagtccattgaacaacttgttcatcctttacaaagaactgggtcatgtgttgagttctagttgcagacaaaatgctgacacaatcatgtttcctctttgtctgacaggctatttggccacatagtggacactaccgcccaactgaggagaacttcgaggagttcaagagcttcctgaacgacaactctgtcgatctcaccgatgttaaggtaagcaagcacatcatgtaaattcagacagaaactgaaaaagaaaaattctcaatgctgcagttatcctgtaaattttcaagcaaactgaaaactccattcagctgtgaatttgtaatctgacatccttttgaattggtgcagatgagcccagcagaggaggacgaggaattctggggtagcctgaaaaggatcagttcagagagctaccccaagaacactgccactgacaactctgaagaccaagccgctgaagctgaagaaaccggcaattcccagatgcctcgagtctctgacgaaccaacctgtgcagagatcgacggctgcgacgaaccggcggcgacgaggagggtagattcgtcgtcagctgttgctgctgctgctgagaacactgaagccgaggaggaggatcaagaaggcggcggcgagcaggcgccggtgccgagggagaagatcctggagaggatcaactccaagaaggggatgaggtcgtatcagctcgggaagcagctctccttccggtggacgaccggcgccgggccgcggatcgggtgcgtgcgcgactacccgtcggagctgcagctgcgggcgctggagcaggtcaacctgtcgccgaggagcgccgccgccgcgtccgcgtcctcccggttctcgtcgccgcagcgccggagcttcaacggcgcggcggcgcccgccacgccgagggaggcgctccggccgtcgcccctgcagcatgggctggtagccaccgtcgctgcggctgactgatcatggacggccttcgccgtggaagaagaaaaaaaagatgaaacttttgccgagtaatttgtataattgcatactaatttaaattttagtgtagatcttgtagaacaggtaatatacattaattacatatacattgatatagtactagcaaagttgtttgacatagtgtatatatacaagtttttttcattcttggaagaagttgaccacaagtgcacgaattgatatgatatatgttccaaaaatacgaatgtatttacatgcccatatgttaattaaattttgatatccccgcaaaaaaaataattaaaatttgacatagaaatagcgatttctgaattgaaattgaaagaaattaaagaactgctttgaagtctatatagatacaatatgaaaattttaactgcaaatttcaaatatatagagaaaaatgtttaaatttatttgtggggacctcctcaaaagagtcggttccctccaaaaattagcgtatgctgctaattgcggcgcgcacacggtattctttagtaaaaggcgaaagaatagttcgctctgtgctcaccgcgcagctgcgtgagttcaagcgttggcaccagacccctatatatagcagagctccctaaggcctccgacttggttaggcgaggtgggactaaacgagcagagagcactctactgtctaactgttcgccctgcgacagccaatgcggcccagatgcaaacgggaggcctacatgagccgcccaacctgtaggcccaaaagcgaaggcatcatgctgaaactggaggaaacaagaacagtaatggtcctttattatgttatttttttgtatacaaagcatgagaagagatctcgtgagaaatgatcacggccaattccaataacagaagagatctcctgtttttgtataaaccatgggaaatggtcacggccaattccaaatccaagtgctacggcagtaccatttcccatggcacagtatattctcgtcgcaaaatgaagatatctgtatatttgccaaagaaaaggaacaaagggagaaaagaatcgacattttcacgaaggtgaagcatgcagacatgctagtacacttgctgcaagatcacctagtacagacagacaccagcaatcactagtcagttgacatgccagtgctatcctctacattcccaacccaacagaagccagacgaaaacctctagccaacaacagtgcacgcaatgaatcaacaaccttagttagggcgtgtatttgagttagacaggtgcattcaccttatgcaattagcctacctacactacacctcttcttccgctggagaaaagcagacgagagatgaatatcctactttctcagtttctccctttctgaagcagccgtatgtactttgtccctgtagaacaacgccgtcatacaacatcatccaatggtacaggccgtgatggggagcgctcttgatggggattcttgtggccagtagatatgccatactcttctgttaaaataccttccgactcttttatgtcattcagagctctcttggcgtacaccgtgaaggcgaccgtgaggacaacagcgatgacgaacgagatggcgttgtatgttatctccaccggtgtcatcttgtagttgccatacttcatgtcagccaatgtgcgtatcaaccgcccgctgcaccaaaacatagaaagatgaacaatcaaaagcgcatcactgaacaccatacctagtgcacttagtaactcctgaaagaaaattgcatgtgtcggtgacctgcattagttgattaactgcaagtgtatacactactgaattgctaaagttattgtaaagatagttatcctgcacagataacttttcctatataatataaatttactcttttataataagttatcaatcacaaaccttctgacatgttttcatgtatatatagcttgcaaaactagtatatccaataccgttttactggtgagcttatgcttgaaagagcgattcattaaaaatcagtgactaggtgcactattgttgacaacatgataaataaacagcaatggaatacagtgagtgaggacatataggtagcaaaattggatgtctgcagattggagaggtatgtaaccaacctataaatatagatgaacgcctcgggtatcatcccagcaattgaaccacatagataagggttgaacttgatttctgtcacagttacagcgtagttaaaaattgtatatggaaatggcgagattctgaatagtgcaacaactctaaactgctggaaccaatttccttccccagcaagttttattagagctatctgctgaggccatctttttaaccatgcctgcattaaaaaatgtagagggaagaagagagcagaaaattagggcaaagctccttcaaaaaagatgcaggtcctaaaatagacatcacaagaacatgcagttcagaatttttacatgcagacgttcgcggaacaatgagccaatccaatatggaaccaccatgcctatagtagtcccaaccataataatcaagaaaccccaaccatagccaaagatcattccagctagccacatggaaggtccagaagggactaaagtaactgggaagagggctaaagatgcaacgagaacaacagccaaaactggacgcccaaaggcacttgcttcccattgcatgattggcaagagaacctacaacaaacagatcttccaacataagtccaaacaattttctggaaaatgaatatgattaaaatgttactcctatctggcacaacatggtacaaaaacaagagataattgaaaattttgtaaacttgaaattaaattgcattgtgacagccgtgcatccattaaccatacattcatctagcattccaactggtgtgcataaactagggtatacatgggaacatatggactagtcaaactatcaatcaacagtttgaaatttcataagcagaaacctccactaatgcatggtagtggaggtttcataagcagaaacctctgccgacaaaccataaaaagaactcaagtcaagatttcagtacttggtcaacctatgaacctatgacaaatattacccttgatgctcaccttctcgaaggcaaaggggactccccatttcacgaagacataagatactaatataagaaggaagcagccaagcagaactttcatccaccaaatggaccttgaggtaggttcttcaggtaggactaccgtgttatcatcagctattacactatgagctggtctgaccagcctttcatattcatcatcctttgtgttttgctcaggttgttcgattccgttgcctgatgccactgcggaagagcttggcatgtctgtaactacctcttcacgtctgtttacaaaccaagcagattagaataagaagttactcaaaacatgtaacaaattttatcaatttatctcattgaagtaaagatgccatgtgcttgttttgttttgtgtactggaaagcatggaaattagttgtatggattaaatctaaacaagatgtgcaacaaaaattaatctgatatgctcacattcacaagcatggctcatatctttgtcatttgatctcacattctgttgggctgtaaatacaacagtatgtgtgtgttttatgtgctggcccatctgctagagggcccatctagtcatgtatatgtaaataaggatagcaatacagagaaggtgaagcttccagagaaaattggctgccaaaaaacttcatggtatcagagccgaccggccggcggcaggcgacggctgaaccctagctggccggaggcgtggaggcttgagcagggtagagagtgcgcatcagcagcggcgcggaagagcggggccagcgcggcgcgtcgaggaggaagaagccgagcagctgcaggtgcggagctgctgctgctgcttggggctgagctcgcaggtgcagagctgctttgggctgaggcaagaaagaaagtgctggtaaacagctggtgttggtgctcctcaggaagaagtggctcttgctctgtagtggcggggtcacagcacagtgaagactttgcatctcttgtgggtgtgtgattggcaaggaaaccgagataaaagcacagctactgcttttgtgatattgactatttgagcaatctataggaagggaaaggtagaacagggggctcagatctgctagttgggtttctactggtttgcagtttcagaatttgcattatggcagaaaatcaaggaatagaacaagtgatgggtaaattggtggacatgctagcgaaaaatttagtaggcctcaactacaagcaatgcaattatccctcatactgaatcaatactgaagattgagttaatgcaaaacgaaatcaagttggagggtgtcaaaaattatttgagttggtcaaggagggcattactaatactaaaaacaaaggggttagaaggatatgtcacaggagaagtgaaggagcctgagaacacatcaagtgtagaatggaggacttggagcactaccaactctttagtggtggcatggttgttgacttcattaatcccagctattgctacaactgttgagactatctctagtgggagtgagatgtggaaaactcttactaaactatactcaggagaaggtaatgtgatgctaatggtggaggcacaagagaagataagtgctttgagacaggggagcgctctgtggcagaatatgtcgcagagttgaagagtttgtggtccgatttagatcattatgatcctcttggattagagcactctgattgcatagcaaaaatgaagaaatgggttgagcgtagaagggttattgagttcttgaagggtctaaatccagagttcgaaggaagaagagatgcaatgtttcaccaaaccactcttcctaccttagatgaggccattgcagctatggcacaggaggagcttaagaagaaagtattgcctagtgccgcaccatgttcaccaagtcccacctatgcaattgtacaaggtaaagagactagagagtgcttcaattgtggtgaaatgggacaccttatgcgtgattgtcatgctccacgcaagcctacttatgggagaggaagaggtgttgatagaggtggaacaagaggtggaagaggctatgctggtaggagcaatagaggaagaggttatggatatagaggtgattacaaggctaatgcagttactctagaagagggttcttccgggactacacctgacaatgttgccaactttgctcattctacttcaggtagttttaatcaagcatttatgtctatgaacacttctcattcaagttggatattagactcaggtgcatccaggcatgtcactggcatgagtggagaatttacatcatataaaccatattcatttgcacataaagagaccattcaaactgctgatggcacatcatgtcaggttaagggggagggcatagtgcaatgtactccatccattactttgtcatcagtgttatatgtccattcttttccagtgaatttaatttcaataagttctcttgttgataatatggattgtcgggtttcccttgatcgtgagaattgtttaattcaggagagaagaacagggaagaaacttgggattggtatcaggcgtgatggactttggtacttggacagaagagggacaaatgaggatgtgtgtgcactaatggcttcaacaagtaaagaagtgactgaggtattacttttgcattgtcgactaggacatatatcttttgaaattatgagtaaaatgttcccggtagagtttagtaaagtggataaacatatgctgatatgtgatgcatgtgagtatgggaagcatactagaacatcatatgtgagtagaggacttcgcagtattttgccctttatgctaatccactcagatgtgtggacgtcgcctgtggtttctatgagtggaatgaaatattttgtcacctttattgattgctattcccgcatgacatggttatatctcatgagacataaggatgaagtgcttaaatgcttccaaaacttttatgcatatattaaaaatcattttaatgctcgggttcagtttattagaactgataatggaggggagtatatgaatagtgaattcggtcactttctttctttggaaggaatattacatcagacttcttgtcctgatactcctccacagaatggagtggctgaaagaaaaaatcgccatcttttggagatagctcggtcactaatgtatactatgaatgtacct

SEQ ID NO: 5864 - DNA, 1005 bp, Oryza sativa
aatttccacttcagttcatggggtttatgaatttatacatatggactagcaatcaagaaaagtgcagttttagttggatagtgggtcaataggtaagcatgggtggacccacttgcagccctagtggcttcttctccttattgaatgtacttaccttataaaacttcgtctttcactttatgcatattaacgtatgctttattggtgatatggcgcataatcttgataaccctaacacagagagaaggcatgatttatacttgctaattttggtgaacacaagtcattgttgattagataggctagggtgctagaccaataacagaattctcccctcgtgctgccacctccctgcatcgctccctcccgtagcacctcattcatccctcagcgctctgcagcacttcatagtccatacgtcacatccctggccacatctccttgttctggtccctccccacattagcccctttggcatcgttgatgcctgtatgccctatatgaggcagcagcagtagtggccaaggagagttcgtcatggttgtattgactttgtcgttgatagatgccaaaaagaggacagctatgtcatacccagtggtcaattgggtttataatttacgataaactttggcaaagggcccaactttttagcctataaaatttgagggccaggcctaaaatggggtgatctgaatttctatttttttacctaaaaatatttaagggctaggtagggttgtgaaagaacccatcaccctaggtagatataatttacacccatagttcaactcccatgtatgaagcttgaaaggttactcctttcttcaaagcgctaatgacgtagtgactgcataaaaatggtttgcctttggcatattgcttcaaaatcaagaaggaactggtaatttttttagaaaggtattgctcccaccaagtaggcctcttcacaattcatgttgcaccaatgacaaatcatgttttctatccatttccttaattaat

SEQ ID NO: 5865 - DNA, 11186 bp, Oryza sativa
cattgtaaactaatatgttaatggggacatgcaaaatcacctccatattgtagtatttgcagaaatatatcttttgttcacacatttatcttttgatatgtggcagatgatggaggttgagctcaagaagctggaggatactatcaactctatccatgaagaaatgttttatcttcgcgccaggtatggcttgcaatgataaaacatttctttgtgaaattcaatatgatctcttaaatcattattatccgtgtttcatttctctagggaggaggagatgcaggaactgaacaggagaacaaactcaaggatggcttggcttggtttcttctcactagctatctgcctgtcagtggcggggttgcagttgtggcatctgaagaacttctttgagagaaagaagcttctataattctgactcagaacatttaggcataaaattgtgtgatttctctttttatgcttaccaggcgtaaatttcctgcaagggacagatgttagcatagttgaggaacatttcttttcagtttcctagaccaacttaaatagatgtaaaatgcaaagacgacaccaatttttgtttccttgcttgcaaagtatgttgttttcatggttcaaaagacaacgttctatttttttgttcttggcctggcctcactgctctaaccaaatacttcatctgcagttggttactgctgattatggtaagtttagaaccaatgttgttgtgatttgtgataacacattcataatattttatatttctaacactaatgccttgtacttcctatggttatatgttttttctttaggcttgaagcatgagtcatttttgcctgctagatgcgcccaaagactgattatcatgtcaggttctgtgactgaaaagggcaaaggtatacactgaactttctattagctgttgcatttgcccttttttggccttcagaaacaagtgccgccttctcacctttccatgaaaagcgcacttacttatgaccatatcaataccaaagtttggcttacgattatgtggggttttttttttttgaagaaacaactatcactacgaagcaacaggccagatgtgtggacgttcggttagatggccaaactaataaatcatgattacaaaacgaagaggaacgtacatagattcttgttttattaactagctagccacctatacactcaagggtctgaaggctcttcaatagcttattggagaagacatcccttgggagaatctaaattaacgcataaaaaaatagaaaagtaacagagaacaccagcctgaaccctgttaaacagactgcagtggtccatctgagacaatagcaatgcataaacccgtgcaacatagaagtgatgatccaaggcagtgaagttatcttgcttgattgattgtcgttgtatttttgtggggacaaatcttttagttttagatcatgcagtccaatgcttatggcacgtttctgggtagcagtttccacattttatgcgaccaatgttaatacactagtagtatacttgtgaagtgagttttactctaattcttgcactttcagatttctctataaaactattccaggcctgttctagctgatagacaacagatgaaactaagtttatgacaattatttgaggatacaaatgaatgagttgactatcagaaatttgataagttgattttatttttttctaagaaatgttgatgaagaatgtttttttttgaaaaaaaaactgtttaggagattaggaaacgtgtccacgataatccataatatgtattgtcattagaatgcccgtaatacttgcattttgacaatatgttggttggcactaggtagtcagcttgtatctggcaaatccgaccaacagtatgttatgcaaaagttttttttgtttgttattatcaacatttgtttgtaaatccaactggtgtgtgccagtgttaaaacgttatagtcatgcgtggtattttgaagaggaatgaactgacgaagttccactgttattttatcgagaaaccgtttttttttcttgcaattatcaggcatctgcagctgtatggctcttgaattttgacttatctgcaacttaacgaatctaattgcagcaactggtttataaatgtctcgttgctggtcagaataatcaggcagctgacgtatctgtatggctgtatcagaggtgttagtccacttgacgcttgctcattttgcaagtactagtaggggctgtaggacaagtcaaagaaagcctggtagataaaagaggttaccgccaaatatttcaactcaaatcgaaagcaacttgatggaagcactgcatgaagattttcaacgagatgtctaaattattgcaaaatgacgaaggcatcaacaacgacagattcacagttaaaacataagtacatgtcacagcgttaacataggttgaaatggagctgtaacaagctgattagacccattaggtttgcgttattatgcagcatcaagttactttaggaactttgctataatttcgtaagaaatactaattccccctgttaaaaaaacatcttttttttactatgaatatggatgctttgggatgatactttgcttgcatgctgcagcattcaacgaaaagtctgaacatgcaggcagcaatgtttctacatgcctttctttctctgaaatattcggcaaagataatatatctgctaagaaatataaaagagtcacaatatttttaggccatgtttaagctactcctaaaatgtcctcactagctgaagacactcgtagggaaactcagctcgcaatgtaggatacccctagatgggctcctcaaaatctgaagtaacttaatagagacactccaacccataataggtattccaatacacaaagccccatatttatttttactaccctacccctaatctctctctctcccaccccctcttctctttttcttcgccaccatcctcgcctttccctctcgctgccgccgctcgcctctcccgtcgccggcggccgcgaggatgacgaggagggccgcctctcccgtcgccggcttccaccgccgcccctctctctctctctcacgtcgctgcccatcgccgtccttcccagcatcctctgccttgcaccgtcgccggttgggggcactagatccggtgctgtagtgggcaatgcggatccgtcttcgctgtcacctctctcttctctctctctctcattgccacgccgccggtgaggggcaagaaggggaggcataggggaaggaggtgggggacagggcaccgggtcgccccattgtgtacccccaatggagtagctcaggaaaagtgagctgaggagcccagagccacccgtcccctgtgtaggggtcacgctcgcgcctccctcctaggggacgacccgacgacggaagttggatgtcatttgcgaggctactctctaggggcacgcgttgctgatggcctaagttcccacacaaaaattttataccctgtcacatcgaacgtttgaacacctacatgaagtattaaatataggctaaaaaataactaattgcgcagattgcagctaatttgcgagacgaatcttttaagcctaattgcttcatgatttgacaatgtgatgctacagtaaatatttgctaatgatggattaattaggcttaataaatttgtctcgttatttactgacagattttgtaattagtttttttattagtgtccgaacacccccatgcgacatcatatataatacctgatgtgacacgacaaaactttacactccgtatctaaacacccccttattttatacgcaacatagattttgaaagcacgagagatgaatataaaaatcagtggccaaatgataggctgctagcgatatgcgtggcctatttctttttagaatcttcatagcttcccgagatatcagcacatgctcatgctcttagtcactctagagtctattactatacgctccctccatctctaaatataagtgattttggttggatgtgacacatatggagggagcagttactactaagttaaaaagaacaaacatatatacaaacctattttttatgagatggagagggtactctttctgttccaaaataattcaacttaagataaaatatgatctatcctaaaacaacaaatttgtattatcttagaatatgttattttgggatggaggaaatagttatccttgcgatctactccctccatctaaaaagggcaacctgcaaaaagatgtgaaacaatatagtacgatgaatctggatatagaggttcagagttattatactatattgtgtcatatcctctcatagtcctttttttagatggatggagcatattatagtgatatagtcatcccagttggctataattggaagtgattaatctggtcaaatcaaataaaagagaatatcccgtcttaaaaataacaagtcattttgaacttctcgagacccattttagaattttgactacctagttcagtataatcattatcataaaaaagttatttagtttgttcttattttttgcataagtgtaatattatgaaagctcttgttaggataaagttgaatatatcattttcatatacccaaaaagatattttgaatggtttttatggttaaaattaactctttttgaatgttcgtatttcaagcaacttgtttttgagagcgggggtatgttacttatttatttgtcatatcggatctagcccaaggaaaactttccttttatattggatcaatcacaaaaaaagcgaaacgtcgaactgaacgcaaatagtgtttctcctttcccttttcttcggtttgactacaggagtgataaaagcatatcggtccaaaatatctttcctacaatcatatttgtctcgcacaacagccaaaacatagcaaaattctaattttcattaccatgttcatatagaaaggcaatgtcgaaagcttcagataccaacgatacatttgaaaagtttaaaagttggattgaaacactcaatttttattttggtacaaagtgacagagcgagagacaaaaattactcgcacatctgaaatgtgaccaattcgatagattgctgcaccattttcatataaaattcgaactaaagcagtttgcacgcaccaaacacatgactagttgactactagcaatcactgcccactcatacataatcccggcaatggcggccgaggcgaccaacccctccacctcgcctcaccaacctcctccacgactccggggaactcgaatcccgccccggatagtcgccgccgagatcgatccatggcggccgaggaagcccaccgcctcgccgacgccagcgccaccgcgccgcccaagaacgccgccgccgtcgatggcgtcgccgtggcggcgccggcggccggcggcgggcatgggagggcgccggggaacaagctgtcgctggtgccgctgatattcttgatcttcttcgaggtcgccggcgggccgtacggcgcggagccggcggtgcagtcggcggggcccctgttcgcgctgctcggcttcctcgtcttccccttcatctgggccgtcccggagtcgctcgtcaccgccgagctcgccacggcgatgcccgggaacggcgggttcgtgctctgggcggaccgcgcgttcgggcccttcgccggttcgctcatgggcacgtggaagtacgtctccggcgcgatcaacggcgccgcgttcccggcgctgtgcgccgactacgtcgcgcgcgtcgccccggccgtgtcgggcggcggcgcccgcgtcgccgccatcgtcgccttcaacgtcgcgatctcggtgctcaactacacgggcctcagcatcgtcgggtggaccgccgtggcgctcggcgtcgcgtcgctgtccccgttcgcgctcatgttcggcgccgcgctccccaagatccggccgcgccggtggcgcgccacggcggcggacaaggactggaagctcttcttcaacacgctcttctggaacctcaactactgggacagcgcgagcaccatggccggcgaggtggagcggcccgggaggacgttcccgcgggcgctgctctccgccgtcgccatgaccacgctcggctacctgctgccgctcttggccgccacgggcgccatcgacgcggcgcccgaggactggggcaacggcttcttcgccgacgccgcaggtaaattcttccgatcaccaacaacgccatcgaatcgaatccagtaatcagatcacgttcttgcataatcacaaacacctagcacgcgcgccacgccgagattcttgattgattgatttatttattactttttgctcttttccattgacattggtacacgattccatcgaacgtgtggaccatggaaaacaaaaaagatttttttttctttttgcggggaaatcaatcttttttagtgttgttgtgattgtcatgagccatggcaagttaacaacgtgggaaagaggagaccaagcaattaggcagaaaggaacaattagatgatgatattattgtcgtcgaagaaaatctctataaagtcaattccccttagaacaatatggcaatatctttacagtactgtcagtacagctacctctccaagaacagtacaaaagattatgtgtcagtgtcaatgacatatactcctgtttagagctagtcaaatcctataaattaattcatatatcttactgtattatcttaatttggtgttccatttggacaatgataatgatgcccaacatttctaccattcttcagctgcacagatgaaattaattacgcgctgcatgttccataaaaagaatacaacaaagaatacaacataaatagtagattgtaacgacgcataattaccttatacctctctctttctcagaatttaaggcctgatcaaacttgacaatagtctccaaaactaatatttttttcgcatgtactacctctatttcaaaatatctgttgttttagattatttagtaaagattaatgcttaaaaggaaatgaccatagcgccccctattaaatgatgtatgatggggagtgtgtcggtagtttagagtaggatagagaaaattttcaattagaggtaactaatgtaacaaaaggtacttttaagtgacaaagctttttgacaaaatttaaatcctaaagcgtcaatattttggtacggaggaattactacactgtctataggaacagagtcatagctataagaaagtatattcaaatgtcaatcccgaatccaataataccgttgtcaacaagtaaaatttaatttacatcaaactaattgtcagtaaaatattatattgtgatgaggaggagtgagtattttccaagcttcacacaacaatcgatttacgcggcgcattaatttaacgatctctgcatctgcattgcactactgtggatggttgatcattttgattgatcactttctctgcaaacgcatgaacacgtacgcaggcatgatcgccgggggttggctcaagtactggatcgaggtgggcgccgtgctctccaccatcggcctctactcggcgacgctgagcagcgccgcgttccagctcctcggcatggcggacctgggcctcctcccgcgcgccttcgcgctccgggcgccggtgttcgacacgccctgggtcggcatcctcgccaccgccgccatcaccctcgccatgtcgttcaccagcttcgacaccatcgtcgcctccgccaacttcctctacagcctcggcatgctgctcgagttcgcccgcttcgtccgcctccgcgccaggctccccgccatgcccaggccctacgccgtgccgctccggggcctgcccgccgccgccgccctctgcgccgtcccctcggggttcctcgttttcgtcatggccatcgccgggtggaaggtgtacgccatcagcgccgttttcaccgccgccggcgtcgcggtgtactacctcatggacctctgcaaggccagagggtggctcacgttcagcgccgctgccgcagaccgcggaggcagcggcggcgacgcgatgatgtaccggcgtcaggggagcacggcgagcgaggtcgtctgatgaggggatcgatcgtcgtcgacgccattgattccggcgttgcattgcaagctgtatatgctttccgatgtttgtttatctgtgtgtgtgtgcgcgcttctttccttgtgcagaagagcataggaattgagtgatttgtaacagtcttaattagtcgtagatgctgatcaaatcaagaaatgggttgcatattactttcaaattagcaaattgtacattcatgaaagtggtagaactaaagaagcatacataagctcaaagagaaattctcgacctcactaaaatcctattgaaaacccaccaggatttcaatcctattaaaggaaaatgagcaattctaaggcacaaatctaatgaaccaatggtagcatcttgtccctgattgcaagaaatcatggacaagctcaaaatcgcggcgaacatggttagcacttagtagctagtacgaaacacctagaaaaactttgaaagaaatacaatcttggctaaccgaatgcacacttttggagaaggtgaggagccatacctacatgggcgcgacatggcttgaacaggaggacaacacagcagcatgccgacggcgtgatgattcgatgatggcacgcatgggcgtcacaggacacagcttaggaagaagaaatggtgtgtgccgtctcaggtcatcatggagtagtacatgatgtttgctttgctaggggtatttgagaagagtgtgttttcttgtcttgaactgttgatgttgggggagaaactgtatttgtcggatctgctacagtactagtactcctactcttactccgtaggccggtacatttctgttgggtggaaatgggaggaagacttccggacccatcatttcgcttattcgcggaataagccaagcggcacatttgcaagcgaaaaataatttgtgaataaaatttttatatttgtagctatgcttatctctgaagtcgatatccggcgtcttgtcttggcgcatgttggcttgtatgttgatattgtatcttgatctattgtttcatgtcccctctcctcctagggggccttatatttatactcataggtatccccttgttcaagtagaactagggaaaccaatatggatacaatccgagtagtccttgtcgtttccatgtagaactctattcatccttccttatgcggaactcctcctatatccgaaggttgtttccgtataagacatggtatgtggtgggtcctgccaagatttagtcaactactataaggtatgtggtatccataacattgacaatgtgttcttagcgatccaaaagaaaatgctgaaaaataagcttcgatgaaaaaaaaaacctcaaaatcagctccaaatgtaacattgaaaattcaaatttggctgataagcataagcataagtaaaaatatgaggcccttcctctctgttctcataaaaaccggtactcggtaggagggatgcagcggttgataagaaaagtaaaatgtgtttgaaactcacaacgcgggaaaagatgtagtgcaaactacatatatagtggaaacatgaaaactaccattagaacgtaaaatggatgttcaatattcgtccacgtatgagtaaaatttttactcctgataatgtggacgaatatcagacgttcatttgatccaacgatagttttcagattcccactacatatgtagtttccaccctatattttccccttactacgcagcaaacatgtgacatagaggaaatccaaaatcagaaaatggaaatgctaacgcatttagaaatgattagactcatttcttagacacgcaaacaataataagagagtaaagcacgagagctgtcttgtttgtttgtgtaggccgaaattcaggcccacccatttgtatgccagaattgggcccatcaagacgaggccaaggttagctagtgggttgggctggtgtgggatgcttccaggtgatatttataaggcaataagttcatattgattcccttaactagtaattgaatctgattcgtatcctataccggatatctcgatcctcaactattaaaacggctacaatttgaccccatcgataattttagagggtggttttgccaacgtggctcctacgtagtgattttgatctagtcttcgtggtgcatggtggtggtttttttttcctttcctagctaatgcctattaagaatcaccgcaccatctggtgttagtcgtcgtaaaaaaaaaaaccggtagattctcgttagcgaacttgtaccagaactgctccgtccgtgtgaagcgcaggtcgggggcgtcaaagaagaatcggcatgagctcgatctcaaagcagaaaaatcgccatgcctgcgccgtctccacgcactcgaacgtcaccgacgaccccggcagccgatccacgaatggccgccagaggcaccacgtacgagtcgtacgacaacacacccttcgaagctcccccaggaggacgaacacaattagaagtataatagtataatagtgagttataagcctactataagtttacgtggatgagagaggtaacaaaaaaaatcaagagtgtaatggctctcatgcaagagctagcttaacacaaactccaagacaatacattaaatgtataagtgagagatagagagaggaaaagaaaaattgtagccgaccttataactaatctattatatatgttggctttaaaatggactaatagtatgaagtgagctctactaccatctttgctcttagctgcaccgggttcctggaaggacctgatcacggagttgatggaaggacctcttgttggttcttttctccaacaagagagagttggatgaagattaagatttttgtggcacgcttttcaaactgataaacggtacgtttcgttctatatgaaagttgctctaaaatatcatattaatttattttttaagtttgtaataattaaaactcaatcaatcatacgctaataccacctcgttttgcgtaaaaaacttaatattcatcttcattttcagaagaaaagaacccccctatatatactatatgtgtcggtttttaatctaaaaccatc

SEQ ID NO: 5866 - DNA, 1037 bp, Oryza sativa
agtcctccacgtggtggtggtggccaaggacattggcggtggccaagggtggtggcggcaacagtggtggtggtggaggtggccctctctctgcattcgtcttcccccttctcctcctccagatctgccagccgacagcagtggcgatggtggtggaggtggcccttcttctgcatccgcctccccccttctcctccaaatccagtgacggtggtggagaaagctggcgcagagagtgaggtggcagccggaagcctaaaaggaggtggtggtggaggccgtcacactcctccccccctcgccaagcacttcgttgttggctccattgggccttttttttattatctcattgaatactatacatgttggttgtggggtaagaactaatacctataatttctgtatgtactggtttcagaactcctaggtatagatgccaataaattagtgtcggcttgaaaactgacacttactggcttttaaccagtacctatgttggtttctgtcgtagtggcggccatgccctcgatcttgtggaggagtctcgtgctcgccggccactgtgctggtggaagatcgagcagagaaaagcagcaaagcagcactgaattcctccttgcgtgacgccattagcgccatagttgcaaaataacccacgcagccgttgcaaagattaacccgtgctgagctcccccccccccccaaaaaaaaaaaaaatctttctcttgagcttgttggtgctagcatctgaatggagcctcgctgaagaatgagccggtggaactcattggtgcaggcagagctcaagctagtgctcgggtccggttgtgctgcacggctcatcgtacgctctggaatctggatgcctggcacagggcagacagagagggagcgaagagaagcagaaggacagaggaagaagaaggccctgaaaagctggctctccataactttatttttttttttaaccaggcatctctaagtagacgaaaaccacgcatatgctatgcgccgagcgtccgatgcaagaagctatc

SEQ ID NO: 5867 - DNA, 1502 bp, Oryza sativa
  unsure (1)..(1502): unsure at all n locations
aggtgatccatcttcagctgaacggcatatccattacagtactatcttccaaccaaacttaactgatactctttcatccggccgagtaattaaccttaagcaatcgattgattgattaattagtccctctctaatctttcttgaggcttcaaaagcaaaagagagtctaatttgccatgtcattagccgactgcttttttgctaatcacccaatgcatgataaggtagcatttcgttggtgccctgcttctgcttctgctttgcgccgatgagccgatctagttgcaccaaaaaggggcaactaaaagagacgcaatgtggaatttgctttgtgctgcattggggacggataagcctcgacaagtagtcgacagagagtgcttgatgcgtcgcgctttggacctgctgacggggtttctcacatgcgctgatgcacggcacacaaaaaccgactagatttcgccgttcttttatccggctatatcctgcaacctgcattagaaaatcgtcatcattctaagggtccaagattaccacccatttttattctgatacactgcacgttcccaatacattatactcctgcgtaaaagttaagggtctcattggttgtcctatcgcttataagtcagagccaaaatttaaattttaaaacttgattttcaatttgattttgatgttctttaacatagtttttttttcaattttagcttttaagtcgctaagaacatattatatatatatatatatatatatatatatatatatatatatatatatatatatatatatatatatatatataggtaaattaacggtgcntacatgagtatgggctccaagattcaaattgagtatatacccaatttaaatgagtatgaaatttttttaaatgtttagatatgaacatcaacttctttactaacaagttcaaacaagtttgaactttttttttgttagattttggttctaggtatataacatccaaacatataattcgttaggtatgtaataatgaattgtgaaataaagttgagtttgagttgttttgttgttaggtatttgtatgaatcaaattcatatacctaggtatatactcacaatttaaaaattttaaaaaatttgagagaatttgtgtgttttatatcttggagcccgagcaccatggagtcccatatgtgtatcatatatatatatatatatatatatatatatatatatatatatatatatatatatatatatatatatatatatatatatatacacacacagaaattttactcatgtattttttttaatcgttaatagctcgttatggcttataagtcataagcaactgatggggataatctaatttattttaaaacggatgaagtatcaaacaaacaaaagtatcaacgttatatatggccattggaaactcgatgacacactttggccgaaaagaacatagttgtacatcaccggatcacccctgcgacaccatacgtggattcaaa

SEQ ID NO: 5868 - DNA, 2560 bp, Oryza sativa
ttggccgaaaagaacatagttgtacatcaccggatcacccctgcgacaccatacgtggattcaaatgcagtcgcactcatcagcacggagcacgtaattaagtaaaacatttcttgtgacaaggaaaaaggagccggcacacgttgcatcatcatatgtattgttgatatacacttcttcaattcgttggcttttctgcagagatccatcaatcatagcttaggaacaaaggaaactttggctcaatctctccctagcctctatgtacacatgggtcgttgcattctgcacacatcgatgcacatggctcgattgctttgcttgggttggttctcgacctgctggccggtgatggacaaatggcggtgtggcgcccggtagccgtgtctcgactgttctctctctaaaactttagttttgtggtggataagtgtaaagttaaggtttcgttattttcggcctcatcttttcacttaaattttaaattttcaacatttaatttgaagctgatgttgggattttttttatcgaagtttatttctaacctttacttttagatcgctaagaacacgtatataaaagtttttgttggaaatttggtcataattcggcatattttaatccaaaatattaagacaataaacatgacatttgcaatatgagtagatctagtgacagtgatagatgtatacagcttgagtatgcttaatatgaaataagcatcaacatttacatagtaacacaatactgccattgcgaagagtattaacaaagaaacatctaatagaatcgggagaatgaaagtataccccgaaaacatcccaccgctggattttgaagcaggattgcctccgttgatgtcgttcatcatcttgtctccaatctccgtcgacatcttggtgaaggcgtcgatgcagcagcagtagccgtgaagaacaagagcagtcgcgcttgaagcgttacccaaaaacttgatcgcccgcctacccatacaggttctcaagcggacggagtttcggaggcacctgctcatcccgtacacctgagcgcgcaggtgaacagaaccggggaaggattctacagctcaagaacagaggaggaggaactcgaagtgcaagagaggtcgggaagaacttctttcgtccttctagtcgctgtggagtatatatatacgagcgtgggagtaacgttcggaatcatcaaccacggtgtttaatttcgtaaccgacgcgctcgttaatacggaatcaattcacgacgtttaattccgtaaccgacggaatcaattcacgacatttaattccgtaaccaatgtgttcattgatacgaaatcaattctccgtgtgtttaattccgtaaccgacggaatcaattcacgatgtttaattccgtaatcgacacgttcattgatacgaaatcaattctccgtgtttattatcgtcaattcatgacatttaattccgtaaccaacgcgttcattgatacgaaatcaattctccgtgtgtttaattcgcgttcattgatacgaaatcaattctccgtgtttattaccgtccgttacaaaacgagagagcgcagcaatagctatctgcctcaccccgcctggttgtccgcgcaccatcaatagagactctccactagctctgtatttaagttgagacctcttcacttatatttctaaggtggtattattacccatagcacttaatgtgggccaatggaatttattaggatttaattgggcctaacccattaatctaacagttttattaaaaaattactctttgttgcaaatatgccgtttggcttatgatgggaacctttgttttctattttctgctagtgtgtttagaccattttcagcaaacgtaagagttttagcgaaatgaggttaaccccctgtaggagctgagaaaattcatttgttacaaagaaggcgttgtaaaacgagaaaaaggaacaatactgattgagaggatggaaaaggcagaaatgggaaaaaaaaagaatatggtatgaaacaaagaaaagaggggagaaagtcaaagaaagaaaacataccaaactttttcatgaggggaaaaatatgccaaacttttcctgagaaggaaaaatttatacttctaccaaactcgaaagacaaaaaaagagaagagaaaatgaaccagaccgaaatgggaaagcaagaaagtagtcgaaactggaaagcgagaaaacataccgtcatgggccaaatttctctacagatcaaagcccaacaagagcccgtttgtgtacagcccatcttacccgtcacggcgtcacctcccgcatccaccgtccaatccccgcccccccggatccaacggtccacgcgacatctctcccctcattaaagccaaaggcggcacgcacgcacccctccccctccgcgctcctcctctccctccccctccgcgcaacatccggaagcttctggaaatctggaggcgacgaacccaggagcggcgaagcgcctccaagccctaggcgggaaaggtaatcatcatccgattcgcgagtcgagattcctatccccccg

SEQ ID NO: 5869 - DNA, 2872 bp, Oryza sativa
cgctagggtttgggtgttcttggcggtgtgaaggatggagtgtttgctggtgggattgaatggcaatgatcgacagctgtgtggattggcggcgtgctcatattcttttctaactcttgatttagatgccataggaagatgttatgcattcattcacaacagttatttcttatacttaaacttgattgatatataaagtatgctattgaacgcttctaatcatttcatcagtacggaagatgttatgtattcattcacaaccattgttaacaatacagttaatagttcttatagattattaagttgacgactcttaagtcttgaatgccttgtgtgcgttcaaggcactacttaaatttaccattgatggatgtaaattgggagtggcaattatttgatgcatagaaatatattgtgatgtctatttttctcgaatgctgaaatgttgtagcttgttttattccctaccagcatctaccgaacctttttagctaaaaatagctgaatggaagaatgagtcttgttgataaggtcacttgctgttggcattgttctttttagcggaacgagtagcttatgaaacacaatcgcatcatttgaatttcctctaatggcaatttttttcctgtaagcttagatcactatgggaagaggctatgattatggtccatcaccgccaagagaatacaggagaagagcccgcagcccaagtcctcgtgggcgctatggaggccgtgacagggatctcccaactagtcttttggtgaggaatcttcgccgtgactgtaggtaagtttctttgcaccttggtcagtaactgaatgagtgttttcttgttaagtaacacatgcaatcacacattccggttacactagttgtagttgagttggtgcaattcatcatcatttgggccaagataatgtctctttataaaattataatactactgatgtgcattttttaaatccgtaaattatttttcatcttgagcttctattgcatacagctcatgagcttggtttgcaatgccaaaattcatttagtcatcacttataaaccaaagaagcattgctttggcgcaaaacagattggagtgtaaatctaaacattgttcttctgttgtaatgacataaggcaaatgagtaaatgtttgttgttttcctaaggattttttttgtaacctgtgttattattgtcatctgttggatattatatatttgatttacagaagttcgtaactgtaaggatttctcgccttttcatgtcttttaatttcaatgctattttaccactttctccatgttgcatgtctttaccttagacataattatgaatacaggcctgatgatctacgaagaccatttggaaaatttggtcgtgtcaaagatatatatcttccaagagattattacactgggtaaggcacctcaactcaaatagagccagtgttcattttcaactggaggcctacatgctgtttagggatcaaaccatgagatgtttaggatgctgtgatattttttcaatccagtaatatgctatttttggattcatttgcaattggcttaaacatgtgctttggaaatgtttgtttgtgctttagtacatttggtacacctaaattgaatgatttttgcccacctcttaagattaactgtgaaaataattttttgaagacacaagccttaagagtactctgttgaagagaagggaagaaatagagtataagagatatgcaagttatgaagagtttcaagtctatctttaaactctgatgagtacaaggtcagcagcctagtgcttgctttatctgttgaaaaatttgtgtatcaacatccagggaaaggaatcaaggttcaaggatatgaataatcaattgttcctttacttgactaaagtcaagtatccttttcaggattttcttgtatactgttcagaattgtgcaattaattaaagctaaatcttgttatctgtaacagggagcctcgaggatttgggttcatcaatattatgatcctgaggatgctgctgatgcaaaataccacatggatgggcaaattcttcttggcagggaagttactgttgtatttgctgaggagaacagaaagaaaccatctgagatgagggctagggaaagagtcgggtattgcactgctctctttcatcctttttctctaatgttttttgttttgttaaagtattatctcttttgtggcatatgtaaccagtttgttcatcttctgcagtagcagggaccgttcttatgatcgcaggtcgcgctctcctagatactcccgctcaaggtcacctgtgtactctccaagatcacggtcccgtagtcgaagctactcacctgcacctaagagaaagcactattcaaggtttgacttcagtatcctccatggacgtttatattagtttattcacaacaaaatcattcacatgttttaccatcttagcaggtctcctgcccgtcgggagagatctctgtcgcgctcaccagcggacagcagatcacgaagtagaagcctctctgatgaccgccgcagcaagtcacctgacagggagaggtctctttctgttagccggtgaggagcttaggacccaaatgccaacggggcactgggttgaaccatgtttcgatgatgactgcttcttgttactaggttgaaccatgtttcggaatttttaggccatcctgatcttctaggaatgttaatgatgtgtggtcttctaggatttccttttcattgttggatcctgaagataaaaagtcgaagcatcgaacaacttatcatattctttgacctcgtgcccattttaagtgactggttattgccttttgtggtcctgtaacgttaccaatgattt

SEQ ID NO: 5870 - DNA, 3100 bp, Oryza sativa
cttgtgatggaagcaatagtaaaattaagtagaagatatatacctgctattaaaaatactatcttattccccaaatgtttgacggtagttaaccaacgaaaaaaacagagatagtattttttgctcatccatgtcaaaaaaacgaagccaatatctatactacattaaatgtgggcagtggtgatgccagtgaattttccgtccccaccactcttactagcgtgtaggctttcacgctgttggtggtgttggtgtttcatcctgaaacaacataagctttgtgtttcttggtctggctaatttagtaagcatctaaaaattgatggcaaaagacagcccgaattgtagattcttaaggctttgaaatgaatgccaaaattatcctttaagatttggtggtcatgcacgggcaaattagctacaagtataaacaaacaatataaaacccgtctctctcctctactgttgcctctttcccagtttgtgctctctcctctcctcactccgccttatccccaaaaccctatcgatcccatcccctttcctcctcacccatggcggccacgctcttctccaccgccctctccccgcacctcctccccctcccctccacctcctccaaccccgcctcatcctccctctccttcctctccaagccgctgctccccgccctcgccgtcgcgggatggccgcggaggaggaccagccccttcgtgccggtggccgtggccgtgtcggaggaggtcgagacggaggaggacgaggaggaggaggaggagggctccgggggcgaggagttctccgacgacctgagggtcttcgtcggcaacctgcccttcagcgtcgacagcgcccagctcgccggcctcttcgagcaggccggctccgtcgagatggtcgaggtcaccaccccattcgtctcgccttactaagtactcctatcacaccaccttcgtcgagtcgctcgctggtgtgtccctgtctttgtgaaaccagaaatggaccgctggtcgctggtgaagtggtgatgaatgattgtgtctagttgcttcatattacagttcacgacaaattcattctgttgttaatttagcttaaaccgcgatacaattgggttgcatatggtagtgtgggcatattctcgttcttttaagaaaaaaaaacttatttcgggtgctcattgtgaggttgtatttggagatgattaaggatgcgataaggttgccattatttaaggttgttaaatttggtgtgctggcgctcatgctattaattctgtgactggcgaaagatttaggattgcatttttctggttaattgctcaattttaagagtagtactcggctttggttgatttttcctatattgtatcatgctaaactgcattgttgcaggtcatctatgataagctgactggaaggagtcgtgggtttgggttgtgacaatgtctagtgttgaagaagttgaggcagctgtcgagcaattcaatggctatgtgagtatatgcttccatacttctaagtcattatttttgctccatgttggtatatgggctggctaaaaatatattgcataaagtgcgctcctatttcatctctttggtttgcatgctgtggcttgcattctttcaagataactgtagctgaggttgctcgatatgaacctgcttgcttgttttaatccttgtttgcttttagcttattcatgactagaaaacaaactttaatttactcttttctggcatgttgctggacatatgttgtgttatatcctatacaacatcattgaattgtgcttaactaatttgctgatttcatttcttaaaacagatacttgatgggagatctttgagggttaactcagggccaccaccaccaagggagcaatcatcgcagagagcacccaggggtgaggccaacagggtctatgtaggtaacctttcttggggtgttgacaatgcagctctcgcaaacctattcagtggggaaggggaggtcttggaagccaaggtcatctatgacagggagagtggcaggtcaaggggatttggttttgtcacgtatggttccgctgaagaggttgagaatgcagtttcaaatcttgatggcgctgtgagttttcactaagtctggctggtttcttattctcatatgtctttcagcatcattgttcttttagtgtgtgctaaaacaagcctattttctttgttgtgcaggacatggatggcagacagatccgagttacagtagcagaatcgaaaccacctaggagacaatattgaaattcgtttagatgccctgaagcctatggttagtccagatatgaatcatactatcgtcatgattgttctatagcatcgatggaattctagtcgtaacttccaccatatggttcaaaagattggtttggtgatgagatatatatcattttgttttaactttttgaacccacttttttttgttatgtatggcttgttccttgaattatagagtaaagtgcacggccggtctctaaacttgtgctattcaggtctcataatttgacaaagtgtgtcattccggtccaaaactgtcataatcctttcgagatcctggcgctgacatgatataccacatactaagcaccaacatggtatcatcagtaactacgcagtatgtccacatctgtatttctagattgacctgcccttccaacttggcatctcattgaatctgctcagtatcttgagcggatagaccaggttgggctgatcttgttttattttgggaacaatttcgattgatggggctctgacgggaccaaatatacttggactttttttttaccagtatacgttgtacgactccattttccaataaaaaaaaaggtgaatagcctatgaagtttcgcttcgagctcaatttagttgttgatgtttcaaaccgtccaaaaaaagtcctccaaatttattatttgggttaatatagtccttagaaaaaaaaagccacgaaagcatatcaagtcatccttgtatgtagcggtatgaataaaatgactattctacccttatataccatatagaaaaaaaaagaccaacaaaaaaaattacgggccagcccag

SEQ ID NO: 5871 - DNA, 3145 bp, Oryza sativa
taatctgtggggttaatggggcgcttaggtggcatttgaattaaaaacgtatacgtgggatccgtttatcattcacacataaaaagttgtggggcccacatgtcagtgggccccacatgtcatcctctctctctttcttcttcctcccctcttcctttctctcggccggctgcggggagcacaggctggagcggcggcggccgggggccggagtggtggcagccggcgggagctgaagcggtggccgccccgatcccatcgccgtgctccacctccagccaggaaggcgatgtcgtccgggagcgccaccccgaggaggatttccgactgcgccgccaccgctgttgacgccgacgacgccgttgccggaggttgcaaagcctccccaaaaccgatagcaacggcgtactggtcatggcgcttgaatgcgatagcaacagctcatgagatctctctccaccgattatcttctcctgtatgtgccgctcgtcgattagttcgtttcagagcttcagactactcacgacgacgatcgccttgccgatctgcctcctgagttccgcgtgctgaaaacgactgccattgatgttaatccattttccttggatcattgtgtgtgctactgcaaaaccgatctaattctgtgttcttgcggtagtaattgtcttgtatatataggagcatttgtgaagaccaaacaactgggcattcaggaattcagagttcagattttagtagtgttgtgatttgcagggcggcagttgcgtggcagccgacgaagccaacggctcctgtgacgaggacgaagcgatgtcggcgaggggtggtggtggctcgtgctcgtggcgaggtagaggcggtggaagttgtgaattagtgaaactgcagcttgacctatatttgagggagtccgccgcgccctaatccaagcgccatggacgaaggcggagccctcgacgcccttgaccggtcggccggcgaggaagacccacccactcccctgcatccgcatctctttctcctccctcccctttctcccccggcacggcgttcctcttgtcgcatgggcggccgcggcgcgacgggattgcgtccgctgtcgttgccgcgctactccaccgccggtcgtcgctcaccaagctcaagtcccgcttcgtcgagcccgcctgccgccgctgccgctccggtcattgccggccgccgccgctccagctcccgcccgctgtcgctacccctgcccgtctattgctccacgagagagaaggtggagagaaaagggggagagagggaggaggaagaaagagagagagaggatgacatgtgggcctcacatgtcagtggggaccacaatatatttttgtgtgaatcacagatgggtcccacatatatttttttaattgtaatgccacgtaagcgccacgtgtgacgaaaactaggtcaatatttccacgtcagcaccacatcagcaaaaccactgagggagtcaaattgcactgatttcagtagttcgggagtcatcctatcctatccggttttgcggttgagggttacatattagatttgggtcacttttaagggagtctatgtggacttattccttgaatttttgatcgcatgagcttcagttcgttgcgtgggacagtgggagtggtgggtttgttcgtttggccggcggtccatctgttcagtcaaatcccgaagtgttagtggatttaactttgaaccctattttttttattaaagcacaacgtcgttaaatcttgaaaaatccgctttcacggggagtcgaacctagacctcagatgctactgagactcttgtaaccactaggttacaggtcctttcgcaactttgaaccctatttgaacttgatttgcagaatttggatatgaaagctttggttttaacttctctttttagagaatggtatttttttacccaacttttgcatcaaaacagatgtatgcggtctttttaaattgggaattttgtccctcaaacaacctaatctaaaattcttttatataaagatttgaactcagtatcttgaggtactacttaggtcacaaccactaaactaacttctcgcacctgcaaatttttttttcaaaatatctagctttctcaagcaattcagaaaactagaagtcaagagctttggattttttttaactttttcaaaattttaaaaactgactaccaaccacctgcatatgtagtgtagtcactccttaaaattttaaaatcaaagatgaatgggaggatcatgagaacaaggtggtcgttgaggcgtcaagctctcgtgcagccgcggaacagcaacaagaacaattcggaagagcaaacatgacctctacttgctttctctctctctctctctctctctctctggataattggagacgacaaatcacgtcgccagaaagcagcctagtacccactgaaatccagaacgacttttctcggagaaacgaagccgttcgtgcctcaacagtgctgccgaaaccgacgccatatcgatcatgcaaaagcatttctgtctcaagatccagacaaacactaccaacacatacacacacactcgcaaacgcttcatcagactttcttttgagtactgcaagtggagataaggagagaaatccgatccgtcctcctcttctccaccaaataaaatgattggcaataagcagcagcagcagtaacaatgcaaaaagagcatgtaatctattggttgcagtgatctgaatagcatcataagattctgagtttaaatcttcataggagtgaatttcagattagattgtttgcgggactaggttcctaatttataggagcgaatttcatatttggttaaacaaagttctcaatttaaatgattgtatatatccagttggatgtaaatgtcgaggaaataatacccttcttaaagaaacatacatcctggccctggtagcgacaagatctgcagaatcttgcaaatttggtggtggccattgcggatcgcagcaaaaggatgggtgcgtgcagtgtgtgcgttcgataataatagtataattaaatggatgggctaacaaatgtaatgcgtcgtaaacaatctgccgcagttggtttataggcagctgccattttgctcagcactgtccgt

SEQ ID NO: 5872 - DNA, 18554 bp, Oryza sativa
  unsure (1)..(18554): unsure at all n locations
gcgcatggaggatatgggcgggcgcccctggccccaccgtccgcccgcgctagagaagcggaaggccgagcaccgccttggccccgccgtcctgcgctagagaagaggatgggcggctgctgcctttggccccaccatctgctgaggaagaggagtatcccattgttttttagtctaactggtatgcgggccccacatttatttttttttaatattttgcttttagtgatcactgccacataggacgaggaccaagtcaaaccagccacatcactgtcacgtcagcctaaaccaccatctaaatcgagggccttatttgcaccggttatgatagttgagggacccgttgtatctggttttggggttcaaggacgaaaatcggattcgatgacaagttaagggatctcaggtgaacttattccacaaggaaatcattcacgaactagattatatgcatttttggaagcccacgggacaggaaattaccggccctatccacatcacttcccagggggataggatttcccggccctttccacccataagctcgcgtcattcgctgatcgcatctccgtcgtcacgagcagccgccgcctccgcctctcccacccgcgagattccgccgtcaccgaccgcaagctgcacttccctcttcttctaactgatgtcaggcgacggccctcgatggtaatgttccggtgagacaaaaatgaacttctttttaatttctttcgatgaaaggactaataatcctcccacaagtttaggactcctgatcatggtttaattttttggtttggccgattctattggaggtcaccagtataaggaaatttctgtccgaaattttgaacaaatgttagtcagatttgaacaaaatattatcaaattcacaaaataaaaataaaaattttggtcgaaataatatcgtatcgggggatccgaaatggctgaaatttctaaccatgctcctattcctgaatgaagcataagttccgttacagtttgatctaatctcggcacatttgaatttgatctaatctcggcacatttgaaattgatttgtctctgcaagagggctttgatatctatggggtgaaattgatttgtctctgcaagagggctttgatatctatgggcttgtttggttctttaccctaccaattcattggtagtgccaaagtctaggaaaattttggcactaccaaaatattggtagggtaaaattatttagctaacatttggattgctaccaatttaaagccaaattcttatagcatagtgaagaaacttctagaatatgaccaaatattttaggggcactaccaaatatttagtctcaatccaaactaacacacaaactattcaatttgccaataaattggtagggtatgtttttggcatcaaaccaaaacggccctatacgagatgaaggaaaatgcctgacctgccgaccatggacgacgacgacgacaagatgggcactcacgcacaggtgcagcagctgcccgacgagctgctcttggagatcctgctccgcctgccgccccgcgccatcgcgcgctgcctcgccgtctgctcggcctggagctccgccgtctccgccgcggccttccgccgcgcccacgccgaccgcccggccgccgtctgcaaggccaccgccacggcgatcgactgctgcgaccgcgacgccgtcgtcctcgacgcgttcctcggccgctggcaccgcggcaacgtccacaccacgccgcggtctccgcgcggcctcgtgttcccggcggccatggcccccgagcccgacaccccgtgggtactcgatacgctggtcgtcggctcctgggacggcgtgctctgcgtcgagcgaggtgctcctctgctccggggaagccgctgggacgccggcgtccatcactggcccaaatccggccggctccgggagtacgtgctctggaacccactcgccatgacccgcgccaccgtctctccgccgcccggccgcggcgctgtcatcggaggctacgcccacccggccaccatgcgcttccacctacttcacgccgccggcgaggccgcacgccgtccaggtagcctcggcctgttcgtcccgaccgtcttccgtgtccagcgagtcggagacggcgcctggcgcgaggttcccctccctctcctggaacaacaagacgatcacgcgcacgcgcagctgcagatgcacggcgctcgctccgtcgccctgcacggcaacctgcactggctggtgcagcggggtggatcggccggacccggacggctgcaggtgctcgtgttcgagccggcgcgcgagaggttccggctgatggaggcgccgccacggcgccatggcgaggaggacgacctggcaagatcgcggatcgtcgtcctgtccaacggcaagctctgcgccgtggccgtgcgcccggccaccagcacgatggagatgtgggtgctcgactcctcctcctccgacgcgccgcggagatggcggctcgacgcgtacagcctccggcgaaggaagtggacgagggtgtgcgccgcgcgccccaggagtggttccgtgggcgtggcgctgctgccgcaccgggagagcgttgctgatgatcagcccagcttcggcgaggcgtcccggctgctcgaccacaccatcgacatcgacgtcgatgaccagtacttgtctatgaacccaattactttgttttgttactgaacaccgattgagttatttatatcagcttagttttattaattttaggaaatgaataaaataagaactatcttataaagaattaatttgttggtggtatttttgtttgtttgatgttagaagttaaactaaccaacgtcaaatataaaaggaaggacgtagtaatatgctaggatgattgaatctgactctgctacatgcgccttcattgggcgaatcgatacgggaaactgttttaattaccacccgtttattacatgtcatctaaacggttatgaaaataattgatatgataagatagtttaatatgtaaaatatcactccacaaacatataagttaaaattcgacttctacaaaaataacaaacaaaacgttaattactatttgtataattgcagctaaatttgttatttttgttacaatttgtagaagttgaatttgaaattgcatgtttgtggagtaatattacatattaatatattttgtcatttttttgaattttttcataaccatttaagttgacatgcaataaacgggtggacgtccactcgagtgattagaatccatctcgatacagatatcttactcagtaacgcatgcttgactctccacacacacccagataggtgttttaaaattcatatacatagggaactctagatttcagatgattgaaattgtcaataattttagtcatttttctcgtccctttgatggcaatccaatgatcctcgttgcttctctttttcacccctttttaaaaggttgacctacatacttaaacatacaaaatttacaagaaataaatctataattaataaaatttacaaaattacatgaaaatgatgcaaacttagataaaaaaaaatgaagtgaagccacatataacaataaaattgcagttaagaagtaaaactacacattacatactaccgcaattttagacataggaatacatatatggtgtgcagcggtcggatccaccgctagctcccgcgcccctcgcagtccgccggggtcgccgccgtcgccattggcggtccgccgttgtcacgcgcccgtcccacggccggatccgtcgtctgcgaccctgcagcagccggatccaccgttcccacgcccatcccgggcggggatttgtggcccgagcccctcgcaggtcgtcgtggtcactgccgtctccgtcgccggtccgccgaggtcacaccgatcgatgccgagaggaggaggagaagatgtggacgccgagagtaggaggagaagctgtggcctgtgggaggagaggttgggggaggtaggggagaggtaggaaatgaggaggaggtgaggtgagaggagaagacaagatcgtcggtgggagtggaaagagataacatccgtgcgattttgatatagggaatttcttttcacagtcggtgctccttatctaccgccagctaaaatcaattttttaccagcggttgtttaagtgggctgccagcgaaaataggttcttagcccctcacccctcgttataattttgtaggtggatttcacaaaaagccgccagtgaaaataatatggtaccgccatgaaaaatcgattttgtagttgtgatagctcttcctgcagaatatttttttttcttccgtctggtccgtgcttccgcgggaccagtataatagtaggtattaaatacctctaagttgacttcttaaaaaaatgacgtcatttgtaatttttcacggaaactaatatttcatggtatttgtatactgtagtccttttctgctttacttacgtaggctatttctcatgtattttcagaaagttttgatccatgttttagaagaagctggctatacaaaagattcacattttactctaccagactttatgaaattaagctccaatctagtactttattcccttggatctctttaacctcaacatacaaatattttctgcaccagtgtatcaggagcatacacatttgattgattttccgtgaatcagctagatgttctagaacgattatatcttgtctgttatttgattgattttattttgaataagctgataatgatctaattaaagtatagttgccatcatctccgtatttgttgtaaatcgttcatcacatcacttcaggtttcatagcattatcgggaaaagttctcaaactaggatgaataaagtttcctctaaagcaaataagtgagaaatgtgatgcgtatcgaggactttaatctttcagaaacaaacataagttgtctacgagagactataagccagttataaacatattttaagaagataaaagaagagagataagagcagtgggctataagtgtagatacaatagcagactataagccagctataaacatattttaatgagataaaagaggagagataagagcagtgggctatagatttgtagccagctacagcacggactccaagacgcatttgtgtatgacaggtgggccagatattgattttgtagcatatgtttatagataactattgtatgaattggatattaagttaactatagattgatttggagcctgtagtaggtttcgccaacccatatagatcctgaagataaaagaatcgactgaacaaataacttcgatttcgaatactgaacgataacccgcatagattctacatatatttaacaacatgctatggtaaagtataggtccaaatagatatttcgaaaagaaaatttaaatggtaatccaataatattatttttagcaaataaaatttagtttacaattaattatttaactatttattgatttaaagagttgaattaaatatggtcgcgccttactgagtggcacggagggggagaaaatatttttatagggagtagagatgctggccatggtcgtcgacgatgagctgaagccgccactgttgggaatagtcccacattactaatctagggggagttgaaccaacttaaaagtggggggagccccttacctcttgacctagcttttgggatgtagcaaggctttctcccaattgggccaacgtctcccgattttgggccaacaagttggtatcagagacaaacccataatctctattgcttgtgcacactcagggtggtgtaaacccaaagcccagtggacagcgggtgtgaggccgatcagtggaccacgggtgtgaggcccgtatgtgcctgtgtgtggggctgatcagggctaaggggtaccaatgtgtgacgggggaaattgttgggaatagtcccacattgctaatttagggggagttaaaccaacttaaaagtgggagagcccctcaccacttgaactagcttttgaggtgtagcaaggctttctcccggttgggccaacgtcttccggttttgggccaacagccgcgacgcctcgccgaagctcacgtcgtgccgcacgacgctgcggcagcagcgtggcgaagcgggagacggacaccgtcgaccacgccctgcgccggcatacgcgtcgatgttggccgtcgttgtggaggatcacctcctcgccctccgcgtcgccctgcaccgctgacacctgcgtcgccgacgagaaagccctcgacaggtcgcgcttgtcccacatcatcaccaggccgaccctctccgcgagccgccacgcccgcgcgccgccggaggagtcgtcgtcgtcgagcacccacatctccatcgtgttcgtcgccggcgagacggccacggcgcagagcttgccgacgccggacaggacgacgacccgcgacatggccaggcctttcttctcctcccccccccccccnnnnnnnngnnanggntgtngnnccacggcggcgcctccatcagccggaacctctcgcgcgctgtgtcgaacacgagcacgttcaaccgcgcggtcgagcccgagccacgctgcaccatccaatgcaggttcccgtgcaagctgacggattgagatgcctgcatcctgagaaagattatggttctccttctccgctgcaattttgcatgtttgcgtcgtcgtggccgtcttcttcttcctgctgttccaggaggggaacctcgcgccaggcgccgccgtctccgactcgccggacacggatggccgtcgcggcgaacaggccacgttccgcctcgccggcggcgtgcaggaggtggaagcgcatggtggccgggtgggcgtaggcgccgatgatgacgccgcggtcgccgccgggcgccgggggagggacggtagcgcaggcccgggtgagcgggttccagagcacgaactcccgctcccgccgctccggctgcgtgttgtctaggtcgggcccgaacctgaagaaccgagaagtgtactcgacgtcgacgcagacgacgccgtcccaggagccgacgacccaggtgagggcgtggtgccgccatggtcgcgagctggaggcggggacggcggcgtggtgtgtggacgttgccgcggtaccagcggccgcggaacgtgtcgagaagcaaggccttgcagtagcgccatggcttgccaaaatatgccaattcggaggtgaccttgacgacagcggccgggcggtgggcggcgagggcgcggtggaaggtcggggcagagacggcggagcgccaggccttgcagacggcgaggcagcgcacgatggtgcgcggcggcaggcgggccaggatgtcctggatcaccttagatgcctccaataattcagagaaacaaacagctcgcagcttattctatgtcagcttattataatctagcttagagtaatctgatttaataatctagattacaataatcttaagctgaaacaaacaggaccttagtatgagaactttataagtgatcgtataaatataacaacttgcaaggtaggtacgattttgatacaataaactaagaaattatgcgacaacttaattatttggagcattttctacatagattcaatttaagtaattattttgacaatatactagtgtggatttgtataagcatatttatatttttattataataattaataacttgaagtcaattaaactggatgtaaaaattattatatttcggttgatatttgagaaggtaaagaaaacgaaaaaaaattttaaggtaattggatgtaaactgtatatgcaatataattactaaagattaaatttaatatctaaggtaatatctgtaggattgctatgtaatggcattattgatatcgggaaaaaaactcacctagcatatgcctagccaaattgatgcaccaaaatacaaattgtcaagttcttgtagtagaacgcacctacctgtcaagttgttacacttggacgctcatttctcaagttcttgcactatatcgcacccacctgccaagttgtaccgtgggtgcaatttactcttctttcttctacagatttttggaagccaaccttgcaggtttcgagtaccattaggtgcatctggtactagcaagtactaaccccttccagctgttagatcttgtgtgatggatggtcaggattcggtacctcctcttcaaaaagggcccaaataaattgattcattattttgttttgtttgaaggaaaatgattatgcacattggctggctatgtacacacaattgacctgttataagcatgaggtctctgttatacgtcatatatcatcacatttatcatttacagcagtaccagaaaagatctccatacagattaagagttctgaatctttagagagtgcttaaaataaatcatttagggaatggaaaaaaaactgcaatcagatgaaccaacatactgcaatgcaaattcagtgcaaacaaactcctagcgcactcaatcccttattttcaacatgctacatgtagatattcagcgtttattttctgaaccaaactgatatacactacttgtgtttcatacttgcagtagtggtctcgtgccattgtgcaacaacacagacaagactaaaccagatcaacttctatagtgtcctaattctggagaaaagggatagcttcccaaaaaaaataaatacagatcaaagtgccagtattaaccacccacaactaaacttgttgttaaaactcaatctcgaaacatgacaaaaaaaagctcatcaagatgttctatgccaactatccatgttgcatcagccaacaggtgaatcttgataattgaacaattaacaagctagcaatccatgtagaaaatctcagatcattggattaagaaggcgtgcatgtatccaactactgcattatattaataaattcacaaaatccagatgtaccacaaagcaaaaaaggcttttactgacatgcagccagagagattgctaaccttaaagcagaaagggccaaaaaatgtatactccatgctggttgtttacacacacaaatactacagaattgacctgttatacatatgagattaacaaaaattgaggagcaaggaacagagtagcagcaagcataaacatgaatataaaagagaacttgatcactccatgttcagttaaataaagtccaaaggagctctgaatatgcagtagcacttaaaatgtcagagatcagaactagcttactaataccaacaggcagaaccgatcatacataattcaggcagaattttcattgggggaaggaaaacctgaatgcagatgatgcaacttacagcaatgtcagcaacatcagtgtaaacaaactcctataaacctacattcagatgcttttttccctcgaaattaactagatagatacaaaatgacactactctgtttcctatacagccaatgaaccacaaactcaaccagataaaattccagtgctctaattcatgagtaaaataatctcagtttattacttgaatcctcaaaagatacagaacaaactacccgtattaaccacccatggctaaacttattcctaaatttgaatccccaaacatgacagaaaaaaatatttaagaacatcttgacaattgaacaattaacaagcgctagcaatcttggtagaaaatcacacatcatcagattaagaaggcatggtcgcatggttatatcttttttttttgaacggaagtcgcatggttatatctgagaaaacactacttcattataaaaaaaatccacagaattcaggtgaggatcgacatagaggtagcacaactgcacaaaatcaaccaaaatgttcaaccaatgtttcagaattcatcggtcaaacgtcacgaacaggtcataaatcaggaacaggttgatcgaatggcaaacacgagtaagagatagacagaccaacgaggaatcaagcataagaagtctcgacggaatcagttggcgccggatacatcctgccgggcgccgacggccctctcggtgcccaacttcgcattcccgatcgcgccctggaggttatcatcggcggcgaagagctcctcctcgacgccagggacacgcgcggatggtccagcagagggaggatcgcatccaggttgctgcggcacccgtcaacactgacgtccttgccggcttcatggagctttggttctagcgttccactccgcgaggtaccaaggaggccgatctcgcccagacgcgtcgatgggttgacgctgccgtcgtggagcgcgaggagctcggccaccccaccttcatgagggacatcgcggaggagagatttctggacgcgtcccccgagctctcccatcgcaagctggatggatcctggtgcgcgcggcggccgcctcctcctcgtccccccgcgtgcatcggtgacgtcacgtgcgccagcgccttggcgacgtagtaacaaacagaactctaaagcaaattggtactaagtcttaatgtattgctacaactagaactcttgaagaatcagaggaccaaagtcgtccttcccatttccagtagaaaaaaggagtataggacttcatttcagctgaaagagaacagcaaaagtggagatcagtagcaaatctgagccgtatgttcaccatgcgccggtgcagctagttcagtttcttcgccttgacaacagaatcgtccaggcatcggacaactcctgagcaacggcttcctgagcgcagcgcatctcattcgttgccatagtggcctcgagggcagcgactgccgtgaatttttcggcctccgatgcccacacatcccacagcgggcacccgtaggcaacgctacccatgatgacgagggcgaccttgcccgcctcggcgtttgacaccgtatcgatcaccctcttcagcgccttgctgatgtggtcaacggcttcctggtggtggacgtcccagctgcggtacgccgggtcatcctgctgggcgccgaggtgcgcgacgtagcgagcgaggacgtgccttgtcttcgcgtggagaacggtgctctgcgagatctcgcggcgggcgtcctcaagggccacggtggggcagattccctcgggatccagctggtaggcagaatttccttcgacggggacggccgccgccggcgtctcctggcgtaagttcacgcgcagcatagcgacgcgttcctggagcttgccatgggcatctcggatcaacctgagcgctttcagcccgccggtggcgacgagcaggaaggctccagggagtgtcctctcaatctcttgccaccacttgtccaccgccgccggtggagctcttccgcgacgcagaatcgctacggcgtcgaagaactcgagagcaacagattggcgcgcccggagcacctcgtccagcgccagggtgcctccaaagcggcgtggtccacgagcttctcggccgccgacgtccactctgcccacagctggagcgggggctggggctgggagaggagggtctcggcgatgtcgacggcgtccttggccgcctcggcatgcgacgcggcttcgctaaccttctccagcgccttatcggtgaagcggatggcgtcctggtggtggacctcccagctgcggtacgccgggtcatcttgctggacgccgaggtgcgcgacgacgtagcgagcgaagacgtgcctggtcttcccgtggcgagcgccgctctgcgagatctcgcggcgggcctcctcgaggatctcggtggggatgactccttcggcggccgggtcgccgaagaggttcatggcgatggccgccggcatgcccaagtgtatccggcggaacaaagttccgcgcacttgtagattgctgtgggcgacttcgatcaacctggtggcttccatctcgcagctgactagcatgagcgtctcgggcactctccacgcaagctcctcccactcgtccattgccgccgatcgagctctctccttctccctctccctctccgctctttctaagtttctagcttcggcttgggcggtttggatggagacgaagacgaggacgcaatttatagagaggcgctgctggagggaggaggggaaatgtggcttgccggtgaagacagacacgggaatctctgtgtcactgacaactcctgcacccgcagtttcaatttttttaaccttacaaccgtgggccccacgtatcttccaggctggctatttcatatctcatgctcgcgagcggcgaggagaaggcgcggccgccgcgcgcaccaggatccacagcttgcgcgcgatgggagagctcgtggacgcgtccagagatctcgcctcagcgaagtccctcatgaaggcggccgatctcctcgcgctccacctccacggcggcagtgtcaacccggccgtcgacgcttctgggcgggatcaaccaccttggcgcccagtatgtacctcgcggagcggaacgcctgtgactaagctccgtgatgaagccggggaggacctggatgcgatcctcctcatgctggaccatccgaatctccctggcgtcgacggcttgattaggtggagcgcgccgccgccgatggttacctcctggccgcgatagggagcgcggagttgggcaacgagagggccttgggcgcccggggggatgtatccggcgccaactgattccgtcgagtcttcgtatgtttgatacctcgttcttctgtccatctctttttcgtgtttgccatttgacctgctcctgctttgttacctgttcgtgtcgtcggtctgatcgatgaattctgaaacattggttgaacattttggttgcatttgtgcacttttgctagctgtacgactcgatcctcacctggattctgtggattttttttttttgacgcggattatgtggatttttgataatgaagtagtgttttctcggacatatccatgcctttttaatccgatgacgtgagagtttctacctcgattactaggttgttaattgttcaattgtcaagatgttctgaaatttttttgctgccatgtttggggattcagatttaagaacaagtttggccgtgggtggttaatacaggcagtttgttcagtatcttttggggttccaagtgataaactgagattatttcattcacgaattagagcattggaacttgatttgattgagtttgtggctgtataggaaacagagtatggagcgatcaagctcttttatatcttcatgttttatgcctgccgctactctgttccttgctcctcaattttttttaatctcttacgtgtaacaggtaaattctgtagtatttgtgtgtaaacaaacaggtaatgagtaaaaatgttttgggcactttctgctcaaggttagccatcactgtgactgcatgtcagtaaaagtcttttttttttctttctcctacatgtgggttctgtcaatttttgagaatgcagtagttctttcttggatatatgagtgccctcttaatcaaatgatatgagattttcctcatggattgctagcttgttaattgcacaattatcaatatgcacctgttggataatgcagcagggatagttgagatagaacatcttggagcgcttgttcttttgtgtcatgtttggagattgagatttaagaacaagtttagctgtgggtggtttgcactggggattttgttctgtttcttttcggaatatcaactagcatgaactgggctatccattaattccagaactaggactgtaggagactagaagttgatttggtttaatctgtgcctttgttgtacaatggcacaatggtcgcgctgctcgccgcatcttgctttcgtagggctccatttgtttggtcgatagatcactgaaatcgcttgcaatttcctctggcgcgtgcgtaccgaactaccaatcatgcgaattcgtgtgcaaacacataagtagatgatgttcatcacaatctgagattcagcagcagattcgcattccatttgctagcggcagtgttccaaatttgatcaaccacactagtaaatgcgtcacaactctgaaatttttacatgggcgcggtttgaatggagacgaagacgaggaacagcccattacggttcattatgccacttgggacaaattaacgtcccgaatttccccaaaaacttaataggcccatcaagccccaattaaagagcgcagagttgtgaacatgtacgttcagaactcagacgcagaaacgcgtgctgttcctaactgtaaccgcatatatagatacaaatagaagcattattgttttttcacttttgatgatatatagaagccctaacgcccgtaacaacaactaggcaatcaaattagttgccttttttccatggagtccaccaccaccacgcgcgaggcgaaactgctgcggcgaaatccatctgatcaccacgacagcggcggaggcggaggcaacgacctgatcagtcacctcagcgatgacatcctggcgcacatcctcgcctccctacccagcatgacgnacgtgatgcgcgcgtgcgcggtctcgcggcgatggcgccatcttggggcgcgtgtccccgtcctcagattcttctgcctcgatcacgacttcagcgacaggagaagctcgaccggttcatcgccttcgttaacaatatccttgccaggcgcgccgatgatggcactagtactactgtagtagaggagctcgagatctcctttaagttgttcaatagccgttgcatgagtggcggcagcaaacgcgtcgtgccatcagtggatgttgcccaagtcgacgcgtggattcagtatggtatgcagcatgtatccaagtctttcaccctacaacttaactacatgctgccattgaacttgcacaacagcaatagcagcaacggctgcatgcaggttttgggtagtaataagcttatgattacctgcggcggcggcgcgacgaggttggagagcatggtcttgtcgttgaacaaagcgtgtctccgccgccttcccacgaacgtgacgctcgattcgcttgtacatctcacgctcgaggatgttgatgatctcaatcagctcttgtcaacagcacgctgcccttctctgcggaagctatgcttgcacaagcaaactgtgagtccggcgacaacgacagatcagtcgttgcatctggagtccaacgagcttttaaaggtgtcgttggattggatctggagccgtgctttggtgttggagctcaggactcccaggctccgtgttttccacacgaggaacgcgtccataggaaggttggtgatatcagcgccgaggctagaggagttgacgttcttctacacgagggtggcttccattgtccaagtcgaggatatgccgtgcgtgcggatctttgagactgagatgagttcactacgacgacccgaatgtaatgaccacgtaaatcaaactaggattcggctcctacgatgctgcaaattccttcaatttctcacgttacacctaactattacccaggtacgtacgtgttgtatatacgagctagagaaatttcatagtccttgaaaaagtgcctcgagataccaaaattttacactaaattttttttttacctcgaggtacttagtacccagagatattaaattttacactagaaagggtggtaattcctggtacttttcaaggatggatgataaaattatacatgttacaatttttttcagactgtgattagctttagtttcactcgcatatattatttataacataatactgagttttcttttgttatactccataattttactatataggacacttatatagagcaccaaggtatcaaatacataaattcacttaaatttttaaattttttgaaattatgagttcaaattcagttcaaacttgtttgaactagttagtaaagaagttaatgtttatacctaaatattttaaaaattttcatactcaattgaattgagtatatacttaatttgaatcttggtgcccgagcaccatgatgcagtgcatgcatgtgagacataacagaaataaagtatggtacaaatattcgtcatgtcttcaactttaggattattaataagctaacaatgatcctttaatttgtgcagaaagacggtcacgatagtgcagaggttgagctgataaaagatataccacaacttcctcacgctacatctttatcattacaggtttttgcacaggtttatgatattgctagtgtgttatgtcttcttactcggtgcaaatttctcaaacatctcgaacttaacataaaatattgttcgatggtaagctgctactccgttgtttattaactgatcagtagtttaataacttacatcgatttaattcatcgaattgatgatggttttccataggcagaatattgcaaaagacctacaggtatcggtacccaaaatcagagggatcatcatatcatctcgttagagcatcttcaggatataaagattaccagcgcttacaaacgacagtacgaagctaggctcctgaaattcttacatgcaagcgcaccggccttgaagaagatgatagtagcattcatatcagcctttatgctatcccagagcttacaaatatgtgcgaaagaatgcgaagaatttctacatagcattccacttaataaggaaggaaagtgggcattttgctaccatggtgctcatatgcaagattttacaacgttcgagtggacgccaataaaaaaagtagagtgcagacagatagtacatatggattaatcaatcgatactgggtatgctatttgttagaattctttttttttcctatcgtaaacgtgcaaaataattgcatgtcaatatattagaagaaaaaaaggttttgttacacaacgcaatcggccagacagacctatgttggaggaacaataataaaatgaccaaaacagaaaaggaaaaaaaaaaccactacgaagaaaaactactccaacaaacaagagagaggaggtggagccgcactacactcccaggagatccccaaaagcggcaatgcctacggaagctcacagatggccttccgagcggatggactcaaaaagcatggagactgaagagagtgcagagtcgaaaacagttccgctccttccacagttgccaagagaccagaaggactaagagtcgaagccggaggaaagatgctccggtaagcgggccctagaatttgttagaattcaaaattttgtacaactagtactgagctctagtttgagttggatgctttcaccagttcccttttttcccccctcaagaatttatcgtggttattttccttttctcaataggaattttatggtttttacatggtatatattgttgtggctaccctcgacagtcgcgaataatgccttgaataacgtgacaacacatgcaacatgtttaatgtcagaatttgcagttttcactagctgcatgaaaatgcccaaaatatttatgcacatttactggtagtgtacacacagataaaaacttgacctgttatatgatattaagaaaattcgagtgcaagggacagagtaattacagcgagaataaaacataaagataaaagaaaatttgatcactccatattgagttaaataaagtccaaaaaagggttctgaataagcactagcacttaaaatggtcagaggtcagagctagtatcttattctcgctaataccaataggcagaacagatcatacataatgcaggtagaattttgattgggaaaaggaaaaactgcacgcagatgaacaaacataggcaactgcttcagaagaaacagatggacacaatggcactagtactactctgtttccacaaaaaaactcaaccagatcaagtcccaaatctctaatttgtgaataaatgaaaatctcggttatttatggagtattactcgaatcccaaaagatacagaacaagttgcccatatcaaccagccgcagctagacttgttcttaaatctgaatccccaaagatgacatgacataattttttttgtaagaacatcttgacaaatcaacaattaacaagctagcaatacaggtagaaaatctcgcgtcgtcggattaagaaggcatgtatatatccgagaaaacactagtacctcattatcaaaaatccacataacaatccaggtgaggatcgacatagagctagcacaagtgcacaaaagcaaccaaaattttcaaacaatgtttcagaattcatcgatcagacgacacgatcacacgaacagtaacaaagcaggagcaggtcgaacggcaagcgcgaaaaagagatggacagatgaacgaggtacgtatcaagcatacgaagactcaacggaatcaactggcgccggacacgtccgccgggcggcggtggccatctcggcgctccgctgaacggccactatcgcggcctcgaggtcggcgacggcggcgaggcgctcggcgttgatcaagccctgcccgtttggtagacgacctacaaggtccagcaagaggaaggcc

SEQ ID NO: 5873 - DNA, 2181 bp, Oryza sativa
aaacaacctacatggcccaccaggaggagggccgcgtcaaggtggccgcggcacccgtccacaagggcgtacgccttccgggcgtcactctcggcgtagctgagcttgattgcggcgctctgctccgcgaggtagttcacctggaagacgcacagacagcagggttgatgccgtcgcgcggagagcgaggagcctggccgccaccgtgaaggaaacgcggaggcgagattgctgcacgagctctcatccccgaggccgagcgcgtccagcgcgagctggatcgtatctcgcacggtgttcgcatcgcccgcgaccatcgacgacgacgacgacgtcagttgcggcagcaaggcgtggaggctctcacgcacgccatcgacgcggatcgccgcctcctccacaagcctcccgaactgcgccttccacacctccgccgccatctcgctcgctcgctcgctcgctcgctgggtgttcaacaatttgtttctggaaggatttcgagtcgaggcgtggcgtggcgtggttgcggttggtatgaaatattagcaagcggccagcctggaagagacgtggggcccacgactgtaacggatttctcacctcgggtggggtgagtgaaaaaatgtaaatactcgctgttaaaaatttgaaacagcgggcgggtgggcgcaaagctgcttgtcagtgagacggtaatttcccgtgttcttatccagcaagccacatttccacggaaaaaaaaagtaaattgcgtttagggccaccttttatcacaaaagtttcactttggactacccttaaaaccttttcactttggactagattaatttgccttttccccgcaaaaaaaagaagattaatttgcctttgtttcactttgaaccacccaaaaactttttcgagcacataaatgattttaaccacatcggcacccataaaccgataatcttcccgatttacatgtagactattcttcgcaagattagagggtagatacaactagaaaagtaacttggggtggtccaaaccgcaacaaaggtaatcttacctagtctaaagtgaaaatattagttagagggtggcccaaagtgaaactttagtaataaaaggtggaccaaagtgcaattaactctaaaaaatgcacattctcttgcatgttcttagcctggattcggcaaacaataagatgctgatcataatcaaacattaagatgaatttggtagttatatgtatgagatgtgaaacctgaatttggtagttatgtctaaaacctgaatttgggcccccatcggttggtctaggcttattataagccataacggcttatttgcgattaaaacatgatatgtgagtaaaacttttgtatatatgttcttagtgattgaaaagccaaagttaaaaaaaacctattgtaacgctccgcttttcgcgtggcgttaaaaagctaatttacaaaaatcctaattgcgaaaattccgttctttgagtgttgagtctaagttgtgccaaagatctcaatttaaaatccctcccttgtctcaataccctgatatcaatgatcgcctcctcaaaatttccgctccaaaataatctcgaagttcgaatgcttctattcggatttcaatccagaaaccctaaccacaaatatcgcctaattccggaatccaaaaccagactccaaccctaaagcccctccgatcaaattccctccttgagctagctctaacatccaagcttctccctctcctcgtctccatcgctctatctatctatctatctatctatctatctatctatctatctatctatctatctattgcattctaccgccacatcctttgtttcacccccgaacattgatttctccttttgtttccctctcaaataatccttgagctgccaaatacaaacatatccctaaaatatcaattctcgctttgaacttcaaccacccatcgacatcgaaaatcacgcctcatcgaaattccttcccattaccgaaagtatcgaattcactctttgaatcccctccttggtttctccatattttgttgagttcaaatatccaatttgaattcaaatccagcgtcaaatgctcctcatattccttaaagaaattttctgggtaaacagtctattatacctccgtcgatcttttgggctgattcctccttccccgg

SEQ ID NO: 5874 - DNA, 3127 bp, Oryza sativa
ccccccccccccccctctctctctctctctctctctctctctctgtcggcgtcgcttcccaccgacgccgcccaaaattccggccgccgccttcgattcccgcgtgcccacgcacgtggccggccgcctgggcgccgccatcgctaccctcggtcgtcgcttgccccgacgaccaccgtgtccgcgctcgccttcaaaccgtccccatcctttttgcagtcatcgccggcgtcatcctctcgggcccggcgccccatgccgcgtgcatccaaaaccgtgaggcgcggctcgttctcatccctttcctcccaaaacggaaggagcaaagctccctttcctcctcctttcgctttttcccttcccgggtagcgagctccctgcctcaactccttggcttcttgctcaagaggcagagccgctgacgccgctgcagcacctcgccgcccccaccttgaccgcgcccgctcgcccgtgccaaccctcccgcgccccgcgttcaattcgctccgcccgatccaccgcctccgccgcccaacgcatccacgccgtcgccgttttcgcgtcacccacgaaagcgtcgatgctgcttgcggtcgctagccgagcgccagctcgcatgcgccctcctcggtcctcgcctataaataccaccccttgagccccaatccatccccttggtctcatgctcctaggaacggagcaccgccgactccttcgtcgctggccgtcgccgccgcgaccaagaacgtctcttcgccgccactgggccgccccatcctcgcgctcccctcttcttccccggccacgccgtcttggcgccgtgccgctcccgtcgcggtgatcatctcgccacgggcggacaactccatcagcccgcctcggcgtcaaacccgccaggacatccttgccgccggcatcccctttctcgcttccgagccctcatcaccaacgccgtctcgcctcgcccgtcggtgagctactcgcctcctccctgctcttatcgccacggtcgcaccgttcttttcccctcccgcgccgtgctgctgttcttgccgccgcgggcaaccacgcgccgccatcggccatcctctcctcgctgtcggttctcttccccttctcgtcgccgtcgctctgtttcaccgccgccgccggtcggtcccgcgccgaatcctctcgccgccacccaccttgagctctaacaaaccaccccaaaccgtcgctccgcccgccggcctcctcttttgcccctgcgccgtgccgtcctttccgccgccgccgtgcacacggttgcgcaccgccgttggcctccctcctctccttgattcccggcgccaccattatccccgtgccccctcggacctccccgaagcgccgccgcagtcgctagcttcgccctctgcgcccgcgccgtgccgctcccgccgccgccgccggacgccgtcgctggccctcctccgaccccggcgccctaatccgcgccggtggaagggatccaatcctcctcctcttgcctccggcgccgtcccctccctctggctcgctgccgctcgccggcgccgttgcgccgccggagccgtccgatccgggcgagctctgcctccctctccttctctcttgcgcttacgtggcagcccacgtggcatttgacccagtccacagcgccaagtcagccacccctctctcctctggctcgtgggcttggcccattggccagccttcctcctcggcctaacaaaacatagaaagttcacttttactccctcctccaagtccagtgcccacacacccaagagctaaaagtccacaattgctacctccaattgctcctctctctcactcgaccttcttgttggccccactcttcaatgagtcaaagatattcttgagaatattttttccaatattccacaagtatttcctttctttttccaaaattccataaagtcctttatcctattccgggattccaataattcattccctcggtcccgcatgtcagtgactatcaataatattcttgagaatattatttctataaattccataaaccatttttcgtattccagaaaattctgacaaatcatcttcttgtccagaaaatttatttaaacttccaaaattcatatctcttgatccgtaactccgatttaccccgttccactttcaataattccattaaattgtgatctatctaatggcactattaattagcctaaataggatattttatttggtctttgtttaggtttttgattgtttgcgcctagttgtggttaccggatatttttcttcaagcggatttctcgaagatttgtgaagcttcgtgaagactctgagcaaggcaagccacctttgaacatattgagcctatatttgaacttaactagttgaatccccacgcgttgctgcgggcttaataagttatttcaaacataaaaagttagtgtgaaactgtgaaccaaaatgtatgctttttattactttcagtgtggtgtcaaagagactcatgtgcatttatatgttaaagcctcctggtttatggtacatactgaattcaaaataacaaatcggtgtaaattggatttcattatagtagtccaggaaaatgtttgattatacacatacttgatactaccacggcacacaacatactgtagattacaaaaatgacaaatgaattattcgaaagggagttgacactgcactctacaatctacatatttaaaaccaatttgaacaaattggttttaaatatgtattccaataagggaggtagaaacttaattttcatgtctaaagtaccatatggtgtgtgagggattaatatggggtgattagttacgggtttacagccactatatggctataacattaactgagcattgtaaggtttggtcccgttttctccttaaaatgggatatcttcttcttaatataaaacgtcggcaactgcctgaccgttcgaaaaaaaaaaaagaaataacacattttgagattttttatgctgctggcaattgacattaattgattcttgttgtaaaggcgactaccttctgctggagtacatgtagtttatatttaattgtagtgtgactgtcttctgccggagttcatggagaggcaaatg

SEQ ID NO: 5875 - DNA, 2012 bp, Oryza sativa
actgtcggaaaaagataattaataaagagatcaacaaaaatataaattaagcaaatattctatatatgtagcttatatttacctgtttagttacctgtgcccatggagatgattctttgattcctgaactttcaatattccaataaaaaattttgtgctacccttttaaagctgagatcgaagacccttttttgtttttgcatgcatgagggcatgacattgaagaggaacgtatgaatatcattgagatagaacatggactgttgcaaatggaaagatttataacctgcagtagtgcaatttcaccttgaatatagtctgtaaacaatttccattaactgaattaaccaaccagaaaagaagtggagatagataccttctgcacagaagtacttctacggcagtggccagagatgtatggtctaccatctttagtgcaggaggagaatgcggccaactgttgtgctcggtagatccatccaaagcaagcaaattacatggattgagctaactcacagttttctcgcatgcagaactgctgaagatgtgaccaaactgaaagcagagtagattaatccggtgccatgcttgagaataccagcgtcgtggtgatgatatgagtaagaagagaccctgcgagtgttggtaaatcgacgcagttatagttgaagtaggcaattgatagcggctgttttttctagtttaattggcagtgattgatgaagaggaaaggatgggtggagcgcaggatatgaacggcctctgtcgctccgtctcccaagtatgtgaggattgcacggtccaggaccaggaagcaagccgatcgaaatccccgtcaatgcgtggcttcgcggagtgtgtccagcagaggtttgcaggagttcggacgggcttgacagggcctgctaaccaacttgggcctgatttctgtgtccagccgagaataagatctaacggtgtttggcatctgacaatagattgatcagacggctctacggctctaaagtctcaatgacgtggcttaacctggtgcttcctttataggagctaatgttgtagttggtaccaactatataggaagaagggattatattgcttgtaaaatattatgcattgataggattgcacttaatctgtttgccccgtctacgaggtagaccggtgggcctacctaacttgttgcatctgatccttccattgttaattgttatatcatgttcccttgtaaccatctagttgtgcctcgatattcatgcactctgtgcgagtatcgacgggcaccttcaaacttaaaatctgagtaacttcttgggtaaaacttggtttacaaaagctttggaaaacccgacgcttggatcggtgccttgtgaaagaaaatgagttttaaaaatgaaactcgcgacacaaggccattcctgggcggaatacttgtgcggtcgcatctaaggaccgattcctatggaattacatccaagcatacaatagtgcgaccacatgggtggaatgggacgcccctggctgagtaaatagctaatcaggggagccttgatgccaagagacatgtggattcaacggggtggtgtcggggagaatccccgggcttcctggcacagtatggtctgggaccaaacttgttgttggtctgggacccctctcgttggcatatggcaatcctgtgtcggctttcgaaatgccttgtcatgaaagccccaaagtcaccagacgtggctattctgcacgggctgggtgacccgggttagtaatgtcgtctgggtaaagtgtaccccctctgcagaggttaacaaactgttcgaacagccgtgcccacggtcatgggcggatgtgaggtgattccttagtgtagtttttgttttaccctattttatgaaaagatgttaaggtttgggaaacctaatgcttgggaagcatttagctgtccgggggatagcgggaccgggagtccctggaagtgattggtcgtttggggaccactattatcgggaagtttggaa

SEQ ID NO: 5876 - DNA, 3465 bp, Oryza sativa
tccgggagttgtgcaaatcttgatacataaatttgttacttctcgccccggccgagttgagacttgtctcgctctggtagtggaaagcacacacttagattattgaaaacttgcaaattaaaccgattgaaaaataacagccttatctttgaagcttgcattaaccacctaagttcccctggcttgctgagtacgtaagtaatcacccttgctctatataaatatagttctgcccgctctgaagatgaagttgaagtgaagtgaagattagggttttgtcctagttccctgctgttgcctgtggtgttgggtgttagaccgttggttctgctgctgctgctgctgctgttggtggtgtttgcctcgtccgtgtcgtcggttgcattctcgggctgtctaagctgcaacctaagttaaggtaaataagtcctctatttatttaaggattgcaatgattcataattgtcaccgtgggtaccagcgctatgtcctgggactggtactgagatcgcggtttcgtatgaagcggttcgcgccgtttttcctacgacacgctcctatcaggtgccattgtacggcggtgccggtttgggctgtgacaactatgttgaaaaagaatcaaattcaaattcaagtttttaaattcaaattttggctttggcttataagctatagggcaaacgatgaggccccagttatgtatgagatgtgaaatcatctaatattgtttaagaaagtcagcttctagacatcacgggcctgtttactttgatgctaaaaaaccttaccaaatttcagcattgccaaaattttggtaacttgccaaaattttggcagaatttcttatgtagttaccaaaatttggcagcaaactaaatgtagccacttttttggcaacgttaccaaattttggtaaggttgaaaatggcatcaaagtgaacaggccccacattccagatttgaacatcacgatttcagattacacaatattgcagatcttattttcgcaaggaatcagagaaacaaccacaagttttttaacaaatcaatcactttgcagatttcataacatccaacacgccaggtgataaaagaaatatattgtacagatatgagtttctttgctatttgaaccaaaagggggttcaaatttgtagcatctatgactactgtccctgcaaactcttaactatatacagactacccagctactttagtgcatcttacaaagaaaggctacagacatgaggcaaaactaactactttcacacatcagctcccagaataatttccttcagtccatatttttctgtcgttgattgttctatggcatttcttaagtggcctcttgttcattgcagtcttctaatgttgaatcatcagccaagcttcaccccttatgtctgtctcccctgcaaagatgttgtatgtaaaaatgtagtgagtaatttactacttcatccgtttcacaatgtaagactttctaacattgcccacattcatttagatgttaatgtgtttagattcattaacatctatatatatgtgagcaatgctagaaagtcttacattgagcaatgctagaaagtcttatattgtgaaacggaggaagtatttggaatcagctcccatcactaagaatcagccaacatgactaagcatatcgatttgtgagcatgcttgcaactgactgtaaatgactgtatatgaaaaaataattattgtttataaacaaacagtcaatagcataaccactcaagatggtaagcagccaccttcacgagtcacgacggacgacagcaccacatcagtggccctcttgcgtgaggaggaatatgtcagcggctgtgggcggcgccggctacccaggtggtgccgtggaggaagaaagcggcggcagttacctcgggcagttggacgaggaggggcggccagcaggcagacagcggcacggcgccctcccacgcgtagaagagggtagcagcggcagacgggttccggatgagagaggcggctggcggcggcggtatcgtagaggggaacggcggggaggaaatacttttgggagcctaccgctacaagcgaagcggatttagatcgagccgagatgagcgagtacgagccgcgtaggcgagcgtggagatcgctcgcgcaagcccagccgagtacgaggcatggccgtgcgcctgcgcgcgcgcagtgcaggccggccgtcagatggacgcctcgtccacgtgtcgcgtatctaagctgggtatgcacggggtgagatttacatccggtatgcaccaaattttttttcccatttccactcttcacacagcgcttatctataaattttgtactcctcttcgtctccatccaaattgccacacacacagaagacgctcagatcccaatcccaaaccgaagcgagaaagagcgagagggagaggaagagctcgatcggcgacaatggacgctcatgcaactcagctccgggatgcgagccgtcaggaagatccaagagcgcgctgctttgatgcgcaacatacgcttcgggatgccggcggccattgccatgagcctcttcggcgacccggcctccgttggagtctgccccaccatgactctcgcggggcaccgctcgccacgcgatggccgaccacatcgttgtgcgctacgccgggcttgtcgatcggcatccagcacgagttgtcaagccgccgtgcaccagcagggacacccactaccgggacgccatccgcatcaccggccgacaaggccctggccagaacacccagggcgctggtgttggtcactcccaggttcttcgacgcctggacgattctgcgtcgggggagagctagctcgatcgatggaaatgaaggagtggagagagctagcaccgaaagtgccgagaaccctcgtgctcatcggcgccgccgagctgaaaagcctggcatacattgatcaaagccgccatcagcaagttcggaagttccagaagcatgtcgagttgctgcacgaggtacgcaaggtgccgatgcgaaaaacacgaggcctgggagatctacttaactccagtgcaggtccaaaaatcttacctttagattcatgagaatgccagttgatttgatcctgcaatcaacaagaaacaaagacagaaaaatagcagttaaatccataaacgatagccgatcggccagtcgccgatgacatatcatttatctttgagccgatgtcatattctaatcgatcggcagtcataagtaagcaagaaagaactaaatctattcgatcggctgtagatattaatgatatataatccttctgtcgatgtatatttaaatcaagtgattgggatagatcggttgtcatgccgagacagtataaatcacttagatcgaaatatacattaacataaagattataaccgttcataacatagccgatcagatagatctagcatgtatcggctaatac

SEQ ID NO: 5877 - DNA, 21540 bp, Oryza sativa
agatacaaaatatgtcctcgtcggacacgactcttatctctacaacactcaaagataccataagtctttacgacagacttttgcctaaacttatctctaaggaaattatataaaacatcctaagtaatagatacaattgtctttccaggactcaatccatgcatggcaacccacatgaagcacttcaacctaacccgatgacgtgtactgcgtcgtattgtcagaatcggcttaatcggctaaccttgtccgactcaaattctgccgattctagtcgcagccgattcgaacttcagtcgattcttgctctgtttccggaacgatccatccttggattccgcttcggttttatcttcatctccgatactgaaattaccagatttggttattaacacatgcccccccaagtccggaatatttggtaatgtttcggatttgccatatctacttctccaggaatatcgctcattaccgtttttccgaccgttaccacagcactttaaatactaaccgtcacccctgagaaatttcacaccgttacttccgttttcaccgctcaagccaacttcgtcttctctctctctctctctctctctccggcgatcccctcggtgcgcaaggcgatctcgaggcgactctccctttggccaagcttccgcctgcggagatgtcgacttccaccagcccgtctgccgcgccatcagccgaatacgcagaggtaactacccatcggctagatcctctcctttgtgcagtagattggtttttccttatctcatcttgttttcttcctctctattcttttttgcatttttagcatctttccaatctggttgcaattcccagtctatctcatgagcatcagtatttccttggtccgatcggctattccgaccccactgagttcattagcaccgaaaccaacaggataccctttagattggccaacccaaatctaggtcactggaaaaatactttcaaatcttggccttcccttgagaaaagttctcctgagaaaagctggcccgtatggtacaagcgtgtatcggctagcaagcaggttcattgggacgaactaggaatcagccaagcccttgctcttactttagtaaattcagctaaggatgaacccctgatggcttctgcaacatacttctggtccaacaccctcaatgcctttatatttaaccaagggccgatgacccctactctgctagatgtcatcatgattactggcttagacatcaccgcatcggccaaccctatgagcttgaactccaagaatcagtttgattcaagactaaaaccataggttgctggtccagctatattgctgcatacatgggcaaaggatctgttactccccgagaacatgtagccttcctactgatgtggcttgaaaaattcctattctacgattcgagttgtggccctactaccaattggtagttcttagccgaaagccttgaagcgaagaaacaaatccctttaggaaaaatcctcctcggctatctgtatcagatgttaaacaatgcatcggttaagataaccagtggatcagtagtcggtgctggtggcccttggtggttgttgcaaacatggcttaaccttgttgccatgaaggctgtgaatcggtcatctttgacatatgctgaatttccaaggctagaaccgattacaaatgatgatggagaagaactcacccaccgccgatgcatgtcatatggagaggctgcatccacaccagccgattctggatccaagttatcggctgagctactgagggactggttcttcagtttctatgatggttttcagaaagatgcccgagtttggtttgcatatgaagactcaatgagctttgaactgccatcagacttcatatttgaagaaatcaattctaaaaaatatgataagtctagagaagtcttctcggctgctatcagtccatgtattcttcctgttggcatccatcaagggagaaacatacaagtatcttatgagttctaccatcccatgagctcggctaggcagtttgggatgggacagctgccaatcggcttctattttgccgataaaattcaatgcagaggcaaaatctcatcaacattgatgatggatcgactgctcaacatcccaggaccccctttgggcagcatcgataatgtagaactagcaaggttcaggagcacgaactttgacaaatggtggggtgaatggaagcagcacttgttccaccaatcggcttccatgtacatgacagatctattcccagatgttatccctcaggtaaatccttactttgtcaatcatgtaaaatgactgtcagccgatttgtattttgactaacctcttcttctgtcttgcagacaatagaatcctctcctcatcgcaaaagcaatagcggcaaagacatagaatatgctccaggccttctactaaatggaggtggtctagctccccctgtcatcggctgttatgcccccaggacctcaagcctactccaagggcaaataagagaaccagccgatgccggtaggaagaggaagaccaaggcaacccgttgttcccagatgttgctctactacgtacccggacagggaggacttaagtgatctcgagggctgtaaccacctctacacctacctcaaacatactatgggatatgcagcaattactagataacaattacctaaacaccacgtctaagcaattactatctactttagtgtttataactcaccaaagcaatcactatattttagttgattatagtgaacaataatcccgtatgctatttaggaactaaccaagagataattctcacaagataaatctaaattactcaagaagaatattatattgaattcaaagtaataaacagaataaaagaaataggagaagattaccgacagctccggaattcttccaacttcttctactctactctcttcctattctagtatacaatatagtacaatagagcctcttataattcagctcaagcttggaagtgtgtgtgagagtgaatgaagtgaggtccttttataggtaagttatgacggttctgagaaggggaaatgttcgaactgccccgcaaccgtcattgggaattcatctggagcgccaccacgccaaaccccaggatcaacggtgatcaggggggttcggccgaacctgagctgggccctcctggcctggctttcggtcggtggactccctggaccttcctctatccatttctcggagttttgggttgatttactgatattttgatgaagttcacaacccctccttgtatagatacatgtttcttctccctttagtctagatttcctcccaacattggggtttatcacctgcatacaaatatacaccaacactatggaatatgtaagattaagcacctatcactatattggatgttttattatctgaactttaggcagatgttggcggtatagaatcagcatttaacagccgccaacaagcaccgactgcgaaaagaaattccctatattaaaatcgcacggatgttatctctttccactcccaccgacgatcttatcttctcctctcacctcacttcctcctcatctcccacctctcccctacctcccccaacctctcctcccacaggccaaagcttctcctcctactctcggcgtccacaccttctcctcctcctctcggcatcgatcggcgtgacctcggcggatcggcgacggagacgacagtgaccacgacggcctgcgaggggctcgggctatgaatccccgcccgagatgggcgcgggaacggtggatccgactactgcagggtcgcagacgatggatccggccgcgagacgggcgcgtgacaacggcggaccagcgacggcgacggcggcgaccccggcggactgcgcagggcacaggagctagtggtggatccggccgctgcagggccgcaggcggcatatccggccgcgggacgggcacggacggcggattgggtagcgagagggccacggtgagttagcgaccctgctctccctctctcagatccggtggcggccaccctactttccccttcccttcctctctcagatccagcggtggcgaccttgccttcccctcccctccagacaacggcggtcgtggcggcgatggcgatggcgacgggtgcggatccggtggcaagatggttagggaccggcgacgccctccctcccctcccgggtctcctccctcttgccatagggagacggcgacagttgcttcggtggtggcaatagcaacaaggtcgccaacgatgacgacgtgttgatgattgcatgttattttcatttcaatgtgttgatgtttgcatgttgaaaatactgagaaatcgatgtagtgatcttggatattgatgtgaatctggattggatttgaatatgatctcctgatgtggatttgaaatttgaaaatgcaacaatgcttcttctgaatgtgaattattatttttattgtttttgcaaaaagatatcgctggtgatcctcttagtggtgccgcctgcacaaatagatttttgctggcagtccacctaattagccgcttgcgcaaatagattttcgctggcggtcctcctaattgtccacaagggaaaaatctattgttgcaaacagatcgtaaccgccagcgaaaatcattgattttcactggcctttgctttgtggcggctccaatttccgtcagcgaaaacccaaaatggccgccacgaaaaatggtttttgtagtagtgtatactgttggagaaacggtttttactcctggttatagcaacaggacgagtaaatcggaactacagaaaacttgtactaaagttacatagcaaataaaatatatatatgggatgtgggattcgaactcaagatccctcacgcgcgtaaccatcccaccttgtacacactacacacatctaacttgaataaagatgttttccttttgaactaatcctagaggtatttttagtcccagttgataacaccaacttggactaaaaatttgtcttagtaccaatcgggactaaagaacaatttttagtcccggttggtaaacccggactaaaaatgtttcaagggccttgaagcatctttagtatcggttcttaatctaatcgggacaattatgactttgggtgccacgggaaaagatcacttctccacgagtgttagccccaccaaaaatacattactattactattactctttttccttttttttctcgttctcgcagtccttttccttatacccggcaacgaccggtctggtcgattgcgttgtgtaactaaaactctattttttttaatatactgatgtgcaattttttcgcgcgttcatgaaaaaaaaaagactcgcaggtagaaattaatctctattgattccaacaattactccagccagcaagactaacaatgtgatcatggaaaaaaaaaagtagtccagcgcatggcatttagggtcgttcaacagtttatgaccacttcataactatcagcttgatcagagcgacatgtgaggtacccattttagccgcagcatgtagttgtaacaacatgagcaataatctacaaactacaattacgtgcaattatacaaattcttatggctctctgctgctcagtcagagaagaaccagtcagatctcgcaagatgctcaagatatcatcaaatgacagtatgacacctccccgttgcagtcagtgtcataaacactgaaacaaaactatagaggggaacatatcctacgcacacaaacttcccgtacacactaactagcaaaatatcacaaaaaattctataaaaaaattagacatttactcctaattgtactacacttatctgccaagttccatattcaaattcattatatttggccgtagcaaaaaagtgaaaaatctgacagtttaaagggtaaaaatctatcagaattttatctttttttgttacagctaaaatataatgaatttgaagataagatttcacgtgtagatgtaatactattgtaagtatgtgtccattttttttttgaattttctgtaatatttgctagttggtgtacgtgcacggagtactgtgcatggaaagtttgtgtgcataggataggttcccggtcaactatgccatgtcaatgttgtgctataggcttgcatggaactccccaatccgcatcagctggcaaccgataactgatcaggagcctttgacagagacgtagcatcctcgaaatatatacaaaaatcacacaattcacccctctagtctttttaaggtacccttgcatatatgtaggccgtccatttgtttgatccagtataagtgggcgtgtggcttcacttgtgtatagtgatcctaataattcatgtactagcctttttaaggtcccattgcatatatatatatataggccgtcatgcccgtccatttagtttgatccaatacaagtgggcgtgcagctccatttgtgtatagcaatcccaatgattcacgtattagctggtggaaaaaaaaaagaatggctagcataaggggtgagaatgatccaggatctcatggtggagaacatgcaatgcagccattaccagatgaggtaggtatcgattttgttttaataagcacacgaacaatataattatagtgtaaatataatgtatcattgtaattacattgtaattataattatggtacactgtaatcacattataattacagtttaattgcattataattacatttgagtaatttttattttaaaaaatatctttcgtatagcagtcctggaccggaggagttagcggaataaaatagggcaggatggctataagcctataaccaaatatacgtttcctttttatgtttaatgtctatgcccttatatctagcttagcgttaaaaaaaaattgcctacatggccgcatccaacggctgaaactgtcaactaggatttttacttattcgatggataagtaaaacaaaatctgacgtaaacatgatatgcagtggcggagtagaaattatacaagactaagctaagatagaccttgactaatggagtagtattagttttttgaaaaatatacatggtgaatcaacaaaatttaagcttcggaggcaggccagccctagctgccctagatatgtgcgttaattgatctattttcctcttcaatcgattattttccaactccaacgaccatgtccgccgccgccgccgccgagctgccggacgacatcgtcgagaagatcatctctcgcttgccgccgcgcagcatcgtcaccggctgccgcgccgcgtgcaaggcctggcgccgcctcacctcccggccggaattctaccgcgcctacgtcccacggccacggcctgtcgccgcaaaggtcaccgtgaagatcaacactacccgcgccgccgacaccatcgtccggttcgagttgttccgcagccactggaacgtcgacggcgcggccgtgccgccgtaccggcgcgtcctctcgctcggcgccgcggcgacgacggacaagtacagcatctcgtcgctggtgctcggctcatgggacggcgtgctgtgcatggccatgacgacgggtggccagggcgccgacgtgtacgtgctctggaaccctctcaccaacgcctgcgccaccgtctccgcgccggccgccgccgacagttcgtcggcgcctacgcgcacccggcgacggggcgcttccacatcctgcacgcctccggcaagaccgtcggccactactactaccggaagcagctggcgccggccgtcttccgggtccagacgatcggcgacgccgcctggcgcgtgggccccgcgccgccacccaagatcaccatggcgacgacgggacacgccgccgctcgctccgccgccctgcacggcaagctccactggctggtgcagtcgggcggccgctggccggccgtccggaagctgaagctcctggcgttcgacatgtcccgggagaagctccggctgaaggagacgccggagcgcatggcggcgatggacctagagacggcgcggatcagcgtgctgcccgccgccgccgggaagctgtgcgtcttcgccgtggaggatcgcggcacgacggtgagcatgtgggtgctcgacgactaccacggcgaccaccgccggagctggcagctcaagaggaggatcgacctgctcagggacgagcgcgggtggcgctggcggcgcaacctgtggccggcgttgaagcaggtggaggcggtgcagggcgcggaggaggagggtgacaaggtgttcgtccacacccgcggccaggtgaacgcgtacagcctccggcgagggaggtggcggggcgccaacgacgtcgcccggtcggtcgccggcaaggtgcacgtgtcgatggtgaggcacgagcacggcgtcctgccattgccgcacgaggtgagcttcggggcggcgtcgcgcgtgctctcgcgctcccggtcgctgcacgcctggggccagtgttgctaccgcctctagcttccatttttgttccaacattttacagttttgttccatcgtgttgatttggtgcgtaacgaattttggattgcgcagcaaatggcagaaacaaaattttgcggatttttgttttcatcatctttttttttaagagagagaaagactaccggggttcgcccagtagtttaaattatattaatactagaaaagatacccgtacgttgcaacgggtaaagactttttacagtgatatatcaagagctaagtaataaattgaaatattgggatcactatacactataattaaaaaagttaataaaaattttaacattggggtcggtatagattataattaaaaaaattaatgaaaatatttcgtaagtttttagccaaaagacttccttccttttcagccctaggctagcccgctacctccctccatttggtctgcttctctttgaccctaccatctttaactttccgaatatgactaccatcttcaacctcccgaagactcccgaagataatcccgtgccggaagataatctcgtgcccgtacgtttgccaaagcaaatctccccatcaaatccggccgaatcttcttgggtaaccaaaattgttcaaggtttttgatccactcgatctactctttccgttttccccaaaatcagagcgtaaaattcgggataaaaatgaccggggaagatcgccgtcaaaatcggcaactttagaacagagattaaatccagcaattaaagctaaatcgaaggggaaatcattgagaaaatggtgagagaggagtagggaatcgatttttataattaaattggaggagaaaacacactatcgatatggcagcagcgtggcgctagggttcacctcgggaggtgtgcagcgaatagatgggattataaaaccggatgagacaaacaaaaagcacacgggagaaaaaaccggtgacaaaaaatattgacgaaaaaactataagcacccaagagatgcacggtgaatagatcggattaaaaaaagataaaaaaaaacaaaagctttagccgcataaaaaactcttctacgtgcaaagaaaaaaggaaaaaaaactctgcgtgcaaagaaaaaaggaaaaaaaataccggtgccaacaaaatcaaacagattttttgttttttactgggagatttttttcctttctctatagagtcagacaagagatattttttttttactaacgacgacggaagctttttttttaatagctcgttaagtcggactttcttttctttctttatttacctttttgattcggacttttctttctttttttatgtatataagacgggaattttttaagtagaggtatagattaaaatcaaaacataaaactaaaatcgtttcaaacacggatgacgtaccaaaattctggcaaaaacaccttgaacttttataataggtaaagatatacagaatttacaaaaaatccatgattacaaagcttgcaaccaactaattagggtgtgttcggcactccctttttccaacccatctccctcgttttccactcgcacgcatttcaaactgccaaacgatactttttttgcaaaaaatttctatatgaaagttgcttaaaaaaatcaaattaatccatttttgaaaaaaaaaactaatacttaattagtcacgcgctaatggaccgttccgttttccgtacgtactattccaagttcccagccgggaatagagaacacacccttaagggtgtgtttattttccaagttcccagccgggaatagagaacacacccttaagggtgtgtttaattctttgggtgtaaagtttttgaaagtaaaagaaccccccattgaagtaattaaccctggcttaataccaaaccaaattccaaatccggctggtaaacggcaaaatgaatttattaagcctaattaatccgtcattagcaaatgtttactgtaacatcacattgtcaaatcatgacgtaattaagctcaaaaggttcatctcgcaatttacatacaaacttgtgaaattgttttttccctacatttaatgccccatgcatatgtccaaacatttgatgtgacgtttttggccaaaattttttgggatctaaacaatctctaataaccgaagataagagaggttctttcatcctacaactatgaaatcgaatttcatgcttgaacttaaccaaccaatcagaaggatgtggatccacactctgaaaaatgaaggcatttctctgcttccaaatattccaacaagcaatggaaaaaatttccagaaagccttttgagcagaaaatcgaaacattgagcagaaaatcagacggctgaaaaggtacacatggaccaaaatctcatcaatccgaggggcagaagactcacccagtatgagcatgcacaatatttccaaataaacagcctcagtacacaggttgagattacagaatggatgattcaccaactcaacttcagtacggtctcaaatacgacatgcaaccatgctaaaatgacataatatttctgaactgtgacaaacccacattctcttaacctaacatatgtactaacagcttgcacactacaagcattacgccatccaatccagttatagatgcaaaatagccggtcaacattaatacagcgataatcataatgtaccaaacaaatgatggctcaaaaaattatgcaaggtcacatcaatgcacggagcagaaattaacaacttctttactgacagcttttccttgtttcagaagggcaacatcaacaaagctgagtgtttctgatgaaaatataacataaggtacattgccagtgcttgcttatatccaggaaattttcagtaataaggtgcaagccgcaaggtggttgtgtaagcagcagaaatgataagcatggaaggtaagcctcaggatcgggatggaaaggcatatctgagatcattggcaatttatccatggttgaaccagcagttttaaagaaaagagagaaacgagatcctggattgctgctcagtacagaacaatattgatcagtttcatgaagacctgtccaattttcccaaatgcttcgaagatacgcctataacatgatgagccatggacactggctttagaagcaaaagccaaaatcaaccgatgtatagagggccatcatgtggtcacactgacacgcttgccctttaaaggaaatagcataagttagcatcctattccatttcatgttatctgcgcatgacacggaatttttcacgcttgcggaaacgtcaagcaacaactcatcagtagcagcttctctccgccctgcaccagcaccatctggatggttaccacccattgatttacctccagttccattagcctgtgaaccttgatctttgtacagttcaggatgctctgcaaggaaaatggaacagtttagcactttaaacataaattatatcaatgatatgccacagctattgtttctaaaacagaagttcaaaaatggtattgctaccatcacatttcccatattcgtggattttgatgcagcatagattgtttcacaggctatttgcaatttgtattatgtaacgattagtggattccttcaatgttaatttaaaattcaggtctattgaggggaacaattgatctgtattaaagacagctgaagatcaaaactcttatataaaacctgaatacttctgctgtaggtccattgggtacctctgttttctttatatagcaaattgttcttaataaaaagggatatcttaagaataaagttatattcggtatgctaaaactggaaataagttgttgtgattgaagtgttgctctgcaactggtcaaaagctggcagcaggcccaggtgattgaagtgaatcaagaggaatatctgatatgcaaattatcattcgaaagctctgttcatggcttagatcaagtgccaatcatcagttgttacataaagctggcatctgataagactggtgtgcgcataccttgcatctctctcttactcatgaaaaaaaaaagaggaatcgataatggtgttcgtgtgctttacattgatcatccatgtatttatgcatatgaattactcatttgcatgatccttttttaaccaatttcatcgtttacacatgtgcatatgtagattacaagaaaacatgttttacttagttttagattggaagatagttgttttggctttttaaataaaaaatagaatatatatttatttgaagaactggtgcagcactacggcagtgtactagtgacaaaatttatgcctgtctacaattctacatttctgatagacttgacctgttatttaactttatgtgcgaggtaaatataaaattaaaaaaaggtgtacttttacaaattattcgttcctagaaaccacaattagaaacatatagtactttatgaaggcgtctctgtttattagactggtaaactcctctgggagcattatgtgccttacaatatcagatagacttaagactcgatagtttctggggatgacactacaagtgtaaaactagttatgataacctgaaaactgaaaggtatatgtacaaacctcttctcaacttttcggtgtaatcttttccgcgatggaaaaagtcacattatagctcgacggaatgttagcatctgattttgttttaccggcaagccttttctcttgtagcatctttttagctgcctcggtctcttcaatgtttcttaatttgtacctgcaacaatcaagaagatggtaacatgaatctgtatatagctgcaggcccagttctaaagaaacgcatgagtgcatgactctagtaccagaataatagattaatatacatatatagcaccaagaaccttgagaatattaacgaggaacaggaaccttttaggttatattgaacccacaatgctgacagtacaatgttgagttgttgacccttcagagaccttcgaaatcaggaattataattcgagcacaccattgtatgcatagatcagtttagaactttagattgaaaataacagttacaggtttgtccatcccactggaccatttatcttatctaactatcatgctgtcctaaaaagtctcaattggattatcacatcattcccatgtatgatagaagaaaagttgtacttttttaatagaagtacaaccagagatgtccataagaccagtgcatacttgtagggagttttgtaggttcagttatctataccattttaaaagactccaatggtggtgctgagtggtgaatttgccgcccaccaccacccactccctgataggtgggctacttgttgttagggcgtagtaacatgtgtcttctaaattcccgtgtgaaggtgatggcgaaagcatctatctagatgattagagaaaaataatgtggcaaatttgtttagggtatttaaaatgtgtataatgaatttcttcttttccaaaattctgttgcaatgcacaggcattcagctagtcaattaataaatatccttattaacaagcccatatgcacatctccttatgatgcattgcagtattttgggcaccttcccctttgaattacaacataatatggaagactaccttaacaaccttttataaacatgaacaaatgaaccttttataaacaagaacaaacgaaggggcacaagaacttactcaataggcagctgaacttcagcaatgccagtggtccactgcgttgagctctcttccgagttcttcttcctaacctataagcaaaaaattgattggcaccatcattacaatgcacacatatcaaagccatgaaatatcctttcaggagtgcatcgaagctctgttcggctaccaaccttgaggtggtctggcacagtgtagagctcatcgacctggtctttctcctccttgtccttcacatcaaccttcttgcccctcttcttcaacagctcgttctccacatacctcagccttcaaacatcagacccacgcacgcacatacgctccgcttcaattccgcatcatcaaagatgaatgaaaacaacagattggcaagaacaatcacacgcgaagttaaaaacgcacatgttgggatcctcgatggtgacggcggtctcctgcgcgaaggtgtcctggaggacaggtcctccttctcggcatcccctccggccgctaacccacctccgccgccgccttttccgcggggggaggccccgtcggcagaagccgctgacgacgcgcccgctgcggcggcggcggcggggatgcccagcttcctctcccggagcttctgcatgtacttgatctcctccagggcgacgctgcgagggggggagagggagagaggcgtcagtcagcgagagatccctaccaaaacccaagcgagaggcgcggcggcgggagcggggagaggggaggggtaccggcgggcgtcgtcgtcgtcggagtggtcggcggcggcgtccgcctcgaggttccgcttgcggaagttcttccgcatggttggacggagcttggactggttccccggcgaggtttgggtggggttcgtcgacggcggggtggccggcggcgagtttgcagatggtggcgagatggggattttggataggtttggttcgaattttttattttttttttccccaaatcggaacgaattcgccgccgccgcctccgactcaaggcagcgggccgggtcgggcggtcgggatgaacccggttcattggcggacagttgaaccgggtctggaccgcttagtccgcttcttcgctgcgatctgggtccaaaaggacagtgggcggacgcgtgtggggtgttttgaatttccagctgtccagcagccatcgagtttgaatcaaaattttcgttctgtctctaccgttcaaagttggaactcaaaacggagtttgcgtaattaattgtaaactactcttatgcccctgcctccagtaatcagtcctcgcatgaccatgcatttgatgaccattagtttaatttttgaaatagcatttaaaggtaggatagtagtacctaaaagtaccatattttgatggcatatacttaaaataaaggggatgagaccttaaaaatatctacaaatgaagttgttgtcgagtgtgaaatagtgattctattgataaagatcgtgagcgtgagtacgaggctacacaaatatgtgcgtagggaaagctgtctgcctgcattatccatccctatctcacagcaaagctcacaactctcgtttaggaccgggatgcattttatacatattctatttaggtggagcgcataaccacgtaaccaaacaaatcgctctgtgtacccaagatatgagcacaaggccagcgaaagcaatcgaacatgccatatgataccttccatatgatatggtttggctcaaatgctaaaagttcaatccgataaacctatacaccaccaattgaacaaatggttgaagtagaacagattgaaaaatacaaaagagtgaggtagatgtgatggtttgtgtggaggaagattaacattaaaaagaaaaataaactaaagaaaaccatagtttgttcgccacaatttttttatgatcctatttgtttgaatttatcgccgcgtttgattttaacttatgttaaggttaagaaatgttaactcctacctatgcgttttgctcaacgatgaaatgaaaaacaatgagttactattagaaaaccatccacatcagtgccaatcatgtgtgcagaattatgcacaaatggaatatctttatggataaataatatttctatttacttgtggatttatatacttcatttttaataagtgaagcacaatatatcattcactgcatatcataaccagacatgtggataaataaaaatgttctcttattacaatgagaccatccacaacagaaattgtgttgatgtgttgttcatcctccatatttgcgctcggtgtactccatgtaggggtgggcgtttggttagactaaaaaattcggtctcggtcttcggtttttcggttagttcggtctttggaaactcaggaccggcaaattcggtctcggtctgaccgaattttcaggagataagtttgaaatgaaaaaaattgacagcacttcccctcttttcagacattttatcacagtcatatatatcacaaaaataccaaataataggcaacatcaaacaccaaaaaatatatcacaagataggtctcaagtctaaacttcacaacagcaacagttgacaatacaacactagagctcacaagtcacaaataaaaggcgcgatggaggcggaggcggcgccaacgcaggtcgctggaggcggagggcggaggtggcggcgcggcgccgaggcgaaggtggcgccggcgctggaggcggagggcggaggcgacacgaggcgggggtcggaggaaacgcgaggtggaggcgtgacggtgcgctagggtggggattggtttggaggcagcgcgatggatgtgaggcggtgagggcgtgcttgactttactcggctgtcctcctctagggtttgctgtatgtactgggtttattgggcttcctaggcctattgggccacaattcggttttctcggttaattcggttaaccgaagcctataaccgaattaccaaaaaaatccggtctttcgatggctgagaccgaactactaaccaaatttctcgatctcggtcttagtcttttcggttcggctcatcggttcggtcttattctgcccacccctaactctatgtgaggagctgaggtacgtgttcctgagctcatcagagatagaccgtgacatgagatttgttgtggagcctatgtatagacccttgagaccacatacaacatgaaacctgtgtccattcaaggtgtgtttagttcgcaaaaataaaatttttgagtgtcacatcatacgtttgaccggatgttggaagggattttcggacatgaatgaaaaaataatttcataactcgcatgtaaaccgcgagacgaatcttttgaacctaattaatccatcattagcatatgtgggttgctgtagcacttacagctaattatggactaattagactgaaaagatttatctcacgatttccctcctaactgtgcaattaattttttaatctatatttaatacttcatgcatgtgtccaaagattcaatttgatgttttgggaaaaaaattttggaaactaaaccagacttcagtgtcttggcctacgtagcacgtgacacctcgctaaaggttttagggcgtatcctgcactactgttgctttaagagcaccataagcacggcccactataccactagtataatcaccccatacatcatggttaacaaaagtcaacccctagccatgcatacacttttactttagaataaaaccaagcagcaatccagccaaaatgatcaggtcaattctagaagccgtccaacaacacatcttgctgctctagaagcgaagaattctcaaagcaaaaccttaacgacgacaacagcagcagctagcatggtttgaccaagacaaaatgacgacccattaattaacttgactccatatttaactactctgcttcccttcgaagtatggggaaactagtaccaggatttacattaacattaccgactgactactaaatttcgagtcctattgatatcacgatttttgataaattttaatcggtttttgataaatttcaactgaaattcgaccaaatatactgtttaacttttaaaattttaatcgaaacttaatttcaagctgtatccaaatttcgtaaaactccatcagttttcgtggaaattatgaaccctgaccagtactagcaggagcagcaaccgcgcaactacccagcaaccaaccacaacccacacggaagcaatcccggccgggccccacccggcagccaccccccgacacgcgtcaccacgcggcaacgcaccgagaccgagacctcgacccccgcccccccgccggtgggcccacctcgtcagcgactccacgcccccgcgcgcgccgacgaatattcccccttcccccgggcgtgcgagcagggccagttccgtcttccgtccgcctcactcacggcgtcgcgcccacctcgcctccacccaggggcatcccggtaaattcgccgggtccgcggctgctactactaccgccttttgtttttctctctcgtttcgtgtgcgccgcgcggctgctgctgctgctttcgtctctcctcccccctccgctgctgcaaagcttccagaaagaaaggggaggagaaaggaggtggaaaagccaaaggcaaaggcaaaccacgcgtctctctttggtattcgtctctccatggcacgcgtcctccccctcagcatcgaggcgggggagatggccatgcccaggtattcttccttccccgagctctcgctgcaatctgtttgtttgcttgttcatcgcgttcagattgttggagttatttttttccttcgaaaaaaaggggaagtttggtggtgtgttggcgattttcttagtaggagaaaaaaggagtttgggtttagttggagccgacgatgcatccaaggtggtttgtttgggaggcttcttgttaatctgttcttttacaaattcaaaatagaatttttgtcggccgaaaattttggagaattttttgtatgccaaagattgcgggtgtggttgttggttttaagcctcgaggtcggttgcgttctcccaccaaagtgcaatagcattgcgtcatggcgtgtggtttgggcttattcggttctttcaattttccgtactccaagaggaaaacaaaagtggcatttatgcgtgctgtggcgtgcactttgttcttcgttgccgcttatccgccattagagagcccattgagccttttggtcacgggcgctgtgatgtgtgatgggcacgggttgatgttcccctcgcagcagtaccatgcacggacacggacacaagactcacggggtgttgttaactgtttcttcacctacgccccgttttttggaggccaatgtggcacatgaacgagcaagaagggcagcgagcatggagtgatccatttgggattctttcaaaatcgttgcaactcaagcgggagctattttgggaaatcttgcttaaccatgtttataacatcggttttttttactgttacagcttaaaaccatatctgaaattctagttatagcagtatttcgcatggaaagatggagtgtcatgattgagtgctgtctgttgctctttacgaaaccaatgttgtagggtgttgagtactgcagataaactgggaagaaattggccgctggcagtttgactagatatgtaaattaagtatacttgttgtattgtgttaaacaaatagaaaaatacgaactggaacatttgacctggttattcaaattttagatcaaggattgtcacatgtcaaatgttttgtctagttcatgccacattgctgtggtgtgagaaagatgacctgtatttcagtagaatagatatgcagttattgcattagttttagggattactgcactttattgtccaaatgtagcaccccgatggcatctattgattgagctatagatcgatgtacattctctgttcggtcatgaaatctagcacttcattttatcgtcgtcctcattttaccaggttctgtatggaaaagccatgtagattatcatggcctagaatgtgaagttttttggcagccaattttctctggaagcttcaccttctctgtattgctatccttatttacatatacatgactagatgggcctctagcagatgggccagcacataaaacacacacatactgttgtatttacagcccaacactccccctcaagatgggtgatagatatctatcatacccatcttgtcacatgaactattacactctttaacacctaaaccctttgtgaaacaatcagcaacttgtccaccagacattacaaattctaattccaaaactccctcatccagtttttccttgataaagaaacgatccaactccacatgctttgttcgatcatgttgaactgggttgttagcaatgctgattgctgacttgttgtcacaccacaatttcattggagtatccaccggcaacatcaactcagaaagaagattccttagccataacaactcactcaaactcactgacattgcccgatattctgcctcagcggttgagcgagacaccaccggttgcttcttgctcctccaagatactagattgccaccaacaaacacacaatagcctgaagttgatcttctatcatcaggacaacttgcccaatgtgcatcacaatagccttcaacctccaagtgtccatttttcttaaaccataggcctttacctgggcttcctttcaaatatctcaagatcctatagacagcatccatatgcccactccttggatcatgcatatatggactcaccatactgacagcataagttatgtcaggtcgtgtatgacataaatatatcagtctcccaaccagccttgggtatctttccttattcactggatttccagactctgcacataacttatgattttgatcaactggtgtagaggctgggcgacatccaagcatacctgtgtcactgagcaagtccaatgcatatttccgctgtgaaagaactatccctctaggagatcttgcaatttcaatacccagaaaatatttcaactggcctaggtccttaacttcaaattctttgcttagattttgtttcagcctagttatctccgagcaatcatttccagtgataatcatatcatcaacataaacagcaagaatggttatatgatctccactatgatgatagaaaactgtgtgatctccattacattgtttatagcccatagcacacattgcacgcctaaatcgatcaaaccatgctcttggcgactgttgagaccatataaggatttcttcagtctcaatactttacctttagtttgcaaagtagcaaatccaggtggaatttcca

SEQ ID NO: 5878 - DNA, 2356 bp, Oryza sativa
aaaacagcccgagaatgcaaccgacgatgcggacgaggaaaacaccaacagcagcagcagcagcggaaccaacggactaacacccaacaccacaggcgatggctgggaaccaggacgaaaccctaatcttcacttcacgatggaggaactatatatatatatatatatatatatatatatatatatatatatatatatatttatatagagcaagggtgagtactttcgtactcagcaagtcacgggaatcaggtgtttaatgcaagcttggaagagaggcaagattgttttacaaatcctttgtttgaaatcattttgaaatcactaagtgatttatttctttctaagtttgggtcgaaaaggagacttgcgtctcgattcgacttaagagatgctgttcaacaactcaattggtaatgtattgacctcccgggtcaaatcattacttcctggctcccagagccatttcacttgattaagcggctcccagagcctttttcattttctcggactcccagagtccagctgcccagcagcacaacaatccgcttccactcgggaagcctaatctatgatgcccgcaaacattccgaatcacacagattcgtttctgaccactcaggtcatccatctgccatgtaggctgattctggtgacgattcccaatccacaacaacttttcataaagcacaggcaaacaaatctacgcaacggaaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaagcatcaaatcctcacataaatataggccattttagttttcacaaatcaaactccaaccacctcgatcggtaatctggcaagcttcgcgttcttgccttaccaggaacccgggttggctccaaccgaccccgccccggcgttcccaactattggcatgcgaggtttccctgaaccgactagttacttagtagggtgtcccataccaccttgtggttgcactttgttatacttgatgagtttcccacaggaatcggtccttatatgcgaatacgggacaacgccatgcaggcaccacccccacatcgcgagttttcataattcatttatttttaaacacaccgacaccacatgtcgggttttcaaggcttctcaaacccatttcccaatttttcgacagtcaacggtgtatgtgggatatttggtatacgcgctcagagagcacggatacggaagtaccacaagggtggagcggcaaggaatcagggtagtacaatctacaggaattagtgcgactactgggtaggtccgtcggtttggcacgcaaaccgaggccaagcaaattaagtgtgtgattctaataatgcaagttacaaacaaaataataatgattttccaattatatgagcaattggtcaaagggtgacttgccttgctcaagatcttcacgaagcttcatgaatctacgagaaatccctgatcgacgaaaatccggtaaccgcggctatacgcaaacagtcaaaacctaaatgaaagactaaaagaaagaccctatttagactaattaatagtgccattaaatagatctcaattttacaggagtactggaagttgacggagtcaatcggagctacggattgagagatatgaattttggaagctcgaatgggattttctggactaggaaatgatttatctgaattttctggaatgaaaggaatggtttatggaatttatagaaataatattctcaagaatattattgacagtcactgacgtgcggggccaagggaaatgatttatggagcaaaggaaaaaggaattgatttatgaaaaagggaaaaaggatttattaaatcctttttggaaaagaaaagaaggatggatgtgatttagacttgggccgagcgaagggggcggggcccaggacatttgcggcgcggctgaggaaagtgggccggcgcacgggtgaggcggtccaaggccgggcgcggcccgcgtgagagggagccgaccgggcggaccgcggtccaccacgcgggatccggggcgggcccgcttgtcagcggctcggctcaccgatggcggggtgcatgcgagcgggacgctagggttagggggaggggcgcggtgcgcggtggacgcgggtgcggcgggcccacgcgcagcctctcggctcgcggtggaccgcgcgcgcgcgagcgggagtggaggaggcggctgaccggggtcagcccgacccaatcc

SEQ ID NO: 5879 - DNA, 4641 bp, Oryza sativa
ttctgaccactcaggtcatccatctgccacgtaggctgattctggtgacaattcccaatccacaacaacttttcataaagcacaggcaaacagatctacgtaacgggaaccacctcacatccgcccatgaccgtgggcacggctgttagaatagttagttaacctctgcagaggggcacactttacccacaagatacgaacttacttcgaacacccgtctgtatcggaggttcgcaacaaagcctttcccaagccgacccagggttacctcatgccacatagaaggatcaaatcctcacataaatataggccatttagttttcacaaatcaaactccaaccacctcgatcggtaatctggcaagcttcgcgttcttgccttaccaggaacccgggttggctccaaccgaccccacccccgcgttcccaactattggcatgcgaggtttccctgaaccgactagttacttagctagggtgtcccataccaccttgtggttgcactttgttatgcttgatgagtttcccacaggaatcgatccttatatgcgaatacgggacaacgccacgcaggcacaacccccgtatcgcgagttttcataattcatttattttcaaacacaccgaatacggggcgactgctgttttataggcgcggggtggggcgtcgaggagaaggaaccggcattggggcgatcaaggggagcgagctggcggttgtgctcggagctagcggccaaacggcagtggaggtgcggtggctgaggttggaaaaagagaaaaagaagggggaaagaggagcttgatcatgtcgtttcggggagggagagaagcgggagcgagagctctggctcccggttttggacgggcgcgggtggagcggcttgggcacgcgctgcagagctcgcggcaggcagcggggctgagcggcagggtggcatgggcggctgcgcggcgcaggcggccagggcgcacgcggcggcgaccgggcagtcggcgcgctcgagcgcgcgtgcgaagttgagttcaaacggagatgtaggtagatagatggacaagagggagggagagagaaacagagagaacgagcgacgctccctctcgactccgacagcgtgcaacgcacgtggtgggggaagagatgatgggctgggaggggagatgggccgtgggaggaaatccggtccacaaaacttgagggaggtaaaatagacttttccagagaatttgatttggagaatttgagtaggattttggaattgcaaaccttgaaattttaatttggtgaaatgtgaggaagccaaggatgggattcaaagcgggatttatatatatttcttttgaaatatatttgtatctagcgactccggggattatttgagagggattccaaaggaagggaaaatcaatattcgaagatggatcaaagggagatagcgatggaacgccatggataggtaggtaggtcaatcgatggacatacatatagttggatttgagaaactgatagttagatcgagtaggtagatagagcgataggtagataggtcgatggatagatagatagatgggtagatggttagataggttagataagcggatagatcgattgatggacatcgagggattcaaggacggatttgacattctccgaatccggagaagtattggcaaggaattcaaggacgggattgaattccggtgtttgatttcggaagttgaatcggaattggaatcttcaggtggaggattttgatggcgatgagagggaataacaggatttgaattgagatccagggcatgacttagactcacactcaaagaacgaaaattttcgcaattaggattttctcaaactagtttttaacgtctcacgaaaagcggagcgttacagatccaccccccttacaagaatcttgaccccaagatttgaaggtggaccacacacacgaaaccaaaaaggggatcttcagacttcatctcagcttcaactctgttggtctttcttcatctcatggttgcacactagccacaaaacgatctggtactctcactcacttaacatgcttcatcttactgtgggtttgtttcttcctgcggattctgttcttcagcttgctcgagattcataacttttccttttgtttccacttgcacatggttcagatgactttgtccaacaggcggtgaggttagcgagacagatccactgtttggtgactttgagctttttggtccgggtacgctagggaggctcgctgttggttgaacttgctttgacttgactttctgagggcagtaccatgaatagtgtcccatctcatggcagatgaaacattcgactcctgccttatgaccacgtcttttcggaggtggagggcatgacacggagttacttccttcaaggcttttactgttgatcactgtggtttgctgactagattctgacattgtcgagcgagacgtagaaccgaaaccattggaatactgaaatactctctgatagtactgtgctggcgagtttgttttttttgacacaaaccttcttttgcttgaatctctaaggatattactttgcgtctcttctattcttgcatctcttattctgcatcttctagtaacaaggacttatcgaccatttgctgaaacatcgagaagtcgtgagccaaaagtttcactcgcagtttcgcatccattccttttaaaaatcttctgatcttctttttatcagtgtctgcatcttctagggcatatcgggccaatctgttgaagcgactcaaatactcgttgataccagaggatccttgcctgatatttgcaaattcttccttcttcaaatcaattatgctttcaaggatgtgtgctgagcgaaagacttatgcaaattctgcccagacgatggtaccagcatctgtatggttagcacaatagttatcccaccaatctgcggtaggtcctctcaactgatgagcagcgtaaagggtcttctcatacggagtacactgtaccagatttaatctcctttccacatctttgatccaatcgtcaccttcaataggctcagttgtttgagagaactccggcggacgtgatgtcaagaaatcattcagttttgatcgcccattatcttgaaccatatggggttgacgctcttgtgtgtgttgttgttgcatagcaattatattctgaatcattccttgtaatatctgagtttgcatggctaggatttggtgaaggtccatgggtgggggttgattacctcttgcattattaactgattcggaagcaaccgtatgatcactctcagcttcttgctcatctgcttggttaactggttgatcgggaatctctgactgaactggctcttcttcaaaaccaaagcgattaggagcacgggtttgacgggtagaacgacgagccatctacttcaaagcgactgagatctgaccgaaccagaaatgggataagaaaaggaggaaaacaaaaacactagatcaaaacgtttttcgaaatcgcagaagacataggtggtgtattccagccggtaacccaactggtctaacacctgaacacgggctaccaaacaaaactcacacacgcactagttcaccacaactcctaccgagcgggtgacggagctagggttgcctaccaacaagggcttaactaagacgcctagaggcttgagcacacctttcttcaactgggcgtgaagacaggtttactctaggataacatgtcaaaacaaacgactagcttctacttttggacacaaaaacatttttcgcaaaactagagctaaaggggacaacgacaccttagctttcacaaatagtttttgtactcaattaatgccatcctattcaggggtttcgatcctagggccaactaatgctctgataccatctctgtcacaccccgatccggcaccgccgtacaacggcacctgacaggagcgtgtcgtaggaaaaacggcgtgaaccgcttcctacgaaaccgcgattacagtaccagtcccaggacatagtgctggtacccacggtgacaaatatgaatcattgcaatccttaaaataaataaatgacttatttaccttaacttaggttgtagctcagaacagcccgagaatgcaaccgacgacgcggacgaggaaaacaccaacagcagcagcagcagcggaaccaacggactaacacccaacaccacaggcgacggctgggaaccaggacgaaaccctaatcttcacttcacatcatcttcacttcacgacggaggaactatatatatatttatatagagaaagggtgagtactttcgtactcagcaagtcacgggaattaggtgtttaatgcaagcttggaagagaggtaaggttgttttacaaatcctttgtttgaaatcatttagaaatcactaagtgatttatttctttctaagtttgggtcgaaaaggagacttgcgtcttgattcgacttaagagatgcttttcaacaactcaattggtaatgtattgacctcccgggtcaaatcattacttcccggctcccagagccatttcacttgattaagcggctcccagagcctttttcattttctcggactcctagagtccagctgcccagcagcacaacaatccgcttcc

SEQ ID NO: 5880 - DNA, 7002 bp, Oryza sativa
cgcgtggcgagctctccagccttggacctgggaaggggaagaagaggtgcctgaagtcctcgtctcgggtccccgcacgcaccggtttccctagtgcttcggcgacggacggtgagggcgactgtagggcaggggcggcaacaatggcgcggtggtggcgacgagggaaaacgaatgagggagatggggcgactgctgttttataggcgcggggtggggcatcgaggagaaggaactgacattggggcggtcaaggggagcgagctggcggtcgtgctcggagctagcggccaaacagcagtggaggtgcggtggctgaggttggaaaaagagaaaaagaagggggaaagaggagcttgaccatgccgtttcggggagggagagaagcgggagcgagagctctggctcctggttttggacgggtgcgggtggagcggcttgggcacgcgctgcagagctccatggaacgccatggataggtaggtaggtcaatcgatggacatacatatagttggatttgagaaaccgatagttagttcgagtaggttgatagagcgataggtagataggtcgatggatagatagatagatgggtagatggttagataggttagataagcggatagatcgatcgatggacagggaaggattcagggagggatttgacattctccgaatccggagaagtattggccaggaattcaaggaccggattgaattcccgtgtttgatttccgaagttgaatgggaattggaatcttcgggtggaggattttgatggcgatgagagggaataacaggatttcaattgagatgcagggcatgacttagactcgcactcaaagaaagaaaattttcgcaattaggattttctcaaactagtttttaacgtctcacgaaaagcggagcgttacactctctctcccccactcacttttctctcccacctctcccctcctctcccatttttccactcctcacatcccgacggtgggctcgagttggcgacgacgggagcgggagagcagtggtgggctcgtgcgggcgcggcagatcctgtgggagcgcgacggcgggtgcagcgacggcaacggcgaatccggcggtatggagggcgacgacggctgccttggcaaggtcgggggatggcgatgccaatgaggagaggcggtaaatgggattgttggaattttttttcacgatttttattttcgtgtgcggactacataagcaccggcacacaaaaatccgattttcccgtgtgggtgcgtcacccacatggaaaaatgggttttgaccgcatgcaaaaatgttttttttatgtagtgttcctaaatacttcttcatgtgattttgaggatagattgctacctaatgatttaattatgataagaaactatggagaatactagcgagagagaggttaggagatggataaggtcacacaggcgttcaagtcaagttggagacccaactcatatcaagttcgagtctacctcggctccaagagtagtctgtgctaaaaacatcgcctaggtcatgttcggactccattttagacgttctacctatgtatggaaaactaacaagaccacctttccgatgggtttggtcttccttcgaagtcattggggatcgtcaaaacaagtggtgtccagaatctgtccgagtgctgtgtcaccatctttttgtaccgttgggccatgtatcgtgttggagtccaacagggacgcatccaggggtttttgatcgaccgtagaacctatatattcagtagttgttgtcgagttagggttgggttttgcttagattatttttgcaattgcagtttcaccgttcatcggtttgtgaaaccccgacatcaagttcttaatcaatcctctacatttgtgttgcaatattcttattcttgcttgtgtcttcgattcgcacgcaaggatagccttctcggcgaggtcaatcgggtttggcatggttaataaccagaggagacgtggtgctgctattacatggttcatattatgttaatcgaaagtcggatcgtgtgtgccaagattttgccaattcgatagatctctacttgacggaagattgggcaccccattatcattataaacttttcccaaattactttttgaacaaaggatagaaacaccattgaatctatgaaattcctttacaatattttttgctgatccatgtggaaattttggaggaaagtcacgacgccgcccggttcaacctcctgaaaaatgttttcctttgactttattaatttcttgattcctgcatctatctgcggtctatgtatcatgtatttttcttgtattttgtacttctttgtttttttcttattcatatattttatccctgtgttcgacatgggcaattcttgataaaaaaaatgcatatgaattttctttgaagcaattctacagaggactttgaaagcctcatgctagatcaattcctcaagaacattgtggagaaatgttattcctatgctatgaattttatttaaaatggttgtctatatccacgtagatgcatgtagaaactggtgggtttttaatccaagcagttttaatccacgagttttcttccaagcagttatacaaattaaattactcgcatataagaattatttttcattgtattcccctagtctttctcacaagccacaaaatgcttcaacccaaaattgggtgatccgatcccctctaaatcgacatgggctgtttgcatgttgatccatcatgaataatcacattctaaaccattcgcggttataaacaaccctacttcgtttttgaaaacaacacatccaaattaatcgaaaaaaaaatccaatcatacaataatgtgtttttcctataccccatttatgacacaggcgagttgaaagtagaacccgcctgtgtaaacattggccaagggatggaccaatgggccacctgtgaagaactaacttagaacacacaaacacatagatctacaacaaattatgaattatatcgagcaaaacctctgccccttagttggtcgagcaaaacaaagcccctctctattcttcccaattgagctggggtgtgagagggaacgtgcatatatattatggacctagttttcccgattgagctgttggttatgtaatagatccaacacctgtaagctcataaatatagccgtgccagggctacttcataccggttcataactaatattggcatatataagtcgtgcaagactattcaaggcccttatatatgtggaagaggttatggaatcgaatccctcacatgtatgtgatctgtgatttttttttctttcctcgcttgcatgaaacttaaagcaaatctaatagtttaaaattacgtgaaagttatatataaattacaatgtaattgtattataattgtactatatttacatctattaagtttttaagaggaaatttgtagataaatatgtaacaaaatgttacaccgttattagctcatgggcaccaaaaaaatcttgtggttatgtcatccgcagaaggctccatcgtcgtgtgtctttgatgtttgtaccaatcaattaaactagatgattcccgcgtgtgtttttctacgagatatataaataaatatatgttaaatgttgtataatcatgaatagaatggagtgaaatattttaaaaatgatttgaagataataattactatgatgtggtatgtttgcatgctagcttttagaattaataataaatactatgcttacctattgaattttagatgtttagtgggtcgtaactttatagaacgtagaacatatagataaccggtatcctaattaagttcaagttcaacatgtcatcaagagtatatatatattcattaaggtacgtggaattatacttcctccatttctgaatagataatgttgttaacttttagacgtatatttgactattcatcttatctaaaaaatttattgtatccatctcatagaaaacaaacttagtactagaaagcgtcgatatagtctatactagttatttatgggagtgtgagctagtatgtaattataatttattttgttgtgagctttttatcgctaaaagcactttacacatgatttatttcttagatatttgcgaatggttaaatgtgtatgaaaagtttacatagtcagctattgaaaacggaggaattatgggcttgtttagatcattgatagaatttttcaccctgtcacatcgaatgtttggatgtatgtatggagtattaaatataaaaaaactaattacacagattacgtgtaaattgcgagacggatcttttaagcctaattgctccatgatttgataatgtggtgctatagtaaacattttctaataacagactaattaggcttaataaattcgtttcgctgtttataagaggaatctgtaatttatcctgttattagtctatatttaatacttcaaatatgtgtctgtatactcgatgcgacacgccaaaactttacaccacttactccctcggtaagaaaaaactcaaacctatgactgattatgtcatatcacattcctaggttaatttttttttaacgaagtgagtatgtttttacgctgacttctaaaaagtgagacgcctgcgtacggcctgacggtagtacaagtactcgatagaaccgtcgatcgtaaattattgaagagtgaagaaaaaccccgtgcactgcaattaattgtcgtgcatccctccctgccattgcacgttgccacagcagatggtccggtcggtccacctcccctccattggtgaatgacaagggcacgttggtgggtgaagtgaactgagtttatcgtaattatttgagggcctaaaaagaataataaaatttcacttgaaaattaatgattttgatttaagaaaagttttaaaaggaaattctaatgaacaaacttttttttaaaaaagtatattatttagaagcttaaaaatggtgactccgataatacgctagctagctattcccttaaaaaatgccctattatttgatgttcaacttgaagcatgcaagatatgcgggccgggcccaccaaggcgtgctaggaagaaaaagcatacaggtctggttccactgcagtaatgcagaagttcactaatagtgaacctttacattactgaggggatctggattttaagcgcactttattacattagataatatactcctccgtttcattttaaacgtagctattagttttcatgtccaaatttcatcgtctattttatttaaaattcttttatgattattattgttgttgttattagatgataaaatatgaatatatatttttttaaaaaaaaattaataagacagacgattaaaattggacacgaaaacttattgttgtgtttaaaatagggcggagggagtatatcgcaaaccgatctatcgtcggcggaaccagaatcagccgtacagataagtggcgctggtcctggtgacacgtaaacgaatatcgtggagaggcacatccatgggccatgccacgtaccgtcccgtacatgcatgtgcacctctggcgacattgtgggcacctcctggctcagaaacggaacatgctatactcgatcgatgacagttaataacgtgtggggggaagaaacgtgttacctctaattttaaatagtgaatttttactctctaaacctgttcatctatgttacccatgtttctaaactcttaaaatatatttagagtaatttttgttgaaacccttattttcataatcaattatgactttaccttttttttccttctatatagccatatttacttttagaggcaattgtgtctctgcccttgctttacatctcaattgtgattttacccatactttttagggtttgtgattttgcccatgctttttttaaacagggtagctgcctgcccctactctgttaactgatggtaacggtattaaatgtgtggtgaatggacgagtatacccctgacatgttttggcttgcacaggatacatgtttcaagttaattttgagcaaatttcatatgggaaataaatgttcacaaattttgtaaaagttgatagaacacaatattttggataattttgatagaactttcgcaataatttgaacacagtttataaacgatgtcagaacaatatttttgacaaaattttgacagaaattcatcaataatttggacacaaattatagaagataacagcacactatcaaggacaaaatttcagcaataatttctgctcgctgcttgctagctcgctgcaagcacacttcctgctcgttgcttgctagctcgctggctgcggggccaccggccgtggcgtctccctgcgcgtgcaacaccgcggggccgcgccgacacgccgacagagccgcgccgctcctttccgacgctcctcagtcgcggggccgccggccgccgcgcctccctgcgcttgcaatccgcggggccgccgtgccgacggaaccgccgctccgcagggccgccgcgccgccgcgtcgacggagccgctgctcctcggggccaccgcgccgcgcctgcccacgcccgactccaccgcgcgctggcccgagccgccgctcctccctgccgcgcgccgccgccgcttgcaacccaacaagctaggtttttcgattggatcggggacagcaaggtttggggatttggttgtttcattgaagcaagggtagaatagtcattcacaaattataatagcattttctttgggtgtagctatatttatggggccatatttttcatgaaaaaatagtcggcatgtatttacattgtaagtccctaaattacatatgtaattttagtgtatttataatgtaagtctaagtactaaaattacatatgtaaattcgaaaattacatatgtaaattcgaaaattacatactaattacatatgtaagtggggtgtaaatgaggtgtaactactgtgtaagtggctgaaaaaa

SEQ ID NO: 5881 - DNA, 5199 bp, Oryza sativa
atcgattgtagcatatggcgccatatttctagcaactccgttttctttcatcggttaattcggaaatcctgggcccatgaaactaccatccaaactaggggcagacggctgcttcgtttcaaaaaagctggggcaaaatcacaagccctaaaatataggggtaaaatcataattgagatgtaaagtaagggcagaaaccaaattgacccttacttttattattgacgaaagcaagtgaacccggaatagttgagcgaaagaaataggtcttttgtaaatcttgagttacccttctatccttgctggtggaaggaaggagaggagctcctggatggaccacatatataccgatgtttctccatccaacagcaacagcggcagtgatgactcgggcaggcggcggcagcgctagctgcatgtggcgagctgtagtaggcggctgtagcgacctcgccaagggagatagatctaggcaaggtcactacatgcttactggaatactccgtattgtagaaattgcgatctactaagatataagtgctaagcctaacatgatcaccctaatgcggaatccttaggttactgaccgttgtttgaagctattgatgctgttctccctgttcttgtcggtgtagaggtagtagtggtagcagtagcagtgttgcaccggcttgatccccaaggggtcaccggcgatcacttgcggggtagcggcggccttccggtgccacctacactgtcccggaactaccacacgttctccctccagcgctcaattgattggatagggtttttgggattttcggggagaagaaggtcgtgaagagatcgtcatctcaccacgacaccagcctcccctattagtatggcgctgagggagatcgggggcaatccaaaatatagaaagatttggcgctaccgatcaatgcgcgtaatcacgtaattatggaaattgaatcgcgttaatcccgtaggcaccaggtggaaaacggccatccgagatttcctctcgatttccatgccgagagataaactttcctaacattctccccctgatcttgaggctaatgagtttattcttagaaaaatagatttactaaggcaacgcatcagggtagttatcatatcctaccaagactccggtacctatagttcactataaaacttcgaaagaactctatctaatcttaatgggagttagttaggactaagactaatgcctctatttctaggatcttagtcttaatcaaaggcaatcagttattcccatgccggctacatgatctttaaataaattgggaggtaagcctttggtgagcggatccgcgagcattgacttagtgctaatatgctcaatcttaatggtttgatcctggattctatctttcacaacatgatacttaatgtcgatgtgtttggcagcaccactcgacttgttgttacttgaatagaataccgcagctttattatcgtagtataatgtaattggtttagaaatgctgtcgaccactcttaaacccgggataagattcttaagccatacggcctgccccgttgcttcataacatgccaaaaattcagcctgcattgtcgacgatgtagtcaaggtttgtttagagcttttccatgaaatagctccatttgcgagagtgaatacataacctgatgtggatttcttagtgtctacacatcccgcaaagtctgcgtctgaataacctaggacttcaagttcttcagacttcttatatgtgagcatgtaatccttagtgccttggaaataacgcaagacttttttaacagccttccagtggtctaatcctggattggactgaaatctgctaagcatcccggtaacaaatgctaagtctggacgcgtacagacttcagcatacataaggcttccgacagctgaagcgtatggtaccattttcatctgatctgattctaatttatttttcgggctttgaaataatccgaatttatcacccttgactattggagcaggtgttgcagagcacttactcatattatatctttttagtactctgctaatgtatgatttctgagataaccccagtactcctttagacctatctcggtgtatttcaatgcctaaaacataagatgcctcaccaagatccttcatatcaaaattagatgacaaaaattctttagtctgatgcaacatattaatgtcgctgcttgctaacagtatgtcatccacatagagtactagtattataaattttccacccttagtcttaatgtaaatgcaattatccacctcattctccttaaatccgaatctcttaattatttcatcgaatttaaggtaccattgccttgacgcttgtttaagttcatagatagatttcttaagtttgcaagccaaatggtccttgccttccataacaaaaccctcgggttctgccatgtatacatcctcatgcaattcaccattaagaaatgcagtctttacatccatctgatggagctctaaatcataatgagcaacaagcgccatgacaattctaaatgagtctttcttagagacgggagaaaaggtttcattgtaatctattccctctctttgtgaaaaacccttcgctacaagccttgccttgaacctttcgattttccctttggagtcaagcttagttttgtagacccacttacagcctactgttttggatcctttaggaatttctactaagtcccagactccattatgactcatagattttaattcatcgtccataacttcaagccatttggatgaatgttcactcgttattgcttctttgaatgaggtaggatcatccaccttcccaatattttcacctaaataaacatcataataatttggaatggcagatctcctctcccgttgtgatcttctaagtggttcattttcgatcactgacggttgagaaggttcttctataatttcttcattttgtgcctcagaagtctgttgagtgtcattatttaattcattattattttcaacagagtcggtatcaccagaattttcatctggtgctaccacggtctgagtcacaggtacaacatgaggtaccaaatttattggaatattattctcttggatttccggtgtaacattagcccgaatttcctcaagattaatttctcttggacttcagctgatcttcactatgtttctgggacaatctctatctcgatttccatctcgattcctcctccacatctgatccttggattaccaaatttggtcgttaacactttcctgtgagctccccaagacttcattattttctaagcatacgacgtgtcttgtttccacaaatttagtgacacggtccgggcaataaaatcggtaccccttagatgtctcagggtatccgataaaatggcagcttacagtcttaggatctaatttctttagttgtggattaaatattcttgcctcagcacgacaaccccacacacgtaaataatttaatgtcggttttcttccggtccataattcataaggtgttttgggtaccgacttacttgaaactcgattgagtatgtgtgcagctgttttaagtgcctctatccataaattcacagacaaagtagaatgtctaagcatactccgtaccatgtccataagtgtacgattgcgacgctcagccactccattttgttgtggttctctaggcatggaatattgggcaattattccatgtatatgaaggtattgggcaaatggaccagaactttgcccataaggagtatgtctcccataaaattctcctcctcgatatgatctcactaccttaatttttgcattatgctgattttcaacctcagctttgaatatttaaacttatcgagtgattcagatctatctataatggggaaaacatatccataacgggagaaatcatctgtgaaggtaatgaacgagtcatatccatcaacagatgttactgggaacggtccacatatatccgtgtggattatctctaatggacactgctcctagtagctcctttcttatttttttttagtgaattttcccttaatacaatctaagcaatgatccgcatttgaaaaatctaagggttgaagtatctcttccttaatgagacgctccattctccccttagaaatgtggcctaaacgacagtgccacaattttgaagacgtctcattatcattacatgcattcaatatattcataatatgattatccaaagagagcaaacagagcttgtcttgcacactagcaagaccaatatcaatattattatacttaataaagcatttgtccttagaaaaattacaatcataaccactgttcgttaaaaccattacagaaataaggttcctcttaacagagggagcataaagaacatcatgaagtaaaagattattgccgcttggaagtcgaagatgaagctccccaacggccatcactttaatttcagctccatcagccactcttatgatccgctccccctttcttaccgtccttaccgaacggaatccctgtaatgagttagcaacgtgcacagtggcacctgactcaatccaccatgatttatgagaaaattcaacgtaaagtaattcatcaacattagagacaatatcaacattagtacctttcttagcaagccaagcccaaaagccttcacagtccttctgtgcatgaccttctgcctcgcaaaacttgcaaaggaacttaccagcagagttctgacctgctggaacctgagatttgcccttatgagcaccattagaagcctgagtggaaggagtgttgggcttcttcttcttgttttgggagttgctggactccccttgatagaactttttcttactgcccttagcaccatgaaggaggttcagctgatccttatgcttctatttgtcagccttctgacgatcctcctcctcaacagaatgagaaatgagttcttcaatggaccacttatccctctgattattatagttaataatgaaagactcaaaatcagaaggaagtgaactcaagataaagtggactagaagatcatcattaattcccatgtccatactcttaagctctccattcatagcacccatctgcataatgtgctttctcacaccatctttataattatagcgcatggacgttaggcgcttaattatagagctagcataagacttagaagaactcctgaagtt

SEQ ID NO: 5882 - DNA, 2651 bp, Oryza sativa
atcgtgctcaacactaaaaggttcctcaggacggtcctctctaatggcataatcataatcgagtatgcctaagttgagtaacacgtcagccttccacttagcccattaagaggctcaatgagtcagatctgaccaaaagctgaaaaatcatgaagaaaaaatattcataagtacatatatgcaattaatatgcgttggctcaattaattacataattaaacagaaataaattcccctaattacatcaccgttgggcagaaataattttgggaaacataatcataaataaattttcgtgaatttataatcaacgttggtcaaaaaataaattcacatcatgaaaaaacaaatatctagccaaatttctcattggttccatttagctagaattaatttataaacagtcataaattttttcataatttttcagcaatttttaagcaatccaaaaaggtactaatgcaaatctgtaaataaaaatacttaaagggaaatcgaaaagagaaaatggccaagtacacattatagcatcagcccggccagcttgggaccttaacgcatgcggcccataatgcacagcgcggcccgtggcgagatcgatctcagccgtttgatgtaatagacggtttggatttatcccgaatcggaaaacatatagccgccggctgtaacactaaaaaaaaatcttttccccaactctctctctctccgaaaagaggcggcggcggcgatttcgcggcggagggggcgcgcagcatgaggcggcggcggcacgcgcgtgttaacagtgaaatttggtaagcccggagtagtcatcggctgagagtcagcatcggcttcgaagtcctgagattagccgatgagaattgtcaagtcgttagtagtcagattcctgctatattcggttaaggaaatcaatctactaaaggaagcttatccctaagtgaccgagtttaaagaggatgcggcatggcagtttatctattaattaggaatagtttgttagtttccttttatctttggaaaagtgtgtttagtgtccgataaggactttatattttccttttttctttaggttagttcctttcttgtccgacaaggacttgtatcaacccatgggtataaatatgtacacccggggtctatgtaatctatcttcacgatcaatgcaattcggcgcatcgccaccctttttacttctacttttgttttttaagttccgacggaacttggcatcggtgttcgatctccggcgaaagggtaagtccaatgttccgtcggcccaggcaattgtatcgtttacgtcggcgtcgttcaaggctgcatcagtacattcgacctcttggattgctctggtttggatgatataattgcctatctatttatcatgtctctgttaatctagtcttagcatatcaatttaggtctatcggctgtctcttgctttagggttcctgccggtatcggctaaatcgcgttgctagattagattagcctaggcatctaccaccgtgaaaatcagtcaacggcttgattgtctagatattgtgtttcttttcatacttagtgctgcatcagttaagtttgatctactaagtcgtgcttagaaccataatctctagcctgcttattgattgccaataagggtttcatcggggtttcagccgatgagttatctggacgttgcatcggcccataaggattgcatatacatataagttggatttagccgatgacaacaaaggtttcattgtttaatccaatcttgtggatttcatgacatcggacctctagccgatgggtgctttaaccttcggatcaatacttgttctactatatcatattgttagccgattggtttctactggattatattgctatattacatcatcatcagccaattgcctttatatcattatctacatttgacatatagccgattgcttaaaccctatccctatcggctggtatcggcatcggctattttcggctatcggctggaactactccatcggcttgtcagccgattggctgtttgatctactatttgcatatcttgtcggttgcaggattaaactgactggcacgcccgcatctcatcaatctttggacctgcacaggagctaagcatatctctcaggccggtgtgttcgattttttcgtcaacacagattagccgatgagaattgtcaagtcgtcagtagtcggattcctactatattcggttaaggaaatcaatctactaaaggaagcttatccctaagtgaccgagtttaaagaggatgcggcatggcagtttatctattaattaggaatagtttattaatttccttttatctttaggaaaatgtgtttagtgtcggataaggactttatattttccttttttctttaggttagtttctttcttgtctgacaaggacttgtatcaacccatgggtataaatatgtacacccggggtctatgtaatctatcttcacgatcaatacaatttggcgcatcgccaccctttttacttctacttttgttttttacgtttcggcggaacttggcacctgacgcggggctgcatcggtgttcgatctccggcgaaagggtaagtccaatgttccgtcggcccaggcaattgtatcatttacgtcggcgtcgt

SEQ ID NO: 5883 - DNA, 7347 bp, Oryza sativa
ataagtgttaagcctaacatgatcaccttaatacggaatccttaggttactgaccgttgtttgaagccattgatgcgattctccctgttcttgtcggtgtagaggtagtagtggtagcagtagcagtgtgagcaccggcttgatcccgaaggggtcgccgccgatcacttgcggggtagcggcggccttctggtcgccacctacgctgtcccggaaacaccacacgttctccctccagcgctcaattgatcggatagggtttttgggattttcggggaaaagaaggtcgtgaagagatcgtcatctcaccatgacaccggcctcccctattagtatggcgctgagggagatcgggggtaatccaaaatatggaaagatttggcgctaccgatcaatgcgcataatcacgtaattatggaaattgaatcgcgttaatcccgtaggcaccgggtggaaaacggccatccgagatttcctctcgattttcatgccgagagataaactttcctaacacatatagcatcaaactaggttgtgtttagatcaggggtttggcgtatcacatcaaatatacgggcacgcatttgaagtattaaacatggtctaataataaaagaaattatagaatccgcctataaactgtgagacgaaattattaagcctaattaatctatcattagaaaatatttactgtaacactacattatcagcttaaaacattcatctcgcaatttacatgcaatctgtgcaataagttattttctcatttatatttaatactctatgaatgtgtccaaatattcgatgtgacaaggtataatttttttccagggatctcaacagacccctaatatatgtcgtgctcttggagcgatataatggttctcaacggcagcgccgggccccggctgggaatagcaccgcccagcatctcctcgtctggctggataagaccattcccaacccaagacattaaacatagtttccataaactccacattatcaagtactaaacgctactcttctaatgcaaacaccattattccacacttaaatttaatgctacttatcacacatgatgccttggatgttgtgtagaaatcatgtctcatgcaagacatgatttccttctctttcctcatttattcacttgtcatatcatttttcattctaggtggcagcttatttaatgttatggacaccatcctagtcattgggttgggaatgatctaatagtactagctcagtgcagtgaattgaagtaaccgtacgaactatagctagtacactgatgtctgaacgtggtgatttgtttcaaaattttgctgatattcttcggaattgttatgttcatcaatgttcgtaaaaaaatcatttggtataaaatatctttaaaaaaatcaagttgctaactgcatgagcaaaatgagagaaaattgcacgattactgatgaataaatataggggcaaatgtgcaatagcaagtaagggtataaatgtctttttgccaacaactggacaccatcaacttaaccatccaaagtaggagtaaaatttgacttattccaaacaaatgggggaaaacaaaaatcccaaaaaaacaggagcaaaaccacaattgaatgtgaaaataggggtaagaacaaaattgcccccattatatttttatgtcctcgaactaattagagtgtcataagtattccatattgccatgaccactccacgatcctatgtggcgcttaagtgacatgctacatagacactaaagtgacattccatgtaaacattctggtctcaaattttttttcatctcctccacatttcccttgtcttcttttcttttttctctttttcccacacgaataggaaggaagaagaggagataaaagataaaacaaaatgagtcaatgttcatgtttatctgccatgcgagaggatcctaaatgggtcattgtaatttgggactggaataacacactctcaaaaggttggggacttaaaaaacaatttggacccttcaaatcaatgaatttagggagaaattttataggattcaaatcatataacctcttcgatacaaaggaccggaactttccaaatcctacgaaattactaaggaatggctcattacatatattacatatagattttggagaaaacttagcaaaaacttcaacctcttgaaaaatttcctgagtctattctctcgtcctattcctgtggacaaatcaaacaacgattcatgtgtttttctatattttataatcatttgttttgcacttgtattcctattaaaattatgtgttttttctatttcttcctatttttaatcctgcatttcaaaggagccctcaatgttcgaggacctagacaacacaggcgaacaagtttagggactgttagtgtaatttactttatcgaatatatacgccacctagttggctttttaaagattaggtttaataattcattttattagaaaactatgtgagcataatttattttgttttttttctaaaaccatcattatttattttgtatttatttgttttatcataataggtattttaagtatgccttacttttttcatatttacgccaactttttaataagataaatgattaaacaaattgtttccaaaagttaacagtgtcatactctctattttgatttgaaaataagttgattatttctacctcttaaatatcatcaacccctaaattaaatttttttattttttcaatactttctaattgtccacctatcaatactattttctattaatgaaggatattgtcggagggtaaaactcctttagcgggaagcgtgaacttccccattggagattcggccagagagctagtgagcggaaacaaggcaatggatagaaaaacgagggatgcaagctttattcattgttcgatctccttctgaactttttagagtgaaagcgattatgtgattggagtacagtgagcttgatctgatagccagccaaaaacatttcttctactatagctactctttacaatttgaaaaaaaaagtgtttatcaccaaaaaaataactatgcattacaaccgactcataataatacatgataagagtaaattctttttatgctttcaaactttagtctgtaatacataattttattttaaaatggtattaatagttttcttataatcatccatatcagtggatttagaacaacaaataattgttatgttagcgtcttttttttttcaccacgaagattcaattcacctataataacctcaattaacttggtggctttatgctcccacccactcgctaccactttttttcctttgactgagtgtaacgcacgggcatctttttatactataacatatagatttttcatatctgtatgtcctccgtatgtacgaaagtgatcacgcgatcggtagcgttttcgtggcgatacggcataagtggtgtagatttaaatgtccaaaaactcggcacgatttaaattcagatcgcctcgttaaggtcagatcgtattggccgaccaggttatggttataaaaacacgaatgaagagaacactagcaactaagtaagctcgcatgagtgagctcaccatggaccaagaaatccaactgaaccagaggccatcgccgcagcgacagcaacaagcacaagaacatggcggcgccaccgcaccggcgccggcgccggcgacgccacaagatgatgaacagcaagggcaccaagcagctgtcgccaggcatggctgcggcggcgcgacagccgaacgccaccaccagaccaagctcacgctactcccgctcgtcttcttcatctacttcgaggtggccggcggcccgtacggcgccgagcaggccgtgagcgcggcgggcccgctgttcgcgctgctcggcttcctcgccttccccttcgcgtggggcgtcccggtgtcgctcgtcaccgcagagctcgccgccgcgctcccggggaacggcggcttcgtcgtctgggccgaccgcgccttcggcccgctcgccggctccctgctcggcacgtggaagtacctcagctgcgtcatcaacctcgccgcgttcccggccctcgtcgccgactacctcggccgcgtcgccccggcggtcgccgtcccgggaagcagggcgcgcacgggcacggtgctcggcatgaccgtcttcctctccttcctcaacttgggcggcctaagcattgtcgggtggggcgcggtggccctggggttcgtgtcgctggcgccgttcgtgctgatgacggcgatggcggcgccgaggacgcggccgcggcggtgggcggcgcgggtgcaggtgaaggggaagagagactggaggctcttcttcaacacgctcttctggaacctcaactactgggacagcgcgagcaccatggccggcgaggtggagcggccggagcggacgttcccgcgggcgctcgcggtggcggtggtgctcatcgccgtcagctacctgctgccgctcatggcggcggtcggcgccacggacgcgccgccggaggcgtgggagaacggctacttggctgacgcagcaggtacgtagtacgtgtgtacgtatatacgctgacgcgattacgatattgatgatgtcacagcttcttttatcaacaaacaaaacacacatgatgtctccggcagatcgccgtaccggtaattgtcgccgttgtttattactttatgagttatttactcatcatatgaaaaagatccaaccttacattttcttggtggaagaagtggccattattttctcaattattattatattattatacaaaaattgatgatgttttcgtctaaattttaatacatcatttacatttgagttggttatacgttgctcttatctaattcgacacgagtcagaataactattatacaccccgtcatagcccaacccctcctcgaccctctcagtccaacccaaccggctcacaccatcccgtcaccccatcccacacgcttccacttaaagctgggcgcgttactccccgatcggggtcctttttctctttttttttctttttctttttctcccaatacaaaagacactataattttttaaaaagtatcaatacaaaatgtttttaatattacttaaaatatgtgttcatatatttaaaaaaaatttggcacacgaagtaaacagagccttaatttcctggatagtctgccacaacaggctagccttaacgttggcactgtcagtttccaggataaccggcgtctgaatccattctgctgctagccgaagcccgtttctgcacgcaaacgcttctgcttcctcggcccactgacaactgcgatacatattccatgaagtcaggagcacgtcacccatatgatcgcgaatgacaatgccagttcaatcattcatctattcggctcttcagcgttccattcaattctcaatcttataaaaaaaagaaaggaaaaacaccactctcgacaagatgggttagagcatcaccaatgtatatgtcaaagtgatccatatagatgagacctatataaattgtttttccctatagcaatctccacagtgtatatagatacaaggtatcaatagaagaagagagaggagtagagatagataatataatttattccatatgggtagtccatatgcatatgggtatcttttgttattttttccatatggactagttgcacaatggttatagatggctgaataaaatattctattgcttatgaactacttttacaccacattgtggatgcccttacagcgacgaagcttgtgaggaatctcaagggaccagctacaagtattccactctaccaaaactacaattcactgtacgttgtgtttcccttcaaactttcaacttgtttgtcatataaaatgttttgacagtacatacatggagcattaaatgtagacgaaaaaaaaaaccaattgtacagtttgcatgtaaattgcgagatgaattttttaagactaattacgccatgatttgataatgtggtgctacagtgaatatttgctaatgatagactaattaggtgtaaatatttgctaatgatggactaattaggattaataaattcgtctcactgttcacacacgaaatctgtaattcgatggttcgaatatgtgtttccattatccatacagtatacagtaccagtatatcgcaaatatcaaggcaacaccacagtagagggcaacaaccaacgagtcaatgccaaaatgggtaaagaacaaacagtaaattctactagcacggaactattccttctgttctgaagcgaccctatttgacgctgtatgttagactttttaaaatacttttgaccgttcgtcttattaaaaacttttacgaatattattaaaaaaaacttgaatagtagtagtatatttaacaatgaatcaatgattggaaaagaattaataattacttaatttttttaaaataagatgaatggtcaaacatgtttaaaaaaatcaacagcgtcaaatatttagggacgaagggagtaaatcataaggagtaggggtatatatttttgcatgaccttaaataacatactttgaacattcatttatttcatattatgtcatcgataactataaaattagtatcacataaaagtatttttaaaaatattaatctaatgatataatatacataatacttgactagatattattagtataactagctaggtgggccgcgcaattgcgcgtctagtacccaaataaaatcatatatttttcagtatgattttacttaaaatttattaaatagatatctcgttctcttaagactttaaaagaccaaaccttatcatcctcgtatttctaattatatagtttttaaaagtcacatcagctgctatgctaccccttacttcagtcatatccttctttatttgcttgctcgatctaccactatttctattcattctctttgaaacctttaaaaattggatcatatagttcttagagtttattgtctcattggtttcgtttttataatttttagaaatcccgtcaaacactgcaattatactcctctatgacccatccactgtcttttctctttattgtcattaggattttaaattttgaacataattatcattcgggtttatttttttactttctagaagtcccgccaaaccgtcagcgactttgccattgtactcctttatggcttgtccgctgcctcccttatttattgtcattaagattttaaaatcgaacatgattatcattagattttttttttactttttagaagttctggacctttaaaaattggaccttgtagtttgtagag

SEQ ID NO: 5884 - DNA, 7489 bp, Oryza sativa
cagtttttatatatcgtatcaaccgccaccgctctactcctttataggcctgttacttgaattatctcatcatgtgttttaaggtgatcttttctttcaatagtatttattttttttcacgaattttagttatttataaattgtattcctaattgaaatatttcctattttttttcaaatttcagaatttatttttttcagattttaattaataccatatagtgttcttttaatattttttttaattttagttgtttcaaaattgtattcctacttaaactctcttttagtttttctaattttggatattattttatttttattttgaatattaatcaatctcgtattgggttcttatatagattcttctttcaatattgcttatattaaatttcgaattttaattaattttaaattgtatttctacttgaactcttcttttaattttgctaatttcggattttatttttatttttattccgaatattaattaatctcgtattgggttcttatatggacccttctctcaatattccttatttttaattcatattgaaatttatataaatattcatattgtattttatgtacgtgttagttattaattatttttaatatcaacttttagttatttctaaattatattcctatatggactctagactcgtctttcaatattttttttaaattccatatttccgttatctgtaaattgtatttctatatagactctaggctcttattgcaatattatttatttttaattctgaatttttattatttctaattgtatttctatgtggactctaaactcgtctttcaatattctttaatttttaatttcgaatttcagttacttctaaattgtattcctatattgattttagactcttcttcccatgttttttttaatttcgaattttagttatttgtaaattgtatttttatacaaactctaaactctacttttaattttattatgtttattccgaattttagttagttttaaaacttttattatgtttatttcgaattttagttagttttaaattcctatatggattctatactctacttctaatattccttatttttaattccgattttcagttatttctaaattatatttctatatagactctgtttttttttctccgattaatatgagaatttctagaccgtgggagcgaacatggagacttttttttatttctttaataagttaatagattaggtgcacgaaccgattgccgcatgagatttttgaggttgtgtgcgagctgacaactctgttctgtcatgtaagcgcgttgctcgagtggaccaaacccaccacacattctcaaacccgttagccagagatcaaaatctaacataccctgcatcttaaaatggtttttgttaaaatatacaaggagaaattgaagaattgcggtattatttcagtacagcacgtaaatagtaagaccccttcccactttatatgttgtgcgcaatccgactgggctgggccggagataaatgtgcaattgatggctgatttggcccaaggatagcattatcaacaggaataagttcatatgagatctcttaacttgttagcgaatccgattttcgtccttcaaccggaaaaccggatacaacaattcctcagctgtcaaaaccggtgcaaaataagtccaaggaggtttggatggcgattacagttgatgtagctgctatgtggttaattttactcggtcatcctctaacgtggcattgacatgacgcttacgtggcaatttgatttggaaaataataaaaaccctgggcccacatgtcagtacccaaggggggtgggcgaagcatgcaggggcagcaggcgagagcggcggtggtagacgagagtggtggcggcgaacgagagcggcggcagcagctgctggcgccccgtcgccacccaactccggtgacgcctgccccctgctccgcttcgtgaggagatccacattgacctgctccgcttcccggggcggcgcgaacactacacgagcgtcggccgcgcgtgcccaccattttgcgcgtcatcccctccgcctctcgccgccagcgatgtcatcgtgccagccacctctcttccctctcccacgacaacgacgacatggggccagataaatggaggagcgcgaccggcatcctctcccccctctcccacgacgaccacggtgacatcgacgagaaggcgctggggcagcagggggatgacaccgatgagcaccctgatcccggtgctgccttgtcgccccgccacccctgcctgcttcgcctgccacacgctcgctcgtcgtgctcgcccgctgcccctgcttgcttcgcccgtcgtgcgcttgcccgccgccgccgccatatacatgtgggccccgcatactttattttttttttatttttctgactgggatgccacgtcagcgaaatcaggtgtctatactcttatagacctaaattggacgcttttatacagtctagggatgaagatttttgatattgaggataagggatgtaaaaaaaaaaactcggtgtaaagttgagggacggacttattccccgtaaaatatgaacatgttaggctcgatttaatctcagcccagcccatgtaagttttacagattggccgtctgatttgacgtgattttcgatgcaggcatcatcggcgggcggtggctcaagtactggacggaggccggcgcggtgctctcctccgtcgggttgttcgaagcgcagctgagcagcggcgcgttccagctcctcggcatggcggagctgggcctcctcccctccgtcttcgcccgccgcggccccggacgatccgccaccccgtgggtcgccgtcgccgcctccgccgccgtctcggtcgccgtctccttcctcggcttcgacgacgtcgtcgccaccgccaacctgctctacagcctcggcgcgctgctcgagttcgccgccttcctccggctccgcgcgagggaggagagcccctcctcgctcaagcgcccctaccgcgtcccgctgccgctccccgcgctcgccgccatgtgcctcgtgccgtcggcgttcctggcgtacgtggtcgccgtcgccgggtggagggtctccgccgtcgccgccgcgctcacggccctcggcgtcggctggcacggcgccatgagggtgtgcaggtccaggaagtggctcaggttcaacaccgcggttgccgccgaccatcgtctgcaactacaagatgctcctcctcctcctgctggtagagtctgaactctgaacccgttttggcagatttcgtcttgcgaaaagatgaaacacggtaagaaactcgaaatatttgctagtagaagactaattacaagctatactagtacaagactaattacatggttggatgaagctctaaagttggcgttttcatatttgttcctctaattaatcaccgtgtacgattgtggttcattatcagagacgcggtttaaattgaacggtctgtctctctcaaatctgaaatggtcacatttgtagtgaagtggacatccatgaaatggcgacaaggaggcggacatgatcatattcatatccacgtactaacccagctcctcttttgtggcacacgcggctccacactacaaacctccgttccgcgccacaaactgcaaccaccacacatgctccatcgcccgtagtcatcctacaaaccaatagacaccgcgcgcgcggaacgccatcgctgccacatctcatggacgacgtgtggccgtggctggccggcctggccggcgaggagccgccgccgccgcaggccgttgtcgcccttgccgccttcgctgacggcaccacgtccattgtcctgcaggccgaccacgtcgcattggctgaaggtgatgaggaagagaagactctagtagatttctctctcgccttgaacagcaccaatggcggcgcagcgcgcgtgctgtggacgtcgggtcgatttgaggccgcctccggtgtcgcgttgcagcggcagctgctggcgaggctgctcgacgaggtgatcacgctctcgccgtccgtctcttgcttgagcggaaacctcggactcggagtcggcggcgcaccgaagtcgaagttggacgaggagatcgtcgccggcatcgggaatgattctgccgcctcattcttctcgctgactctccttctgcgcctcttctggctgtgcgccaccgaggcacccgccgacaccgggtttctcttcttccaagctctcggcgccgacatccagcgcgctctcgtggactgccgcccagcgctcgccctgttcctggcctccctcggcccggacgtcgaggagcggttcatgcggtcgctcggctacacgctcgccaagctgtgcttgctacgggagatgcaagcggatgcggatcagccggcgccggcggcgacacggcgcccgcgcgcgctccccgcggtgtgcctgtcgtacgccaccgaggtgcacgggctgtgggttctgagaggatacgcgccggtgctcgccatgccccgtgtcacctgcgcggcatcgacgacggcgcccatcacggcgctgccgcacgaggcgccggaggagccggcgctgaggtacggcctggtgcaccagcagctggaggtcgtggcgcagctggagtacgccgtgcgcgctcgccgcggcgagaggttcatgaccgtcgccgtgcgcgtcgacaacgtccgggtacgcgtcgcgcggctcgggttccggagggacgacgcggacgctgacgccgacggtggcgacgctcacgacgacgccatggacggcgagcgccatttcccgtcccgtctccgcctctgggtcggccctaggttcggcgcgtcgtacgcgaccggcccgagcctcggccggtcgacggggaacccggagcaggacgtcgagacgacgcgcaccgtcaagggcgccttcgccgccgccggcgccacgaagctagccaacggcggcgtccctccgaggatcaaggccaagacgcggtcgtcggcccgggcacgcaaccggagctggcggtgggagcaggaggcggagggcagcgccggcgtgttcgagggcgtgctgtgcgacccggccaccggcacggagatctcggcgtggcgcggcgacaacaacaacaacaatggcggcgccggtgacccgcgcaacgggatgcggcggcggtacggcgggccgggcagggcgttcagcaagatgcgggggctggtggtggccggcgacgagctgcccgaggaggtgacgtggagggtggggagggaggcggaggggagaacgctgccgtggcgcgtggggctcaaggcctggttgacctaccttcccaaccaggtgaggagccaccatttcgagacgaggtgcgtcgagtgggcacacgaggtcgacctcccgcttgccgccgttaatggcgacgagaggtaaaaaaaaaaaaagaaaatctctctttatatcacctatgaacacatactagccaaaagaaatgaaatgatcttatgcacgtattgtgtatatgaaatgaacagctaaaataagaggttaagaatctaaattcagatgctgtccatttgcaccgatttttctttttttttcttttttttttcgcagggcatttgcaccgactttaagatagatcatcttaatacctgatcggagaccaaatcgtaatggatgcaaaactatttctataagggcacaactattataccgccgtaatggtataaccccccatttcaaatgctcatgcgtccactcactctcccactccatgcgagcacgcaactcccgacacgtgagcgcctgacacacgccatatgcatccattatgtgtcaagccatcttgatatgtatttatcgggctgaacctactagtcaagtttggttggttctagagaccaaagggtgggaggtttcgactccattcggctgggctagttcggttgttccatctagctcttttctcattatcaagttctcaccacacatatattcatagtcttgaccagtacatgtctatgatacttaattgatgcttaaaagtatcatcacatatataccttccaaatggtactcgtgtcgagcgatactagtcggcatcagacatcatcccctgatacatatcgataccaagactatactaatcagcactaggtccgataacgtttagtaccactctttgtaccctctattggtaccaggccggtattaggggcctgtttggtagagctctaactcctaaatttatctccaggagttgggtctaaagtggagttgtagagctacctaaacctaactccatctctctagttcattttgtgagagacctccacccaagcccactcccattttaggtggagctgaaactgtttggctgagctccagctccagaagaggtggagctggagttggagctgtgacaaacaggccctaggtctaatacccatcgatgctacacatggtactcctgatacccatcggtactaagctaataccgatcggtactaggtagagtatattggtcagtacaaacttgttacccttattagtaccatgtcgatatcgggtctgatactcgtcgataccagagttactactcctgatacccgtcggtacctatgtgataccaattggacccagtctaataccaatcaatacaagacttagtagccctgatacccggtgatatcagactaatacatgtacgtataaggtttgatacatatgtactagcctaatatttgtacgatattaggtcctatatcttaggacaaagatatgaacctgggatcggaaataatatgtatataccaattgaaaaaaaagaagaaatgaactctatatagcaaaagaagtgaagaaaaatgttcacttttacacttgacaccacttaagaaaagagtatataaattaaaaagtactagctataataagttggcaagaaggtcactaagctcagtcttatcgcatgattagggtaatggttttattttttccgacatctttctcttttcttctcattttgttttgccgccccaacatctgcagtgaacagttagacagccatagagtaggctgatcgatagttgcacgttctgacacatgtcatctgtaccgaaccacgtgcaaagttactaaccatatatagacttgtgtacccacgaagtctgtatgcaagaaggaatataattccataagctcatgtagtttcttacattaaacttttacagtcagtctaaaagcaagtttaataatattgtcaactaatatctttaaaagttaacacatatcatctacagccaacctaatagtatgttcactcatcaatagttagttgcaggcccggccacaggagaggagggggagggggttgagctatgccaccgcacagggcccacaaagtgaaggggcccaaccccatatatgctgtatataatagcccatagaaattaggaagcctat

SEQ ID NO: 5885 - DNA, 817 bp, Oryza sativa
acagaagaagtttgcctcgcggtcacataaagcctgcgccctgtggcctgtgacatcccgtctccataggagctgaggattatactgacccctttcggtataacgaatcggataatcatttgctcagattcgtggtactgggagaaaacatatcttttactaggtcagaaaccaatgatccaagaatatccaaaatgaatgctctagtgtaatgctcaatttgccttttttcattgcattatctggcatcaacttgaactgatcccgtaatttttttaagctgatggagtagttagaacatgtcatcatcccgtaacttccaagtcaccatcagctgcctttcgcttttttttgcttcatcacatgttttactggagtaattccttgtaaggtctcaatttcatcaatcgatggaccctctgacttgcctatgataggctcaacttaaattgataagcccatagacaactcacatcttgcaggacgccatcattctactaatgctccaattagaaatctgtctatactcattccaaccatctgagcaacttgataaaatctaagcctcttcaatagctgctcacataaataatagtatggaatgtcaacatggtgatacctgacacttgcaccatcattatcctacatacatagggtaaaaattagtcaatcattctttttttggaaacaagtatatgaaacaagctaacgacaacttacattttcccaaactattgagattttgtactggcagtggggcatccacagcagtgcactgaaatgttctgaaacacttttttcagtttgctgaactaaa

SEQ ID NO: 5886 - DNA, 7629 bp, Oryza sativa
  unsure (1)..(7629): unsure at all n locations
gatttggtatctcatagtacctaggtatcaaaatgtaccaaattgtagtaattcacgttacattctcaataaccgtaaaattatttactactaataattgttttagcttaggaaattgttttggatcattcatggtcaacccaataagacgcggacacttggcttcaagactagcctagttcgtgtcgctctgccgatgacaccaggcagcggtgatcgatcagatcaccggctgggtccggcgaattcaagtccatcttcttcttcttcttctttcttcgatgtgtgtcgtgtcgcatctcaattattttccctgcttaatttcttcatgacgtcgccatgtaggactagtagggttgtttggtgagtatacggttccatctctcgaagcatctccaaggctacaatgtatggcccggccgacctcagataacgcagcatccgtattatgaatattgctgtgtttgttctgttctgttctgaattctgatccaacaacgtcccaactaccggacttattcagaggacatggaacttctcgctgaatcggctggaaattccatatccggacatgctttcttttcagattcgttgtactatgaagtatatgtcctattcgatactaggttgctatattactaagtagaaaatcatcaaaacaatgcatggggctggttgacatgtattgttcttatagagttggcatgtaattgctaagggttgtgtgaacaatgatggagaatttgataggaacttttttgtaggattttattatattgtagtcttttccttgcaagtcctttagctttgcttgcactttgcaagaggcactttcttttgggtattcttcttcttttttgcaagggggtattgccccattttcttttgggaattttgtgctttagttcatgaggatctggaaacaggtcatttttcccctgactccaaaatgagcatgcaatgatgcaagcgtccaattgcaaatactttctataatcttctggaattctctgatggtattgctaggttcaacaggtccaagaggtgcatcaagaagttgcccttcctgtagcaccatctatcatcaatgatgttggacagaagatggcggggaaccatacttttgctcatctgtcttgtctgcaatgcatcaggtatgtgcactctgtagtagcaaaagtagcattatcatttactaattagtactccgtatcagttgttctcttgttagtttttgcttcagtttcagttaacaacagaaccaggttcctttctcactttctttttcatcactgagattctttacaaaaaaaatgaacatacatgcctaaagtgcagaacattataggagacttttaagctagtacaaagttttctgatatgcttgtgcttttccccactttgcatgccttatcttcagtcacaaaaagcatacgccatacatgtgacatctagaaacttatcagttatctcatgcttaagaaatagtagaatggtgcgaataatatatacttagccaatgatttgtttgatacaacccaaatcatatcagtcagctgtgagaaaacaaacattcaaatactgaacactctgaaacctgaactgtagccagttctgatctttcatgcagcaggtcatgttttctttccctgatgacagcaaatgattccagggcttcatgatctaacactcttaatctaacaagagtactatcattctatgcattatttgtatgaactatgaagtgcacaaccatcatgtactacaaccaagtaccaacatggattaacaggattaagtactagtctgaaccaactgtactttcatatctttctgcacttcgtcagtaatcagatattcagaattcaaaaccatctgttgtgtttgcctgtcttacactaaaattttctgctccaatcaattactaacatggattaacaggataagtagactagactgaaccaactgaacttttatctttctgcacttcgtcactaatcagaaattcagaaatcacctgttgtgtttgcctgttctacactaaattttctgctccaatgatgagcagggacttatgttggcgccaacacgatcccttcgccggagaactcgccgtcggagttcgccaagattgttcagtctaagcagacgaagcatgcgcgcgtgttcatcggcggcggggaccatcggtcgctgcgatcgctggcgaacaccggcgaggaggtgatcctcaccgtgcccaacgaccagctcgagcacatggccgagttcccggaggaggccgagctctgggtcgccgccaacgtcgcgcggttcctcccggcgacgaggatcacgcacgtggtggccggcgacgacgttgtggccaggtcaccggggaacgcgtacttcctcctcccggcgatggccaacctccacgccgcgctcgccgcgtcgcgcctcgacggccgcgtgaaggtgtcgagcgcggtgtccggcgccgcgctgcaggctcccccggcgtgggccgccgccgccgtggcgggcggcctcctccggttcctgaacgccaccggcgcgccgctgttcctcaagacccggccgtcggagtccacggacaccatggtcgacgcggcctacggcgcgatgcgcgcgctggggttccccgggggcgccatcccggtgatcgcggcgccggtggagacagaagaattcggcggtggcgcgacgacggtggtgtaccacagctacctgctgcaggcctccggcggcgtcggcggcggcgagaggcggtcgctggcgacgtcggcggggatgttctgcgtggcgctgcagaacgcggacgcggcggcgctgcaggcggggctgaactgggcgtgcgggcccgggcaggcggactgcgcggcgatccagcccggcggcgcgtgctacaagcagaacaacctgccggcgctggcgtcctacgcctacaacgactactaccagaagatggcgtccaccggcgccacctgctccttcaatggcaccgccaccaccaccaccgccgatcccagtaagctccatttcttctgtaatacggagtatttcactccctcctcggtcactgaatttttgctgaatttaatttttttcttcttcttttgaatactctcaggctcaggatcatgcgtcttcacaggaaggtgagtgagctcaaatgtggaaattcttgaacaaatcagccacatattacattcatacgagagtaaattttactttagacatgttttattgccgatatttcatattcgtcaatgaacttcaatagctatatgtaaccaccatttttcagcatataataaattggatatagattgataaaagagttgaaaatgatctagagtatcataaagataaaaatgttaaatgtttaaaggatagctgaaaacgaaacgtgaataataaaagattgtttgaaatttagcttttcaaattagcaatgcaagaatgcgacaaggataaatatcatatttatttctgtttactttgtgcagctcgatggcaggaggctcgaacacgagcgtgccgggagccagccctccgacgacgctctccccaccggcgggcctcacgccgccggtcggcaccagcccaccgaccgactcagcccgccggcggccggcacgacccctccggccggcggcttcaccccgccggcgggcggcttcggcaccccgccgctgggcgggttcggcacgccgccgtcggggttcggcccgccggggagcttcaacgggagcggctcgtcgttcgggcccagcagcgccttcagcccgtacggcggcgccggccaccgcgacggcggcgcctccggcgctcgcctcgccgccgctgccctcgcgtgctgctcctgtccgtcgatctcatgtgaagttcgtttctatttgtgtaaatttgggaatcatgcgttgtgatgttgctctgagaaattgctggtctctgtaggcggcggattgaaattatgcatacgaaaaattaggagtttatatatatatatgtaattatgcatgtatagtatatatacttgatcagcatggacattatctaaaaaaatatgtgctagtcagtcgctgacaatttctgttcttcgacctgtcagttaatggttatacatgtacatgccactagcctcacgcatggttgagttggatctggaaaaaaacaatctttacatgatactgaattggcgatacaaatatacaattgatcccgcatttgaatatatgttccataacatctcaaaattccactaaatacatagtacagtacaagtatttcttccatgtttcatattttccagatgaactctgtccaaaatggttcagagttcagtgcaggaggagcatcttgaagttgtagatgatggtcagcggcaaccacggtgttgaacatgaggcactgcttggacctaggagcagagcaccgccatggacaagccaacggagcagagcaccgcaccggcctccccttacaatgattgagccagcaccctcgatgatgcctgcaacaaaattctcattaattctgggagcccacctgtaaatttgcatgagctgagcatgtccatgttagatcagtgttgggcctgtatttagaggctctcgtggcatgtttgccataaggaagaagtccactttacattcgtcgtgtaagggttgagtttcaatcacgttgtcaactctaaagccgaatacaacacatctatcatctttacaacaagtgtaaatataattttaaggcaatattgaggttggtgttagctggcgcggcgctcacgtgacgtattcactagttctttgtgccatgtagcgtttacgtggtacttaccgttagaaaaaaaaataacgataggacccacatgggcaatcgatcacactccttctaccttgcccacccccacggaggcgagtttgccgctgccttgctcctctcctgctaggtgtcgcccctatcctcgccgcctgccttcctagagacaaagaggaagataggggagatgtagagagagatgggaagaaaggggaagaagaagacccctcacaggtgagccccacgtggatcttaccatatttttttttctaaccataagtgccacataaattcctcatgggacgagaacttagttaatacgtcaggtgaacgccgatatcaaccaaaatcagcctcagtaatgccttgagactatatttatactaattttaaaagatgagagattgttatacctagtataacggttgagggatgcaactgaaactcgaccctaaggtgaggtatgtaaagtagacctgatatagttggcccaaaccagacatcaattgcacatttatctaagggcataccaagagattatgaataatctcctcctaaaaatttgtttttggtttcctaaactaaaaatagaaataaataaactgatatcttcaagagaaacctaattanattttataaaaaaaactaaaagtggaccgttctgttaaactatagatagaattctcgtgcagaatagatcacgctcctccctcacatgtgagagacgagtcgaaggggagcgctttctctcccctaaatcaacggagcgagaaataagggaagagaactccaaaaaactccaaaacgtgtgttggactataggggatttgatcaaaattttcacctaaaatccctcaaaatcagttttgggaaggtgatactttaagagccattttctatcaaatcttttgtgatactgagttgaaataaaactcttataattgtatatgccttagatacatgggggagacagagagtgacaattattttcaatgtaatatcatcaccatttgcatgagtggatctggctcgataaatttggtgcaaattttaatccattgtgtagtgttgcatggcaaatcggcttggcaggactatatgctaatttgacttacattgatgtagctttaggctttcgaggttattttttcttttcacaaaagaggtataacttacagactctgcgagagcatataattcaatttatggatatagtcggattttaatcatgatgagttaagttatgtatgcacaactctaccaatgcacaatgatgttggcaaccgaaccaggcaggagaagtcaaccctacgagtgccatctttgagtgacttcgattatttgacactcatgaactctgaattgtttttattttatcacttcttctaacacagcatgataagtatgcaattcggggaaattgactctcttgcccatttttccacttttttggacatagttcatgcgggaggagacgaattggcaacaactaatggacggtgacggcaccaacctccttctctgatgacgagccatcgccgctgccaccaccaacgcagagcaccacatagcgagttggctgcctctccttgccagagccagccgcgacgagcccgagggcttcatattagtctgctattgagctcgaagatgccagatctaccctgaccacctcaactgtgcctccacttcaggtgctctattcctccatctccccaccgttgcccatcttttccctccccacgctgcaggggtgatcttgctgctctcgcaaagcaccatgacgaggtggacgtagcatgcatgatcttcacctcgcaccacatgtcctcagcattgccatcaccttttggtggatcatctggtaggctagggtagcgctagtatgcatgttgaggtagcactgtgttaccccgaagtcctgaactcctcgccgaaaactgctccacgaaccccgctgccatcttgttggtggtttttgttcttctagcgctgctcgccaccattgtcgtcatcgtcgaagattgggttagagtacctatggagagtgagaaggcagcgatggggattaggaggatctgcgtatgaagggcaggggtagcatggttattttttgttcggtgcgacagggctcatgtgatgtgacagtgatgtagtatattgtgttcaaaatgacatgagagcattggctgtggtgtctcgatgggaaaaaaaatcaaagtcgaccaggagagcaaccatttgacagtgtggtattgaagcagctagcaaatagtataaatctcacatgttcggtttgatatcgcttgctaacaccaaacaatgtgggactcatgccatgtgtgcaatttttttaatgaaccagtgcaaagcatgctaatttcattgaataaacggaaaatactatacttatacagggttttaaaagaaaagctatgctaagacgttaagtcatatagactttttactcctgcaagggctgaatgtcatgtgcagttaaccgattaaaaaaaatcccatctctttccattcttaaccttctcactcaggcccaaacatgtaaactggctcttccgccgataacacaaggcaacactccagcgcttctatctcggtggcttccacctcgcacagtcgcactataacgtctcctagggcccctccatctcaggtgacgttgcctcttcgctgctagcctccaccatgcacttggccaccgcctcctctccggcggcctttgcctcatgtggcaccacctctgcttcgccgttgctgcctcgcagtccagccaccacaaaggct

SEQ ID NO: 5887 - DNA, 1915 bp, Oryza sativa
acagtaatcatccgttaatcatagattaatatacctggttagattcgtctcgtaaaatagcctaggggttatggaattgattttgtcagtaatttacgtttaatactcctaaataataagatttcggagggctatttaatagcccgaaggatccaaacaaggcccatgtcactaagcataaaccataaagctccaagaagatattatgcaagacactgtaacaccaatacttttcagggcttaaatgatgcttaacatgagtgctaaacgtattaattaaagaccatttcttttcattccttagctggttgttgttgttgtcacttcatgagtgtccacttcactacaaatgtgaccgtacgagagagacagttcaatttaaaccgcgtctctgataatgaacctcaatatatggggtgatgagaagaagcacgcgtttcttctctgcacgtatatgtgatgattggccaagagaggcctggcctcgatcgatccttttttatttttaacgaaatcggcaagctactaattttcattgaatagagaagtgaaaattatacaaaaagtaagtaattaaaagttttgaggcctcggccctagcggccaaaaaaggttacactttcagccatgcggcaaggtgtctcgtgcccgcgaggctccacgtttttgcttcttccttttatcttggagagtatatttaaggccgacatctctttgtgttggaagatcctctggttcctctcattccaaatttcccatccgaccaacaaggttagcatatgtagtgcttttttcagcgcttctcttgtattaaccgtggcctcccaccactcatgtaccatcgaggccggctcccaaagcgacgggcttagatggtcgcagtccatccatcgtgcaatctcctcccagattcttctcatgtatctacatccttctagtaggcgaagggccgtctcctgagtctgacaatagagtgggcatgtggagccatttggccatcctctggttgttagtctgtctgagatccaaactctgttttggaggaccaactagacaaatgtcttgcacttgcgtggcgcctggcctcgatcgatcgaataaagaagacatgatgttattcaaagcgtcatgggtgccatttcagagacactggtagctagttttttttatcagtagttaggcctaccacgggaagggtattgggtaacccatatccatacctaattttatctgtctccatctaaaaaaaatatgacccatacctaaattaagtgggtatacccaatggtatgggtaacccaatgataagagaagagacatatgtgggctccacatgtagaaatggatcaaaatttgtacaaagttgctctttaatataataaatcatccctccaaattccagtcaaatttgataagattttgtaatgtgagttcgagtttaaaaattttaggtccgaattttacaccatagcaaatgggtacggatgaagtgggtaaaatgggtaatatcttccccatattcaaaatttaaattggtaattcttttacccataccctacccaaataaatgtgtatgggtatggggatgggtactgaatacccagtggcaggctgatctgtatagtgcgtgtcacctgcttggtgttccatgcctccatggtaatgtgttgccgtttcatgagtgttcacttcgctacaaatgtgaccctattggagataaaaagagagcccttcctttctttttttccccaggctagaatggaaagatgctgcttgattgattcttctaaaccatcctgttcatgcttgcgcaaatcagaaaatgtcacttcagagcttcatccaaccctgtatacaggggtgaagacagctatagaaggctaaagctgctggatcgtttttacgatgagatcgg

SEQ ID NO: 5888 - DNA, 4695 bp, Oryza sativa
  unsure (1)..(4695): unsure at all n locations
cacaagccagcattatacgtgccggaatagcgaaaaccgacgcctagtattttctcaccttcataggctgaaaataaaaaaaaccaatacctttaaacgactataggtactagttcttgagaaaaaccaacacctatactataggtgtcagtgtaaaaaaaccaacatctttaatatattataggtgttggttaattaaaaaccgacactaaaaaaaccgaaccattccggatctaactctttttagcgcggaagccaagaggggggggggggcttatccactcaccccctcctctcggccgtctctctctctctctctctctccagctctcgagctctcctcccctctctaccagttccctctcttgtcctgccccctcctctctcgcctccttcgccatcggcggatcccggagagtcgatggcattggcgggtcccgtgggccggatctgacgggcctttacccttttccctttcatccctaagcttctctcgcgggcagatccagcaaaggcagcggcgatggcggtttcgatagttttctaaccctctccctttccccttctacccctaatcttttcccacggtagcgatgatggcatcggtgctcccacggccggatctagcggtggcgcttccgacagatggatccgacggtcctctaccccctcctcctccgtccncaagcttttcccgcaactgcagagatggcatcagtgctcccgtgggtggatccgacggaggtgtttccggcgggcagatccggtagcggatccggatctgccccaagcttctcctgtagcggatccggtggcggtgcaatgccgacggctcccgtgggcggatccagcttgattgttgttgtgttgttgcgatgatgttgttgttgtgttgctgtgatactgaccgatggattgattttggggggcgaagtagggggaatgtgctcggtgatgatgtattgagcatttttttttcatcccggaaaccttaaaggtactggcacctttgaggagactcaatggtgccgccttctaagtgtaggttgggaaatccgacacctattgccgcttcccaactggcaccaaaggtttttctgcagtagtgttgacacttcgttcttcaacatgcctcttatacatgtacatggtgatgagtgacaatccttgcatagatttgaattggcagtgatttaccttgtatttgaatacatgttccatataacattgtgataccacctgagattgaatgactcaacaatgattagattgatagaaatgtggagtacatatataagcgtaatccttcattatccacttacagcaagaaatatcgggaggatcggctaagcaaaacacgggtacatgccatatacaagtgaaacactaccattttcttccatttttcatgttttgcaagatgaactgtgccaaaaatgggttcagagttcagactctgtccgccgcaggaggatcatcttgtagttgcagatgagggccggcagcaacgacggtgttaaacccgagccacttcttggacctgcacaccctcatgacgccgtgccatcccacgccaagggcggtgagcccagcggcgatggcggagaccctccacccggcgacggcgatcacgtacgccaggaacgccgacggcacgaggcacatggcggcgagcgccgggagcgggagcgggacacggtaggggcgcttgagcgccgcagcgtgcctcccgcggcagcggagccagaggaaggcggcgaactcgagcagcgtgccgaggctgtaaagcaggttggcggtggcgacgacttcgtcaaagcctaggaaggagaccgcgaccgaaactgctgcggaggctgcgacggcgacccacggggtggcggatcgtcctgggccgctgcgggcgaagaccgaggggaggaggcccagctccgccatgccgaggagctggaacgcgccgctgctcagctgcgcttcgaacaacccgacggaggagagcaccgcgccggcctccgtccagtacttgagccaccgcccgccgatgatgcctgcataaaataaatctcttagaaatcagggttttaaatttagaaattgctatttctgctgggggcaccgaaattttagaaattttaaatttttttggccgaaattatttaaaattttgactgattttgaatgaatttgaataatatttggtcaaattctcaaaaatatgcagaaaaacaaaaaattccatgcgagatatgagcttgctggtgggggggggggatttcagaaattttgaaacgaaatttcaaaccctacttgaaataaggttgtcgtatgttctgtaaaaacttctttgggcaatgcgtgtcaccctgtccatattcgttgacgctggatttgaaacacgttgggtggagtcatgtacagatgattacaccaccacactgatgcttcttttaaagcacgatattagtttgaataatttgtccttaatcttttgtgtagaaagagttacaaaagtggaacacgataaatcttcatattaggataaacttgaatatctatttgtttatatgcaaaacctgatcaagttaaattgtggtagttacacacgaaactgctattcggtgaccagtcgtgcgcgcctctctccgcgcgactggacacgtgtcacgtgcggagaggggcgccggacagcgcgccgcgcgggaggagctccgtgttttcccttttttttttcttttcggtttctctttttttttctttcgtatttttttcggtttcgtttttctttttttctttccgtatttttttcgtttttaatacgtatgtatgcaaactttgtatacgtaaaaatataaactttgtatacgcatgtataaagtttgtatacacgtatgcaagctttgtatatgcgtatataaggtttgtatatatgtatacaaactttgtatatgtgtattattttgggttttatatgtacatatacaattttatatacatgtatacaaagtttgtatacacatatataaagtttgtgtacatatattttttttaggttttttatacatacgtatacaaattttgtatacacgtacataaagtttatatgcatatatataaagtttatatacacatattttttaggttttttaatgtgtatatatttttttatagtagtagtactaatagtagtaataatagactagtagtagtaatagattagtagtaaaaggtactagcagtagtcgtgtgcggccccaggcgcgcgattagtcgcacattaggcgcccccagttacacatccttaataatgttcttttatgattgaggttatttatgagaggtagtaatcaagaaaagaatttatgatgcatgtataaataaaaaaaacgtactacctctattctaaaacatagcaatatattggatatatctaagtgctataaatcttaacatatcgatccatgtttagatttattagttttataatattagaatatatcatatctatatttagaatagagacagtaatatactgctagctttatatcatccgaccatgatctatatttatgcttacttttgtctgttttggtagctgtgtgcttgtttgtttcataaccgatctaggcattggttttgcttcggcatgttggtgttgttgctgatcttattgttctcttgccttggcttttgcgataccggaacagacaaggcattgtaagtagctttggtagagcggaacagatatgcaactgccccttgagatttctcaaaactcactagcagctttgtcactgctataacccattttgttcagacagaggtgctgtgtgtgggtcaaggatatgtgtattacaatatcaaaattgatcctaaatgcctgtacaatgatagatgctactactctgttttctattattaagaatattttgtttcattagaaaaaaactttaattaacaatatatttaccaataatataatttatgtgatacaaaagcataattataagtaagtacttctgaatataaatccatctatctaataggggatacaaatttgtaaatttgtcacctaaaatcgcacattgataataattctaaaattgcagtagtatgcaatgtgtaattttactccttttaactataattttgttgtcatatttagctttacattatttttatttaggtttgaatattttttatataatttgtaaagtttatgaattgtaaatttatttcatatattgttatgtttaaatatgttattcaacctttttagaagaaaaaaaaggaagaagcaatgagaatcactgattaccatcaaaggtagaaaaaagtgacaaaaatctagacgtacgctcccaatgtaataagatcaattttacgccataaaaattatatcataataaagtagtgttgtcctaaccaaaacaaagtatggcatacagttttcaatgaaggatgtactatattaggtttttttttttttgaagttatatagagcgaaaagaatagaggatcgatcggctcactatagtggagaaactttgaggggagacatattacaacgaaatagagggtgacacatgctttaatttgcactggtactaccatctttcttgaatcaggcaagtaatcgattttccttttcctagttctttacatagcaaatttttttaacaatggacaattacatat

SEQ ID NO: 5889 - DNA, 708 bp, Oryza sativa
tttcattgttgttaaatgataaaacatgattaatattttatgtgtgacttgtctttttaattttttttataatttttttcaaataagacggacggttaaacgttgggcacggaaaccagggtttgtcttttttttgggacggagggagtatgttttagaggacaatgactgaaatatgagcaacagccatcgtagcaaatgcttttaagctaactaggaaagtagcccgcgcacatgcgcgagcacctagattatataatttagtgttgcttgaaattttattatgaatgtttatgtgtaggtgacttttcttaaatattttatcaataatttgttttgaattggttttttctacttacccctccaacattttgattctaaaccaaaattactttgaaaccgtactatcatttgctcatatgaaactatcatttgtactacgcgtgtttcttcttgttttttaatatgtagcacatcttattttgggaatttctaaacttcaagtaacaaattttattatatattatagatatctttatggattttacgatatattactcgatgatattttttattaaaaatatggccagtaggattgtttcatctcattaaagacatacttctactcacttctccttttatttcataagctttattattttctttggaaataaatttaatttgcaataagagcgcaatcatactgat

SEQ ID NO: 5890 - DNA, 3171 bp, Oryza sativa
tgttccgactaccaacaggacaacaggcaagcaaaagtacacaacacaacggtggattttcagcatttcaaaaataatttctgaacatagccattttgagaggaaaaaacagagacacaaacttaattggaactaaagactagataatgggaactaatgaagaaacttattcgcaattctcagctggaatatcaaagttctccacgtgatgcagaggcaaacaagatcagatagatgaactctcatgatgaggatgcaatcaggtgcttagatcttgtcaagcgcctgaacaacgtcattcttcaaatcctcaaaatcctccactccaatgctgaacctgatcaagttgtccttgattccatagatttctctctgctcctttgaatccctgtaatgattcataactcagcaacatgttctttttgattgattgattatctgaatgtgacaaaatatgaacagtccataccagtaagacatgatggcaggctgatcaataatgctctcacagcccccaaatgatggggcatgatagggtatcttaacagaatcaataaatctcctagtagcatcaaagtctccagcaacctgcacagacaaggtattttagaaatttaaatgggtggtgttatatccacaggtgagatgagaattaaagagaagaaagtacctcaaaactaatgacaccaccaaagccggtcatctgactcttggcaatgtgatgttctgggtgacttggcagaccaggatagtagacacgtgcaatctaaggataggaaataagagactcagaaaaaacaacacaacaaaaagaactactcgtagcttcatagcttgtacaacaaatgaaaagtgcagagtttgcaaacctttggatgttcctctaaaaattgggccatccgcattgcagtattattctgacattgtacacggagatgcagtgtcttcatgcctcgaagaatcaagtaggcagcattctggtatcataatggcatgaaaagttaagagacaagagaccagaatattcatcaacagtataacatacagaaatagaatgcaaagacattcacaacttcaattcaaatcgctttcagacattcacagctgcagatcatctattatagtgtgttatctatttctgtacaattgacgattttaattacagaattacctaacaagggctatcactacctctagtcaatgcaaacgagagagatattttaccagcccaaactcaccggatttagaacaccaccaactacatggtgatagatgcggactttggaaactagctcatctctgccactgatgcagcctccaataacctaaaaaacaaaatattcttgtcaaggcaatctatatgtgtaatgagtacaggaagtttggtccaaacacttacatcattgtgcccagcaatgtactttgttgctgaatggataactaagtcagcacctagagttagtgccttctgattgattggggatgcaaaggtactatcaatacaaagcaatgctcccttgctatggcacatttttgagacaagatcaatgtcgatgcatctcagaaatggattagtaggagtctcggtgaagaatagggatacctgagtagaggtcacggataaatttttggttaataaataggcatatgatagcattagaggaaaaggaaatagtacaaagatcacactcacattattattatccagtgcattttggagagcatccatgtcagcaggtctaataacggtcatctggacacaaaattgtgtcataagataagcaacaaattgtaaacatttatgtataaacaaatggaacaaagatcataggcatattccaaacaccgtattctgcagaacataaatatttaatatgcacttccaagatactggaaatttgaaagcaactatgaaatcattatacatttttggcttctacaaattgatggaaagccaatctcaaatagtaactgcagaatcaagtgtgtgcacacgcacgcacgcaaaaagtaccggtataattataaatgcctctatctggctctcacaggaatctgtacagattactaaagtagcaatgattgagtggtggtggacaaaagaatgcgagttatgttggattagtttattatacaacataaaattgaacttagaaagatgacaggtaattgctgtgccaattaacacaggaaatagtagcctccatgtccaaatataatattttaagtagatcataaaatttaaaatttgtaagccttctgctactatagaacaatgacaagtcacatcaactacaagaaaaactccattgaaagttacatatgcattactgcaaacaagaataataagatcagattaccgtaattcccctcttaggtagttcagtctccatgtaaattctcgtcttgcggtaacaatcagtggtggtcacaacgtgcccacctgctggaacaagcgcgctgagcatagccacacttgcatacatcccggatgccacaaagacagtggactcggctttctccagtgcactgaaacatcgaagtagagcaatcaaaatcccatccactaaaaccaacacagcatcaagcattcccacttccaattagcagaaccattcatttcaagaagaaaatattacaccagcaacaaaggggaaacatcacctcatcttcttctccaatgcctcagtggtcgggttaccatacctcccatactcgaagctagcatgcctcccctcctgagagaagaggaaatttttaacatttgcaaaaagggcatctaccaaatcgatttgtaggagtaattgcaaccccccaactatttacgaaagatcgccaatcatttctaaccttgaagtcaatgagctcctgcgagttgttgaaccagtaggccgaggtgttcactactggcgtggtgatcgcgtctgtggcgatccttctgcccagcctctcaccttcgttaggtatatcaaaagcacgaaatggatcagaaaaaaaccgaagcagcggggggaaggcgatagatctgagaggggattgatcgtgattacccgcgtggacggcgaggctggcgtctgaaccgagcagggcctgctcggccaatgcggcggcggacggctggccgagcttggcgttggggatggcgccaacctcggccgtggcctccgccgc

SEQ ID NO: 5891 - DNA, 3994 bp, Oryza sativa
gggatccaaggggtgtgggtggcgctcgtgtgacctttcgaaatgcggtgcgggcttatttgtagtggggtgggtgagaggcctcgtggctaggtgcacccgagggggagaacggattttttttttcaactctgagcatgagcaggaccctatcccgtcgaagtcacgtgactttgtcactgacatgtggtgtggccctgatgaagacgccaggctttgaagggcaagggatctcaagtcatgtcagctacgttcggtgttaaggtaactttgggcctattcggctgccctagctgcggctgcggcgcagccggcacgaacagtttcgcactcactgtacgcagctgcagccgcagcagttggcctaccgaacaggccctttgttacttttagatttcaacgtttaactgcctactactccatataaaaaaagttgattatcatatctaagagcggaaaatagttacatgttccttcgacatcagcggagcgagagaaacactattgtttaccgtgcaggtgtttcctaagcctgctaaacggtgtgttataagttgtttttaaaaattatattgatccatttttcacatttaaaatagttaatactaaattaatcatacgctaatgactaatctcattttgtgtatcttctcttttcctctcctctcaaacacatctatgtttggttactgctataatttgccaaacatttcaggttttttagagcttaggttctgacaatgcatggtttgtaactctgaatatcacatggcttactccttctttttccaaacctagtagtaagaacttgtggacacacctgaccttagctgaacatctgatgtgttggcgattggtgttgcgaaatgtagtattgaacccaatttaagctaaataatacttaagtgggttgttagttgttacttgttagttatacacatctacccatttaaccaaacattgctgaacaattttgagtccattgctggttgccacatttttttgacatggcacaaccttcccacaattcacctaatcttttgcaaaattgtaccttacgataaattattggccatgtcttaatcaaggtttggcaaagacttacatgatagtatttgatagtgagagatttaagaccgaccgagactcaagggagctagatggtagctatacacatccatagattttataaactaagttaggatcaataatatgatgtatgcacacagttacactgtaaagttgcaaccgccgcacatgacatttttttttatagaagggtttttttttaccgctcacatatgtataggcaataaaataattgtgatcttttatgttgtgtgagtttttcttagtttgtgtgtgcttttatttattcaggtgtgagtttttgttgaattggtgttataattggatgtagctatttgagcaaaggccgggattatattccattattaaaaaaatatgtataggcagtaaaatgtgaagttgatgttgaaaatgagaatgataaaatctgaactattggttctaaattctggtcttacatttctttgttagtattgaggtagtcgcaatttggcagtattataaacaaaattagtttattctactttcatatcttattttcagtttatgacgataatctacacatggcactatataacttatttcatattaaactagtcacagagtggcgcgttgcgcaacaataaatatccacatataagtgttaacacgtgctcgtaaattattttgtgagtacatctgcactatttaatactcccttgttacataatataagagattttatccttactaattatcccacaatataacaatttatttcagaaataatataaaagatttgggggtagtactaatcacttctatcaattcaaatccattttctacctattacacataactacccattcacccacaaccaattttatttaatagggataatttaatttgcgatccatattttaaaaattatatattatattatgagaggggtattttagagaagtagaaatcagagttacatcattttgttgcataatattaggatatagggggtgtttacacctagggatgtaaagatttggggtgacacgtcgggtattatatagagatgtcgcatgaggcgttagggcactaataaaaaaaactagtacagaatccggtcagtaaaccatgaggtgaatttattaagccctaattaatctgtccttagcaaatgtttactgtagcaccacattgtcaaatcatggatcaattaggcttaaaagattcgtctcgtaaattagtcataatatgtataattagttatttttcagactatatttaatacttcatacaggtgttcaaacgttcgatgtgatagggtgtaaaatttttgtgtgggatctaaacagggccatagtcattcaagtgcttgttgttggtgcatatcacacaccattctctagatcactatatattcaaacaacataataaactattatcccgatatactaagtactttttaggcatgttttttttgctgaatggaatgtaaatgatatattaagataacataatgtttaatacaaatatttaagtacaaatgcaacactttagtaattaatcaaataatttatttttgcaagtgtgtactctttctggattttaacgtacaacaccgctaatttttagacatacttttgactattcatcttatttaaaagttgtgtaaatatgaaatatacataaaaatacctctaataaaataaatactaacaaaataaatgataaataataaaataaatactaacaaaataaatgataattatgtgattttgttaaatacatctttaaaaatcaagagcatcatgtattaaaaaccaaaaccgaagacaacatatcgaagttccttgttttagtaaatacattttgtatttttacttgaactatgctattgatttttttctctatcattgacagtgtgcattgtagttttgaggctttttgttttgttcatttgaatagaactaagaatccaacggttcattttgcttgctgcctacatctgatggtggtcgttttgtagcctacgtggctcaatgaggatgagagaaagattaattctttcactactttagatattttccctatagtgcaggaaataccataaataggctaattgtagtcggccacaccaggacttcacaaagcaccaataggggttttcagaagacagaaattggtgttgtaggcttgtagtggcaacagcttaggatgcgttcgttcgttagagctaggaaagttcacctctagcaccgaaaaaagagcagttcattagcatatgattaattaattagtattagtcaaaaaaaaaacttggaaatggcttggtttggatttttttaaagccaccttttcttagaatttttttttaaaaaaatttcccgtttacctgttaaaaaaacgtgcgcccggaaaatgaggaagcggagttgggaacactcggtgccgaactcagccttaataccctcttcatcccataatataattaacgtgtgcatatattttaagattcaacattaaaaatatttggccaatggttagtataatatcattacattttattttttttaaaataatatcattggattcacatttaaatttacttttagatagttataattttggtgtaacaatccatatagtatatgagaaatataagtcaaagattctagtatatatgaaaaaaaaagtcaaatattagttttgaaaattgtacaagtttgatcatgcctatattatattaggatggtaggagtatcaaggttgatgttcggttggtattattggacggagtgactcattagcgcatgattaattaagtattagctatttttttaaaaaaataaattattaaatatgaattatgaagcaactttcagatagaattttctttgaaaaaaatacactgtttaatagtttgaaa

SEQ ID NO: 5892 - DNA, 1348 bp, Oryza sativa
agcacttcttgttgagcccacttttatgcatgcttagatcttatacgggattgactatatatcagtcaactaaaattttaataaccctgtatctaccgtgagccgttggatcgacacctaacaaattcatgatatacatggtttatcttctccaatgagacatgttatattttttttcatcttcttacttcgaatgaacttccatgaaaccatgactcaccggtgtcatctagcctacctcatctccggcggctcacttcacctaatacataggtacctccctccgcctcatggtcactccatttcgctcaacccctgcgactagctaatctaccaaaactatgtactgctgccacctagctgcaccacccgactaccacacatcaccgaccgcccgaaccaccactcccctccccgaccatccctctaagcttcagaacacccctctcccggcccatagccacactcacactaaccctcatcccgaatcctaatctagcgatgccgacatcctctcatcatatactaacgtttacattgtaatgaaagtggaatgatggggacattggtgttgttgttattagtgaaaaaaaagagagataaaagccggaggagagttgaagaaaaggtagaatacaactcacaatgatcggattttagtccaatggtaaatacaaggtgacactgtgaatagtttactgtgatacaaatttataacttattaaaaatgccatgatttatcttccattatagggcaacattttcgagtttttattctaataattctatttcaaatttattctagcgagatggcttattgtaagggtcagcgaattgctcttctatctgttcagtttgctttaggcttgatgatttgatccttaatccttcttccgaggccatttatactcgaagaaataatcatggaatcctttgatatagttttggtcgaggtcgagtaggtcatcaggattttgccaaagttgattttttttaattcagaatcctatcctcgttatacgtatgtgggtgaggatcctctaccataatgccactgccattacggccagtgatgcgtggatcccaccgtcctattgccccacatgtcaatctctacgtacacatattgggtatgatatatgtggactagcacatccatacatctatggaatatctcatactcccttcgtctcataatataagtatttttggagttagaaacgattattaagaaagcatgtagaattaaatgaatgagggttgtgattagataagaagtgaggtagatggaaaaattgaatagcggagggttgtgactagttgtgaagagaatattggtaaataaatt

SEQ ID NO: 5893 - DNA, 777 bp, Oryza sativa
gggccccacaatttttatgtgtgaatgataagcgggtcccaggtatacgtttttaattcaaatgccagcaaagcgccacatcaaccccacagattaggtcaacaatgtcacgtcagcgaaaccaccctccaaaaccaccaagggagtcaaattgtaccggtttcaatagttcgagggtcaggatatccggttttgcagtttaggatcatggattagattcgggtcatttttaagggagtaaaagtggacttgttccaaaattcaaaatggacagttttttttaggaataagttcacttggtgaccctcaaaagtgattgaaatttaatccgtaaccctaaaccataaaaccggatatcttaacccccaaactatggaaatcggtgcaatttgactccctcagcggttttggaggtcggtttcgctgacgtggcggtattgaccgggtcttctttacacgtggtgttgacgtggcatttagctggcatttagaattaaaaaatatgtgtgggacccatttgtcaatgacacagaaaatagattgtgggacccacatgtcccttctctctcccctccctcagttccctctctctcctcgtcgttccctctctctctcccgcagcaggcggagacggaggtgcggcgacctgcgagcggcggcggcacccgggctgagctccaccacggcgaagacggaggagaccacagcggcagcggcgggaggcacacgcggcggggtacagcgagctcggcccagcaatgggaggactaggggagc

SEQ ID NO: 5894 - DNA, 583 bp, Oryza sativa
ttctgttaataattaattaggccaagattaaggcttatttaccactgctcaaggccaattagttcatgtttatgttgtttaatcatttaaggcttgggtagcaattagaaggaggtgaatttcggcggatagtaacaatccccaaattttccccaaaatttcaaaaccctaatttgagaaattccccaaataagaaccgtaaaaattcccggcggattagcaaataacataccgacattacgaccctcactgtcgtcgccgcgcgtggcatcagctcgcccgcgcgctcggtggagtcctcgccgtcgtcctggaccggcctcgcgcctgcttcccgtgggccgcgcgaggtcgaggctcgctgccatggccccggctgcgcacggaggagaaccgggacggcaggcaccggcacggcattagaccgtgcggcatcagcccgccgcacggggcaccgccgaccgcggccctctacgccgcgcgtcgtcgccgcgcagccccgcagccgtcaccgctgtgccctgccgccaccgcctcccggcgcgctccgccacgcctcgcactgttaacagtgaaatttggt

SEQ ID NO: 5895 - DNA, 689 bp, Oryza sativa
  unsure (1)..(689): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctccccgtatgtttcctcctattattgattgcaaaaatcgattccccactcctaactcattattttcttggccccgcacgtttcctcctattattgattgcaaaaatcgattccccacttctaactcattattttcttggccgactagcgagcttcgcctttttatcccgatttttgcgaattctctccgattttggggaaacgaaaagaagagatcgagtggataaaatccctcaaccaattttaggagatgaggatcggctccagcattatgcatgcataggatatcttccgaatgttgaagatcgcagtaggctatgtgagttgggcctacgactccacttgtgcgagtggcttgggcttgcttatgtgctg

SEQ ID NO: 5896 - DNA, 1319 bp, Oryza sativa
  unsure (1)..(1319): unsure at all n locations
nnnnnnnnnnnnnnnnnnnnnnnnnnnnnnnnnnnnnnnnnnnnnnnnnnnnncaaccaaaaaaatgttcttgtcgatgtctatccaccaaagaagtgataaacaggaccggccagttctatattattgaaggccggggatccacaacacatgcattgatcagtgcttacacctagatagacgcatcacgaggtgacgagtgatgaaaagtgtcaccaccctattatctgccaactttattgggacaacaattgattaaatggtctacggcggaagagaaaatcttgatcaaacatatattgctcatttgcacttcaggttcagagattcctaagtctcaacatacatataaacccatatacgtgatacgaatactgaattgcttgctcttttcttttccattttttaatccaagaacaaataaatctatctgctctaaacaagccgaaaaaataaacattgaattcaagaaactgagatcacattcattactaggtgacatgcgtaataagaacaacagatgaatgaatcgatgccattcaaatcatataaattatacagaaaaatggttgaaaagagtcaactagtaactttttactggatttatacgcacaacatagcatcaatctctgtacgacccccaatcgcaggtctccctaaagaataaagtttttttaaaaaaaaaagaaaagaaagaaagagtcactgcaacacaagcacaaaccgccactcattctcctcgcgaatcatagatcgaacacccaacaggcaacaacagacgaccgcaagaagcacgaactcgcggccggggacgagaaaaaaaatcttggcgaaacgggacgagaaacccgcagatcaggtacagtaacacacaacccatcatccccgctcccaacaatcaaaaaggtaagtagcagtagactagtagactatagcagcaggcaccaagaaccaaaccggagatcacacacgcacacacgaagaaagaaaaaaaaagaaaaagaaaaagagagagagagagagagatcattaccccgacgtggagagagatcaatcagagcagcatatcccgcgtggcttgtggaatctggagagatggagaagaggaggaggaggaggaagaggagagatcgatttcgatccggggaggagcagcaggaggcaggcaggcaggcaggaatggaggctgggggctcacacgagcagaggcggagcagcagtggagcagaggaggagagagccagttacgaaaaaggagcagcacaaaaacccaaaacccatcaaagcgtcggtttcttctactgcctcgccctctaatt

SEQ ID NO: 5897 - DNA, 12857 bp, Oryza sativa
gacaaatagttcggttctagtagaaggaatcattaaagagtcactttcaaaacccactcatttattggcacaacttcatagctcaaaatacaaccatatcactgtcttttaaaactactctagtacattactcttatgttacagctctgaacacatcacaacttcttagttcacagattgcatatgtgtgtggccagacacatgggcaaaattcagaaagaaaaagaaacatggtttgaacagagacaccaaaactatacactagaagctgcaagggagcacacggacacaaacttggccggacagacatgccaaattcgtttcagttctagccgttgcgctataataaggttcagctgccatcagcaagtgcctgaaccttcttttcgagctcaggtttgttggcgcccacaagcttgtcgacctgcttctcgttttttatgaagaaaaaggtcggcgttgcgcggatatcccatgatgagctgaaatcctgcagagaatacaagagagttgttaaatcggaagaacattacaacatgcaccctgacctatagatatgctaagtgagaagctactctaatgtcaggacttcagttaactttaggacaatttgcatgcaatcactacatctgtttacttaattctagaagtgttgagaagctctttataatgctataatgctaacagtgcaggcgcaacatgtgtttagcctttatatgataatttccaatatataagaagctttaccaaaaaaatacagagacaccaaacaaacttattttttttcaaagttctcatggtatgtcgacagcaattactccataagtaggatgataggtcatgctttgggtatgatatccctcagcaaataattcaacacatctggaactcagtacacaatctattcttgattataaaccttaatcgatggcatttagtgaggatgcacaatcagttatacaggattacagataaatgatactattgataaaatgaccgccatcagatgtataaggggtttcttggttcatacaaaactgaaattaatcatttttcaatagcaaatttgaccaaacaaacggttagaattaccattaggtcatcaacatctattgtcaagaacatgagttgaggataagtctttgacatctcagcataaataggtgcaataacacgacatggtccacaccaggaagcactgaaatttgccacaacctacaaaacaaaacagtgagtacgtcaaaggtactagtttgcatcaagaattttcataactttatcttgttacgagatttcagccaacaacagaatggccatctaaagtggatgagtcgtaaatgttgtgtgtgtattgccaaaaaacaagcaggcatcctaaaaataagcaaaacaaatcctgaggaaaaaaaaaaggaaataccaagtggatgagcatgcaagtgctattcagaataactgggagtatggcataatgttgtttaacttgttttggatgagaaataaaaccaacataaaacagacctaagtaatttacaaatgaggtttgaatcttttagaaacaaactagaacaatggaaaaagcagttctacacgtcagcataactagaaatgatttattccacacaaggatcttgcattgactaaaggcagaaagctatataaatcagggaatactaagaaatggcaactttttgcacagggtactagctagaatatctgaatgcagttttcatgaattatttctgactttataactggaatatctgatttttttttcactctcatgcagatttcagtctgttctcaatcccattagataattacacttctttttttttaaaaaaaaaaagaaaggaaaggaaaggaccatgtgataagtagtgcatagatatcaacttcgtaaagttgtatagtgtgaagcaaactgatagatcaccaaccaatgcacaacataagaaccaaaagatgtatttgtaatccattgagcaaattgctagcttgcttacaattttcccatccttgtttgcttcttcaatcttcctatcccagtcctctttgcttgttatgacatgaacatttccacctttgaaatcaagcttgtcttcctcaatatgtcgtcgtccctgaacaaatgaacataaataaaagaaacatcacaaatcaatatatgtggtaaattgaacagccatgatgaaccgctaaatatcaattatggttttggaagactcaccttgcccacacaacctcccattgtgaacttgagccaacaaagctagcacagcactgagcaaaatgtcctctaaacaatgataaaagcatgtcatggtctatcagaaaaagagcaactaaaactacgaaagcactgcaagaaaactaaaatctaggaaggcatggttgaagtctgagttaggcataacaatagatcataagcgataatggacaccaaatgcataggacaagatatcatatattcaagtgaacaaactcgcagacattctagcataggatgatcctatcagaataaagactaggaaggcaaatcatccctattgataattcaccgaaaaaaagaaaggacagataacgaattctgcctctcttaagagcacgaggaatgcccagaactgctctattatctctgctagtaattcttgttccacaaactatcaccgatacgataattcactaagacaaagcataatgacagtactacttctcccaactaccacaatttaaggatcgaaatcccaacgccatggaacccaatggaatggaaggcaaagtagggtacacatgaagaaccatatctccccattcccccaacccccaagaacagtagaacaccccctcccatgaacgtcgcaaaccaagaaagcacgccgaatcgacagccgaagcagaagaaggccacggatcaggaggaatctaccttgggctcacagagcgagcgagcgagcgagcgggcggggcgtggatcgattccgacgcccgcacgagagggggaggaggagacgaaacaatcgaaccccggatctccccgcggtcgaagagagagagaggatttgattaaacgcagcaaaaaatcccaccaaatgagggtttgatccgccgccgccgccgcgttttggaaagtagagttgatttgtgcgggggcagtggagaagaggatgaggaggaggaggagacggttcgtggaattctccgctcggctcgtgcgtttctggagacgacgacggcgacgcggagacgcagccgcggccgcgtgtggctcgaccagacccgaccccgcttcggtcggagcggaccactcgcggttggacgaccggctcctccgcctccagaaattgttttttttttcttttttggcgcgtgtgcacagcggaatttgtggagtgcgcgcgcctctacgccaaagtatcgcgacttcgcgagattggccacgaatccacgagggcagtgacgcacacatccacatccaatccaatatagtgagaccaaaatacctgatgactatacaccgttgattatacctgtaacagttttcttgcgtaaaaattcttcttttcgtgtttttatacgccgggcgaccggcgcgggcgagtcggatcaggtgctcccctccctgacgcgtagccgcaccatatactccattgcaataaatcacccacatattttgaaaaccctctattaaaggaatttggtttattttttttgttccacaaaaaaatatcatctagtgcactcacaatgttttactatgtatagatctaatgttgcagtgaactgaaatattccattgcaacaaatcacccatatattttgaaaaccctctattaagggaattcgttttatttttttgttccacaaaaaatgtttcacctagtgtactcacaatgtttcactatgtacatatctaatgttgcagtgaactgaaacattctttctctgtttgctgaaacattgttttaatataaggtgaaacaacacccgatttaaacgaatgaaacattttcaatctacttagtgaaacaattccgatatacctggtgaaacatcatgtaacatttaaaaataattcaatgataagctaaaatttttcagtcggaatatatctatgtgtggtcttgttttgaagatttaattgcaacgaatttaatggtgcaatcggatcatgatttggataagtaatttaagagaaaaaacagtttaaaatagttttgcacgtgagtcgagcgctgacgttatgctgatatcagcgtccgattttaacctcctaccattgaacgcccgaaccagagagtccctttaagtcagaaccttctattcccatcgagatgtcaacattttttgctacgaaataagtgtacaaaccgaagctatgctgcacttaattttgttcattaacattactctccttttatttttttcaaaacttgttccggattcgtctgagattttgagtaacttaatccaatacatcctccggtctaaggccatgtttagatctaggagtgtaaatttttaatcacatcgggtattatgtaggatgtcgtatagggtgttcaggcactaataaaaaactaattaaagaatccatcagtaaacagcgagacaaatttattaagcctaattaatccataattagcaaatgtttactatagcaccatattgtcaaatcatggagcaattaagcttaaaatattcgtcttgtaaattaggactggtttagttcccaactttttattcaaacttccaacttttccatcacatcaaaactttcatacacatataaacttccaacttttctgtcacatcgttccaatttcaatcaaactttcaattttagcgtgaactaaacacactcttagtcgcaatctgtgcaattagttttttagatatatttaatacttcatgcaggtgttcaaacgttcgatgtgacagggtgtaaaatttctgtgtgggaactaaacagggcctagctactagaaggagctcctctgacttcatgtgccattgataggtggggcccactcgcatacaactctctaactttaactaactttataaaaataaattaacacctactataccaaataaatacactaacaaaaagagaaactaatttgatgtggtatgtgttagtttatttttcatcaaaatttaggccccgtttgattcagcttaggattattataatctggattattacgagtaagctgaaacaaacagatagcttattatgatagattattataatctataagtcagataactataatctggtaagctattctaaaggtgctttttttagattattgggtagctaacaactaacaaacagataataatctagagaaataaactagtagcttattatatgtcggtttattataatccagcttatagtaatctagttatataatctagattataataatcttaaactgaaacaaacagggccttagagagctttgacttaaaagacaactaaaacacttcgatgatcgaaaccttgaattaaatatatatgttctaaacagacatatattagaaggtatataatgcacattaataaataaataaaacttgaataacccatatatatatttttaaaaaattaacatattactgtcaactgatgacttggctgtattagaaggtatgagttgggaaccataccctgatattcaaaatgataggatgaatcagcgtataattaattaaatattatattaaaaaactctaaaaatgatcatatagatttttaaagtaatttatctataaaatattttaaaacacaccgaaatgtaggcacgaaaaaacagaaatgagttggaaacatgagaacacacccgagtggactctgaccagcaatatccactcccataaaaaacgaaaagaaaaaaaaataatgacaggaagaggtggcccaattgcaatgggcttccatgggctcctcaagcccaacacgcaatcaccaccatcggtcacgcgtgacgcaaaccccacagcccccctcccctctatataagcctctgcgccgcgctcctccgaaccctagccgcacatccccgcctcttcccgccgccgtccgccgcgcgcacgccgccgccgccatggggaggagtaagtctaaccatttcctgctctaccgctcgttgtcttgctgtttgttccacggttgcgctggatcggtcgccgcggctccctgatttcaggcgcgttttgggcgtttggtttagatccatagtagctgggcgctgctggattgttgctgttcccggtgttgatctgtgttttgctttgatgaatttaggtgtagatagattttgtagttgtttcgttgcatatctcgttagtttgcttactcaacctgaaggagtcatgttggacttaataggatgtgaatattgttgggggaactgtaccgatctttgattttcacagataatggtagtatgatatgattagtggttctctgtgaatctaaatgatttattctgatgtagctagcagatgtagatgcatttatcctagctagaaatggcttgtttgtggtggttttgttgtttgaagcgaatccctgtaatggatttagttacttcatggctatttctatatccactattttcttgttcatcgatcaattatgattatttagattaatgtaatggatttagtttctttcatgactttgtatattcactatttgcgtgttcatcgatcagttatgaatagtattcagattaacagtgatggggctgtaggtgctttagggtgtttctgagtaactaacttgactttgtggcttgctttggttaggacctgcaaggtgctatcgccagatcaagaacaagccgtaccccaagtcaaggtactgccgtggtgtccctgaccccaagatcaggatctacgatgtcgggatgaagaagaagggtgtggatgagttctcccactgtgtgcatctcgtctcttgggagaaggagaatgtcaccagtgaggctcttgaggctgcgcgtatcgcgtgcaacaagtacatgaccaagtctgcaggaaaggatgccttccacctcagggttcgggttcacccgttccatgtgctccgtatcaacaagatgctttcgtgtgccggggcagataggctccagactggaatgaggggtgcttttgggaagccacagggaacctgtgctagggtggatattggccaggtcctcctttctgtgcggtgcaagcccaacaatgctgtccatgccagcgaagccctccgtcgtgccaagttcaagttccctggtcgccaaaagatcattgagagtagaaagtggtaagtatcaaacagggtgatgcatacgagtacatctaaatttctgatgtgctctgagtaccataagctcatgttccgttcctaacttgcactttcttgttcaggggtttcaccaagttcagccgcgatgaatacgtcaggcttaagagcgagggtagaatcatgcctgatggtgtcaatgctaaggtaaacacgctgtttctaaactaatgcttatcttgggtcctatcaggatgagtaacttattttgttaaaatcctttttcgctttgcttttatgacctgtcaattgctattgtaattgttctcgtatgcatcgttgcggataatctaatctttgtcaatactgtctctatggtgcagctacttggttgccatggtcgcctctctgctcgtgcccccgggaaggccttcctctcagccgcttagatatatctatccttatcatctgtgggaaacgaaatatcggacctttttgtttgtttgtagactcgatcatatatcactttgttgaaccctgaatcaccaagtgtctggtgctatattgcctggtctgaagctatcttgtgttgaacatctttatctgaaatatatatcagatgactttcgtgtcgctaatccgttgctgcttatttcatctatgcatacatactcttaaatatcggatgcatcgtgtatatctgatcagcaatgttcatcttcccgtttttcattctacttacttattcagaagccatgtactcctgtaattaacctgccgaattgtttgtgtgctattgtttcgcctatccttacgcgtataaaccaaaatttaaattttaaatctgattttgtgaatttttacagcatttagttttgaattattaagaatatgtatataaaagatttatctacaaattgtttgtttctgctaacaagtggtacggaaccaggtaaacatacttggtttcaacgcaaaaaaaaagaactacggtcacgaccaaggtttataatccagatagtagatcaaaattcactcatgaaaatcatgaaatccattgattaaccgataaaattcaatgaaatctgcataaatttgtcaaaacttttaaaatctagtttaatcttgttgaactttatcgaaaaatcgagtggttcatgttttcaatctcataaaaaaaactgaatttcgtgaaatccaaaccctgataaaaatcaatgaaatctgcataaatttaccaaaaaattaaaattcattttaatcttgttgaacttatcgaaaaatcgagtggtctgtgttttcaatctcatgaaaacaatctgaattttgcgaaatctgaaccccaataaaaaccgatgaaatttgcataaatttgtaaaaaaaaaaaatcaaaatccagtctattcttgtcaaacttatcgaaggatagagaaagatcgagtggttcgtgttttcgatctcataaaaggaaattttgaatttcgcgaaatccgaaccgatttccatggagccgtgtgaagtgaacccggatcacatcacaactcccacaacccgaacacgaaacgaaaccacgccaaacaaacccgagttgaacaccgaagcggaacggcatcgctcgtcatctagcgctccaccatggccgcgaccgcgagcgcgcccgcccaaactcccgctcgctgcctccgccgatagctcgagctccccggaactccgccggcgaccgcgccgccgcccccgcattcccgatcccacggctgcgggaaagagctaggtaggtaggtaggtaggtacgtgcccctacttcctctctctctctctcttggttaggtttgattcccgtcgtgttaacctctgggtttggcggttggctgattcttttgcggggtgttgatcggccgtcggcgtttgatttttccctgccttttgcgctcttgcggcgaggccattggttctaatctcttgttacttgttagcgtgtatggattgactatggagtattggagaggcaactgatgttatttattatagagatcaaatcttagatttcagggccatctctgcttgatttagtgctcgttttccttagctttctatcatcttgatgatgttttctgtatgtacatgatagctttccttagctttctatcatcttgatgatgttttctgtatgtatatgatttaggttcttgaggagcataattgttcgacagtgctcagttcttgtgctctgaacaagccgttctactctactgttctaggagcgattggttcactctgaattctgaaaaaagaagggggcaatttctgctgccagaatcttggtgattaacctcacttgcgtgccataatcttcagtctttttcacctatgggccatgttgaagaagcatctggcagtgatgacgatggggtggagttgctgtcggtttcttggaaccaggacaacagctgcttcattgcagcaaccaccaatggcttcagggtcttcagttgcaagcccttccacgagaccatgaggaggatgtttggccccaatggagggattggaatcgccgagatgctgttccgcaccagcatattcggattggcaggtgcagagtccaacaccgagttcccacccaccatgctccagctctgggacgattacaacgaacgccgcatccacaagtacaacttcacaagcgagatccgagccgtcaggctgtccaaggactactttgtggttgttcttgagaagaccatcaatgtttacaggttcaaggacctgaggctgttctaccaggctaggacggtgtcgaacccgaatgggctgtgctgcctgtctcatcacgcaaacgcctccgttttcgcctgccctgggacgtccaaggggcaggttctcattgagcatttcgggttgaaggagaccaggttcattgctgctcatgactcgcccctttcgtgcatgacaatggccttggatggaacactcttggctactgccagtgtcaggggtactttgatcaggatattcaacactagggacggcacctgcgtgcaggaggtgaggctgtttttttttctttttttgtttgcgctgcaaaataatcttttgtttcttttgttatatcattgttatgtctttggatatcataaatgtttccttgctatagtctatgtaatttacaaatgttcagcagtaaccagtaatgtacttaccttcaaaaaaaaaaacagtaatgtactcgtcttgctatttaggtgcggagaggacttgacagagctgagatatatagcattgcactgtcaccaaatgtgcagtggctagcagtctccagtgacaaaggaacggtgcatgtcttcagtctgagggtgaaagatgcagaggaggatgcaaaaaagggggagtctgcaactgcaggtgcacaggtgaatgacaattgcaactatggttctacggttccagttacacaaacaaagattggatccaatacgagctcatccctgtctttcatgaaaggttagttgattaaggtttgaatcttatgggctagtaagttatctctttgtaatatttcaatcaattttaaaatacagtattgtcagttattcaaatattgtcttcactagttttttttttttttggtgaaacttccttgcaaaagcattttacatagaaaacttgtgttgtctcagttctgggacatgtatgtatttagcatcttatagctcataacaaagttgatagcttcttttatgctcggtactgtgattctaattggtaatgcggtacagtccccttcttgtgtgctaataccatgataccattaacatggccgcgacaactttacaaattacgatcccatttcatttgtttactttagggggtgtttggttgctagccatactttgctacagtttgccaaccattactatagggggtgtttcatatacactacacaaagaacaaaactatttctttgttaactatattggcatgtgggctttgagagtttaaagtcgagccgatagagaaaagaaactcaattttatcttctgcatgggggttgacaatacatattttttgctcttccatctgtatttcctgttcaaattccttatatacattggaaatttacagggattctgccgaaatacttcagttcagaatggtcttttgctcagttccgtttaccagaaatcacgcggtatattatggcatttggagatcaagacactgtaatgatgatcggtcttgatggcaggtactctttctttacaaaagacaacagaggataattaagaaatgggttttagacattttgtttagtttacaaacatggtgttttacttttgttctaacattccaagttttaaaaatatttaaaactgccaaagctagatatgtgaaaactcggaataacttttatcaaagctagattttgtcacgaagaattacttttgtcatattgcaacctatataaattccagtgatgtaaagttaaaaatgtaatgataaaagtcacatctcaaagactatctatactactttaaaaggtagtagcggtgatggccaccacctctatcagtgacatgtggggccttcttgtcggtgaaactcacatgcttactaaattcaaacgtcccccaagaaatgtatgtctaagcaaaataatgtcaatattctttggtaaaatctgataagcatgttgggaattaattcatattgctaaaagggattgaaaagatccagtctgcagattcttcaaacgatgattgtgcacaccataactttttatttttggcaatttgctactcaaattaaaataacaaaagaaatatgcaatgtaagcagttccctgtttctttctttgtttttttattgagcaatcatgctcgttcaagtcaatctggatctgtaacttctgccttcctatatgtacttcttttggattatattttattgggattattgtttaaaatgccatagcattgtgtagttagacaggggatagcatcagttaagtaggttggactgaagtagtccgtgcaatactagcataaaccttatttagattttgatgatgtattaattatttgctgaatattgcattgtcatgggtttgtcttctgagaaatattttcgactaattacaacaacaattttttggcacattcagtttctacagatacagctttgaccctgtaaatggcggggagatgatgctcaaggaatatcacctgtttctgaaggccagcaaatctttgtgaagaactccaaacacctgagcttcatggtgggtcataccatcatctcagtttatatctagatggtctgactaagttcaatgcgtactgttctctctagtaacatttctcactagcaaggttaatcagcataggctatttcattccgaattaggcgtaatttttgcacatattaggggttagtcttttttttgttggcttttctacatcagtaagcttaactgaaatgtataaatttcttaggaatgagtcatttcccaccggatgtgacctagttgtaactttaaattcgtagtggagggatttct

SEQ ID NO: 5898 - DNA, 15471 bp, Oryza sativa
acgctactactactaacaacacacattttcatcatccatgaaattgaccatggttcaacttcaaaggaaaagacaggtaactgaggtaggaccattcctgcactccattatcatcagtctgatgcaccacttgatcttgctattgctcattttgctacagttcatcttgctcttttggctgctctcctacacctacctgctaacctgcctacacacactctgacacacactattagggcatgtttagttggtgaaacgaaaatttttaggtgtcacatcggacgtttgaacggatgtcgggaggggttttcggacacaaatgaaaaaactaatttcataactcacctggaaaccgcgagacgaatcttttgagcctaattaatccgtcattgacacatgtgaattactgtagcacttatggctaatcatggcctaattagactcaaaatattcgtctcgcgatttacatgcaaactgtgcaattagtttttcttcttatctatatttaatgcttcatatatgtatccaaatattcgatgtgatgtttttgagaaaagtttttggggagctaaacggagccttagtggagggagaggcccatggcccatggctagaggcaatgcatgtaggcatacagaaactgcacatgcagatgcagtgctgtgctgccttttggacagactggtgtggaggaaatattatgatactatctcacttatcagtgggagcaattgttgatgtcaatgtgggggatgcaagtttagtagcagtactccattctatttctaccaacaagattctgtacaagatcaaaagaatggatttagaatgcattgatgtttgctatgcataacacatccatttcatccctccattttttatctctggaaaatggctcgatgcttcttttcatggctaaaacggctgtctggtgttaacttcatggcacgttataccttgtccctagcagtttataggtggactatatacatttgaaaactagaagtactagcttagcttaatgttcttcttgttcttaataaaaaatggaacactagcttagttgcttgggttaagtctcctaagtccatgagtgtcaggctgccactctgggtctctggtgttatgtcggtgcagagctgtgtaaaattgttggagtatgcaaaaggaaattctgcaaactaggggatcactctggagtctggtctctggtgcagtgaaggtactattggaaggtcaaatatgcaaactaattcttgtactaatgaaactgaagttcagttccatcttagatgtatttcagttgataccaattgttgatgccaatgtggggggtgcaagattagtagcagtactccattctatttctaccaacaagattctgtacagatcaaaagaatggatttagaatgcagtgatgttcgctatgcatacttatatccatcggaccatttcatccctccttttttttttttgtcttgaaaatggttgtatgcttcttaacttcttttcatggctaaaacggctgtctggtgttaacttcatggcatgctgtaccttatccctaacagcatatacatttgaaaaccagtagaagtactagcttaacttaatattcttcttgttcttaataaaaaaatggaacactagcttagttgcttgggtttagtctcctaagtccatgagtgtcaggctgtcactctgggtctctggtgttatgtcggtgcagagctgtgtaaaattgttggagtatgcaaaaggaaattctgcaaactaggggatcactctggagtctggtctctggtgcagtgaaggtactattggaaggtcaaatatgcaaactaattcttgtaactaatgaaactgaagttcagttccatcttagatgtatttcagttgattcaaggtttattccttttctggtttttgcgttatcctgtccatataaacttgcaaaacccaatggtttttttaattaactgtaatgagcaaaagtccaggtaaaaccaatggtgctatcaacttctcaggtgtcaaggtactgcataaacttcgctgtcacttacctagcacagatgttgaagacttggagacaataaaacttgagttgatgcctgtattcttgctgtaaaaaactggggcagaaactccaggttatttcacttctgtcagaaaaatactaccggtaaaaagacgaagaaaaaaaagaggctctactcccttttttgtgccatccccagaaaaaagaggcactgcaataagtgctggttaaaatctcatcatcagactaattctgaaacctgcttccaaagttcagaacaaaagaacatgggcagccacaaaccatgaaaccacactcacgccatcccttgttactctcaaatgttaaaccctttcctcctttaacgcctaagggctcgttcggatcataggatagggaaagaaaatataggataggaaaagtataggaataggaaaagaatcaaagcgtgaaaaagaggaatgaaatgaaaaacaaaggaatacaaaagttgagagcattcggatcataggaagtcaattgcctaggatttgcacgcaggaagcaaagaaagagcttgaggtggattagaggtggccaaatgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcgggccggcacggcacggcacgccggcggcccgtcaggcgcggacagggctggcggcggtcgaatgggaaggcgccacgtggcattaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctatttgttcttaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtattgtgtttgtgaattcaataaatattcgaaaatttgtttatgtcggtttaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacatttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctacatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacaagtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattatatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaataccattttttcttttttttaacattagcaaatcattacttttttaaaaaacttttatttccattttttaaataccatttttttcattttttaacattagtaaatcattacttttttttaaacattttatttccatttttaattttttttccttatacatttcctttgctttttttttttaaaaaaaacactgtgcactgcaggctggcgggctggcggcctgccttcacgggccgccgtgccccgaacggcccgtgggccgcgggcgtgccgtgccggcacgggcacggcccggccatccacgggccgtgcttgggccggcacggcacggcccgtttcatcagccgtgcctaacgggccgtgccgaaacgggccgtgccggacccgtgcccgtgccgggccgtgccggacccgtgcccgtgccgggccgggccgtgccgcccgtttggacacctctaaggtggatggacttttcctgtactttcctgtaaaatcagcatcaaaggaaacttttctttggatttcctacgaccagtttccataatccgaatgataggaaaaaagaatttctatgcacattattcctcaaaaatcctgtgaacacaatgcgagtactcctacatctttgcaatagaactgcacttgcagacagcatggacaatgcagcacattgacagtgacaatgcaatgcctgaaagggacaccaggcttaccctcaagcaactaacatgcatatgctcgcattctacctttttctcctccttttcttgtcatttggcaccacaacattataacataaatactatacattgcactagatctatgcagaaaagggagagctgaaaaaaaataaaatgcttcatgatataatgtgcgacttgggggaatctgacatgagaagcaaaacaccaagcagatggaactgatgcatgcagaagtgcacggacaaatgtgactggacatggaaggatttgatagtctctttggatccaaagctagtagtctgatgaatctagagttgaatctagagttcatagcagtgtttgtgtgcagatgagaccacctcaggtgccatgccagcaaccctcctgatgacgttgcactgcatggatggccccacattgatactgccagtatgcagtagagagtacagtatctgaatactgttttaagtctataccagtacagtcacaattgccccagagcttgtgagtacaagaagtaacacatcaattggaggaacaacaatgatgagaatcattgaattggctacaccatcgctgcatctccagccagcacagttttaaattgaggccatcaaaagtccaaaggtcctaagggtaggggataaccattgccacggcactagggtcccatgtttctgatggaacagaatgccaaacatgcatgttgatcggcagatctgctatgagagtataaatccatgtgaaatacgcagttcctgagttcaacatgcttgattaatgtttgggtaaccagatcacgcattgccttcgatggaatgactacagtatgcatgcaagtataagacatgccaattctctataaatttgaaaaaggaatttgtcgtgaaaagaactgaggtgattcttgccaatccaactgcaggtggttgcttacagttacagttataatgctaagtagtgggttaacatatgtactaacctaggtgctaaaagaaacaaactttattgctttagaacacctatgtcccttttcagagtgcaacaaattgtaatgaagatgcccaaaaaaaattcgctgttatcttctgtcccctccaccactttcctttacgtatgtgcaagctggcagtattctgcttttgacggagaaactttacatggtagatgcgccatttgctgctatcaaagactgcaaaagggaaatttggagagagcaaaaactataagcaaatcacaatgtgatttcgttagacaatacattaggtttaggaatgcctgtgtttgcatcacgatatgaaatgaaaagctaaaggtcctgaacttactaaatcaagaagcttcagaccagctgctcgtgtaaacttccttgcaaaaaggaagcaaggtgctggttttccattacttgtacaccactcctttctattttcagtctcataatatatattatcaatatcctaaaaattcaacaaataggtactcagtgaatagttagaaaatgtcatgtgcatttcgtacgggcagcttgttttggcagaactgtatacatgacaaacaaaagctgacattccttatcagacgcaacacatttccaaactgacatttgttaaagctttgaaacagatgaattgatagcgtctgccattacccaacagaggttccaacattcaccttggttgttgctttgtacttaaatattttaataatgacagaattttcaaataaaagaaaaaaaagtaaagcctctcttaatttcctttttaaatgtacatactatataatcaccactttcaggtaacaaaaaatgtgccattgcaaagaaacatatacctttatggattttacaagtgcaggagtagcatctgagattttgtatgttacaggatgccatccacgcctttcacgatctttagaagatgatagatcccacgcactgtgtgtaactgacctccgtgtaagctcttcttcaagaccatgttgctgcattcgataaaaataattgaacggtcagatgtctttgtgaggaggaacagctgcaagggatactgtaaatgattgttgacttactgcaagcaatgtttgaacatagtgctcatctggtatgcagttatgtgccttccatgcctccgcaggctggataaaatgagcagcatttagtctcacagaattactaattaaactttgttctggaacagtagagcaattagatagagatatagagttcagtggtaaattttgaagccatagataataattctgttaattaagctttttatggagtacaagaaatagcacaagagttgtgattattatactcaatgtgccagctgcagttcaaaaataaacacataaaagcaagttcaacaagctaagtgacagttcagtattttattggagactttcacttacaataggacgatcccagtcccgccagaactctggtaagggccttctctgcaataaataaaaaggtacatttaataggaacaagaatagacaactctaagctaattgataggaaagagacatgagttaagtaacttgggttgatgatatagaaaaatccggtggatcttctattcatttggcaaaggtactagtatcgaattattttatttttttaacctttttaattttaaaatctgaaccttttggccaagctagcccacctggcgtgacaaaacaacactgacacgtcacccgcaatgggcatgacaattttacaatatttccaaaatctgaaccttttagccaagctagcctgcctggtgtgacaaaacaacactgacacgtcacccgcaacgggcgtgacagttttgtcctgccagccacggtggtgtggcaagacaacgctgccatgccagccagaccggtgtggcaatgttgttttgccaaccaactacggccaaaaggtttagatcttggaaataagttttcgaatgatttatttttaaaaataaaaattaaaaaggtttaaaaaataaaataaaataaatcactgatatcatgcattgtcgtaaacattgtcagaatgtcagtaccatacgtggcagtttacataaatctacaagtttctttgtgtcctatgttgattatcttgagagcacattcacttgcgaatgcaaaaaactgtcataaaaaagtaaatattgataatattcaaattttcaacttctgttatcctgattttaatttgatgaaaggtacaaggtgaaaaagttcactggtcagttatgatcatgagtaaactatgttatacaatactgaaatttatctgcatagagtgcataaatattgagtcacataccctgcaatgcttctggaattctggcaaaacctcttcatcttcaaccacaacttcagcatgttttcttgttaacacagcccactgtatggcacaaatgaatggtgataaggtatcaaaactaactgttacacagttcaagcaaaattctcctatctttcatcaatagaaacagaaaggtacctgcgagccttttctccaattttccactgggataattgggtccattctgggattataccgacccgcttttgtatcagcaaaactgtccccagcatatgcaattggatgctgttaatacccaggatattatacaagctaaatgaaaggtgctttaagctgcaaatctgcagtttgctacaggaaccattttgaagctcaaggtacatggaaatacttagataatggaaaatgagaaaggctaacatgattttttttctttcttttctttaacattcatagttactagctgatacttgtcatgaactcagaattcattcttaagtcttaaccatcatcaggaaacacaacacgaaattgtgatgcctatacctgtcaacaaaactggttgacgaagacattatgtagtcgtaagtgtagttgaagttgtacaatggcacacagctggcagagagagaagatcctagtaagcatgaatccaattaagatccaaaatggtgcaacaacgagctttgtaagattataaaaaaagatgtgtagtactaagttcaaatttggagctgtcagaaaaacaaccgtgtaaacgatacctaaaattgcaccaaggcatctggtaaattcagtacagcttcatgtggagtcccgttaaacttaatagaaacagactaacagtataacacaagattcatttccatggaatttaagattgaggactgctatcgcaccacatttttagcatgagcttaaaatcgcggacagaaactacttatcatctgagcattgcatattggaaaaaaaaattagttagccaaacgatgattaaaaaaaacaaacaatctttactagataacagtccacatttataaaaatgtaaggacatatcattatgttcaggaacattcccttaattcattatgatcagaacctagaaacaacacattgtgctgaacaagagattaagccaacacagattgcagttagggcttgttttggttcatagccttaccaatttttttggcaatggcaagaactggccattgccaaattttctggcaaaaactggctaggcattcatttgcttctactaaacttgcatttgctattcaaccaagacaaataatttagtagtgcttaatttttggctataaacagaacacatgactaaattttttgggcattgccaaaattttgtgccaatcaacttagtatctaaagtcagtaatactttatccaagcatacacactagcacacatcataattccataatccatacctgtcggagacgaacacgaagcgctcgtttaaggggtccttgagcgcgtgggcgagtagaacacgctcagcctcgatcatgctcgcctccccccaatccacctgaaggacaaatcacacatgcccaactcatcaggaacccagtgtggactgcaacggatgctgctaccgacggatcacatcacattgccaacggaagtggggacgaggtcgcgaacctggacgctgttgttgacctgccgattgtagaagaagccggatcgggtggtggcgcgggtgagcacgaaccccggccgcgagtgcacgaagatggagaatctcccttccttgtcaccctactcacccccaaaaaacgcaatgcaatcaggattcaaattaaaccagcattcgctgaaattgggagccatccgagcaagagcgagaggaagggggagatccgggcgaggcgcgcgcttacgcggaagaaggcgtcccagacgaggtcgagcgggaggcggttgcgggcgatgaagaggaaggcgagccgcgcgttccccggcggcagcggcgcctcctccacctccgcccgcgccaccgccacctcctcctcctctccccctccccccgccgcctccaccgcctcaggcttcctcccctcgccctccagcgacggggacgagccgtgcagcagcagcagcagcaccaccgacaagcagaggaacacccccagcagcagcagccccgccggcttccccttcccgccgccccgcccgtacatccacctccgcggcggcttcatctccggcgaccaccgtgggggattcggatctcaccgagcgcccatcgaatccagcgagaggaggagggtggtggactcgtggtgatctcgtgaatcgaaggaatctccgatttcgcgtgggttgccgtgccgagcaagcgcggcagaggcaaggcaagtgaagtgaaagttaagttgttggacttggagtgtctgaagtgtggacgcgccagctaccggcacgggaggggcgacgcagccgccgcatccgccgcgcggcaacggctcggggtcgggggagatcacaggtggtgtctgggccgtcggatcggaagatggacggtggcgatgtgtacggtgtaccgtgcgagaaggttggccacttcggcgaggagcttcaaagctgggacagggaaaacagaaccgactctttagcctgtctagattccaactttttttctttaaacttttaacttttctgtcacatcaaactttagatgtgtttagtttcacgttaaaattgtaagtttgaagagattgaaacaatgtaacggaaaagttgaaagtttgaagaaaaaaaagttaaaatctaaacatggtcttttctacacacacaaacttccaactttttcatcaaatcgtttcaataacttccctttaccgcgtaattaatttaacacatattcaaccttagtcttactgtacttttacgataaacaaaatactccctccgttttgaaatgtttgacaccgttgactttttagcacatgtttgatcgttcgtcttattcaaaaacttttgtgaaatatgtaaaattatatacctacataaaaatatatttaacaatgaatcaaatgataggaaaagaattaataattacttaatttttttaataagatgaacggttaaacatgtttaaaaaagtcaacggtgttaatcattttgaaacggagggagtaacaaactaaacttatataaagttagataaaaatatagtccactctataacatgtggatcgagttgtggcaggaaaaaaacaaacatttcctaaaattatgacttacctaagattttatgtgataaatttagttaccaatcaaacatgccctaaatatcaacataaaaaagttgaaaaatagattaatacgatgatgtaaaataataccacacgatttagcaaaagtgattaacaaaccattcgataaaccaaggttaaaatcaaagatccaagatgagcagggagcaagaggccggggagggtgaccacgttgtgagctgacagtggcacgtgaagtttccatgatttgcaccgactattctagcacacacatgtcccgactcccaaagcgcccgtctccaattgacctaacttgaccagcccatttctcccactggcccaatacgatatttactcaattaggcccacactctcttcacgtctaggcctcgatttgaaagcccacgaaacccggtccattcacgtgaaaaggaataagttcaccggaggttcctcaatttaacagcgatattttttttagatcaaagggtttccgcccagctttactaacaaagcataacagagttcattacagactggaaccgaaaaagaaaaaagaaaagagactttctccggtacttgaaaatcacgttaaccattgattaggtacaatccaatggtttacgatacaaggtacccatagaaagttacttaaaaaaaggtgggcaggtataaaaatagagattaagtgggagggtatataggtaattttgtcccctggtattatatcaatctatcagatatgaaaaggaaatgaccgtaacatatataagttcttcgattcttctcgaatttgtttcgttacgaagtttttaatatggattacatgaaattgtgaacaattacggatttattttgttatgaaaattgatctacacagaacggggaatgtcatattatttgaagttttggtagctcattcatggattaattaagacgtggtcgacaccggcatgctcaggttatctaaaagatagagaagaaaaatgccttcaaaagactagcagatgtgatactgtgaatgaccatagatttatgtaatattcctatctcctaataagtaactattataatgtccctgaaaaaaaagtaataatgtaagcaacaacagcgagagatgagaattagtgagcgaaagtaatacaagagcaacagttaatagagtaggggctagcggcaaacaatcaggaagaagttagaagttgttagaactggaaacaattactaaattacccatcgtcgtgttttttctatttctaaattcatctttagcaatcaacggttgatattcaatagtttgaaaggtacgctgagtacctcccaagcaccttaaaagatctcaaaagaaaaaggggaggtagtagagttggggtttccaactgaagatgagatcaacatataactgacaaaagatcaccctaacaccttccaggaaaaagaaactttagaaaacaacaacgcatcgcctggatccaaacgaaactgctgtctactctgtactcctaatgcatcttcttccttgaacaggtcccgagcatcagcttgttcctttctcgtccaactccttgattctggcacgcagcaagtccttgaagtgctccacctctccagtagacttctgcgccaccaaaggactccactgttacaataacatcaccaccttatgagcaatcatagtaatgcccgaaagacatttatcattaaagacgaaatcattccaagccagatggcccagcaaacagcagaaaaaaaacaaatgtaaggcaaattgttctttgtgccagggtctttcaatttctcaatcatctcagctcttgtcctgggaacattgctccatcccaaaaatgtctctcaagcagcaccaaagaaatctagccgaagcgcacttaaaaaacagatgatccatctcagtttatctctcccctccttcaattgaatttcctgtagcagttcctgcaactctatcctctcttctacttcaacctcagaacagcgatattgttttaagatcccttaaccataaaactagaaatttctgtatacccctaaactcacataaaccgtgcactcaaagttctatggcagtatatattggtggtttcgctgacgtggcatcctagtcagaaaaaattaaaaaaagtacatagggcccatatatcagctgcactttttttttcttctccttctcttctcttctcttttctctcttctctcttctcttcttcagtgagggaggccggtggcgggcagagctatggatggaggaatggcggccggaatgcggcgtcgcctcgagcaccgtgacaggaggaggtaaaggggaggcagtcggcaggaaataggggaggggagaggcgcgacgacaaggacggtgcggcgacggggacggcgaggcaatgggggacagggcgtgcggcgggggttcgctccgtgcgcgccgcatcaccgggtgtgcgacgactagtgggtgtgggcggccg

SEQ ID NO: 5899 - DNA, 4984 bp, Oryza sativa
ccccccccccccccccccgcgtctgccataggggtggtgaagaagcctgcctgcgcccgcgccctcactgaaaagagaagagagaaaagagaatagaaggagaagaaaaaaaatgtgcagcttacatgtgggccctatgtattttttaaaaatattttgctgactaggatgccacgtcagcgaaaacacccatatatactgccatagaaccttgagtgcacgatttgtgtgaatttaggggtacatagaaatttctggttttgtggttaaggaacctcaaaaaaaatctcgctgttaagttgagggacctccggtaaacttattccacgtgaaaatgccggtatggtaatattgataattgagcccacaatattctgttttttttaaaacaatcttttagacgcgcgcacatcacacttaattacacacacctaggtttacaaatacgaccataactgctcgggtttagaaactatcgataaattggccaagttcaaaaaagaattcaaaatttagtaaattttgttcaagtttcactgtttttgtccccccaaaaaaaacactagggagcggttttcgttgacgaattgcccttgtatgaaccgttctcactcaagcacgctggtttttgctttgcggcgagccgccggtggtgttgctcctagctaggccctagctagttaatcttcttctccagcggattgtgtcgatcgaattcaattcgaatctcatctcacccctacatagtggatcatgtacgtatcacgtactcatctcctacacatcatctccaattaatctaattcagattttctcagaaagctcagccattacatcatccaattgcatatttgcattctcatctccatgaaaagatcgaatccggttccttcggccaactcatgtcccttcttctccacgtcgtggccgacgccgcaaaagctactccctccatcctatataaaatatttgacgccgttgattttttttaaaatatttgaccgtttattttatttataaaatttaagtaattattaattcttttcctatcctttgatgtattgttaaatatacttttatgtatacatatagttttacacatttcacaaaaatttttaaataagacgaacggtcaaacatgtttaaaaaaatctaacagcatcgaacatttaagtaaataagggagtaattttcagctgtttgatctcgattgccgattaattagttgacctcttcgcttatcctctacacccgtctcgatctttcgctcaattccgctttaatttggtgacttggcgatcgatcgagcgagcgcgccgccggttcgccgccacgtcgccgcggaactagaaacgccggcgccgggagggaatccggtaaagccgtaaattaaaggtgagtgcatgcatggaatcttggaaaattggaatcaaagctaagctagctaagctaggagagattgtgcgaatcatctagctcaaaattaatctctctctctctatatatatagcttcatggctgggcgatcgagctgcaacgacacctgcaggctagctagctaacaaccagctgagaggttaattaattatgatttgtatgagagatcgatcgagaagaggagtagcgagggagaggatggcggcggtgagcgtgggcggcggcgggaggaacatcggggtggcgatggacttctcggcgtgcagcaaggcggcgctgcggtgggcggcggcgagcctggcacgccccggcgaccggctggtgcttgtccacgtcaagccctcgttccagtacgagcagggcgtcgcccacctctgggagcagcaaggctcacgtaagcttactgctaccactgtcctatactacctccgtcccaaatatgggtaaccgtggatatccgcgtctagtatttaactgtctgttttatttaaaaaagaattatgaattttttttaaaaaaatactattcatattttatcatctaataacaataaaaatacaaattaaagatttttcaaataagacgaacggtcaaacgtcatgaacagggtaaaactatacttattttgagatggaaggagtattataaattgctttaattttttttatagctaatttttaaaacatttgattaagtttatatataaaaaaaatactaacatacgaaacaaacgtatcactaaaacatatttaatggaactaatttagtgctatagatatagcaatatattttttttataaacttagttaaatccaataattaattagaaacaaatttaaaacgactttgtaataccaaacggagagagagcagagagagggagtatttaatttctttcttctagcgcgtgctaatggcgattcctcaccggccggagtgcagcgatgatcccgctggtggagctggccgacccgcgggtgagcaggatctacggcgtcgcgccggacgcggagacgatcggaatcctcaccagcgccgccaaccagaaaggggtatatatactgaatggtttactgttcgatcgtctgttaatccttgtgtggtagtagtatatattgaatgcccattggtgatcgatcgatgatcactggagaaatgaatggatggatgcaggtggaggtggtggcgaaggtgtactggggcgagccggcgaagaagctgacggaggcggcgcaggggattcccctgcactggctcgtcgtcgggaacagaggcctcggcgccgtcaagaggcaagcacatccatgcatctctatctctctctgtatggtggtgtttgtttctattaaagagaagataaaattaggacataaaaaatgaaaatatattagcgtataattaattaagttttagttattatatattttaaaattgaatttatctaatattttaaatcaacttttttatataaaaagttttcaactagagtatttagcaagttaaaaggtgtgttagcggaaacttaattaggaaataatgggacatatatctatcatgagtatcaatcatctcatgatagtacctactccttccgtttctaaatatttgacaccgttaaatttttttaaatatgtttgaccattcatcttatttaaaaaaaataagtaattattaattcttttcctatcatttgattaattgttaaatatacttatatgtatacatataattttacatattgtattttacaaaagtttttgaataagacgaacggttaaacatgtgctaaaatattaacaatgtcaaatatttagaaatggaggaagtactactaataaagtactagtacgtagccgatcggtaagctgaattacacggcgaggaatttgtttaatttgtttggttaattaatttgttgcttgatatatatgtagggttctgatggggagcgtgagcacgtacgtcgccaaccacgccacctgccccgtcaccgtcgtcagggagaacctgccgcctccgccgccgccgccgcagccaccgcagcccgtcgcaacggcggcgagctactactgatggctgatcagctgcgatttccccacgtatgtctcggtcagctgtaaagtcggttgctgtgtgactgggagtctgggactgtctctgcttgactgcttgtgcatagtaaaaaaaaaaaaaaagggattcctaaaactgtacttttgtaataattttgtaaagcaaaattaatgttgtaccatcttcgtcccaaattataagaatatatatgttacaaatattgtaacactagaccattctgattttaagtttttatattttgaaagggatggatagttatgtgtgaaagtattggatcgatcagtcgttgaacaaaaaattctagctagtgtgtgtgatggtgcagctgtagatatacacgaatctatcattcggtttaaaattctgatatccataattaaacgatgtgcgtgcttaattataatcggtgtagaagctagaagatgctttcagctttctctatcctaagaaagcgaaaaatacttctattactatttcctacgaaagtatatagacttttgtgtctttgagatggattcaggctcatccgaacaaggacaaagtcatttacccgttccatcatttcgtttatgtttacgtttgtaaactaaatttaaattttaaaatttaattttatagttaattttatgttttttcatcatagtttattttatataatttgctttataatcactaacatggcgtatataaaaattttactataagctattttttaagttaataataaatggacacgtatataaaaaatttactataaattattttttaagttagtaataagtggttcgtaaaagcatagacctatatatttgtcaacaaattttctcctaaaaatttaatagatgtaattatagtataatcatgatgtaattacactgtaacttattacactataattataatgtaattacatcaaacaaatttttagaagaaaattttgtcgacaaatgtataacaaaatgaaagcgtatgcataagtgagtgagtatgataatccccagatcaaccctacatatgacgggctgaattctgacctacgtgttatacagcccagtcagatgagcttcgacttgtgagtgcgtctggctgggccgaatcaaagtaatataaggaacaagttcatctgaggtgtcttaacttgttaacgaatccgattttcgttcttcaataaaaaaaaacagatacaaacggatcccttaactgccaaaaccggtacaaaataagtctcaagacgatttggacggcaatttaagctgacgtggcgcctacgtggcaatttaatttggaaaacaataaaaactatggcccccacaagtcagctacaccaaaaagattaattaaaatggtgaggcccacgtgggcctcatatgtcattctcacccctcctcttcttcctgctctctccgcatcgcccctctcttcttctctcttcacgtcgaggattcgtggacta

SEQ ID NO: 5900 - DNA, 11192 bp, Oryza sativa
atggtgatggcgacgatggatctgggtagtctatgaatcgtggacagggagagagaagaagagaggggagatgcggagagatgaggaagaataggagggatgtgagtgacatgtggggccgatgtgggccacaccatttttaattaaatttttggtgtaagtgacatgtagggacacatttttttaaagttttcaaatcaaattgtcacgtaagcgccacgtcaatgccacgtcagataaagtccgagtcaaattagcgatgcaggcaccacatcagcttaaaccactgtccaaaccaccttggaacttattttgcacttgttttgacagttgagagacccgttgtacctgatttttcggttgaaggatgaaaatcggattagttgacatgttagggaccacagatgaacttattccgtaatctaatgaccaggtacaccatgtctcggcccggcccaacactgcaagcctgtaaccgcggcgtcgtctcctccccgttcttctgctcgacgcggcgccgcggcggcggcgacggcagatggttcccggcttcagctcggcgtccggcggcggcagcacggaggtcgtctcgcgacgggttccgcttgttttgagccggtgttgtctgaggagagggggctcttcttcttcttcttccactggtggactacccgaagcctcctgcccctgacgcctgccaggtgttcgaccttatggcgccgaagcgaagcgggcgcgcgcccatccaactagcgtccagaacttggaggcgccggcgtgtgtggcggaggcttcgagcaccgcgaaagcacttccctttctcctcccgtgggggtggtcgcgctgctcgagcgtggcgtctgtgccgttgtccgtcgatggaatccttcagctcatggccggggatgcatgtcggagtttttttttttggcagctgagtgctcactgcagagaccaagcaccaattcaccaatttaagtgcaaccggaataagtctgtcacttgacaactcgccaatccattgaccccaagctcaacctcaagctcacttttggccatgggttcacagcgagttccagtgttccacagattaggcaactgatctgctgctattccacactgcttgctaggcagtgagtgagtgagtgagatgaagattggcgcatgttcagatggcatttggccacgcaagcatgatgagggttgcggaattcacaatgaaaccgggctgatggatgggagctgcctctgtgtgaaactcaacatggttttcgacgaaatgtcagatgcctacgcagctctgccgaactcgattgtctccttacatgccgctgattgagccgtcataggagcaggcacgcaccacaggttggtaaatgcttgagcttttcatttttttcccttcctgcactgcacactgtcaactctccatgcattgcattgcaagcgattgatcgtcatgcaggagcctgcctcatcttctgctatgaatgttctcaagtcaattggttaatcatcggcatcccgggaagcatagctttaccggcagattcctgaaaggagacggactttttacaggaaagggtgtccacacgcatctgattggttgcatgggaaaaagtgagactgatgagctatatcctatgcacatggttaaggttagcgtccacggatttgtcgtgcaaactaccctactgcactgcatccctgctcgccattgcagaggttagccgatctttactcaaattattaatcattccatattgaaaacaaagttatgaataaataaagggaagacaaaatggttatgctggggcctagctagctgtccggaagaaccccggcgaagtttaatttaatgactgaaagtcgaataattggagaaattagagcaagattcagaggaatgtcgtgcttctgggggtttcataattttaagtgtcttattttatcgtgccttttagattgctttttttaattaaaaagatagtctcttaagtctccaaactccctgccttgtttctattaattaaaatcggttatactcctgttcttaataggtgccagtttaaaatgcgtatagtcaacccttaaatagtttagatgcaaatgtatgcaaatagtttttggatttgtcagatgaaaataacatgtagttccaatatgaaaaacacacaccattatgtttctgatagttattatgaagtatgaacatataataaaaaagtaataatcaaatacggagtatgcgtattggagaacgtatcaatatccgaaacaacaagtaaaaaggaacataggaacatcagtttacatcttgataaagatcatgaacactaaccttttctttctcatgatccaaatatactaacaatgctacgcatgtccacactctagtgaatgtagtcatattagtatttctttagctgagtttacgagggtaaggttcatgcacgtccaagtagtcagtgatgtattagcatgatggacatgtccatttgtccaagaatgtttgtcctggcgtccgtgattttcgcttaaatataccatctcgtttttcaacatcttatattgaagtgatactctttctaatactaaataaattaaccagttcatttgagatgagcaagaaggaaaggggcgctttattctacacccacatttgtcctttgactcatgtcccatccggatctcaaatcctgtggttaggcaggttagaagcgtacaagcaagtagcacagtattaggcaggcttaagtcaaacccagatcaatcaggacccagtactaaaattgtttgaatgtcaaagaaagtcaatcgtagaccaatgatgcaaccattgcaccaacagcacatcactgtcctcatgttaccgaaacgacgggtagttgtgtaggctttgagtcacaaccaatcatctgctggcctttcgactaatatttactcaaatttcaatcatgcgttgctaactagtgtggttttacagctaaatgagtagataatctagttggaaaaggagttctttagttacaaattctgggtaccacaatgtggtctgaactctgaaaatctgaaccagaaagtagtgtgtcgttgtgcatcatgaggatttagaagccagtaggcaatagtagataaccggatagccatattgatgtctctatctggttggatgtttcctaaacgtgggaatctctgctatgtgcagttcaactgaaggaaacaaagaaaagtgcgagctggtgcgtcccatgcatgctgctgctgcagttctgcctgtgatgggggcctggatatgcaactatcgtggtagttactgtgagttctgttcttttttttttctccgcccccttcgcctttgtttcgtgtggtttattgatgcaattctgttcctgtcattgtcactcccctgcaaaagtcactttccctctacctgataattgaaaacaatgccactatgtgtgtctcgctggcttggtgattagttagtccttttctgtagttctgctaatgtggtctattcagatacaaataccatatatctatatacgaatttaccttctgttatgtgatcataatcgtattactgtatgctctcttggttgattgcacattcaattttctgaattttcttgtagtgagactgtctgccactgccagtacttcccatggtggatcggtgccaaattaggctgacaaggagaaaatttcatgccgtgtacttgtttgcagggtcagcaaaaatatcgacttcggaatcgatgaacagggtaagcacgaatcttattagttttctgtcactaaacctgagttagaaaactattaagccaaggaataaggatggaagcgtcatgctattgtcctcatgccaccaaatcatggggagtggttgaactgtttacgcacgtacactctgtaaagtggcagtgtatcttactgattcccggtgcccttttttcatccttgtcaccagttgccatgcagaagaagctgagctaacaagtcaaagcaacaagattagcctttaaaatacctcatacttagccctgcattatacaagtctaggctgattattgtaaactccatgtctgcaagagatagtgtacagtgctataccttctcctttggctttgtgttgcattttcagtaccaagaatccatcacattaccctgagtgatatgcacagagcaggtagtgtttgacaactttgtttctgctttttgcagcttaggctcctactttgtgcacatgatgagcctccaaacctcagctatggagttcatagtttcatgctcaccttgtcatctccagagttccagcatcctgtaagttccaattcatatgcatcttagaacactgcttcagttgctcagttgatggtatcattggtcttagcaatggctggcaagctgatcagctcctccattgttcttgctcttctacctctgttctgtggcatcctgcttgcaccatcatgtgaagcagccacagtagacacaacatctgccactctcctgcaagtgaagtcaggtttcactgaccctaatggcgtcctctccggctggtcgccggaggccgacgtgtgctcatggcacggcgtgacgtgcctgacaggggagggcattgtcaccggcctcaacctgtcggggtacggcctgtccggcacgatatcgccggcgatagccggccttgtatccgtcgagtccattgatctgtcgtcaaattccctcaccggcgcaatcccgccggagctcgggacgatgaagagcctgaagacgctgctgcttcactccaacctcctcaccggcgccatcccaccggagctcggcggcctcaagaacctgaagttactgaggatcggcaacaacccgctgcgcggcgagataccaccggagctcggcgactgctcggagctggagacgatcggcatggcctactgccagctgatcggcgccatcccccaccagattggcaacctgaagcagcttcagcagctggccctggacaacaacaccctcaccggcggcctcccggagcagctcgccggctgtgcaaacctgcgtgtcctctcggtggctgacaacaagctggatggcgtcataccttcctccattggcggcctgagctctctccagtctctgaaccttgcaaacaaccagttctccggcgtgattccgccggagatcggtaacctctccggcttgacatacctgaacttactcggcaaccgcctcaccggcggcatcccggaagaactgaaccggctgagccagctgcaggttgtggatttgtccaagaacaatctgtccggagagatcagtgccatctctgcatcacagctgaagaatctgaagtaccttgtgctgtctgaaaatctcctggagggaaccatccctgaaggcctctgcaatggcgatggcaatggcaatggcaactcgagcttggagaacctgttcctcgccggcaacgacctcggaggcagcattgatgccctgctgagctgcacctcgctgaagtccatcgacgtgtcgaacaacagcctcaccggcgagataccgccggcgatcgaccggctgccgggcctcgtcaaccttgcgctgcacaacaacagctttgccggcgtcctgccgccgcagattgggaacttgagtaacctggaggtgctgtctctgtaccacaatggcctcaccggcggcatcccgccggagatcggccggctgcagaggctgaagctgctgttcctctacgagaacgagatgaccggagccatcccggatgagatgaccaactgctcgagcttggaggaggtcgacttcttcggcaaccacttccatggcccgatcccggcgagcatcggcaacctcaagaacctcgccgtgctccagctccggcagaatgatctgactggcccgattccggcgagcctcggcgaatgcaggagtctgcaggcgctggcgctggcggacaaccggctctccggcgagctgccggagtcgttcggccgcctcgccgagctcagcgtcgtcaccctgtacaacaactcgctggagggcgccttgccggagtcgatgttcgagctcaagaacctgacggtcatcaacttctcccacaaccggttcaccggcgccgtcgtgccgctcctcggctccagctccctcaccgtgctggccctcaccaacaacagcttctccggcgtcatcccggcggcggtcgcgcggtcgacgggcatggtccggctacagctcgccggcaaccgcctcgccggcgcgatcccggccgagctgggtgacctgaccgagctcaagatacttgacctctcgaacaacaacttctccggcgacatcccgccggagctctccaactgctcgcggctcacccatctgaaccttgacgggaacagcctcaccggcgccgtaccgccatggctcggaggcctccggtcgctcggcgagctggacctctcgtcgaacgcgctcaccggcggcattccggtggagctcggcggctgctccggcctgctcaagctgtccctgagcggcaaccgtctctccgggagcattccgccggagatcgggaagctgacatcactcaacgttctgaacctgcagaagaacggcttcaccggcgtcattccgccggagctccggcgatgcaacaagctgtacgagctgcggctgtcggagaactcgctggaggggccgatcccggcggagctcgggcagctgccggagctgcaggtgatactggacctgagccggaacaagctctccggcgagatcccggcgtcgctcggagacctcgtcaagctggagaggctcaacctctcctccaaccagctccatggccagatacctccctcgctgctgcagctcacgagcctccaccttctcaacctgtccgacaacctcctctccggcggcatcccgggcgcgctctccgcgttcccggccgcgtccttcgcgggcaacggcgagctctgcggcgcgccgctgccgtcgtgcggggcgccgcggcggctgccgggggcggaggtgtcggccatcgtggcggccatcgccgtcgtgtcggccgcggtgtgcgtcgcgctgctgtacataatgctcaggatgtggagcaactggagggccgtcgcctccgtgtcgagctccgacggcgaggagacggcgtcctcggtggcggcggcgcacggcaagtggtgcgccggcgacggcaagtactggaaggtcgggtcggtgtcggtggcgtcgtccgccgccgaagagaagtacagctcggcgtcgtcggagacgaccagcgtgctgcacgggaagccggcggaggcggccggtggcggcgccggcgcggtgaagccggcgagcaagtgctgaacacgacgacgacccaccatggatcgcctcaagctcatcttcttcctgttaattgttgtttctttaccttgcctttgttattgtcatgtgttgttgatcagcgaagcaaaattagccgggaagaacagctttggttttgtctgatggtttggtttgctctgttccatgacgatccatgatgatggcccattggtattttgggtctaagtttagcagcccaacgtgttcgccttagggtcggcccagtaaacaaatcttccaaaatgcacaaattaactctttttttttacataacggaaattacattggctctttgcgataaaagaagatagagccacttattaaaaatattattcactaaacattgaattgggtatagaccaattatgatgagacaatgagaggtacaaattaactcacaagacttagtgtaagagaagtatttttttttccagtttaaaatataaaatatcaaactttgataattgatttatttgttaattaacacttctaaatacaaatccagccgataaaactcacaatatcaaccttttcaggtatatgcatgatacttcgatccaaggggcgaagacatacatagtgcatctagggcttgagaactaggtttgtcttcttaactagatgaataccccgctgtgttgctgcgaaaaattaaattgcataatatgtacaaataaaatgtaatttgattatcgaaactaaaacaatatgatacaattttgaacctaaaaataattgagatggtatgttttatgagagaagaaagaagacacaatttagaccatagatctttcatccaaaggctagaaataattggggtgatgtggcttaatgagagaagagagagatatcattaactacacttggtggggatgaactatataagtatataggattcacattatttagatactattaaatttttttgaaaatttcgagatacaatttgtataagcaagttcagtcctagtcttgaagattttccagtccacactcgctagcctgactctaaagatgtgtggagaccggatctaacggggggcaggggcgaggctgtggtgctagagaagaggaggagatggcggtgatgctaattcggagagcaaggggagacattagatggagcccaaagaggagtcaccttatccattgctcccaagattgaggcgaccagatctatcctctattactgtcattgctactgtcttctcaccattagatggtcgggcttgcactgccttttttttctccttcgtggggtgacaggctcttacgtgtacagacagtgacactaactaaaaattatcaaaaaaaaaatctaaaaaaatcatacatgcactttcaatagtattacatctacgtgcaaagtcgcatcttcaaattcattctacatagagaataacaaaaaagataaaattctgacaaaattgcaaccttaaaactgtcagattttttgttttttttttacggctaaaatgtaatgaatttgaagttaagattttaaccctaggtgtaatactattgaaagtacgtgtatgattttttctatattttttggtgatattttttagttggtgtgcacgtgtgtacacgcgagagcttatgtacgtatgatatgttgccactagttctcaatccctctcgtagatgaggttgtcttaaatggatcacatgttgacctgttagagatgccccgcacgtttgttatagacatttctacaatagtatcatgcatgatttacttttttattgatatttttggtcccatcggttcactaattataagcataagcgaaacggtatatttacaaataaaaaataatttgtgaattaaaacttttatacatgtgttcttaatgatctaaaaacaaaggtggaaaaataaaccacgataaaaaaaaactcaaaatcaactctaaattcaaaattgaaaattcaaattttggctgataagtataaatataaacgaaaagatgaggccatttattatatgggagtacctttcttacaaccatgtaatgcgtaatcctacatttacacgcaggtccatcaatccatatcagaattcatctccaaaatccaaatggcagggagggccagggcagcagctgcgatgcaagtcttggttgccatcgatcgtggccggtgcatgctgctgccgcctcgtccacctgaaatccgtccccgaccagatgctgccgccgccagaatgccaggtcatcacatcggccactactcatgctgacatgcagatgctgcgatgtgcactactactcctgtatatatacgctcgatctctccattgatcgtcttcatatgacggcgagttggttcacgtgggttactctctccgtctcataatataagggattttgaattttgtttgtttgcaacgtttgaccacttatcttattcaaattttttttttgcaaatataaaaaacgaaaagttgtgcttaaagtgctgtagataataaagtaagtcacaaataaaataaataataatttcaaatttttttgaataagacgagtggtcaaacgttgcaagcaaaaactcaaaatcccttatattatgagacggggggagtatactccatccgtaaaataaaaaaaacattcaatactaattattaatttatacatgtatttgtttagatacgtaagttaggattggattttctttttctttttccttttacggtgtgtgtacgtaatttgccatcagcacccttatcaattaacttattaacaccctgtaagcggggaactctttcaattcgggttaaaaatatttaaatattcaaatagctacaaaaatttctgaaaagaattcaacgacattcatatagcaaatacatatccctctataaaatcttaaatataaacttaactcacatatcaagaaataaaaaaaatacaacgtataaacaacgcgagtgctattcactatctttttcccttctcaaataagtttaaacttaatttttggtagagtgatgaatatcaatatactcattttattttaaaattttcacaaccatttacattaaatttaattttaaaaagtgtacgagagaacatcccagtgtgcgaccttcaacactcggtcattgaaatgcaccgacaatatcacaacttattaagaagcagatataatttagtctgacatatttaaaatttgcaccaacaaatcatttatcttgttttaagagtatgaatgttattaaatacatgtcacatggtaacgtcggtgtattttctttgacgaataacactaggtgacacatcattactattaatatacatttgaaaaaaaaactacaacctaaaatactacaatcagaaaaaaaaggaaaaaaaaaacaacaacacactacgtgccaacaacacttgtgcacacaccccgctgaggaagaaacttaacactatgtcggatgcggctatgtgtgactggatgttgccgccaggtttacaatagagccacgaacacaccacctatcgccaacacttccaaataactgatcacaatgcacgcccggataacaccacagtgaagggttgtagagggagagggcaacagagaagaaagatccactcgtgccttgtatagacccaccggccaccgccataataacatcctaagcgtcatcgcagtccaaattgtctaaagatagcataggtagccacatgactttcaagagatgacgtccttaaaaaggtcgtgatgctgtcgcctattcatggacatgattttcacctggaaagttccatcagggaggtggaagatgcctcgacaatgctccc

SEQ ID NO: 5901 - DNA, 4023 bp, Oryza sativa
  unsure (1)..(4023): unsure at all n locations
gcgctctattgtccctcctcccactagctgctggccataacatgttagatctatggaaggggtggatccaaagtagaaccattgtctccctagtcgcctccattgacatatatagcgcctccaaggagaaaagagccctgccaaaactattcttgcagttgctcagcttaccagcaggcttcttcaacgacggcgaggggagaggggaaggagggaggcggttgcgttgtcccgggagtccgttcgggtcaccaatgagacgacacaggcggggcgtgtttatagttggccatatgggccgcccggcacagctcaggcccggttgtgctcgggccaagatttgtcaggccgacacagcccgacctacatgccggaccgtgccatgctgtgccggcccacgtgctccacctgcggcctaggcatgacccaataagggtcgggccatgccgggctgacccgaaggcacgggtagcccatcgtggtttctttgaaataagtctatttcccctccctactctttgggttgtgacatatatatagttaaaataagtctattttacatctctactccttgggccgttccatataatacgtctatttgtcctccctattctttgtgtcctgtcttacatatggttgaaataagtctatttcacctccctgaagttcgtgccgtgccaggccggcccaccgtgctgaggcataggcccaggcacggcccaacagcagggccgtgctagcacatgcctgacagcgatcgggccgtaccggcacgggcccgacagcgatcaggccgtggcgtgcctgagccaggctaaaatcccgtgccttaggccggaccatccggcctcgggccttatggccaactatcgtgttgaaatgtttttctgtcggtgcatttaatttacttatcagttatcaatacatgttgaacactaagagagatcactgcggacactagttggcaaatctcactgcgaacatgcatacatgtactactactcataaaatctaccagtactctagcttgctggttgattgattcatcattcattacaaatcgcaaatgcgctcaaccgtacgaccggagtacgtccgtacgtcgtcgtcttcgtcaccggtcgccgcagcagctgtagctatagctagcgatcgacctaagctagtgttgctgtcgtcgctttccaatgatgagttcttttattcccggccccggcagaaggtcgttagttttcagtgaacgcatcgagtggattcaccgcgtaatttcgacgacacaatcatattcgccagggtttcaggatcgaatcgatcgatctatccgtctcaattctcaggtgaagtaatagtaataccttttcttataaaaatgcctacttgcagggatgaacagtcgcatgtacaaggtgtgtgattaaggattccaaaatgcaaaatttgctacaggacactcaaaaaacgtgtaattagccgtgagacaccgtaaaaacatgaattggctataggacatcgtaaaagagtggtaattagctactggacaccggatacattattttattatttccggtgaaaacggagagagaaacaatcaaaaaagaccagattaccctatgtgggccacggatgtcagcctctcctctattttcttggtcaaagagcgacatggtgagggagccgcacccggagccggactcgagcacgtggcacccggggacgagctcgaggtaggagacgacgaggctgatgtcggcgaggtagaggatctgcgtccggtggctgagcatgagcgtccacagctcagaggtgggcgcaaggaggtggatgaacccgcccttccccttgcctccggcggtggcggcgctgtggaccttgcagccgaaggggcggccgatccagtcatcatggcggaagacgccgaagcggttctggagcatgcatgcccacagcgcgcatggcgtcgtggcgctcgtacaccacgacggtgtccccctccgcgatgcagcgttgggaggtgggctttggatgacggatccagtggtgttagatttggttgggttttaccttctaatcccccttttaatctgagatacgtccaaggtgttttggtttggccgtatccgtttgggagaaatatcccacagcaaccatgaggtcgacgccggggtcggggccctagacgtacagcatcacacgcgaagccggcttggactcgacgcggaacgacctgccgatctcgtccagcgccaggacctgcccgccgttgagccactggctgtcgacggcgatggcgacgttgatgtgttctgcggcttgccggccacctgcccgccgacgcgcacccacgccaacacctggtatgtcgcgtacagcgccagctcacctcaccctgtccccgcctctcctccctgccgtcctcgcttcctgcaacggtcgacgcgggccgccggggcggagccggaggttgcatgctcccgccgtggctgcgatgctgccccggtggagtgcgctctactcgcggcgggtgcgtcgctgtcgccgtcgccgccgagaacatcgcaagtgggagtgaacgggacgatggtagcgtgcgacgtgctactgccgggtgaggctgaggcggccggcgtgcgcagcaccggcggggagggcggcgaggaggctggagagggagtgcttgcggccggggacatttcagtacttttaacgctctttctctctccgtttctaccgaaaataataaaataatgtctctagtgtccagtagctaattaccactcttttgcgatgtcctacagccaatttatgtttttgcggtgtctcgcggctaattacacgttttttgagtgtcctgtagcaaattttgccaaatcttaattgtgtgtagtacttgatctgttatattttctcttagtttccgttaacatacttttcaaactctgttaactactaaacagagtggttcatgcgaaaattttctatatcaaagttagttaaaaatgtgaaataaatcaatttatcaaggcaaaataattaaaacttaattaatcatacgctaatggctttctcattttacatgtgttaacttaatttttatcttcatcaggatacttagttagcggaatataaagagtaaagtaatgtatattcatcatattaacaaaaggggaggggtaacggaaaataatagcatcattccaagctctaagtcgagctcgaatcgaacctagcttcagtagcccataagatcaagttggtaccatggattttttttttcttaaatttactaacggtatgtggtagaatataagtgaatctttcatcttttcttatcattttcaacttttaaagtgaactgattggggcatgtaaatcaatatgataaaaaaaaatgccagagaacttgaaagacccgatgaagcctctatatgagaagagcttaattgatataacaatgtaggtcaacttcattatttacctacaaattaaatcaagcacgccgagtttagattacattggacaccatattacatctacgctagtcccactcatttgaaatgaaagataatttcaagcacaataactgaattccccacaagaattcagaggataacacaaaaaagttcccctagctagccaacaatatcaacatgatcagagattaaaaaaaaaaaaacaccaagaactttgtcttttgctctactaccatctgcgtgtcagtataacgtgactgctcaaaactcaaaagcagtacctgacagagatccatacattttcacatggcnnnnnnnnnnnnnnnnnnnnnnnagaagtacatgagtttgcattgcatgctatacccatcagattgttgcatgcttcctctctgttcttttgaccagaaatttcatccatggctgcattttgatgtagctttggaggccaatcttttctcctgcttacttacctgcagagtatgcagaccagccttttctgactgtcatttgcattttgtcacctggatatgcattcagccattaaatgggg

SEQ ID NO: 5902 - DNA, 4520 bp, Oryza sativa
agcagaagtacatgagtttgcattgcatgctatacccatcagattgttgcatgcttcctctctgttcttttgaccagaaatttcatccatggctgcattttgatgtagctttggaggccaatcttttctcctgcttacttacctgcagagtatgcagaccagccttttctggctgtcatttgcattttgtcacctggatatgcattcagccaattaaatggggtcttgtgtactttggattccaatatatggaactgttttgttcacttgctgttccttgtcgtcacctcctgtgtataaaatcagtacatgtaaatcaggcccaaaaagttggtgaatttctcaagttaattccttgatgtgggtgaatttataaaattagtgtaatatgtggagtcctggaaatttcattcaggagctgtgtatgtttattgtaatttttttcttttaataataaaaattcccagtgatactcatttattgtttataaaattccagtattttcgtgctttcattcagtataaaaattcccagtgcttacatatataattctgtactatttgcataagaaactgaaaatactggtttaagcgattgtcaaattaaggcacacatacatatttgtacggtcatatagtacgtatcaaggaatttagaaaataccataccaatattaatttaccgaagtgtccattttggaccgacatgcatgccatcatctatacatatgcttctcatatttctaggataaatattttacaaattattcatagctaaaagatttgaaagttgacatcattcttatccaaaatgaatgacgagtattattaattgaaaggaataactttttttcacaaccttacgaaccaatttaataaccataaattaagaattaatttggcatcgtagtggtttcaaaagcaccaactcattttggatttggattcagagaattagttgaaacttgaaactcagaagcatcttctaatttggagctgtaactttgcccgtgtacatccattcaggaagtagaggcgagattttaatccattattaaaaaattaaaatttggatctgtaacaaaagattattactggaaccaataaagattcactaattaagtagcatcggaagcgactaatacataacccaacaaccacaaactgctcctgaacacaaaaggaagacaaattaaacaaacaaacaaataaatgagcagccagacgaaaatttacccttctttcaagttcaccaaatgaaacaactattagcaatttcgatcaccaaccttattatgtacacgcggaataattatataattaagctcagctcatgattattgccaattagtaattaaacaacacaaatatatgtacagcaaaagagagagaaattaagtactcaaattaacgctcacaagttgtgcagcggatttgatccagtcggcgagaacctcttgtcgtcgctgaagaagccatcgtcgccgccgccgccggtgccggtgccgaaccgccgtcgggtgaaggcggcgtggcggctctgatccttccagtgctgcccatgagccgacgacgacggcgaggcgccgttcttggaaccgggaggcggccgcggccgccgctgctgctgctgctgctgctccggcgacgacgacgggacgacggcggcggcgacggcattgccgagaagcgaggctcccctcagcgcgagagggacgatgatcagtgtcaccaccatggcaatcttgatgcagttcatggcactctctcttacttaattattagcctctctctctctctcacacacgtacactctcgagaagagatagaaatggagctatagcaaattatgtgctagctacttcgtcgttgtggccatgaaatactcggcaatgatggatacagtcttacataggccttctttgtgttggcagcttctgtaactactcgtaaaatctccaactacataaataggggtgtgtttagttcacggcaaaattagaagtttggttgaaatcagaacgatgcgacggaaaagttgaaaacttgtgtgtatacaaagttttaatgtgatggaaaaattagaagtttttttttaaaaaaaattggaactaaactcggcctagatcatgctcacgtccaaatttcgagaccattactaagatattttacaaagatctttaccggtagtagaaataaatttagtcggctcatctttttattagtaatttatttatattatagtctgaactattgatagtagaatgtataaaattaacggttaaaatcagttcgactgataacatacttacacaattgaatactatcagtacaaactatcataatatcactataaactagtagtaaccaaaagctgagcaactcagtttcttttctcacccactactaaccaactacttaggctgtgtttagatcagaggtgaaaagttttgacgtatcacatcgaatatacggatacacatttgaagtattaaacgtagactaataataaaacaaattacaaattctgcctgtaaactgcgagacgaatttattaagcctaattaatccgtcatcagtaaatgtttaccacattgtcaaatcatggagtaattaggtttaaaagattcatctggcaattcacacgcaattcgtgtaattatttttttgtctatatttaatactttatacatgtgttcaaacatttcatgtgacagggtgaaaagtttttacgtgggaactaaacatgaaatctttagccctcaaataggggagagagggagagagaatgtggctgtgagagttaagccgttttgttgtgtggttgggccaaacgaacaaagaaggcagctagatagctagttgctgctgacaaaaaggcctcctcattcctgaatgaatgcatgtaatgccggtgcaacagctctgatcgattggacgtgtgatgactcatgaatggtcgatccgtcccttccttgaaatttttaccggaaccaattgactgaggccgtgtttagattcattttctttttttctttaccaaaaacgtcacatcgaatatgtaggctcatgcatagagcattaaatatggacgaaaaaaaatcaattgcacagtttatataaattgagagatgaatcttttaagcctaattacgccatgatttaataatgtgatgctacagtagaaatttactaatgacagattaattaggtttaatacattcgtctcgcagtttacaggcggaatttgtaatttgttttgttattagactacgtttaatactttaaatgtatatcacattcttaaaaaaattggccaaaggactaaacacagcctgagccgataatgccaactacccctctatccaacggatgttcgcggcaaagtgatccaacggatatatgctccagctcgctgtatgtcaagaaagcttatgtatgtatcaagaattctcttttttttttccttaaacaagcagagagctgcgtgtcattttagtaaataaaaaaccaataatacattacaacccacgttgacaagttaaaatagacgcgccacttaatcaagaaaaaaagatcaaaggacactaggaataggaataggggcctaagctgtcccgacccacaaactctcaagatcattagctccaacagtacaccgcagattgccttttgcactcaaaggacaaataccatgcttacacgcttggggcatctctgaatcatcaagaattcaaaatgtcattatggacacacatgtatttaacatggcccatatatatactccatccacaaaagttacatctattactttttgtcaccaagacaaaggagaaattaaatcatcttggatattacaaaatcaaggagtgaatgcaagcatgcaaccaatgagtatttagatgactccttggattctaattaaacatttaatttatctcttcttttaagtcttgaatgcataaagactaaaaaaaactacttatttagaaaaactcaaatgtgaaatatgtctaacttttgtggatggagggagtacatcggaaaccgaacgtggaagtacaccatagaagattcaaactgatgacgacatcgagtaacaatatttgttaacaaggtttaactaaaacctatatccctggaggcactaattgcttatgcctctctgagttctctccgatccaatataattatagcgtatcagaattacaatgatcctctagcggatgttgtccgtagccatttcctcttacttatgctaagtcactatgcggtttcaaccggtatgtccctttatttaagagagaacctatgaccttaagtcgccatgtggttacaactggtgtgccgaacgtggaagaacaccatagaagatccaaactgatgatgatatagaggcaccatatttattaatgaggttcagcagaaacattcatccctaggacattaattacatgagcttttccccgatccttggccggtgttagccattaattccctctcacctatgctaagtcacca

SEQ ID NO: 5903 - DNA, 5552 bp, Oryza sativa
tttttttactatttaggcctatatgtatatgtggttttctgatcttccatgtttcacaaagaccacatttttgtggttgtatgctaagacaaaaaaaaaatatgatcttgaggagacttttttaaactttacattagaaaatgcagcacatcctgatatctcttcatgactgtaaatctgtcggtaaagtaacatctgtacagttgcatcaaaaccagattgttgcaacatctgaatgttttgacatacctttccccaaaagtttcagttcagttcaccccacattttcatggctcatcacaacagttacaatttccctttaacaaaagacaagcaaacacacacaacatcatcaatcaccagcttgagcttataactgatgcagtgagttaatcacaagattacaccaacaacaaaaaaaatcacaatctgccagatttgctcctcttcatttttactgaagctccaaaagtcagaagagaagtccaaggctgcgcctacgtcacgcatgcgcgcatcgcccccggccatggcgtcatcgcagcagccacaggctatggcgccgctcacgcgcgcgcggcgcgccaccggtaaccgacgtcgctgggggggcggcgcgccatggcgcgcccgggcgggcgcgcgcggcgctagcggacaaggcgagcggcgcggccagagcgggggagcgcgccaagtggccagctagctagcgcgcgcgatggcatcaaccgcgtctctctctctctctctcgccatcgtcactgcggctgctgctgctctcgcttccgtttcatgtcgcgtccagtagcgggcgcgccgcgcgcggggccttggaagtgttcgatcgcgagcgtctcgtctcctccttcgcacgagcggttcgctttgggctatagcctatagcgcgctctggacgcgacgacaccgagtcaccgacgaacgagcgcgacgccgacgaacgagcgcgcgacgccatggacgagcggagagctgctgcttccttgctcgccgtgctggttctgagcctcgtggtgtccgcctcctccgccgccgccggcgtggcgcccgcggcgccgccggatgtctttcttccccagccgccgccgccggcgaaggtgaaggtgaaggtgctgaacacgcaaaaaaagaaaataaaataaaaaattctttgatcgcaagccttgtcttctcatcttagtttgatctttgattggtttcttagctcatgctattctttcttgcttgaatcatgatgataaaagttcttccaaatatatcaatcttttcttgatatatatatattgcgaatttgcaactgaaaaattttcagttcttgctgcactcactcacccggtttttcttgctgcattcgcgtgcgtcttgcagcggaggcgttgctggccgtcaaggcggcgctgcatgacacggccaacgtcctcgccgactggaacgccggctcaggcggcgtggtcgtcgccggcggcggcggcggcggcggcccgtgcaactggagcatggtgacctgctccaagaccggccatgtgtccgtgctgtatgtgctgactagctatctagttgtccattttcttctgtgcttgtgcttgtcgccgccggccatggcgggttcgccggagctcggactgatggatcgatctctctccgtttttttgttcggttttgcagcgatctggctcaccggaatctgtccggcacgctgtcgccggcgatcgggaaactcaggcggctgcgactcctgtacggattgattctctctaactgtttactcgatcggtgcccgttccgtttgagacctagaaatttcaagggaattttgggaaatttaattttgttctgattcatctggaattcgttcttcccaaccgaaagtttacagaattttcgccgtgtttagttccaaaatatttcttcaaacttctaacttttccattacgtcaaaactttcctacacacataaatttccaacttttccatcacatcgttccaatttcaaccaaacttccaattttaacgtaaactaaacacagcctggatctacagtggatccattcaggaagtggctcccaccagaaatataaaatttgttttgaactaagtgtgagtttcttcaaattcagcaaaaatatgtacatgtttcttttttttttcttggaaaattcgttagatcttctgaagttttggaatcctccagcacccccccccacccccatttttttcaaggccctctatttatttcttctttccaaaatgtgaaaccctaacctgtatatataatctttagattactagcctagagcccgtgccttgcaatggaaaacaaggctgagttcgctggttgtagttgggaactatttcctcgatcacgtaaaacggagcgactcattagcgtatgattaattaagtattagctatttttaaaaaagtagattaatatgatttttaaaacaacttttctataattttttttttgcaaaacacacactatttagtagtttgggaagcgtgcgtgtgaaaaacgggagagaggaggagttgggaacattaggaaacaaactcatcccaaattgaatttctagcttattaaatcatttaataagcactcatttagtctaagtaatactatgatttttttattgaacaagtaagtaattttgaaatttgggggagcctatagtgaaataggggaggacttattaaaatgtggtgtaatattatagattatggggctcagatgttactagtagggatggtgtgcaaatgaacaccaccaataccaatattttaagtagtataaattatcgatgcgattgttttacccctgtttggaacaagagaattttggacaaaatgtgaaacatcaattctcactgagcatgggtctcttttcgaatccagacattccaagacaaggcttttttcactgttatagacagataatctcaggaaatgaggaatttggtttgaattttgtgcaggtttttgcaacacaatgcaatttctggccctattcctgacaccataggcaggctgaaggtgctacaaacgctggacctggcatataatcacttcacaggcactattccaagcatactgggacattccaagggcatcttcctcatgtaagattagcatttatgattagactacttttatagtggtgtctgctggaagtataatcaatctagacattccatgttttttttttcatccaatggactatatctgtttctactatcacctgatctactggttgtagaataaaggtagaaattgtagaataattatttctaccggtagtagaacgtataaatcaacggctcggattgcttgtactagagatgatactggtagtagaatactattggtagagaatacggtaaaagtactcttatgactattgatttgaaggcattgttattttgttgcataatggctctgattgtttgtactagtgataataccggtggtagtacaatactaagaatgcctcaaaatactcttatgttttttgatttgaaggcattgttattttgttgttgcataacagatatgaacatgaattggaccacctgatttttttttctgcttgcctcattcctccaggagattgagccacaacaatttatctggatctatacctgattcactagccactgctcccagcattgtcctcctgtataattctccttgccaacttctacttattgcttcattgtttttgtaaactttttttgttgtgatattgagcttgagctgaactatttcagggatctatcctttaacaacctgagtggtccagcaccagtttttagcgcgaatagtgtattgtaagtgatttagaatgagtttttctttcttggtctaactaaatagtgcaacctgtctcaacattatctctcaggggttaccactaatttgccttctcttttctctgtttttctcacttgtcatacttgataagccttcgtggaaatcctttgatacaaaacttcagttgtgaaggaacctgtacttctgtgatagaagagacgattgctgtcccttctgcagcagaagaaccagttgctgtcagcatagaagaaccaatcagtaatacaaattgttcaccacccaaattctgggacatttaactgcatatgaaccattatttaaacaaatttgtgtgaagcaagcaagtttgggcattcatgccctcctgcatgttctaattagagtcattttctcttcccagttcacaggaaaggcttggcaggaactgctcggcgtgtttcattctacatagcagctgttcttctaatagttttcttgattgctggatttgtcgcgtctatttcgcagtggcgtaggcgacaccagatctttgctgatttcgatggtaatgacatctcaagtagtactgcatatatgtgcaagatttgttatgatatctacctgcaagggggcagtataggtcaaaatatcaataggttaactttggagtcaccctgattgttttttttcttttgggagtgcttgccatttttggcacttatatacaacataataatgttttatgttttaatgttgttggtggagggtttgcactgtgatattagaggaaagtttgcattaagtccaataaagtggagagttctcttgaggttctacatgttagctaattttgttacaggtttagcgcattaacttctgtacaaaaagtaatcttgcgagggtctgaaacatttgtatcaagatactcaggccacatatttccataccaaagtgagtaggagcacataataacatgttcctatgaacgcgatactaagttagaaggaaaacaataatgatttatgattggaactctgatcgcatacataaaacaccaaggtagctagaatgaaaaaccttctcacaaccagccttcatgagatcacaacaagcactaggctcgcctacaatgctgccttagcatcttcttcttcttttttgccaatgcatcaaaagttacatgccaatatatccaattttctttaaacactaaaacaaatcatggagttggacaataccatcatacgtgctattgacatatggatctagtgccacgtgtcattctcgcacacaatggtattttgcaattcacatatttttatgatggtccatgatgatatctttcattatttcattctcttattgttatataattataacattttatttaccaaaccttacttggggtagaattaaggaaaatagagtacatgtctttgaaatgacggtacgacattgtcgtggttaacggttattcatgattcaatcgggctaaagagatcaagccacgaacattgtcatggattgacatgcatagcagaggtaggcttacttagagttgtttgccaatgcttcctacactatatataaagataagactgaccgaaatagagttgtatattcttttgtgtcatagtacaggttctagggtgttttggttagtggttacccaactttggatccttagggtaagtagcatggggtgcagcaatatgtgacgt

SEQ ID NO: 5904 - DNA, 2241 bp, Oryza sativa
cgagaccgagcaggggagattggaggtgcttgtggcggctaggtgcggcggagccaaggagtggccggcggcacgtggcacagctgcataaggtgttcgccgttgagcgcccggtggtgcatgctagggcacgtggcacaaccacacggggtgtttgccgttaagcatcattgtggcaatgttgtgtcagccatcatgccttttttcagtttatcctccgccactgccctaggatgggtggcctggtcacgaggagctaattatggtgttgaagatgagataggtaggtgggggaattgacaggtggtgccgattgtgtccgaagagaggcatgagtgggatatgggtggccatggcatttttttatgtgctgaaaagtataggtgagggagagatccagagcttgttaatcttgatctgcagtaggacatttagatattagactttctagaaaaatatattataatctttctgcacctttttttaaagatattctatcatgtgcactgactcgaaaagtttgatattcatatttttgtgtggatctctttccctttgaccattgatttagctttgctaccatttggtacatggttaacaactggatataatatatgagaaccaattcaatgctgataaaaaaatcctaatagtgcagaggggtcgaactgcattaacatttcacataactaatcatattatggtgttaatactagtcatgcccatgcatggttgcttttcatatatgcttatgtatagttttcccatttttgtctttttagattaaaaacaccagcaatttctaagtatgatacaacatttgggctctagccaaataccgtgttttcctcagtttaggcattttaactatttcttcaatagcatgactatagagttatgttaattttactgtgcagtactctgattcctgaatgtgatcatatttatccaggaccagaaatatacctaggccatctgaagcagttcatgatcaaggagatcaaagaagctaccaataacttcgaccgaagaaacattttggggcagggaggatttggaatagtatacaagggtcgcttgcgcgatggcacaattgttgctgttaaaaggatgaaagattgtttttctgtttgtggggatgatcagttccacacagaagttgaagtaataagcttgattgttcatcgcaatctccttcgtcttactgggttctgtattacagacactgaaaggctccttgtataccctttcatgccaaatggaactgtttcttctaaattacaaggttagtcccatgcttcagtatattcttttgtcatttatgcatgatgtacactgacacacatggggcatgccaaagtcctatttttctcaaagtcctatattttctaatggatgtaaagtatagatgttaattatacaaggcagtaatatatttctcaaaaatatgtactacatgttagtttttttcattaaaaaactatagtgcactttctgaatatatcaaagttaaagttggtgtgtacttgagatttgccttgatttttcaaaatgaaaagaaaatattgatagcctaccaatcaaagatggaacactataataacataatataccttagctaaccatatgtaaggtgattatacatgttgtccttgccttatttgcaaatgtttatgtaaggtggtctatattttaccatcacatttgttttcttggtctatgcatattatactgttaatggtacaagtgctaaaaactatgtgcatcttgtgtactgtcattattgtctccctccaaaggatgtataacaaaaggtatctattagttgatacatgatgtttctaaacaatcagatgttttttttttaagtgtccttgggatttaccctttctctgacagactgacattcatgtttattttcagtatttttagaccgaatataaatacattgacccggcatttgggagaaagccaaaagatatatagtacagagttctttattttcagttgttctgttctttctttagattagagtcatcatgtttgtttttgtttgttcctatagacttcattacatatatttgtgttagtatgaaactgagtcaatagggcattgactggtgaaaagaattatatgaaaatgatgtataagttcttcattcattgccacacacaaacaatgttttctgaactaagtattttcattttctatgagcaaattgaactaactgtttttcctca

SEQ ID NO: 5905 - DNA, 640 bp, Oryza sativa
cacgtctatgactccaccacactcaaatctatccatgcttttaggtaggagagggagaaggcgagagagaaggatgcatccactctcccccgcgcagacccgccaacatggccatcccaaaagcgccggcataggaggacaaatcatctagattagagattagtgggaaagggccttcaaacgacacctccaatgaggttacgacgccaagggtgtcgccatcgcctgtcccaggagcagggcaattttcacccgaataatcccctaggaaggaagaagactccacaccaacgtctccaagaaggttgcggcgccagaaagcgctgccgctgccaaccctaaacagcctggactttctcccaaagaacctttggccctcccatgccacatctccatcactcccaacagccgctaccatccaaaatcccttcaacgcatggctaccgcacaagtgccaatcgccagcggacaccatacaggaggccccttctcgaggaagaagccgaagtccatgcacaacaccactctgcaccaacatcgcaatctcccaccatcgcctacatcgtagctcgttgctacgaaagaggagagctgccgccatccggtgaaccatggcctctccctccttctgcacagacca

SEQ ID NO: 5906 - DNA, 2616 bp, Oryza sativa
atttaattgacaaagataatatagttctttagagaaccatcttgggggcagtgcccgggttttgagggtagtggaattaagtcctttgatctctttcggctctaagcagcaattaaaccaaaagtactcatataagcacaccatagctgttaccatctacctctactttctgacctcatcaccttttatcatgtgcacctaattatacagtatattcgtttcttgttcatcatcagcttaaaccttctcctgaaattttcaaattattaatggttcccaagaaagattagctttgcttttcactgcactcctgttccattgtaaagaggttacttgtggaatttgctaactacatatgaagttaaatgttcctgaatgatcatatgaatttatatcgaaactgtgtggtgacaaaagtcttttgcactcaaccagtgtcaaataaaacgcatcacacttttctttgatatactactttcattaaatcctaagtttgtacttactacattcatttccaatatcaccttatgttactttcaggagtgaggttccatggtcaaatcaaatgacatcaagacatagaacaatgaagcaaaaatccaaggtgcaatgcttccaaaacagatgctatagcatctttgcattgaaattacaaattgaaagggaatgcaactacagtaaaattgacctaagaactcatgatcaagaaccaataggtaggagagaatccacgtgcattacaggaacacataaatacaaataagtggattcccatttttccatcgcttgaattggatagataaatcacccaggacaactaatcaaataccgcaccagctaatccaaaatagaaaattgaaataattcagtttacgggaagcattacaatcaccaaatgtgacttcttattattatacaaattgtaaaactgtgtgggaaggattgcatcatctcatagtgatcccttcctcaatttaagggaactgctacattgcattaattgtatagcaacaaaaaagaagcaaaaaaggctcaaaagctcaagggcacttacatttggacggtgtaaaaagacagagaactatggcagtaagctatgatccaaaaatacagacaaaaatgaagtcaagttagctttttgcaagtccaaggaaaaactgtgtagtatgtcatggcacaaaaagacataccaaaatgatgtcaccattttgtttctctaaacactaattcataaggaagttgttttctgtagctcaatgtatggacctttttacacggatagttcaccaactttatgccatgaatcttagccaagattatttcaacaaaagtagagtctggtgagaatacagtataccacagtccacatataaaattagttttggtaaaaactattgttctcttcagcacggccactaattgcacagcaattgcagagcaacaaggaccagaaactttcacatcgatcttccatcagtttgtttcacaggcataactcttcagcacttatattatgtgatgtcaccatcattctcatatttatagggaaaacgttcagcaaaggtaaatttccaaatacttaagtgctaagacaaaagaatggtctcactgcaaaaagaagaaaagacaaaagcatggtttcaaacggtacattctaatttatttccggaaggaggccccgaatgttaaaaccaaaaaattgtacatttggcactaaatggtgagcccattaacaacggaacaagggccactttcatcttctcacatgggcaaacagcacattgactgaaagtgatagcacgaagtagaactataattgaggaacttactgatacagaaggaattgaggcaaatttcataacaatttgtagaaacaaaaacttcttgaaaaaaatgaagggatcttcatgattctcaaatagatatactgcgattaccattttccctatcaaatcaaatacttttacattattacaataaacacttcaactaagaataaccaaaatcttcttcattagaaaaaggagaacatcaccacacgtaccatttcataacaaaataccacttacaacaatagaagaagatttcagaatggtataacaaataacatgttatggccatataaattttgttcctgttttatatagaaataattgtgccaaaatcaaaccacctagaaaacttctttacttaggtttaagcacatagctgaatagttttgcttttaatgtccgaatcataaatattttggggtttcaaaaaaaaaaagaatcataaacatttcatgaagatttccttttttcctgaacacatttttctccaacatggttttcaatcaaattggattcatcacgaaatttcctcttccttcatgctgcactcttgaaaaatgcacagcaagtagcagtttcaaaaatagcatcagcgtgatacaatatccagaagaaacacaaaggccatcacagggaataagaaagcgagtgcattgcatatgcttcctgctttatccatataataggaactccttttttcagcagcctattagacaatgtttttgcctatcatacggatacaaaacaaaagatatgaaataaagttgaatggaacaggatgtgc

SEQ ID NO: 5907 - DNA, 6971 bp, Oryza sativa
aacagtgttcatgatgaaaaattgaaaaccactagttaattagactaagctactacctgtgatctgtgtaatggaacagcaagcaagcaagcacctccagttcatcagaactccaattcccaggcagctctctatatatatatcactatatcagaatctggtgaagcctctgaatcatgctgtaattgcacagtcaaaaagatcatacaagctatgatgatcgaagaattgactgaacgaatgatggtaccttaatcttaaagcacactccaaatgacacacaactaatgaacaaaaccagcgtgaaaaaaaaaataatcagaaaccccttctcgttttctctgcataaccagtagcgggaggacgagatcccgcgctcgcgctcgcgcgatgaaccattcccctttcgctaactcatgcagtgctacgactacgagtgatttcccccatcccgcgacgcgcaaagcggagtgatggtcggagtcggagaagacgagcacaaagagagggaggagcgtgttgggatccgaacctcgcggcgacgacgacggagcggcgatcggcggcgctcccgccggcgtcgaaccggcggcggcccgcgccacccaccctacccgcggtcgccgccgccgcgccggcgagcctcgcctccctgctgggccggatcgggccgatgctatgctggtctactcataatgggccgaaacaggtgggacccactcttaaatgggccgaatcttctccggcccaacgaactcccaagcggaggactagtcgtgtactccaagtcgtaagtcgtctcctccagtgaagaaaaataaaattaaataaaattaaaaaatattttattttattttatttttaatttgaagcccaactttaatttccttcctaaccaagcagtcaagcacttcattcaccttgctcccctccgcaagccgccgccgcagcaactccggcgaaatccccggccgccgccgccgccgcccgccgccgcgatgaacgcgtcgcagttcatggacaaacagatcctcggcctcgcggcctcgggcgccggtgcggccgccgccgccgccgccgcgtcgtcgtcccctcccgcggcgggaggaggtgggggcggcgggctgttcgatctgatgagccccgacccgcaggaggacggcggcggccacgcgcgccgcgggcagcagcaacacggcggcgccgacgaggtggtgcccagctacgacttccagcccatccgcgccgctcccgccgccgcggcgccggcctccgcggcgagcccttgggggtcgctcgactccaaggcggcgtcctccaacctcaaggtatcatctcccagccgagggcgcctccgatagatctgctcagctcgcctcgcctcgcctgcttcacacacgaattgaacaagcgaaatttccaaacattcgtaagcttgtgtgcttttcttagccataggaatgtccagttctaggtgattggtaatactttgtgactctgcgctgtagtgatgtcgaattgattgtgtgaagttgtgattgctcgtttgctattacatgattcagatatagaaaggaaagtgacattttagtattcgatgttggtgaagattgatgccttatctgctcataaaggggagaccacagtgctagttaggatactactagttagcttgatttctacatttagcagttcaatgctatttctgtggaaataaccctgagcccctgactgtaatcaccactgtattacgatactgagcagttcaatcagtttgttttcctaaaaccatttgaggatattttcagatgctactctgttatgggtaaatcatgctcttatcccaagaggcaaagacccgaatatgtcaagtgttcactttgctaggcttatacccttgtcagggaacgatggatatttgccagcattgttttaattttgtgattctaatactttatcaatggccctgatttgttttgattcctttatttagttggttctgattgttcaagcctttaaggtctaggttagatagtttggcactttgcccaaataagaaaaaagaactatcgtgaaaaatatgtaggttttatatgatattttttatttggcaattttgtgaatttctgatttaggtaatatagcaatacaatttgttgccaactcatcaatcattaacatggacaataattacatgtatcttttcatcccaagtccagcaaattacctaattttttgatactttgattcatggtcatttatcaattcatacaagtgatctgcctctcttcccttgtgatatattgcttaacatgtttatcctctctcattgtgcaaagagtgctggcatgttggagtctcatgtgctcaagaaggtcagtcacgaagaagaaaggggcaacttcagtgcagtctccatagcagatattgatcgcacaatgaagaaatatgctgataacctgctacatgcactggaaagtgtaagctcaaggctatcacagctagagggcagaacacaccatcttgagaactctgttggtgagttgaagctaataattggtaactacaatggcagcactgatggaaaactgagacaatttgagaacacactgcgtgaggtaagcttccctctcttttactgttagacaatatgctgtaatatctgaattggtaaccaatttatggatttgattatcaagaggtaaagtaagtaaccaatttatggatttgattatcaagaggtaaagtaatttagttttctattgagtaacagtagtcttttctttaccttcccatgtgaaatgctgctatttttatttttatccttttgagagaaaaaagctgaagccagtattctaagtttttgtcttcttttttgtgtatttatatgaatagtaaaatgtacagcttctactttaccctgtcttggcttatttgattattaatggtccatagcttcacatgccctagctgggttgcgacattggttatagttactatttgtgatttaaaggacaataacatgagcagggagctaatatgtaccttaactgagtttattctttaactataagtatatgcagtttgcctggtgttgtagtctttaagttgtgatataattgtcttgaacattactaaaaactgcttatttggttctaatttgtattaatttgttttataccattgtgagggcatcccgtatcttactatggcatgtgctacgtgtaggttcaagctggtgtgcagattttgcgtgacaagcaagaaattgttgagacacaggtccaactttcaaagctccaattgtcaaaagcagaggatgctcaatcagaaaaggctggtgttggtcaggcagattcaaggcagcagccaactctaccccaacctcagcatcaagcccctccgccttcccatccaccggcattgcctgcccttcctgctccaaatgcaccacctccacctgcaccccaaagccaacctccatcacaattcccaggccatttaccacattcccaggtgcaatcagtcccacctgctccaccgactccattagcaccaaccataccacaggagtcctactatcccccgtcagcagtacagccaactgacaccacacaccagcagtatcaagctccacccgccccacagtcgcaggcacctccagcaccaccacagcattatcaaacaccacctcagtatgctcagtattctcagcctcctcctgcaagtgctaacccctcaactgcagtcccaccgtcagtgcatcagcagcctgaagaagtagcagcgccgtatggccctcctcctcagagctatcccccaaatgtgcgcctgccatctccttatgtgccaccacctagcgggcctgcacctcctttctatggtccaaaccctggcatgtatgagcctccagcagtccggccaaactccgggccacctccatcctacaatactggatacaaaccacagggtggaggcggtttccccgagccatatggttacagtggatctccatctcaccgtggcaatgctggaatgaagtcgccctcgccgtttcatccaacaggctctgcgggaagcggcaactacagcaggctccctacagctcaaatgctgccccaagccgcgtcagcgagctccaccccaagcgcctcctcgggcaacagggtgccgattgatgacgtggtagacaaggttgccacgatggggttctcgagggagcaggtgagagcggccgttcgccagctgaccgagagcggtcagaacgtcgacctgaacatggtgcttgataaggtgatgaacggcgccgacgcccagccccagagaggctggcacgggcgttaaaagctcagctgctatccagggccatgaagcgctctcccatcaacctgtgcatatcactgaacatccaatccacggagtcattttgtgcattcgcgtgaacgtcagattcggaattcatattgtcgatttggtggggaacagaccaggtctgctcgatttgctgttggtgatcttacagcaagtgttctttatctctttgattcgcctggtgttggttggtactagcagtagtactaaaacttggtatctgatctccaaaaacgagtttttctagagatggtgttatggttgttatccactgatgatatgttaatgattcacgggctgcactgttctgtttaactagtcacgctgctaagctgccttccagtttccagaaacacattctgccggactgatgattgattacccgatattgtgttgtgatagcgtacgttgtgatgagtcgctgggagagctgtttgttgtctgcccaagacggacagctcgggacgaaatacactgaagcagaagggaaatttcgataatcgaaatcgtctcgaaactttggaacgacatttcgagaacacaacagaaatttaagaaaatttggctagcatatgcagcatgcttgatgcggatgcatctgatctccatccaagctgtcttccccggccggatcgatctctcaccacgaccttggcttcgaggtggtaaggttgtttcccaccgaaaaatttcggatatttcggaaaccctctcgaattatatcaagacaatcgaaatttcggaaatatagttcccaccgaaatatcggatatttcggaaaccctctcgaaatacaatcgaaatttcggaaatttagcgcctacggtttcccaccgaaaatttcggatatttcggaaaccctctcggaaatatacaaccgaaatttcggaaatttagtgcctagggttgcgttgatccctcactttgccgccccaacctcgccatctatctataagcagcctggccgccgacggcggtggtcgacggcgacgccgtcaccaagcacaagcgctccaacgccggcgccggaccgggcgacgaggatccatggcgccgccgccgccgccagcgaagaggagggatatatatacgttcgtgaatctttgacgaagaggctggaccggcccgatcatcgccgaggtcttggggaaagatccacactcgcccattgcttgacggccagcctattcccaacgaaaggctggaatctctctcgaatgcgacgcttggaatctttggatagataaattatggacttggatatgcgttcttcgacttcgtcgaccagcaccgcgccaatgggatcgacgacgagggggttagcggctcgatcgccgccggcgacgacgaagacgacggcgaagagaggaaaggactatgtgggccggccggtgtggcggtgccagcagtaactgacatcaagcgcgtgtgtagatgaatggagacaaagttatacgcgtattactcaaacaaatccacgagagaaattttgggaattttcgaacaggatttatattcaagcaaattctatataatcaaacatgaaatttagtgcagtgttttcgattcaggcaaagcaaattttgcttgcttgcttgcttttgttctagtacactacaccactctgcaatgcatatatcatgcacgcacggagattttaattaagcttctctaaatttctgagcccaccgaaatttcgggaatttcaagatcctctcggaaatttcgaaagatatttgtcatactttcggaaatttcgggaatatcgcaatcctcgcgaacgaaatatccaacagaaatcgaaatttcagaaattccgcgccgaagaactagcttgcgcgcgcgagtgattctgccgccggccgccgcagacggaactcctcgatgctgctctcgtgtttccaccggcgggccggccggctcggacgccggcggcggcggcggcgagcatcagaacctcaccgtcactataccacgaaacagcccgatgtaccacgaacttgatccacgagcactagcagaatctcaccgtcactataacaagggtgggttctttccctagttttctcggcttctactctctcgtttttcacatgcaatgcttcctaaagtgctaaatgatgtgttttttaaaaaaaattcaatatgaaagttactttataaaattatattaatccagtaattttaagctactacttactacatccgttctaaaatgtgatttgtaccaaaatgaagctattttttcacctgccctcttatctcaaccaatcgcaaccattctcttctccaccaatcataacccttctttaattatctatacctactttcttaatatctgtgcctacctaaaaaatgtttatattatgggatggaggaagtatttgggtgtagctcaattctattttttttttttgagaaaattgtaatccttaatttgtataggcaaattagctcaaaggatacactcactaattactatgaaaaatttaattacaagcttgttacaagcccaaggcgcgaacacagggcgtctctatcctttccattaaattaagtttagaatttaagtgtgtgcttcatatgtatccaaacttata

SEQ ID NO: 5908 - DNA, 8639 bp, Oryza sativa
aagttttaaaatttcggccagccttatcctaaaggttatttaggagagtggatatacagtgtaagcgccagtattaggtgacatcgaccactttcgataaaatttatggttaaactacttatcaacatattataacattatggtttaagtataattagtacactatgacactgataggcacgttatgacatcaagaatattttttttggcccgccactatatatttatgaaaaaaaaagagtactagtttcctttcctggtttttccaaagagcggtcaggcgcataaaaggaagttctcgtttctcaagagtaggaaaaaagaaaggaggattttgaaactctatggacacatggaaaggctaatgggcgggtgatcgctcccctacccgcccaccctctcccccgtactactagatgtactcctctctcttctcccccttcctcctctccttctcctctttctactgcagtagaccacataaaaatttttgaaaaacaaaagttagaaaaatttatgtataaaaatattatatataaaaatttgaattcaaatttaaatttgaatcgggtatgtaaacttgcgacttataaactttgggtctataaactttaggtgtataaactttagatgtatagaaatactatatatagaaaatatttgaattcaaattcaaatttgaatcagatataattcaaattcaattttgaatcgggtatataaactttaggtctataaactttaggtgtataaactttagatgtatagaaatactatatatgaaaaatatttgaattcaaattcaaatttgaatcagatatttgaattcaaattcaaatttgaaacgggtatataaacttttaacttataaactttaggtctataaactttagatgtacagaaatactatatataaaaaaatatttgaattcaaatttaaatttgaatcggatatataaacttttaacttataaacttttggtctctaaactttagatgtgtaaactttaggtgtataaactttaggtgtataaatttactaaaataggaaagtaatgcggtgccaaaaaaggaaaccaggtgaagggagagaggggggaggtggggagcgaatctgatcgctaccccatccccacggcgatcgatcgcccattagaggtacccatggacacaatgcatgggatatatatatggaaatgaacatgcatgagataatccaagctctttgcggttgctgatgtggatgatgagcctgaatgttgacacaattaatggcactgtcagcgattattccacagctgaaatatctttaaacagttcaaaatatgatcaactaaggccctgtttctttcagcttgggattattataatccattttattgggagtaggctgaaagaaacagacaacttattgaagtagcttattataatctggagcctagcttattataatctgataaactcatttaggtgagctttttccagattattgggtaaaaaattacccaccatgccaccccactccctctttagacttacaaacccaataatctaggctctaataatttaggaaagaaacaactaaccgcttatgctactacagattataacaatctagtttatagtaatctgactcaataatctagattataataatcccaagctgaaagaaacagggcctgagtaccttcaaagtaatcctataaattagtccacgaacgcaaaaaaaacaaagaaattacacgtcattctattagaagaagtaaattaaggaaattaagtttttacacgacgcacagccatatcgcccaaccatctactctcccaaatcaagctcctacactacaataaaaatgctttgtagagacatttttctagtactatagaggtacttatcaaatgactttacaacaatgtagaggcattttaaaaaatgtctaataagtgtcttatggtgaattgtctctacaaacgaaaagacattttataaaatgtctataagatggtagaggcattttctagagacattaaattgtaccgcaaacatataaaaccaatccaaaaaagataataaaatagtttccttggttttgacaagtgttgaactcatgatctcttgattcaatcattttaatcttcaatacactaaccaactcaactccatgtcattacttgtatgcttggtcctctagttatttatatttagtcctttagtacatattatcattctaaaaagtgtctctacatagtttaaaatgtctcaacgaaatgcctttatatattagacgcattttatagtgccgaaagaatgcctctacgagataaaatctaacaaactgatctaaaaatgtctctagagtaaaagttttctaggcaatttttaaagtgcctctataaagtgtctctacactataaaacttctgattttagaagcaatttgcaaaacgtctctacaaaagtgcctctatacgaggtttttgttgtagtgagctagaagaactagatgcaattaaaatacaaaaacaaattaaaattaagtagcagattacccagccgcgcgtattttcattcacctaattaattaatcgcaagccagaaaatcacaacacatatatacttaattatgatccatattgatatccaaccagccacaaactcacaaattaaagtctcacaacacaacatcgaaattttaagagtcgatccaaaattatatagagttttggactaatattaaccaaagcacattaccatgcatgcaccccagatcgatatctagaaccgaacttgatgaagcaaccaaagacgacgacgataactaattaagcttgatcttaatcctcgcaacttaactgaccatctcatcgtcgacatcgatcaagattcaagatcaagccctagctggggcgagctcgctcgctcgatcgaccgatcagttcatggcggcgaggcggtcgacgaagatggcgaacgcctcgtcggtgtcgagcatgctgatcctgaccaccctcccgtcggcgccgaacttgccgccgccgcggctgatgatcttgcgctcgcgcaggtacccctccaggtcgtccaccccttccttcccgcagcgcagccacgcgaacgctgcacccaaatcaaatcacatcatcaatggcgatcgatcgaacacaaacatgtcagcaatggcgatgcgatcgagcttcgtgtgtgtgtccgtacgggggtaggcggagacggtctcgttggcgaaggtgcagtggccggggagctcgtcggggagggtgaagatgccggaggcggcgacggcggcgcggagcttggcccagcgagagaccatcttgcggcgggcgaagtggaacagtcggctcgagtcgtcgtcgtcgtcgccggcggcgggcgcgcggtcgtagccgtcggtgatggccttgaggatcttggcggcgcggagctgcgagtccttggagacgccgatggtgttgagctcgatgaacttgctcatcttctgcgccaccgccctgtccttcaccagcgcccacctgtgccaaaaaaagccaatcacattgagccaaaatttgttcgaatttcaaaagtattcgtacgatgaaatttgtgtgtacgtacccgaggcgggtgccggcgtggccggtgcacttggagacggtgaagagcatgatgtcatgggcggcggcgctggtgatgggggtgtactgcggccagtagtaggcgaggtcgtggacggcgacgccgtcgccggacttgagcacggcctcgcggatgccgccgtccgggttgctcggcgagcagacgagctcgacgtaggtgtcgccgtcgaacatcttggcgtcgccggcccacctgtacagccccgacttgaggaaatccgtcaccgccgggtacgactgcgccccgccacgccgcatccacacaacacaaaagatatattgtgtcaaacaaaaataaagattaaatcatgtcaagatcaatcgtacttcctccgttttacaatgtaagtcattctaatatttcccacagttcattaacattcatacttccttctagatagatatatgtctagattcattaacatcaatatgaatgtaggaaatgttagaatgacttacattgtgaaacggagggagtatttaactttaccatttctatcatttcgagttggtaatatcagtctatcttgttgatgtatttcttttaaaaaaaatcgcaacaacttagatgatatgcgaactatgagagaatgtcacctctcgagagtttagaatagtttccctatcaagatcaatcagaaaagagtaattttactatatttgagaatgtagttagaggtatcacatttactagcataaaacttatatttgtacttatcaatttttaatgtgaaatttaattaggtacttctcaaaacttttaatgtgaaatttaggtatctcaagacactttctcgaggaagaaattttacggatactgagaaaatacctcgtagtacctaagttttacactagaaataagaattttggtaccaagttttataaaataaaacttggcacctccatgtactttcttaaagatattaaataaatctacctttctcaaggacactaaaatttctaatgagaaaacgaaaaactacctttttcaaggatgaagataccactagaaaacatggcatctccaagtacttttccaaaaatgataaaactacatttttcaagaactgtaaaatttctcatctggaaaaggaaaaaacaaatttgattgcaagtgatgaaatcggattgataaattacggagtagtatggtgcgggggagacgacgttcatgggggcggaggggcccggcggcgagagggcgtagagcgcggcctggaagagctgggtggatccggtgccgacgagcacgtggtagccgtcggcgacggcgttgccgacgaggcggtggaggcggcgcacctcccgctccaacccgggctccaggaaccagcacaggctgcccacgtcggagaagtagctcatcgtctgccaccccgggatcacgatcgtcgccctctccccggcgccgccgcgccagaacgcctcgtacatcgtcgggtcgccgctgcgccgccatcaccacaaagagatcaagatcggaacaaaactcactcgccacgccacgccgcgccacgccgcgccgcgtcgcgacgcgaggcgtcacgtgtacagtgccatgcatggacgaacaggtggtcgagatcgatcgatcgatccatcgatccaccggcggcggatcagacgagaacacttactggtcgaggttgatgattgagtccttggtcaccggcggcttcccggaggacggcgcgacctccgcctccgccttcttcctcaccgcggcggcgtcgtcaccgccgaagtatctccggcggaggtagaacgcgagcgcggcgaggttgaacgccacggaggcgaccaccccgagcctcccagcctgcgccgccatcccgccaccgccgccgccgccatccttgctgcccatcgccgccatgaccaactcacactcactctcccttctcctctctatttatagataggggaagtggttggagactggagctgagataggggtcccctatttatatctaaatcgcgtacacgtttcttcctatttttagcaagcacggcgtcgccggcgccggaatatttcctccgccggcgccgacaaggctaccggcggcggcggcggcggccggaggagatctcgccggcgagggagcacgtggggggagcgagcggtttcgatcgagatcacgaggagcatggagagtttgttcgatttgtttggttgccccggattaaggaaagaaaagaactccatcgatcgttaaacctcggtgattaaggttaatgacagtgcgcatcatgcaataatgacatgtgtacttgatttatttggaaattttaaaattggaaattagagttggtgtaaaaagtatatatagaaactggttttatttggaaaattggaatgcaggcacagtcatgcaaccggggttaattaattggatcttgttgagtgctaacctgtgttagaggcgatgactgcatgcatgcttttgtttggaacttttctttatttagattagcatatgactcagatctattcgcgtggataagtacaattgccatattttaacttaggcccttattatatatagagtaaatttcacaaaactacatatatattgaccaaattatcacaaaactacatatttaaggagttatatcacaaaactacacatttagcaccaaatttatcacaaaactgcagattttaggttaagtatcacaaaaatgcatatttaatattgaacttatcacaaaactacaacttttggagtttaaatccctagcaccattgttatggtggagctataaacattattactttgtgattaaattggttctaaacctgtagttttatgataatttagttactaaacgtgtagttttgtgacacttcatcttaaatgtggagttttgtgataaatttagtgctaaatatgtagttttgtgatacaactcctcaaatctgtagttttatgatagtttggtcatagtatctgtagttttgtgaaatttactcttatatatatatattggaagaagaaattaaaatagctgcatatgcaagaacaatatacagagaaaactctattaatttgatctccctgaaagattatgcatattattgttatagaaacattagttatttttttcttgatgaaatttatatatcgaatcttagacgtcgattgatcatatcaacaacttacatttgcttgggtcattagttttttttttacgaggagcagaggtagagttgcataatatgttgaaaagaaacacgtgagtatatctataaacggtttatagttaaatagatatagtgaaaaccgacaaacggatgtcgccttgcgcattttccataattggaaagaatgatatgttttggttgggtacgcgtttaacgttttgtatattggaaagtaacctatattataaggtggtgtgtgtgatatccttaaactatactaaaatagattgacaacctccatcgaaagcgacaaaaaaaccgttccacaatttcaaatacaacaaaagcgcgggaaagaatagaaagagtgtgcttactcttacatcctgtaattataagacctctacatgtatggtctcatccctatgcaaataaccttgggtggtttttccatcggttcagtgatgctagcaaccatcaatgaaatatttttattttgacaatgcatttagcaatatatatatatatatagtctggcacccaattatctactaagatatatgggataatggttttgtttgttcaaggaataaatatccaatatggagtgataaagcaggtaaagacattgcacattgcgtgacataatttatacaagcttccaaacaaaacaaagtgtaatcatctttcagcataacaccaccacttaaatatacacgtgttatacaaaacatcaaatgtacccaagaagagtctgaaacgaaacgatataaagtactattgtgggataagtccatttgacaattctaaactcttcactttatctaaaactcacccctaaacatcaaaaacacgtatttgacaacaccctcgccccttgtccaaacaaaaaatggttggttaaatattgctaagtgctaacctgttaggtggaaatgactgcatgttttttttataacttttcctaataagctattcgttagattaattagtatggattggttagactcgatatatttgcatggataagtacacttgcttcttttaacttagcctcattggaagaagaaaatagctgcaagagcaatacttaggaaaactattttgatctctcgagcactagaaatatattgttgttaagaaacatgagttaaatttttcttaatgaaacatctagaatcttagatgtctattgatcagattaaataacataaattggcttgggtcattagttgtttttactttttacaaggaagagcagggttagagttgtaaaatatattttaaaaaaatgagcatgtgcatatatctatgagcgggtcatatagttaaagcagatatggtttggcggttcatatagttaaagcaggtatagcgcaaatcgacaaatggcgggtgttgttcatgcactttccgtaattggaaagaatgatgtccttagttggggagttgcacgttcgttgcattatgcgtttttaacattttgtatattagaaagtaacctaaattatgagattgtgtgcgtttgatatcattatattatactagagtcacttgacaaccccgttgaaagcgacaaaaaaaccgtaccacaatttcaaatagaacaaaatcataggaaaagaaaaaaaagaagagtatgcttactcttgcatcttataattataagatctctgtatatatggtttcatccctatgcaaataccccttaagcacttttaccatcggttttcagtgatgctagcaaccacctatgaaataattttatttttaaaatgcaagtagcaacatatgaactgaaatgtctggcaccagattatccaccaagatgggaattt

SEQ ID NO: 5909 - DNA, 17154 bp, Oryza sativa
cactaacaccatttcagttcttttaaacaatgcaatctttgtgcctattattgttactagcaagttgcagtttagctttaaaatatttctgattttgattgcctttcttccttttctttcccccctttctgttataagtgtgatctttgcttttgttcttaaaacttccctttcatttcagtttgaattatttacatgtaattgcaccacactaacaaaagatgagccacatgagtagcaatagcacaccatgtctaggaggagctacagacgaattggaatattattgatggttggatacagtcacgcggcaagtatctcaagagtccactgcctcacgtgacaggttaatcacttttgcttagtgaaatcaaagatatatactgctagtgtcaaaaaaatgatatgtactgctggctctttgagatgcctttcaactaaacgctggttaaaatactgtcatgaattgcatgcacaagcatcacgagaatagatgaactgatcaggaatttgtcaacaagactgacagtgccatatgctaaggacacaataaatgaattgggtaaacatgtttaggctggtagatctaggtgatgatgtggtgaaaaccttggaaactgtgcaccctacaaatgattgtactctttggtatttgtttacttgttgttttatcagtaattaagcaagtacgactctctctccctccattcccttccattcatgtataacttggttagcttttgcagttatgcagcttcgctgctgatgaattgttacaagttaatgaacactaatctcaggatgattcatgagaactgtaaggtatgaacaagaatcatccgtgaatttttactggtggtaataaccggtaaccaaattatcattagactttactcctcattttgttcatgtacacttgtcaatcactgtatttgaacatgctagaatgttcactcatgtaagcattctacttctacatgctagttaaatacacatcataaacatatctttttactgcaaaggcagaagcatgtaccctatcttttcgggtaaaacgaccaacactgcaaatggaagttctaaccccaatgtaaatactctgcaagtttccattatcttctacgggattagtagttcagcattggtcaatccgaactgcccatttaccgatgggaatttggagaagaaggtagatctagatctgcgagcctgcaaaatttcctgtacttttactagtataatccagctgctagctagatggcggcttcctcaccattaacacaaagtacaagaggcagtagtaattaactatgaacttgacagtggaaaggtgagattagatctaaccaggggcatgtgacagcctctgctggggtttttaagatccaatcctttctgtttatcctgacaagaaacagcctctgccatgcggtttatataattgttactgcatggaatgaactgtgttcttctctctgtgtgtcatgtgttaccactaagcacccagctgtgatgtccctttttattcttatttttcaactttcaactctggagattcttaccagcgcagttagttcaattctcaccctgcaatgatcataattacagtgcagggctttactgtctacttacacgatcacattcagaaatggctgttaatatgtaatcaaacaaggcaaaaaggtcagttaattgttgtcttatattccaatcaacatgactctattctttctaacatctatgtttttgagttactgacttgagactttgctgcccatatattcagagtttttttctgcatttctgaagtaccgatgacccatttttctcaagtaagaatttactaattcccatttccaagttgtcaactcttgatgttcttaattcatactagtaagttcaattaccaccctgagatgtgaaaatctacagccaagtccttacccacagtctgttaaagctgttgcttctactgcatcttatttaatcatatcccccttgacacacacagcctttccatgaagttgcttaacctgatgccattgccatgtctctgggggcaccatcttttactctcaagccagcaaagctgttgcttcagttaaaaaatttctgcatcctctctcactcccctctttaagctccaattggggcattgcactgcattgcaaagcaattagtcgttggtgatggctgtcaaaaatttatacacccaatcaccaatcctaacagcagcattaaccatggtgattatgtgcattgctactagaggccataagagattgctactaaagtagtcatagaagggacagagtgcagtgttagtactgtgctctgtggccttggatccagagattctgcagggacagggacaagtctccattgcttcattcaccttcatgatctcatcagactcaaaaactcttcaacctctcctacctatttagacacctcattcttgtttcttgatctcacctcttccctacaagcatataaaaactgtaccatttgagatggtctctcttctctctctctctctctctctctctctctctctctccttcatactaaaactttattaggacttcattgattagttagaggttagtagtacttagtactagtcttgcgacataagcaagaccaagatttgggagcaattaacacaagtacactagaatccctataggattagctactacactttgcatagtagtgtgtgttcttggatatacttgcatacaagtagaggtacaaagagtgtggttattagtgtatatgcgtgatgagtagcagaagcagatggagggcggcgccaatggcgtcgaggtcgccggcggcggcggcggcggcgatggtcatggcgtgtgtggtcgtggtgctgcgcgtgagctgcgtgctcgccgtggacgagcagggcgccgcgctgctcgcgtggaaggcgacgctgcgcggcgacggcggcgcgctggcggactggaaggccggggacgcgtcgccgtgccggtggaccggcgtgacgtgcaatgccgacggcggcgtgacggagctgagcctggagttcgtcgacctgttcggcggcgtgccgggcaacctcgccgccgccgtggggcgcacgctgacacggctggtgctcaccggcgcgaacctgacgggcccgatcccgccggagctcggcgagctgccggcgctggcgcacctcgacctcagcaacaatgccctcacggggacgataccggcggcgctctgccggccggggagcaagctggagaccctctacctcaactccaaccgcctcgagggcgccatccctgacaccatcggcaacctcacctcgctccgggagctcatcgtctacgacaaccagctcgccggcaagatcccggcgtccatcggcaagatgtccagcctcgaggtgctccgcggcggcggcaacaagaacctccaaggcgcgctcccggcggagatcggcgattgctccagcctcaccatgatcggcctcgccgagaccagcatcaccggcccgctcccggcgagcctcggccggctcaagaacctcaccacgctggccatctacacggcgctcctctccggcccgatcccgccggagctcggccggtgcgggtgcctcgagaacatctacctctacgagaacgcgctgtccggctccatcccggcgcagctcggcgggctcgggaagctcaggaacctgctgctatggcagaaccagctggtcggcgtcatcccgccggagctcggctcgtgcgccgcgctcgccgtcgtcgacctgtcgctcaacggcctcaccggccacatcccgccgtcgttcggcaacctctcgtcgctgcaggagctccagctcagcgtcaacaagctctccggcgccgtcccgccggagctcgcccggtgcagcaacctcaccgacctcgagctcgacaacaaccagctcaccggcggcatcccggcggagctcggccgcctcccggcgctgcgcatgctctacctctgggccaaccagctcaccggcagcatcccaccggagctcggccggtgcgggagcctcgaggcgctcgacctctccagcaacgcgctcaccggcgccatcccgcgctccctcttccggctgccgcggctgtccaagctgctgctcatcaacaacaacctctccggcgagctcccgccggagatcggcagctgcgcggcgctcgtaaggttccgggcgagcggcaaccacatcgccggcgcgataccgccggagatcggcatgctcgggaacctcagcttccttgacctcgcgtcaaaccggctcgccggcgcgctcccgccggagatgtcggggtgccggaacctcacgttcgtcgacctccacgacaacgccatctccggcgagctgccgccgaggctgttccgggactggctctcgctccagtacctcgacctctccgacaacgtcatcgccggcggaatcccgccggagattggcatgctgacgtctctgactaagctggttctcggcggcaaccggctgtccgggccgatgccgccggagattggctcgtgcacgcgcctccagctcctcgacgtcggcggcaactcgctctccggccatgtgccggggagcatcggcaagattccggggctggagattgcgcttaacctcagctgcaacggcttctccggcgcgattccggcggagttcgccgggctcgtgaggctcggggtgctcgacgtgtcgcggaaccagctatccggcgacctccagccgctgtccgcgctccagaacctcgtggcgctcaacgtctcgttcaacggcttcaccggccggctgccggagacggcgttcttcgcgagactgccgacgagcgacgtcgagggcaacccggcgctgtgcctctcgcggtgctccggcgacgccagcgagcgcgaggtggaggcgcgccgcgccgcccgcgtcgcgatggcggtgctgctctcggccctcgtcgtcctcctcgcggccgcggcgctcgtcctcttcgggtggcaccgccgcggcggcggcgcccgcggcggcgaggacaaggacggcgagatgtcgccgccgtgggacgtgacgctgtaccagaagctggagatcggcgtgtccgacgtggcacgcagcctcacgccggcgaacgtgatcggccacgggtggtccggcgaggtgtaccgcgcgagcatgccgtcgtcgggcgtcaccatcgccgtcaagaagttcaggtcgtgcgacgaggcgtccatcgaggcgttcgccggcgaggtcagcgtgctcccgcgcgtccgccaccgcaacatcgtccggctgctgggctgggcggcgaaccgccggacgcgcctcctcttctacgactacctcccgaacggcaccctcggcggcctgctccacggcggcgcgatgggcggcggcgccaccaccaccgccgccgtggtggagtgggaggttcgcctcgccatcgccgtcggcgtggccgagggcctcacctacctccaccatgactgcgttccagggatcatccaccgcgacgtcaaggccgacaacatcctcctcgccgaccgctacgaggcgtgcctcgccgacttcggcctcgcccgtgtcgccgacgacggtgccagctcatcgcctccgccgttcgccggatcctacggctacatcgctcccggtaagagccttttctcacactcacacacattcaccagttcaaacaaaatttcagcagtttaattgaatttgttttaaaaagaaaagcacaagattaatcaatggctgatatttgatcttgatcaacgcagagtatggatgcatgaccaagatcacaaccaagagtgacgtgtacagcttcggtgtggtgctactcgagatgatcaccgggcgccgcccactggacccggcattcggggagggacaaagcgtggtgcaatgggtgcgcgaccacctttgccggaagcgagacccggcggagatcatcgatgtgaggttgcagggccggcccgatacccaggtccaagagatgctgcaagctctcggcatggcattgctatgcgcaagcccacgacctgaggatcgaccgaccatgaaggatgtggcggcgttgctacgtggcattcgacacgatgatggcgtcgaggcaagaaaagccggcaatggagttggtactgatgcagagacaaggaagcgggctgacccgagacagcccatttcaccgaccaaactcatggcccttgctagaccggcccaggcccaagcccaactccaagcccgtgctaattccggttccttgggcctgctcaacgatcaggagtgagtaatacagtaatatagatagttcaaactgaagggggcccactagcagtgtgatgtgagggtgatgattgttgatgttgaccatgcaaccatgggtgtaggcactcacggggacctgtaagaaaaggatggtttactgtttgctggtgggcccagcttgccatagactgtagggggtgtgtcgttttgctaggtgcacccttgtgggtacagattgggaatatgttatctttgtgcttagggttttattatttagtgatcataggagatatgacggtcaataatcttttgtaccataaattggggcataatgcgcccaatggattattagtgtaaattatcccactaaagtaataattgctagccatattatgggtgaagatgtttgtcaaagagagcacatgttcctcttgttgttcatattgtcccatttcttttgtttctttcttgagtggtccaatcttgatttgtgctatcaactgcatatgtaagctagcaagatgctcttttagatgtggattagtctgtacatggggtctacatttttgaaccagctaatagtttagggccctttgtagagcaacatgggtcattaatcagaattaatggaagcgtgccaccaatgattaaatcatttaataaggacgatgacagccaactcatcaacaatagtcctattttccgatgccaatatgccattgcattcacttaggacttgcatgtcccaaacttcagtgatattatatacaaaaaaaaaattctaaaagggggcctgttagaaactactggcgacaatactaaaattgctccagcagtcaggcacagggttcaaaatttcggatcgaaatttcggttctatcggagacccccccccccaatacgatcaaaatttttaaattttttttcatttttttcatgaatttggtaatattttgttcaaatttgatcaaattttattcaagaattcataaattttcggaccgaaatttcagaatttcggccacccccaatagaaatcagcaaaccgaaacattaaaccctagtcatgcatggatcatgtttgcctagtgtttctttccccccttttttttttctgtatgagtattatcgttatcaatttttggacgcaatgttccacttgacacactcaaaaccatacattcacacatccttgaaaaatgttggcataaaagtctcctagaaaaggggcactatcatcagaattaagataagagagtgtagagtagatacacacacacacaagcacaccactatgcatttggtcacaaactagctccctagcatttctaaatttgaccaagttattttttttcttctttttcagtgcaacaagtttgttttgtgttgcgtgtccccgaagaaaaaaaaaagaacaagtttgttttgtgcaaaggctaaaaaggccaatgggcctcatctcaggaaagaagacattgtgggcttcatatcgtttcaaatttgggcttgggctagagtgtgcacatcccaacttcccaaggcccatttacctctctaaaatcaaaatcaaatttcagcccacatcaccatatcccaaaattggaaaaagtacaccgaaggtccctcaacttgtcatcgagttacaaaatcgtcctcgaactgtaaaaccggatacaacgtatccttcaatttacaaaaacagtacaaactagctccctcagcggttttagctccctcagcggttttaactccggttttttccgacgtggcagctgactcagcgtgagacccatgtgggtcccacgtgtcaacctcttcttcccctaccctctccacatctcttcctcctctttctattctctcactagcagcgtagccggcggccggtgaggaggaggccagtggggaggcgggagtccggcggcgaggcggcggcggcaacgaggcgacgacgtgggagcaggagggcctcccaacgccgccgccgccactgtcgccggcggcgcgggcgccagatcccgccgccatggctcctcgtcgatagaacagccacagggcgttctctccctgcgccgcggtggcgttcgcggcgatgatctcgtccagctcgtcgtcgacggggacgccggccagcgccagcgagagccctccatccccaacctcccctaatcttctccacggcaaagttcacggtcgtggcggcgagagctccgaaacaaaggctgaactggatgccgttgctgaatgctccccagtatcgcgccggtgccatttcagccatgcagagtggcatagacagcaaaatgtttcaagaacttgcaaaattcaaaaaactttgcagaagatttgtccaaatggcacatcaagaatttgagaataatttgattttttcagtgttgtgacctcggtggtgaagccgaggccaacgccgaggaaagccctaccaaggatggcaatggacacgttgacagcggtgccgctggccgccacgccggcgatgtaggcgaagccgccgaggatcatggacgcgcggcggccgcggctagccgtgacccacgacggaggagcgcggaggtgagcaggccggagatgtagagcgacgaggtgaagagcgtcagcagctagctgtcgaacttgcagtagttgctgacgcggcgcgcgccagcgccggcgcccgccatccgccggagcacttccggtaataagtcccttaggaacgactccatggacgacacgccgcccgcggtgctgatgtcgtagccgtagatggcgccgcccatcaccaccgtggcgcaggacagtgccacgaacgccatgaccctcccggcgccgcccctcgtcgtccacgaatccggcggccataatggctggcagctcaaggcaagcattgtgtcggaactgaaccgagcaagcttgtttgcttgagctattgatttgactgcttgacttgctctgctcttatatatcgttccaaagattctggcggctatggcgtgaaagctcgatgtgacattgcatcactaatcaccattgccgatttacttgctcatacatacatctgtttcccgtccgacgacgacgccgagccgcctccccgacgccccgccgcggctccgacgccgcacgccgccaccgcttcccggctcctactacggcagcgcgcctcatcagatgccaggttcctcccgcgacggcgcggcgacctccttcccaccgccggccggcctgcccggagagaagaaagtgagagagaggaggaggaagggagaggagggggggaagagagaccctgttgacgtggcacctgacatatggggccaacacgggtcctacgttgatttagccatcacgtcggataaaatcagggtcaaactgctgaggaacctagtttatactggttttgttagttgaaggatgcgttgtatccggttttacgattgggggatgattttgtaactcgatgacaagttgagggacctccggcgtactttttcccccaaaatttgcaattcttctctccgattaatccatgcaatctcaagacgaatgcattacacatgcaacaaagagaagatgtaagactgtaaatttgaatgcaaaaatatacataaataatcaaactaagctaaaactcgatgaacatatgctcagtcacacaagaacctgaagaagattgagagggaaagaaaaagcaaaaaaaacaaagagaagatttactctatcgtatattttccttgaattagctagcatcatcatctcatgggcagcgggcgttccggccagggccgccgtagtagaagtacctgccccaggcggcgccctggccgccggcgatgtcgtagcaggcggggtggtcggcgaggaggcggagggcggcggcggggatgaggttgttgtcccagtcgacgacctggacgttgcggaagtaggcggcgcggccgtacccttcgccggggaagcggccgctgcccatctgcgtcggcgtgtgcgaccccgacggccgcgtgttcaccacctcgccgccgaactgcgccatgtcggcgcgcgcgcccaggtggctgaagaggaacgacggccagtagcccaccagcgcacccgaccccagctgcagccaccagtgaccctgcttcgggtcctgcgttgagattcgtgcgcttattcagactttttatctcggtttcaagctactaaacggtgcgtttcgtgcagtttcaaatatcatcttggagtttagctgttcaaatatgttcagattgtgagagaattaagcacacacacaaaaaaaaactgttcaaatctcgcagtgcttaaactgaggctctgtttgaagaaaacaattgatatgtaactagctggtgagaatatggaaaagctacggtggcaacttttggctacctgttcattcttagattctatatgtattttcatagtttgaattcggaggaaggattcgaactgctttgagaaggtggagattcttacaaccccattgtttggttgtttggaggaaaaaacaaaacggcatatttacaggtgaaaaataatttgtgaataaaacgtttatatacgtgtttttaacgatctacaagcaaagggtgaaaaatacactacgataaataaaccctaaaattaaatctaaatttaagattgaaaatttaaattttagctgataagtataagtataagcgaaaagataatgttgttagagtatatgctgacaaagctaagttcacattcccaataaaaatcgatcgagtgaattccgcaaagtttggtgtttcgagacagctcaagatgggaatagaatggtttcatgaaaattcaaatttgaatagaaaataagaattgaattaaattcctataaataccatggcatttgtagtactaagtagtatagtaaattttcaaaaaaaaaagtttaacttattatatgtagtttgagatctccatctatgaaaattttgccttttagaaaggaaaagacttcatggactatataagcccatcacttttggcctattgagcctatttgagagaactaacttcttatacacctatatgtttacaatctcagtttccagtcaatatattcgaatttcgttcaagatcgcaaatcatcgggagagtttatattcaaatcttggctttcaagctttgtttgaaattcgtcaaatttcattcgaaattcacagaaaagtgcgcacaacataccttccaaatgaggagggtgatgtcgaactggcggccggcgaaggaggagatgggggagatggcggcgcccatggcgatccggctgttggtctggacgaaccctgagcagtgcaggttgtagcaacccgtctcctggtacgcatcattctgcacaatgcatcattcttcagtaacttgttctttgaactgactgatctatctctcttctaatactgaaacactaggaacagattactactttactagcaaagaacttactgtccaatacgtgaagaaccttgggttgttgtcaccgtacagctgagggctcacctgaaaattcatcagaaagatacaggtagctagatacgatcagtattcagagttgagagttgagagcaatggcaatctctgaaattggctacgcctgaataagtttaagaaaatgtagcgttggtttcagggttaacgatcccgataccggatcaaaatccgctcacgagcggtatccacggaatccgtcgataaaccgataaaatccgaatgatcagtatgcagagctgagagtaaaatgtaatctctgaaactggctactagctagctaggcctgattgactgaacaagtttcagaaaaggaggagagaaagaaaagaaaatgtagcacctgccatccggcctcgatggtgttgaggtcattgccgaaggagccggagatgagccagatctgggagaggctgaactccgccggcgacgccaccttcgccggccacacgttcaggctcgccttcgccccgtagaattgccccccgctcatgtaccccaccgcatgctgcatatgcataaatttgttttgctcaccaatgtcagtatcaacgcaaccaaattaaagccctcatcttttcgcttatccctatgcttatcaaccaaaatttgaatttcaaccttaaatttagagctgattttagggttttattgtcgaagtttatttttcagcatttacttttagatcactaacatttatataaaagttttatatgtaaattatttttcgtttgcaaatatacctattggcttattccacaaataagtgaaacaatgaggccgtaaggcgtgtgtgcgtgtaaattaaccatcggcatctgaccgacacacgccagtttatttggcaaacaaaaccttgttggttattacaggaaaaaaaatacaggtaaaaacaattatatttgtattcttagcgatttaaaagctaatactgataaataaacaatgaaggaaaaaccttaagattaactttaaaattaaatattataattcaaattttgactgtgcctgagaagacaacatccaaacaatgacggtagtaacaagtaagcactccctccatctcaaatcaagttcagttttgttttggacattaatcttgatataagttatgtctaaattaatatattaaaataaacttattttgggagttggcacggaggtagtacacacgagttaacaaacttcgcatcactaccatatacaagtatatatgggggttattttagctcaattcagtaaagttgtactcagtaacattttcttaccgacaaaagtacttctttagacttcttactactgaagtattatttatttagatttttccttctcatatgatttagagttttggaatgaaataaaaaataaaaaaaattatctcggaaaggacgtaataataaaacaatgtccgagaaaaagaaaatcaaatttgtctattttatttgaagtttctcaaagtttagtatgacgcttaagataagattcaatcaaacttttaaaatttatagttatactatcgataatttattaaatacttagtcttaaaaaataaaaaattgcatgcatatgtttttcttaaaaagtattatgatattatcataaatttatcatttttctaaaaaaaatattctaacacaaaattgatgttaaagtttaaccaaaccattatcttaaacgttaaatatttattaccggagatagtagcatttgacatgacctatgatagataaagaaagaaattaatttattatccgaattaaaaaaactttctcgattttaaatcattgtagtttccctttgacagtaaaagaaactcatttgtttcagaatccagttttttcaaatgattcacaaaagagaattttaaccctggttgttgaaaaagatagataaacttttgagcatgcacagggcttgtcagctgtggtggggcccacgtggcacgctgacgtgtccacctgccgcgccggttatagttggccataaggcccgaggcccgaaggcccggcccacggcacgcctttttggcccggcccaagcacggcactgcccgacttgggtcgggcccgtgccggcccggcccgaccgtcgggccgtgcctgggcctccccaccagcacgctgggctagcccggcacggtcgggccggcccggcacgatgggctggcaggccagacccggtacacaaagtatagggactaaaaatagacatataaatgtcaatgtctaaagaatagggaccttaaatagacttattttagctatttatataccacaccacaaagaagagggaggtaaaatagacttttttttagctatacaatgtcacagcccaataggagggagaaaatttagacttattctgaggaaaagcacgatggcccatcgtgccttcgggccgtcccggcacggcccgaggcgtgttgggccgtgcctgggctgtgagtgcggcacgtgggctggcacggcacggcccggtgcgtcggtcgggccgtgccggcccgacaagcctcggcccaggcacggccgggcctgggccgtgccgtgccgggcggcccacatggccatctatagcgccggtgcactccagcacggcagtacggcttgtctgaatccgtcggcagcggaagctgaagctgaggtgacgtggcactcacctcgtggccgctgctggtggagtcgcgccgcgccgcgccgccgacgacgccgacgccgcgaggcttcatcccgaaccggccgccggcggcggcggcggagctggctcgcagcaggtcggcctccgtcgtccgcctcaccggtatcgtcccctccgggcacgcctcgccggcggcccaccacgcctgccgcaacccgtgctcgccgtcgtcctcctcctcccggtgctcgccgccgccgccgccgtgggcgtgactcctcctcctcctcctcctcctcctcgtcgtctccgtcggcctcgccgagggcggctcctgcagcgcagagccgtacaccaatcaatcattgatcagctcgacgcgacagcacacgcgccaccgtacgttgagtacagcgacgcaatggtcaggtcaggtcaggtcactgctccactgcttctgcagcggcagccatggccgccgccgccgccgctgctcacctctggcttttggcctctcagcctcgggtgctcgaacgccggctgcaggtgagacggcacgcagtcgatcacgtcgccgtcgggactctgcacaatcatccgcaaatatgccgatcaaccaagaactccaagaacatcaaacaagattagctaatcaagattgagtaatcatgctcatgcctggatcgtcttgacggaagctctcctgaccctggcgagctgtgccctgactctctcaagccggagcagctcctcgccggggtggagcgccgccgccgtgccattgctggacgacgaggcggcgacgacgacggcgaagaagaagaggaggaggaggaaggggacaaaggtggcaatgattgggcgaggcctcttgtaagagatgatgaagcagcaagaagccatcagagtggagctcatcgatctgggtttttggagccgcctgaattttgtagtgggatccgatttccgatcaatgacaagctagctgctgcaacttctgctgctgcctcttcttgtgctctctcctgaaaactgtctgtatctgccacacattggtgctcttgtcttcttcttctcctccctataaatacatggatattgttaccacatagtagtagaaagatagtccatgtatcaggtgaaaatgaggctaaaaataaactaggagagtaggaggtgaagttaacaactaacaatgcaaagttgttgtgatgttggagtggtagcaattagcaatgggaaatggctgcgaattgcagtgatcttcaccaaccagcacagcttttaggtttcaaggaccagcataattgtctcaaaatgagcaccccacatctccatgcttacatcattttactagccatatgtttttcatgtcccctctctctccttctctctctccagaatccattggtgacctttggctggcctctctcagtggggttctgtgtggtgtcacccagtaactttctagagagaaagagagagagatgttggtggatgctgtccagcgtaagatgctaaagtgaagctttccaagtgtgctctccatgtggccaaggtgcaaggcattcctaaattttggaccaaatgttcagcacttgaagcttcagtataattttctccatgcgttcatcctagttatgcagaggtcgggagtgtaattaaggtaaattgtatcatcttgatgaaattgactgagtgggataaaaagcttcagttatcttaaaggagtagtcttcgaactctgaagtatcatctcctctttctgaagagattcttgatgattgatatgcaacagttgcatttccaggtttgctgggttcttcagtcttcatgatgctcattgctttttccttgtgaaagtttagagtcagtcatggtgggggttggtgtatgtgactagatagtgaggtcactggtcactgatgagtgcagctgcattcatctgtggccatgtttgttgctttgctagccaacagtgaacagtgactcctttttttttactaagttactgaaatcttttactgacttcaggtaagtggtacggcatggcagctatacatgatggtacaaatgtgtaattgatctgaattttacggttactatgtaataaagctgtagttcatgatgaggatggtaggttttgccccctctgattattggagtaggagtaaatgtgataactgttcagctatgctttgtggatcatatggatgcatatgatcattccctgcaacaatttataacgtcagtggattgtcatgagattctgatattaatgtagtatgcctttttctttttactgtgacaatgcatggaaaattagttagtcagaatagtacaatgttacttctgtcctaagaaaaaactgaaattgatataacaggagcaagctctgcttattgttaattcttaagaatcgtaaaatttctcttaaaaaaaggccattggcaaaacttacctcgttggaaaattacagtatattaaataaaatgggttcatctacagagcatgtggtggaattcttgtattccaacaggcttgactgcttagtttaacaactttttagataaggaagatgattacatcctaggcctctatatctaggatgaacataggcataattattgttaaagaaagcctcaataagagacaaaaacccctatgagatgaaataagcaaagctcaataagagacaagaatccttatgg

SEQ ID NO: 5910 - DNA, 8717 bp, Oryza sativa
tgttttgcctgtctgatactctgatcttgaactttggtaccttcccaattcacagctagcttaacaaaaatttgcattcgcaggagtttccagtagagaactctagccacatcactaacagcactactcgtgtttgtgtattatgcaaattccttgctggtgacatcatcttattcaaactcattctgatacccaatcacatttagaggagaacatcatcgttgtcatctccaaggattgacagagagaatggtgcaattgcgacattgaatgtagacgacccagctttgtcgatgtgcttcatctcaaaatcaccttcctaaatccaaaagagaattcaggtaagtttgctttgcagacatgcaacacgcaaacaacctaaacaataaataaattgcaggatataactagtctttcttaattgaacattactatttcttctttcagcttcaatcaaaacaattgatctagataccatgttaattattgggcataaattgatgccagctatatgcaatcaagagatattagaaccatacgaatctcttgcacagctagaatctaaaaattactttacaataacctatttacaagtgtgacaacataggttgtggaagatttagatgttaccattctcccatttggtgtgtttaatgggcatgcagatgagtactcaaaaccagtccttggaaatatgacaggttgctctcccacaacacctacacccctggcatggcaatggagcaagtctttattagctttaacatacggttcttttggtaaggtgagagtacaatagagacttaccaaatgttctccgtccttccatttgcatcagtgacaatccaatgtcttctgagaagctgaacagggcgctgagaattatttgtgattctgattctgtaggcaaagaagaactggcccttcaaaggctggctccggctttcaatataaacactcctgacttgaactctaatcccctaaattcaacattaaaaaatatcaggaaatctagttaagctcaatgaagaatctgagaaaatatttgatctacattaactaaagaattattacagaacaggtgacgaaaccaacggaggtggttcatctgtagtgcatgagattttcgtggaaaaaaagaatggggcgcctgaacatatgaaagaaatgaagtggtgcccaagggccaacgcacacagttataaccaactcaaatagattcttgatgaccttcacgtattaatctcttattttccatatcctgccttagctatttttttaggtcactacttgatacccaagttccctggtgaaattgcgtgaccagctgggggttttaaacactaatatactgccatagacaatgataatgtttcatagcctcaagttttcaaatgaccaaaccatttcattcaaaactatgatactttatcgagtgaaagaaacatgccagagttgtagtataacatcactaaatcattggattgtaagataccagggtagtagcatcactagaacattttaggagggcgtgtggagccaaaatcttcagttcatctctgtacttagcagcatcctggaaagcatgaaaacagagaaaaatcataaacatggtgaataaaagatgaagaaagaatgccttctagactgacaaccagggggtatgaaaatatctacacaaatcactattggcatatgattagcgtaaggagcccaaattcagcactatgtaatgatgaattcaaagttctggtcatgaaaacacaactccaactattacaagtagaaaagtcaacagtgaaggaagtaagtgaaacatgtgtattgagatgatttcttgacacttgagatttcctctcattttccgatgttatcatacaatatacagcacggagagaaaagaatcaagcatacaacaaaattgttgcatgtgcagtcgacaaaaggacacatcaggcatcactataaagcggcttttggcattttcggcagagacattgcagcaactaactgaggctgcacgtctttggattaatcgtcaatccacaaacatcgttagcaaggatggattgggacagtctcacaatccaactttgctaatgcctaatggggatatcacaatttacaggattctttttttagactacaattcacaagattcttgtatggaaatgtatcaactgaaacaagcaaatatggtaaggaaacaattgctatggatgtccaatacctcgaacctctcctcctcaaccgccttcttgagcgatcggcggagacgaagaactggctcctcctcctcgaatgacttgagcgaatccctcagcctcgccgcctccttgtaatcctgcaaccaaattattccaattcgcagtaaaccccaattcggatggattcgattgcaagttcgcttgttgaaagaatccaatggagctcgtctcgtctcgttacctcgaactgggcggccacggcgagctgctgcttgagcatggcgtacttctggctccgcatcaggaaggccgccgccttctccatccgcgccgcgtcctccctctcctcctccacctcctcgccgccgccaccactccccggcgagttcgagttcgagctcgagttcgcatccggcgacggcgacgacgacgacgccgcggcggccagcaccacccggcgcggccccggcgacggcaacctcgcggttcttgccctccgccccatccacaccgccgccggcgccgccggtgccggcggcgagctcagcgccgcccactgcatcccaagaaatccgaatcgaccccccaagaaatcgaattgagcgcctcacgcagagagatcagcgaggattcttggagagggtggcttggccaagattggctcctcttccctcgccgtggctgactaaaaatgggcgccgctcttggcccccatttctgtggctctctccatctccatcgccgccaagaaacgagagggagaggagtagaaaaaaaaaagaaaagaaaagaaatgtttgggcttaactggtgcggattagcgattggcgcgtcattattggatcagataagaacgatcgacatgttggaatcgcacgaaaaagatcccggattttgggtgtgggcacaggggcagccacgactccgcgattgcgatcgacggagaaaaacaacaggaaatgttttgtatgctgttagtgttaggtttaatagtatagcccactactggcatcaaatcatctatagccaacgtaatggtcaattcatataatagttgcttactatcctattaatagctggttccacctgtcatacacacattacgtcttggagtccgtactgcagctagctacagatctgtagtccgctgctcttctctctcttactttatctctttaaagtatgtttatagctagcttatagcctgctattgtacctgctcttagcttctttttgtgtgtttgattatgtggctagatttagggtgtgttggtaagttgggattggaaacccatctcctccgcacgaaaaacgaagcagtccgttagcgcatgattaattaagtattagctatatcaatatgattttttaagcaactttcatatagaaatttcttttgtaaaaaaacgcaccgtttaatattttaaaaagcgtgcgcgcggaaaacgagggagaggggttgggaacttagagcaccgaacacagccggcatgttcttcccactcatttctcaactaacatccctcgttttcggcgttcacgttttttaactgctaaacgatgtgtgttttaaaaaaaattacataagaaagttgcttgaaaatcatattaatatattttttaagtttttttactaatacttaattaatgttgcgccaatcttttactttgtgtttccatgtgaggaggcaaggttaactcaaccttatcagtctagttaccccgcacgcagtcaaactaatttaagtttaaaatatatatgattatactagtaaaatataggaagtacatttgcccttaagcgtaacacaatttttgtgaatgtccatgataaaaaaaagataataaaattgtccaatagattggactcatgaaggtcacaactatccgcccctgcttgtagaccagatgacacactactaccaaataaccaaagtggaggtctgcatcatagagaaggttctcttctcagttctcaccatggccatgaactagaatgccactaaggctgtgtttagtttaccgtaaagtttagattttgtttgaaattgaagatgatgtgactgaaaagttgtgtatgtatgacatgttgatgtgatggaaaaggacttaagtttggatctaaactttagatctaaacacagcctaagttttggttggctcatgatttagatgatcaagtgaatacttgttacagtgggtttaagatttggtttaagaaatagaatgagtttatccatcatcacttcttaaaaccacacacttaggttaaaagaaaggtatattgcatattgggctacttattgttgccaatattgtatattagatcaagaatattcgatctttagactttgaactagataattgtacatatgttttacgttggactgttcttatcttctttgttgatctgaaagctgttgacaccttctaagttctaacttgaggtttgcccctttcctactctcaagctcaggcacgtatgtgttaattagccccaaactcaagttctgcccttggccccgccaccatgttcgacctcaagcacaatctttatttattaacctgagcttaaccttgagtagatttggaggggagtaaaataaaagaagtatattagtcatgcgacctaacttgagtgatatgattgactcatagatatactcctactcaagcaagtcagcaacgcctattagagcaggtacaataacagactataagccagctgcaaatatattttaaggagataaatcaggagagagaagagcagcgggctacagatttgtaaccagctgtagcacggacttcaagacgcagtgtgtctatgacaggtgggactaggtattaatagtatagtatgtaactattgtataaataagctattagattagctatagattaattggagctagtagttggctatactattgaacttgctcttagtgcatagctcaaggcatcataaatatgttaccactatcagtgctaaaatgtggtggtggtgggtgtatagctcaacttacgacatcataaatacgtggggaggcaaccgatgaggagtgagaactgagaacattaatacttattactcacctgatggcatcttttcctccatgaagaggaaagaatgtaagcacagagaagagccgtagaaaagcaggatgggatcaatattatgattgaaattgaaccttttatgaaattaactaatctaaaataaaaatattctataagaataagtagcctaaaataaatttactaaaaataaaacgttccatcatattattttgtttcaaaacagacaactcttttgtcttgcttgaaaaggctcaagatgatggcctcatgttgatgaaaaaaatacacacactgatctaagagatttgcttagcttcagtgcaggtccaaggaccaaatttcactgttaacaccccatccattttttcaatgccaaccaaaaatgatttactcctaccttaatgcgtttagtctgagttaaaaccttcgatgaatttcagaatttgaataagtactcttctaaagtgtacaactcagaatttagaattcttttaatgcaatgccaaaacacgccatctattttagaaaaaaattaatttttaataatgaatttggatgagcacttatccggattcctcctcaatatttgtaatttccctttttttcttaatggagtactcctgcagagatcccggtataggtgtacaactccatacataaatgccacgtcgcattcagtatgtggggcccacaacgccatagccgccgggcccattccctgccactctgccagtgcccaccacgaaaaaagaattgaaaaaaaacactgtaaaaaaagaagcctttttcccctcataaaacaagtttttttccctctctctttagtctcagaagaaaaaaagaagtttttttcccctctctctgagtctcaaaaaaaaaaaaagaagtgttttttttcctctctctctgagtctcagaggctccccgcgcgcggagccggagaggcggagagcgagacggccaggtcgccgtcgccctctctcctcccgcggcttccagtggcctctcactcgcgccctcgcctcgccgcccactcgcgccgcagccgcagccgcagccactcctcctccataagtagcagatggcgtctcctccaccgcgctctcgcgtccgtgtccgcgcgcgcgttccgcgactccagggcggcgttcgatcgatttgatttgatttgaggcggcgccattgttgtgaccaagaaaccgtggacgcgtggttgtggaacgcggcgtggcgaggcgagatgcaggccgtggcggcggcgacctctagagcctgggcggcctccccgcggcggcggcggcatgtcgcctcgtgttcttctcctcctcctccgacgacgacggcgacgacgactacgtcgtctctcaatcgatgcccggtcgccggcgcgggcgcgccggtgctgccgctcggcattcgcggggggcgcatgctgctcgcgcccccacttctgtggaacagcggcgccgcggcgaggaaggcggcggtggcgacggccgcggcggcctcgccaccggcggaaggcggcgggaaggcgaacggcggcgccgtcgccggcggcatttcgcggacggtgcagctcggcgccatgatcctcgtctggtacctcctcaacatctacttcaacatcttcaacaagctggtctgcacatatatttttttcccccaattcgtcaatttccttctccttctcgacatgttctttttcgtctctaatttgttcatggcggatcttgttggaatccatggcttgcaggttctgaaatcggtgcccttcccgtacaccatcaccaccttccaattcgcgtccggatcattcttcatcaccctcatgtggttgcttaatcttcaccccaagccaaggctctcccttggacaggtaacccactgttcttgtcaaaaaaaactggaataatggaatcttctattatatactaaaagtccatgagactttctacaaacgctctcaagccgccaagtggcgctctaataaaatagagaaaatcctagaaattctaagaaaaaagaaaaacaactaccctttgattttcacttaaattggtgagtccaatattatacaccgttagataaaatcgatcttaaaacaaactaaatatcatgggtcccacctatcttcctcctgcacgttggcaggtggcaggtggagtatatacgtacgtatacattatacgtacgcttccttcctttttttcttttttttttctttttttcttttccatttatatatatatatatatatatatatatagtgcatatattttttaaataatcataattttacaaaacaaagaatctaccatcatataacaaaaaatcttcctttcaaataatgcactattttaaaataaattttacacaattatattatgtacctattaaataaacaatatctatattaactaatttatacgtgcacttaaactgatggccccattatataaatcatcggatctattttttattacattggtatattattctcaagtaatgcactgtttcaaaataaggtctacaccattatattgtgtacccattaaattaacaatttaaaatatatattaactaatgtacacttacactagaactggtggacttattattataatcatcgtatctattgtttgctaataaataaagcgtccgaaattcttttttttttgcccgctgcacaatgcacatttgcacctttgcctttcgcatgggtgacaaggtgtagtgtttgagacatataaggtgatcacaaccaccgtagagctaccgctttgccatatatcaaatcatatatggagatgattaattttgttaataacatgaaaagaaaattaaaggtgtgatgcagcgagagaataattaagcaccatgggttatgtttttctcaacactaattagctctgtttaagttgaaaccgagagttgattatataataattataatgtatttgtgttatgtcgtatttggattttgtactatttgttcgtaaaggtgaaagggatcattatgttataaatgtgagcgtaatattgacgaatattaatagaactcttactatgataagggtgataaagggagtttaaggccctttatttttttcccgattccatattttggatttttgtttgcacactttccaagtttctaaatagtgtcttctttaaacaatattctaactttttagaagtcaattcatttgttatacccttaaatagctatcacataaattatataattcattaatttcagctatcctgaaccttaagtactacatattttttttcatgcgagtcatggtgataaatcattaaagtcgtaaaattaatatgtaagagttactctgaacaattgtaaataggtgtcaaaattaattgctattaattagacatctaatggcttgcaagccacaaaattaattt

SEQ ID NO: 5911 - DNA, 6912 bp, Oryza sativa
agtcatttaaaattcatgaaaatgctctcaagctgcgacgtggtgctctaataaattagggcaaatattagaaattctaaggaaaaaaaaatcaaagtatctatttcttgattttcacttaaatcgttaggtctaatattataaaccattacattaaattgatcctagaacaaactaaatactacgaggtcccacctctcctcccgcggcatacgtacgcacctacttacatgggtacgtacgtttcccctcccttttttcattttttctccttcttttttttttaccatgcatatgcttccctccctttattcctatatcatacgtcttcatgagacgatttaatcaaaagaattttgagtatcttgcactcgcatttttcatttgtggccatactacacggtatatatatagatggactatatgataattaactagcaatacctttcaataatataagtgcccgtgcatacgcgcgggccaccttcctagttattagaaatgtcttatattgtggcaaaagtttgtgtattggaatactacaatacaattctagaaatgtaatgaattgtggtaaaaaaaaatgttgttagtgcagtatgcaaagatcctgccattggcattggtgcacacgatgggcaatgtgttcaccaacatgagcttgggcaaggtcgccgtttccttcacgcacaccatcaaggccatggagcccttcttctctgtccttctctccgtgttgttccttggggaggtacatgctttgttcatgatttttatattttgtcttaaaaagaggagacatataaccaaagagactgatcggtttatgctttgaaacaaatcgtgtgtttcggcagacaccctctttcttggtcttaggttccctcgtgccaattgttggtggcgtcgtgctagcatcgatgaccgaagtttctttcaactggtcagtggtatctattatctttaattccaatgcctaagaactgaggagtccttgatgctttgacttctgtcttcgtatttgtttaagcaatacaatgcattttgttgtaatgtagtatcgtgcaaaacttttgataaaacaggataggattttggagtgccatggcttccaatcttaccaatcaatcgcgaaatgttttcagcaagaaacttctggctgataaagaggtgattttcccaacccatgaagttgtgtagttcctcctacaagaatatttttcagcacaaaatgtatattcggacatttacagtatggtaaataccgtgaagcactgtatacctttacgcaatttgttcatatcgcaggaaacattggatgatataaacctcttctcgataatgactgttatgtcatttttattatctgccccactgatgctgtctgtggaaggcatcaagttttccccatcgtacctgcagagcaacgtgagtgtttgggctgttctgtattatctttgctaaccaatgttttattcaaacactgtctttttgggcatgtagggagttaatctacaggaactatgttttaaagctgctcttgctggcacttgttttcatttttaccaacaggtgggctaaattccagtataaaaatagtttttatggttgtccaacggttcttagaattttgtagtaatttttatggtttgtctgcatggatccaaattttctagtggtggctagtaatacatgagtgtatctgcaagtttttttaattaccatggtcaatctctttcggattttgtttaattaccttaaccaaaattatttttgtttctgaggcaggtttcttatagtttattggctagagtatcacctgtgacccattctgttgccaactgtgtcaaacgagttgtggtcatcgtctcatccgttctcttcttcagaactccgatttcacctattaatgcccttggttacctcacaaccaaattcaactgatcctaacagctcgcttttcaatttacccgtactgaattttgtccttttttctgcattcaggaactggcgttgctctagctggagttttcctgtactctaggttcaaaaaagctaaaccaaaggctaagactgcatgagtcaacatacacagctgcaatttaactagaagattcaggtttatctcttcttgaggtgaaatgggccgccaagcaatcacttggcttctctccaatttgtcttttgccagcttgtctgggtcttagaagcttgtgtataagatttttctcaggaaggtagtgatggaccggcaccaaaataacaaaataacattgtcagaagatttctcaagagaaatgaattttggcacatacttttgaaattcctgtccaagaatattgcctccttttttactggttcacttaaaatgtgagtagggatttttattcattccttttgaatttggctgaatgctcaccagatcagactacagtttgcatcacacaaaaagaaagtttagaagcttctatcttccgcctgttcttttttgtaggccatgaaactgtagaaccttctctctctgttttttttccttggtaatgggtgaaccagactggattgatactctagctggtaattgacagccatactagccagtcaacagaagatgactcctttgtggatgagaagttgggaatacattcaccataaaaaagatcaaagttgaaaggaaaatgttgaaaagagaacatgaagcaaagaagctgaggaggtccttgtcctacttcttgttgagagaaggatggcgcttcaatgattggtctatccaactattcaacctagcaccactagatgtttattttattttcttttcttttttgaaaccaaataaaatgtttattgttatagtgaataaaatcccaatttcaagggtgctactattactatctggtgtagaaactgttcctggattgaatttttgcagtctaattgatgatatgacagacaacaatacagtctcaaaaatatgtaacgccgttaactttttacgtgatgtctaatcgttcgtctaatttttttttaaaaaaatataaatttcatttattttgttgtgacttgttttataaaaaaaactataatcttaacttatacttttacatgtttatactaaattttggaataagaggaattatcaaatgttatgaaaaaaaatcaacagcatcatacatttagggacggatggagtatatagcagaaatgcaacaaaatcaacaaagttcaaatccatagtgtgaaactagcaaatctgtcataacaaatagcaactcatcatgatgtttcactgcattaatgcagttgttattgtccaaaataaatacagaagccataaactagtgtggtgttcttattcaaaagtaaaaaaaaccaaaataaatctcttctcattgacgataaagcgcacagagaggttaatttagctcttctttaagtggtcaaaattggcgggaggtagtcggatttggcgccaaggatccgcgcctgggtgtccgggaagaactccacgccggggagctgcgtgatggtgccgtcgccggcgacgccgacggggtaggtgagcaggtggccggggaggtcgcgctccggcccgtcgccggcgtagaggtcccagcacctgtccgccatggcgttcaccttgcgcacgcagtcgaggctctccggccgctggaacgcctcgtcgacggtaccgaggtgctcgtaccacagcgccatcctgaacccgtgcacctgccccctcgccggccgccccgccgccgccaggtggtgcggctggtacgctcccatggcgatctccgagtccctcgccccgtccatcgacctctggttgatgttcgccgacccgacgatgatgtactcgtcgtccactgatgaacacacaaccaatcgatcaagaaatgcatccaaaaacaatcgtggtaagatcaatcaggagatatatacgaaccgatcatcatcttggtgtggacgtagatcatgaagcggcgattctgctgcgcgtggaagtagccggtgtcgggctcggcctgctccggtggctcgtactcgccggcggacttggcctcgcggttgccgaggcagaagaaggtgaggtagtccttggggtcggcgtcgatgcccttggcctggatggcgtgggcgatgtcggtgtacatcatctccatagtgcggcgctgccagtcaaggatggcctggacggagccgctctccgggatgccctccggccacatcggcacgacgacgtagacggtgaagcgctcgccggcctcgatcttgctcaccaccttcatggagagctccttggggatgaggtggagcgcgccgacatcttccggcttgacgccgtcgttgggcttccagcagtaggagctcccgaggaagtactggttctcgatgtagatgaagctccgcgccctcctaatggcggcgatgtaggcgtcctggatgctccggtcgatgatctggtccttgccgctgacgaggccggcgcgggcggcgtcctcgggggtgtccgggaagccgaacgcggcgccgccgtcgatggagcggaacagctgcacgttccacgactcggcgtcctccgggaacatcgccggcgacggcgggatgaccgtctcggcgaggtcccggagctggacgaggaggtccttgccgccctgcttgcgccaccgctgctcgaagttgtagagcacgtcccacgccacggggccctcgaggcggcagtggatgtcgtgccacggctcgcgcggcccgcccttggccaccgtcgccgtcgcgaagttcggctggtggaagtcgtcgtggtgcgccgtccccagcgtccggaacagcgagtggaacggcgtgtcgtacctcccgtcgcagaggtccagcccgccgacgaagctcaccaccctccgccgcccgccgccattgccgccgccgtggcgcgacgacggcatgtcgtggtcgacgacgacgatcttctggtggtgcgtgaacatggtggagatctgcaggtcctgcacgatgctgccggagtcgtccgggttgcgcgggcacagcacgcagttcacctccgtgccctggaagtagttcatcgtctcctcgtcgtgcgtcgccatgagcccgtccttcttgagcatccccaccgacgtccggtcgtcccacaccagcatcagcaccctcacgccctcgccggccttcttcttcagcagctcgccgagcgtcacgccgccgccgggcttcggccggtcggcgtccctgatcagcgcgatctccgtgtacaccgaccaaccagtgatatagataaaatgcctcgcgccattgatggcgtcgaagatgtcctcccagcaccggtgcggctcgtagctccggccgccgtcgagcgggatccgggggatgaacccgtcggggacatgggcgtcctggtacaacgtcaccttgcatccttgccgctgcgagaagaaggtgtagggcacgccggggtacttgccgctgcggacgccgcggccccagctccgatccttggagatgtcgaagtactggagcttgacgtggaccttgccgccgccgtcgccgatgggggtgcgcgcgtcggtgtcgtcgcagagggggagccagcggtcgacctcgtcgccggcgaggacgtcccggacggggaggtagccgacgccgaggagggaggcgccgatggggttcttggccttgagggtgaaggcgacgtgggtggcgaggtgggcgcagtagacgtggaaggactcgtaccagcgcggcgcggcggtgtcgtcggcgagcgtgcgggtgcggccgacgcgggccttgtcgaggccgatggtggcgtacaccttgctcgtccccttgcccacgcccaccgtgtcctcgatcccctccaccagctgcgtcacattcgcgcaaatgcaaatgcagcttcatcagtactcctacagttttctaaatatttgacgccgttgacttttttaaatatgttttatagtttatcttatttaaaaaaattaagtaattattaattcttttcctatcacttgattcattgttaaatatagttatatatatgcatatagttttacatatttcataaaagtttttgaataagacgaacggtcaaacatatgctaaaaagtcaatggtgtcaaatatttagaaatggagggagtaacagattctgagtgaggatatttaaatttgaccctttttttatatctcagtttgtaagttgattttgtgaagtgttgtatatatgctgtatgaatgttgtcaaaagaatttttcataattatttgaatgggtttttgacaaacaagagacatcatctcgagggatcaaaagagtttaccgaggcaaagcattgcaagctattttttgatttgatttgaaaaatataaatttcaacaaaacactagtactccctccgtcccatccctccgtcccaaaaaaagacaaaccctggtttccgtgcccaatgtttgaccgttcgtcttatttgaaaaaattatgaaaaaaattaaaaagacaagtcacgcacaaagtattaatcatgttttatcatctaacaataataaaaataataattataaaaaaatttcatataagacggacagtcaaagttggacacgcaaacctagggtttgcctttttttaggacggatggagtatgtttgtagactagctcgtcctatagattgaaaatgtatgcacatgatgatgctactgatggtaatttcaatatgattatgactcgaatatcgccgcacacatttccattggatagaagagagaagagaggattagcaaaaaaaaaaggaatagaattggactgtagcaaaaggagcaaatcacgttcatgcatgaatggatggcaagaaccacttccggttatgactgttaaaacaggcaccagctaaaatctaaattata

SEQ ID NO: 5912 - DNA, 9035 bp, Oryza sativa
ttagggatggaggaagtatatactgcatgggagatctaagtaagtccatgatgaaggcacaagcaaaggaccttgcggaggaactggggcgcttgggagcttggcctgctagggttggagagcgattccgcctcgaagatggtgacgtgcatcgtcccatggagcaggatcttcgccattgttagattaaactatctatccctcaacacgatctcgatgatcacccctgcacacatacaaaaagggaaattgtgtttaccatgatgcaaaatctcatgctcgatcatagacaagttcatggctagaatctatacataaatccgtcagataagaaaaaaaataaagatgattaattatctgcaatggcgaacgcaccgattgatcgaacagaaggagaaggaacagggagagaagaggagataaggaggaagaagaggaggaaaggacggtgaattaatttaggaatttctagggaaggtgatccgatcatccgaaaataggaagtctagtgttgcagcggacggcggaggcaacaggggagcggagcagccgggcatccaccatccatccatcgctgcatttttttttcttttttttgtccccggttgcgccgcgccaacgtgctgacatggaacatcaagccctggagtttgtctcgccgagcatcaccaaaggtcctcctatttcatcctcaaaactgatttggagagattttagttaaaaaaaaacactccaaccctgctaccttacatgatttttggagtgtacaataattttttcaaccatagcacaccttctgcactgtatcaaaagatcgaaaacggaagagtcctcttcttcgagaagagtttttcccgcagcaatgcccagacaagcaaataatactagcaaattcgcaaaacaatatcatagcaaacaatatgtgcgggttggaatacttgtacataagtagtagtattaaaaacttgcaacacgcggaaggacaagggcctttagcctagtggttacaagcctcaatagcaccttaggtcctagattcaactttgcgaattttctaatatttaacggctttgtgctttcaatggtaggcgacgtactcgtcaacagcgaggtgcctgtggcagggtttacattaccggttgaccactaaatttcgagtcccatcggtatcacaattttcgataaattttaactaaatttagaccaaatctattgtttaacctttcgaaattccaattgaaacttaattccgagccatgtcgaaacgtcgaaatttcgcggacatgtgtcagtgtgcgtgtccccatgggagcgaattttccaggatttaatggacctatgtgagtgtgcgtgtccccatgtcttcgaagatgctcataggggtagggtgagtatacatgcgttgtgagtgtatacgtggtattgtgtagttctaaaaaaacttgcaacacgtgatttttttccctttttgcacaaatatcgatgtgttctaatggtacagaaatcaaaattacgatgtagacaataagggcatgtttagatcccctgtcaaaatttttcaccctgtcacatcgaatgtttggacacatgcatgtagtattaaatataggctaaaaaataatcaattgcacagattgcaactaatttgcgagacgaatcttttaagcctaattgctccacgatctgacaatgtggtgctacggtaaatatttgttaatgacggattgattaggcttaataaattcgtctcgcagtttacaggtggaatctgtaatttgttttgttattagtctatatttaatacttcaaatgtgagtccgtatatccggtgtgacacgccaaaatttttcaccgttggatctaaacacaacctaagtttgcaatgtaactagatgaaccctgcatgttgctgcaggagttttgtacgataatagtagaaataacacgttggatagctagatgacataattttatatattttatataattttcatatttgatcaaaattttttaaaaaatataatggtttataacaatttaaatcatatatagattgaccatttaaattaatgtgaaactaatgtgatgtggcagaaggaaaataaagaagataatatagattattcatccaaagtaatatgaattcataagagaagaaaaggagaaaaataattcgaaccatagatcaatcatctaacggctaaaaaaattaaggtgatatgtcttaatgagattagagaaatagtattaaccacacttagtgagcatgattttatagatacacaggattacccacatttgaaatttcttttttttataaaaataaaacccgagacaaatttttaatagtctcgtttattatgtgctactaccgtgtgtaaatagggagtataaggaaagtaacatctgtcataaattagtaacagcagcgggcatttggtctagtggtatgattctcgcttagggtgcgagaggtcccgagttcaattctcggaatgccccattttttttccagttctttttttttcttaacctgcacactcccgctaacagcaacgcgacacgcaaactcgccgcgctgctgccaccgcggcgcgcgcatcgaaacggacgaccgcgacgcccccacccccagtctgccacgccgcagatcgccggggcccccgcacctgctgcactgcacgtcgtcgtcctcctcctctttgtcctgtcgccgaatatatcctcaccgtgcccatgcccatcacgcattcacgcctcacggagtcaatagcgtgaacaatggtgtccatggcgccttcctcctccgccgccgccacccgccgccttccccttcttcttctcctcgccgccgtcctccttctccacccatgccacgccgccacggtccgttcttgccttcttgctccctctctctctctctctctctctctctctgtctggtcgtctgacgcgtgcgtgcgtgggtgttcgttgcaggaggcgtcggcggcggcgaggcgggagtgcacgtacacggtgcgggtgaagacgagctgcgcgtcgccggcgcggacggcggacattgtcagcgtcgcgttcggggacgcgtaccggaacgaggcgtacggcgcgcggctgccggcgggcggggcgtcgggggcgctcgaccggtgcgccgtcgacgcgttccgcgtcggcgggcagtgcgggtacggcgtctgctacctctacctccgccgcgccggccgcgacgggtgggcgccggagtgggtgcaggtgttcgagcctggcgccgccgccggaaaaaaaccgtccaccttctacttcggctcgccgctgcccgacggcgtctggtacggccacaaccgctgccccaaggcgtccccggccatggcggcgcgccggacgaacacctccgcttcacctctaggctagggtagctgctcgctccgcaatgtactagtagtactacggaattggcgattttcggaattcggatgcatccatccatcactcaagaataaacagcctcgtgtgtgtgagaaatatcggaaataagagctttcggatgacacatttatttgtctttgttcttttgtgttcaaatgataaactttaacttatcgaattctactaaattttgttagtccgagcaaaatttagtcatccaggaaaaggtggttgaaagagaaaaatactgcattgtagaatattgctgctccctccgtttcattgtatacgctctctcaaaaatcgttaactcaaaggtgagaacatttaggcctctttggcaaagggttttcataaggttcaaattatgaattttttccctataggaaaagaaagaaagcttttcatagggttgtattcatatgctttacgtttcatagaaagtttatagaggaatgcaaactctcttttgttttcttccatcgcactatcaaagagctgtaatcttttcttgtaggatttaagaatcacactacaatttccagtgctcctatcgaaaatattctttccaacaaacaaatggctatcccaaaatcacttcgaatttcttaggattttctcaaattacaaggctcctcgggacgtaggattatcaaaacgcacaaataggaaaaatatatgaataagatgtcatgtcacatacttttgattcctatagggtattaaacacacaggaatttcagattttttgtgcatttggatggtttgtaggaaataaaactcagaatttttggaggttgttgttttgtgtgtcagatatagtagacagacaaagggatactgcatgggacttcagactcctttggatttggctaatcatggtgcatgataagaaaaacataggaattgattgccatggctaggccaaatcctacagaaagtaaaatttcagggatttgctaaagagcatgtttagttagtccataggaaaacctcaggaattgtgaatgaaatacttcattagaataaataaaatatgagagataaagagacatgttgtcttggccttctcaaaggaggaaaggaagcgatcctacagaaattttggaacccagtcttacaatccaaaggaccttatagggaattttctataggattttaattctttgaaattccttggttccaaagagagcttatgcttatatcctatggaattgaggcataggaagcaattccaaaggatttttatcaatcgcattcctatgatccaaaggagctaatagggaacttttttttttctaaggattgaaatcctccaagtttcctttgaaattccttcagcccatagggattttggattatttttaatatgaagtctaatctctaatatccacttcgtgacacaggattatagaaaaataggaatatgaaaagcataagaataataggattttaaaacacaggaatcctgaatttagttccttttataaaaacagaaatagagaggaactagataggtaaataaagcacaacatttttcaaaatatttaatgagtatattaaaaaaaatcaagcattaataccagcacatgacacccctctacatcattcaaagcatttattgcaaaatgggtactcccaaaataatatacatatcaacatgagctatcgagatcaccgtgggcagcaacaatcagaagcgagagggatgatgcagcgtctccaaagtgtgcaggtttgcaagatcaggagggaagcaaataggattgctcatgctttagctcaaatggctatgaggtctagatcgtatgaggagtggaagttgtgtcctcccgcagaaatcttagacttgataaatcaagaatgcaattctcttttccgtaatcaataaaattccctctttgaagtaaaaacaaaaacaatatacatatcgcatatattgtaaaatagagagaatccgtgaacacatttaaagatgaggaagctacacatgaccacaaaataaattcatatcatgtttgcaacatacatatacttctgtgccgtgcggtttggtttgagccattgaaaaacatgtgtgttgtaccgaagaaaatgtgataggtgcccgtttataaaatccacatgtagagacgaagaatcaaaacctctggtagctaatcaacgtcacttagactgccacacaggagcacaccaactccctactagaagtagtagaacgccacgtgtgcaaaccaggatttggatcctctgcatagaggatgaatagtaccgtgtttatttaaggtacccggtagccattcgatcgagatcgaacggactaggtaacacgctgtgatatttgtgatgttgtagccaccatgatttaccacatttcagttttagcacaggacacattttattgcactacaagagattctcttgatttattttaggacgggtgggtagttttctgcgttttcttttgtatttttggttgaaacagaagtccacggaagtcaggaaccagtttagatgagacttttgactttttactattgagctctatctattcacttattcttatactaaccgaatcgcttattagcaaataaaaatatatgtttgtaggtaattattttatatacgtattacaaagaaatactgtaaaataaatttagataaaatgccaaaaaaaactcaatttcaaactaagttgtaaattttaaattttgatctgcataagcatgcgaaacaatgagaccttttgatgaaaggcctggttttgttcccaaatttttttttcaagaacatcgcatcgaatctttggacacatgaatattaaatatagattaaaaaaactaattgcacagttacagtaacccacatataataataatggattaattaggctcaaaacattcgtctcacggtttacagacgagttaatcccttctaaacatctaatacgtcgtctaaaaatttccttttcgcaagctaaactggccctttgcattcgaagccgcaaagtgcaacaaagaaaaaaaaagtgcactttcctggccggctgcactgcagtgacctcttctcacctcccacctcctctctctctctcccctttcctttacccgccgccgccggcgtccaagaagcgcgggggttggtagggcggtgaccggcggcgaggtcaaagggattgcttgctgctagtgctgggcaggtacaaaatagtcgcttactcccattctctcactacctcaattccacctgctgctgctgcctgcgacaccgtattccagatcacgccgtggaaaaaggtctctcatctttcgtttatttccttccctttttttttctttccctcttatttatttctttcaggttggttctttttctgccaattcctggagaatcgcgcccttttttggctcccaagattcttcccccctccatttctgcgtcttttccacgccacggtgacggcgacgagcttgctttttttttttttttcttttttggggccaattagtgattctttgtccggccttgcgattgctggagttgtgttggggatcgaaaccgaggtgagccgatgagcaagaggagttgcggcggcggcggcgcgcggttgcaatgcgcggcggcggattggggcggctgcttcctcgcgctgccaccggcggcggcggcggcggtgccctcaggcggtgacaccgatggcggattcaacctggcgtggactctccaccagtcgttccaccctgcctccggcctcttcgccagcgtcggcgtcggcttcccggcgacctcctcgagctcgccgtcgccgccggacgctcccggagacccgtatgccaagtatgtctcgccggagatcgagcaccatgctctgcccggtcaaagtgtggaggtggagctaatggagaaggggaagaagaacaagaagaagacgaataaagcattcaagctcaagatcaaggtgggcaatccccacctgaagaggctgatcagcggggggatcgccggcgcggtgtcgaggacggccgtcgcgccattggagacgatcaggacgcatttgatggtggggagtaatgggaattcgaccgcggaggtgttccagtccatcatgaagcatgaagggtggactgggttgttccgcggtaactttgttaatgtcattcgagtcgccccgagcaaagcaattgaggtaaccgactgatttactgatcatggtggagtcatactttttttacagtgtttatgtgtaatgtatattgatactgtactgtgctttgtttgtgatttacatacaatgggggaatcctgttaatggatttttgttttacaaaatatgtaacccttattcttacaaaatggtactccctctgtcctaaaatgtaagcatttttagctatgaatctttgtctagattcgtagccaaaagtggttatattttgggacggaggtagtaagcattaatgtttgttgcaaatcaatgtttgtttctttccgcttttcgtgtgcttaattgatcctgtaaacggcaaaatgtgttttctcccttatgcttaggatacattatgcaaattgttaggtatgtggttcaaataaatctaggtatatcttttatattttaagattaacccctgttacccaagaaaagctgaatagctcttttggcatagcttaaaatttgttgagagattgtgccattttggtattggataccatagagttaagttatataggtcagtgtgctagccttgcgcagtatgcaatttcggagctagtgtaaggctgaaagcatcgatgtaatttctgttataacacatcatttcatcagcgttgtgctatcttgaccttatggatgatattaatgggaaaaaatagtgatgattatatacccaaaaacaagaagcagtttgcagtttagtccaccggtacgtaagaattgctcttatctgttgccataacatttccctgctcaagctggtctgaagataagtagcttgaacagagtatggtcttcataaatcactatttttttttattttaacataatagaaacttggtatttgctttctctccagtgaaccatacctgataatttacacaatattagacaacagctgagcgcaaaccgaaggcacatacaagacaaaactaattatatccttttttttttttgagatttccattcccagaggtattggcctgattaaaccaaggttttgatctgcagctaaataattcctatatctttatgtttgagtgagctgctccaaacctcaggcaacttgttgcatgattcatgtaagaaaaggtttgtatgtttcaaggaagctacagtcagaaagttcttgtattgattttttatcgtaattaaaaatgtaataagggctataaaaaggctaattctcatgcttatttgaagtatgaaaacatcaggcaggtccttgcattattgttggctttcttcaaattttcatttcttttatcaagaaaccttttctggcattcacagttagagggttgaacagaacacagttgggtgtttaatttttatgttctgtttgttgcttagttcacacatgttggatgcgcatggttgtgtatatcatcgg

SEQ ID NO: 5913 - DNA, 990 bp, Oryza sativa
ttacaggggtctggggccaagttgcatgaagttggtgccagccgccggtatttcgtttatgtgctatgaggcttgcaagaaggtattgacagaggaagaggatgactgaatagtgtgtccttacactcttcagagcgcagttttgcaacttttttgactggaggcatcttttgggcttgatttggaatcaaatcatgctggaatcggatgaaactcgtgtagtttcttaagaatttttaccccaactctgtgctgtcagcttggcctgataaaacctgcctctttccccagttttgcttcaggatatcatatgcagagaacatgtccaataactgatttctgctgagtttatgaagtggttgaaacgcaaatgggcagtcataattcccaggtggtgaaacaactacgagactctgtaatctgtgtgcagctttgcaagtgcatgaaaggttcatttgatccatttcctctgtgtttgtggcctctggtttatctgtcgagttaagatggcatcaacaatgttgtaacatcaagaagtgtgttctcagtgataattttttttcagagctcaataagaaacttccaaactagcccagcccagaaagcaggctaacaatgtccatgtccatatccagcccatttgtctgacactacatgggcttaagtgggcctatcgcagcagagctcgctgaaggcccataggccgaaaccgtagcaggcttcctcacttatgtacctatagcttttattatggaaattacaataatagattggggcagagctaaaacgaaatggaggagcttaccacttatttgttttactctgctttataccaagtttatatgtataattctataaaagaaattaatgggctgggtttgtgggtgcctccttgattcctcatgtagctccgccccccataatacgcaatactaatttctttcaagaaaacgacaactctctgtaacatgtggtatcgatacatcgttt

SEQ ID NO: 5914 - DNA, 1464 bp, Oryza sativa
cacaactaagctactcattagcacataattaattattaagcattagttaacaaaacataaaaattgattaatatgtttttttagacaactttcctataatcttttaaactgtttagcctcctttgattgaaaggaaatccataggaattttagaggatattattcctataacaatttgtttctatatagtcctttgaatcaaaggaataaatcatatgaaatcctatgatatacctaatgccatgcaaattttgaaggaattctataatgaggtagaacctcatggaaacattcctatgagtcattgtatgaaacatgctacgtttttcctatgaaacattcctatggaaatatgctacgtttttcctacgctccaatcaaacgattattattgtgtttatcatgtgctttgtaattctctgtttcagacttatattcataccaaaatcttgtgttttttctatttatatattttctcaatcttgtgttattcaaaatcttgtgttcttgggtgagggttcccaaccctcacctcaccttttgacacgaaaaacagagcaatggattaatgcgtgattaattaatattagttttcaaaaaacttcaacaatgaattaatatgatttttttaaagcaacttttctatagaaaaattttgtaaaacaagtactgtttagccgttcgaaaagtatacgcacaagagtgagattgggaacttggactaataacacatcctaacacagaaacgtagggcctatttggttctctaccctaccaattaattggtagtaccaaaatctaggcaaattttggcactaccaattttttggtagagcaaagttagctaatctatgtttggtttaataccaatataaagccaaaatttagtatgagagtgaagaagattctagaatgtagccaaattgagcgtgggcgctaccaattgtttggcttcaatccaaactagcatgtttactattaaagttaccaaaattttggtagggtcacattttggtttcaatccaaaacgacccgtaaagttgaagctaggagaagtgccgaacacactaggtgacacgtagataatccatgtcatcccatgtgcaccgtccaccccgatccacgcggccatccgtgcatgccacgtgttccgctggcgaatgcgacgacacgccacgtacgctagcaatttagcaacgggaataccgtatacgaatcgaaatatattaatataatactaacatgtacgccgttggccgtacatatcgaccacgaaacctccggacacttcccgcgaggcttgtttagattaaaaaaaatttaggcatcacgtcaaatatttcgatatatgtatgagatattaaatgtagaaaaaatcaattacacaatttgcaagtaaattgcgagacgaatcttttaagtctaattacgccataatttgataatgtgatgctacattaaaca

SEQ ID NO: 5915 - DNA, 2419 bp, Oryza sativa
aggcgcaactgtttttttcgatatttcataatacgatgcgcatatacatgcgtgcaattaactagatccttcctcctctctaaaatttgtttttttaaatcattcaaccttaagatctctaatctcgttaaaccgtctgtctttagtatcacttagatccatgatcttgtaaattcaacatctagatctatgatcctgtttaagtgaatcatcacatgtccaaagctcgtctgatccggttgacctttctacgtggcggtccagcatgaccgcaactttgcacttagcgccctccacacccggttgacccacttctcctccccccccccaaatatctcctctacccgcggccactctcactagaacccccatccctccaactcgcaccattgcaacgactccgagggtagcaattagggtggcgtcagcgatcatgggcggtccgtggtgaccagagacgcgttaagggcagcagcaagttcaccgaattagcaggtgatcaagctttttcctccgtgaacttgaagaatacgtgctgcttcgagtagctatggccttccctacaggcgcacttcagaaattaaatccccctagctgcctccctcgtcagcaccaccctaccgcctccctcgtcgtcgccgtcatagccacgtctccactaccacccctgtcactgtcaccacaaccctaaatcaaaacaatgaagatgagaagacatttgggagagaagtgggtcgaccgggcgtagaggggctaagtgcaaagttacggtcacgctggtcagacgggccttggacctacgataattcacttaaacaagatctaaacaagatcataaatctagatgtcgaatttacatcatagacttaagtgacaccacgccccaactttaagaaccgatggtgtactttactatatatttattagggtgatctaaattagaagataataataggtggttgcccctcatactttggaatggagggagtactacttctctctttcatgaaagttctgtttttcctaactattattttccgtgattgatccaaataaaatcacctaaatattttcacaatttaagaccattgtaaaatttgatttttcttgtttacaataagatatcttatttcaataaaaaatcataattatttgtaattatataaatggctaaaaaaactcttcccacaccttcgcatgtgtcacgcccagaaattcccgaatagaattccaagcagaatgtgcattaaaatccccgtccaggaccagccggcgtacacaaacgacaatgttgacattcagatccacgtcttacaaacatcataaaagtcttacaaaaatgcagcggaaaacaaaaggtaactggagctaagccttgactaaactgcagcgggaacaccactccacaggcatcctcgacagcacggacaaagcctactcctcggagaaaccttcatctgacccgaactcgaactctggggttgggaaaagtagagcaagactgagtactacccactgtactcagcaagtcataccggaataggggtatgatgcagggaattaacaaagaagagctagagtggttcatttgcataaaacgagcatttataaacagaaattgaatgcgaaaacagttgtaaattaattaatattaaacatcccgctgccaacgctagcccacgttgcgacaggcccaaccatccacctaaactatccaaattcaaaagattacactagggtgagactaatcacggtgaatctggttgaccgcccataaccgcgggcactgctattcgaatagttttactctgatcagaggtgtacaactgtacccacaagacacagccccatgacacgtttccgtgcgccgacatgccaccacgacatcccggaaagaggccgtgacaggaccattcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtgattcattttaattaaccaacaccaaagcggtgtcactaatccaacattatcataaaaacctatagtctaggttttaaatgagatctccccattgtgtgctagttgaactaagcatggctaagcaaaccctagtcctaactctaatcatgttataacccaagctaacaaaggagcatggtatcaaaatagcatg

SEQ ID NO: 5916 - DNA, 3486 bp, Oryza sativa
cggagcgtcggaggaatcggaatctagcgacatacaaagcaaacattgcaaacaggctataagactactgaaacagggaacaaaaccatttttaatggattctacacatttttcttgatttactgagacttgaatgggattaaacggagctcggatgaattagatatgaattttagaagattctctgtgtttattactataacaaaaatccttaaataatttattgcgcaatattaaccagggctgacgtcagcacggggcgcggcgccgacatgcggggcccaccggtcagcgactcgggagagggaggaaggggcgccggcacgcgggcccactggtcagcggcgcgggagagaaagggcggcggcaccggctcggcttggctcacggccggccgaccgaccgcggcgacggcgacggcgcacgcgcgaacgggttgccggcgacggcaaccggcggcgaaggcgacggcgcaaaggcgatgcggaggcggctgcgctaacggcggctaggaaggggagggaacgggcggcgatagaggcggccgccggctcggctcggcatcaaaaccgaccggccggctaggtctagcggcgacggcacgcggccgacgacggcggcaaccggcggcacgggaggcggcggcggcagtcgaaggtgacggcgcgcgacactaagaggagaggaaggggaaaaagaagggaggggtgcctcaccgagggtggccggcgcggaggaagacgatggcgaacggcgacggcaagccacgggaggacgacgtcggcgagcggacgagcttcggggtgccctaaggaaggagaagagagggattagagagaggatgataaaccacggcgaccggaaaccatggccgaacgcggcggtggaggtgatgctcacccgtgcgcgagggggtgagggctccggcgacgaacctcgacggaggagaggtggacggggtggatctcggccacgcgaatccgacggcggcgacggcgcggcctggcggcgagcctagcggcggctagcggcggccggagcagcgaaaatggcggcggcaaagggttgcacggcgcgggagcgatgggaggctcgagagagtgcggcgaaatggggaaaaagcgagagggagcgacggcgatgcttaaatagggggagagggaaccggacgtggccgggagaggcgggaatcgccggccgacgtgagggagtggggaagagagagaggcgggattcgattttcgaatcccggccatctcgggcgcgggcgcgagcgggagagagaggggagtgggcgcgggagacgcggcgcacgcgcgggcgtggtcgacgtggcccgggggaggcggaggcgagggcgcggcggcggttgcggcgcggcggcgcgagcgagatcggcgggaggtgggagacgggcccgacaggtgggccccacctgtcggcgacccggagaggagggcggcgggcggcctggctgggcctcggcctgcggccggcccagtaagggggagggggaaggaaggagggaatgggccggcggcccattcggaaaaaggaggaaaaagggagggaaaagaaaaaagaaaaaaaggaaaaaggattttccctggaattaaaacattgcttgctcaattttaattggttaaaattatttctagagctctgaaaattccactaaaaatccctgttaatgagtttcgacatgtagaactcaagaaaaattccacatgtcaaatccgattattatttgcattactttcttagggttttctcctgatttcacctgcattttcttagggtcatttatcaaaattacaattttggcttgggaggaaaacttcggggtgtgacagcatgccactaataaaaaaaatattttcgcagacggtcaaaatggctctatatggaggcagccaaacacactgcctgcaactaaactttgcaaaatacaatattttttaagcggatatgctcgtacatttacgtgcttttaatcatttgttattcaatatccttgattcatagtttcatatatagtcacccaattataatataatccatatgagttgcaatgtaattacctcacaattacattataatctatctattatatactaaaagtccattaaatttcctataagcgctcctaagccaccacgtgtcctcctacaaacgctccaaagataccaagtggcattctaaaagtctaaccgttgattttcctttaaattggtgggtccaatattttcaaccattagatcaaataaaaaaataaaatcctcctctccacaccggtccccacctcctctacgttcccctcctcctcctcctccagttggtacgtaacgtacgtactccctctctccccacatatcctcttccctttcctaatcttcaatctatctattatctattatctatctattatctactaaaagtccattaaacttccaataaatgttcctaagccgccacatagcacctctaaaaacactcctaagttattatgtggcgctttaaaaaattttagaatgcagtggacctatatttataactattagatctattataaaaaatacaattaaatttacctcaaaaactcacattgtatgtgcacgtataggtataaaaaaacaagtacgtccatactttgatacgtacgtacaacgttgggcccacatcattctttttttttctttctcacttattagatggaaaaccaatccgcctatatttatcgtctcactttcccaaaaaaaaacttaattacatacgtcatatactatggacaaaacaataaatcacaaaaatatatcaatatattaatagtaaaatcagaaagaaatactaataagaaaaatcataaacgccagcacttattgttgtcaatagtctttaaactacgattttattaaaaataataccacacagaaataagtaggaggcaaaaattataattattttcatcacctcctcttttttccatccctgtccttcaatgcagggtgtagtgtttactatgccattgtaaatatcacaggcatatgcatatggttgagttaagatggtgtcagtaaaagaccaatgtagacaatgtatctaaagtgacattcttactaatgcaatcctttgtgggtgtgcctatagtgaactaagtgttaaaatggtgcgataggatggtctttaggtgcacttctacatcaatgtgggacccatgtttcagggcattacataagaaagcttttgtagttatcgacttcatccgttagagagacatttatgtctatttttaacggtgctatcgtattatccggtagaagtggtatgtttagactatttatacatagatgtggaaataagtcatgggcatcgagttaagcagtgttgatgattttttaataatatacaatgcagtttcatttattaaaaatgcacatagcttttaaaactataacaataggggagtttatatatgaccacgacaaa

SEQ ID NO: 5917 - DNA, 677 bp, Oryza sativa
tataaaaacatacacctgggaacaaaaattgaagttttaaattggaaagcatttggaaccaaagaaaaaaaaatgaagtttcaaatttaaaaccagatgcctctcctagttgtgtgctactacttggatggcattatccaattggagacttcgaaaaatgagggatccaatgaccggctgccggcctacgccgcaacgcacggccgtttcgccccccactccggcctaccggcgccccaggaaacacgccgcacgcgccacggccatccgggccccaccaccagccatcactaaaccctgtgcttaaatcaattaattagaccttaatcacccagcgttaatcccacctggcactcacagtgcgcttaataaacgggcgtgtccagctcagcaccagccgttccaaaaatgtttcgaaatcccaagccgcgagagaattgtcgtctcgaatcccaaccacgactagggggccatctctgtaaataaaaaaaatcaattaacgagacgaccagtgatactccctctatctcattttaaatacagttatagatctctatgtccaacatttaatcgttcgttttactaaaatccttttatataaaacataaataaaaaaaatgataaaacataaatagtactccctccgtttcaaaatgtttgacaccgttgacttttta

SEQ ID NO: 5918 - DNA, 1137 bp, Oryza sativa
tcagaagcaggtgggaggactttacgctgcagcaagtgtgatctgcgcggccatacttacaagaaatgcccgaagaatgcagaagttccaagcggcgcagatgctagtccatctggacattcaagtgatggtaggcgaccacctggtgaaggaacaacaagcaggcgcgcacggccaaggcgtcgtcgcgcagcgggcgattccatggtgtaacaatgctatcgatttaggaaataaaatgctgttgtgatgtgatgagtgttcggactaaatacttctatcgtgtaatttcaattgaatgttgttgtaatgagtacctccgactattgttgtactagtagtattgcgaactatttggtgttgtatcataatgttatcgtgatgagtgttcggactaagtactcatatcgtgtaactgcagttattgttgtaatcagaaatattccgtatggtgacacttttgtttgtttgtactcttgtttaatatgtgttagtaattcgcttatgaacatttattacttatgttgaactaattatttatatgtttctgatcaatctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttattgaggcggcggcggacgaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctagaaccggccaacacccttcctccgtactctacagtcgggcctag

SEQ ID NO: 5919 - DNA, 2519 bp, Oryza sativa
tctagcctagtggatccccccttttacaccctgacgctgatgattactcggtccgacgctcccttgaggcgtacctgttgtggttgttcgagtgggtgatgttcactagcacccacgggcacgctgtggacttccggctggtccactacgtacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttaggcagccgagaggtttgccataggtcgaccagtggtggacagcgcaccctatggggttggtcgcagtgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttagtgttcgagtttgaccgtctccaaccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcatgagttcggattgttcatttctaaatttttttgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcatgttgccgctgtcacggacgcgtatcccacgcaccgtgaccgagactacttcgtgggggtacgtcgaatttgtattagttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctgtttcgcacggtactgctcagcccagaggtttcttaagttttgtttctgtttttgtacgaaaacatcaccccgtcgtaacttgatgttccatcctcgcaggacctcgtttgccttcgagcgcccctagcttcggagcagtgcgacctacagcaccggtttcgcacggtacagttcagcctagagattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgcccatccctcgcccacacggtactttactttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacaggccacaacagcacacatgaaaagcggcagctcgagttgtcactatcaactttcggcgctgcctgttgacataaagtgaatcacgccca

SEQ ID NO: 5920 - DNA, 9498 bp, Oryza sativa
atctgaaggcaacctcttcatatcttctttcccactagcacacaacacacgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcacagtataaaatcgccctcccccagggcggcaagggggccgcctgcaaaattccaggccccccgccgcccatttgcaggcggccccccgcacagtacaaaatcgccgtagcggagggcggcaagggggccgcctgcaaatttcgttgacggccgtcgcccgagagcgaacggccgtctgccacgtcactttcgccgccctctgggatggcgacttttaaaaatcgccctcccagagggcggtaggcgaccacttctgtcaattttcaaaatgaaaaattatttttgtaaaacttttaataaaaaaattaaaaataaaaaaacctctcgcgactccccgatctcgccctcacccctccgcactcgcacgcgcggcgggcggcggctgatggcgacgaggcggcgcgccagcagcacgggcgcacatcaaagaggccaaacagtcagaggagggaggacgggagaagatccaaggcggtgcggcacaatggcaggcctaatttgttcagcctcacctgctaactttttcttgatccactcctgcttaatacttcctccgaaaaaaaaaaacgagactaggattgagtaaggctgagtttagttccaaacttttctttaaacttctaacttttttatcacatcaaaacttttcaacacacacaaacttctaacttttccgtcacatcattctaattttaaccaaacttttatttttggcgtgaactaaacacaccctaagatccaaaattctacattaggtaattgtcaactccacttgtctgaaaaggccgtataagaaactggcacatgctagtctgctatagcaattttcatactactacagtactactgtatagttctcattgcgtttgttaattgcgcctgttaggtttgagtttcacgcggggtttttccacgagcaatatcgtgtttagtagttaactaatgacattggcatccacttgcaaaaacacatttagttacgccaagtgccatctagggtcaactctcctttttgcagggtacattctcccggtaattaattaagaaaagccttgcgatttttctatgtcactgttggtgttgatggagacgtcgtagagtacatgatgacgctctatcagatggggtcaactgttggttaactagcctgaagtgtcatacctggaccgctaatcagtggtggaggcatcaaccatgtatacatacctcatccctcaaaagaaaattgttctacttcctccatcccatataaaacctgacgtttaaaggttctaccggtgtcccataaaacatattgtttgagcaattttatggtcatttgttttaaatttttgaatatgctaatgattgctttgccatgtgtaatttttatggccatagctttagtgtgtagagatatataggtattattcttattgaatgccttgcactcagtgaagtgacaactgattattaataagtaaggacaacttgattatattttttcttcaagctaatttgcttttgaaaccttaaagtgtcatgttttgtggacggaggaagtacctttttactaatgtcctaagaaaatatggcttgtttggtttgataccaatttattaccctacaaaaattttggtaacttcaatagtagcaagtgtatgtttgatttgctaccaatttttatccataatagttcaaattgaatactacccaatttggtagtgtccaatttttccaatgttttagcactaccaagattttggtaggggaaaaattggctccaaccaaagaagcctgcagaaacaaatttgattaaaaagtgggatcacctgtctagtctaagtcatctggcaataagctttgaaagagttcattaatactcgctccgtcctatcttaagtgtagtcatgtgttttcatgtcaaacgtttgaccattcattttatttgaaaaatttattaaaaaatctagaaaaatgagtaacacataaagtactattcataatctgccatctaataataacaaaaatactaatcataaaaaatttcaaataatacggccagtcaaatgttggacatggaagcccaaaactgcaccggaggatgaaagcccaaaactgcactttaaatgagacggtgggagtagtatcttgcatgcaggggttcattataacatgctgagtgcatgtagactcaatgaaatgacaaatttagtcattttaacctgaagctaactagcttaaaaatcttaaagcgtcaacatttttggaacagaggaagtacatgtcaatctagctcatcaccctgattgcttgtagtgaaaaaaatggatatgaaatgatatggttttaattgtctgttgatttttgcatggtctattttatctggaaaaaaggtaacattagataggttttgactaacagcttaccaaaatataagtttatttcgcatatacaaatttataccaatcgatttttcggaagaaacctttgaaaaggacattgagtttctacttttattttttaaaaagaagagatctgatctagagtaatttacaagaaaaatcaggccatagactcttacaattgtacaattaactggagaaaaaaaagggaacaaaaccacacaattgtaccgattgatccatatcttatagagttgtaaaatctgacatagaaaaaacgccagtggaaaaatatgacaagtcataactattaccgtgaaatagacatatctctacctattataaaaatttaaaatgtttttgccgtcatcttcgtacgtcgcaaatctgtcatccgttcagattcctaagcatgtttgtagttggttctttccgtgcaaggtattttaagccgctaatcgctcgtgtatatctcttcgtcagtccgatccttatctgtattctttccaaaaaccacagcccagtatattaagccggtacatgttgcagtcaagcccacgtttccaacgtcccacgtcacgtaaggaaagagcacacccgtgtatcatgcaaagctgcttctgatctatcgctatattctgcctcacgtacgtacatgcatgtacatctgtttcctatcgatcattatatctgaaaacgaatttgattcacacacaaattaataatgtgatatatatatatatatatatatatatatatatatatatatagtatgggctccaacatcatccaccgtttaagtgctttaggattcatgctacttaaaccggattattagacctgttagcgggttaaacccgattagatgtttccatttttactatacccgcaggattgcatgcatgtactagtgaaatactatgaatcactgacgtgattaactcccatcgtttccatataagcttccatgcacgtacttaatttccatttgaaatattaatgtgattgtgtgataattcatttccaaatttgacatgatattgaatcaaatcaactaatttcgatgtaattgatttatttccatcaataccgatttatactttctattctttgtgtacatatacactagtagagatggcattccatattttacatactgttgttgtttcgactccatgatgctacgccgccggacgacgtcggcgagattctccgtcgacaagccgttgcatgaacggacgtgcccgagcttcttcgtcgtgggctgctggttgttcgccatatccgacgacgcagccaggcctccacaaatctttgtcgctaatcttcatgagcacgtcgctggtcgtccgcaagcctcgtcgcagccacgattgttgtatgcgactccgtcctcaaggctcaagctcgttcctcgccccacgaagtaactggttgccacctttttcaggtacgtcaaatcaactggaacatataaattatcgcttgtattttttggattttttaggtaccaatgattattgttcgtattctctgtgtgtatgtacagatgattttctatttttaaaggtattttagtaactgaatccatgtgaaatcgatcatctggaacccaaacaaacatgattatattggatgattgtaggtagtgatatcggtgttcatttccgctgatggtttgcatgtgaactagctgactgaattcacccctcgatcaccacgtagacgcagttcggctgcttcctatctgccgcgcctgccatctctccatgtcctcatcgtcgtcatggagatcaattgcctcgcgtttcgttccccattgcaagtatgttcctatcatcataaagcaggcttcttagtttcaaatgcataggtttttgcagggagtttgacatttggttctacctgtgttttgtaggatgattatgttatgcaaaattctaaagaagattagatgctctttcattcacctgtcaattgtctggacaaaacaaatgatcattaatccgatggtagagatgttcaacaattttggacttgctgaacagggtttctcatcaagacaattttgaatgaacaagtccgatttccagaagaccgatttctttttttttcttcgacaacctagcaatttatctaaattttcacatctacccccaaattgttctttggtttattaattccaacatagttaggttaatttctccttgtaacttgattttctttttgtgtatataccctgtataataataataaatttttaagtaatccctccggttctatattaatgagtatgaaaaattaaatagggtatataaccaatttgatcgattgtgaaaaaatagcttatacccaatttaagcaagtatgaaaaattaaattggtgtatacctaattaatacgattatataaaaaaagacttcgattaaatcgggtgtatacacaaattaaatgagtatgaagatttaaacgtgtatataccaaacttaatcgctaacaaaaaatcgggtatatacctaaattaatcgataaccaaaaatcgggtatatacactggcgtagagataaacatagttggctttgcctggtctccaaaaaaatgctatgagaaacgagcatacaattcattaattcttttcagttttagttaaaagtagaatatggttatagacttctatgagaaggtatatttgtcacatacttagccctcggagatataaccaatatacgggtgaaatccttttttataaaagaattaagcagaagaccgatctataggttctatactccatactttaaataaatttaactatagttaaaataaaccatgcaaaagttctcatttctatatatctagcgtatcgaaaaagtatatgtgtacacacacatatatatatatatatatatatatatatatatatatatatatatatattcacgcagtgatataacctatcgaattgaaagcaattttattagcttataccctgacacagtaggtatattatacatacacataacgatacatagccagataaaaatagaagatagattattcgatggtcatgcaaactataatttattccatggtcatgcaaactaataaggagtgtatatattacatatatacaccggtactatgtatatacctacacgaatgtcacacccgtagcaaactatattacatatgtacatcgcggtactatacatataactacaagaatctatttcatgccatatacgtatccacataaataggggcaactactattttcacaaaacaaaccggttatatacctatataactcatagcacagagaaaccaaatcatttgtgaataatgtagaatttacatttataccggaaaaacaaaacattaataaatactctaattattttttccttggccggctgtgggaatagaatctaggtatatattctaatataattcactcccgtgattttaagaaacaaaaacaaaacaggagtacatatactttatatacgttatgcatacccaaaattaaggattatgatttatctgttcaaatgtttcctttatttgccataattatgtaagtaaatcaaagggcattaaatacggcttaattagtacaatgcatgcgccagttttttgaacagggcattgcaccttccaaataagaaattaaatacgggtgtaaacccgttaatcttagaaacacatcaatctccttgatcaagatctcatctaacggtttacactcatggagcccatacaccatgctgccccatttggccatcctatatatatatatatatatgcatgcaaaccaaaattcaacttttacaaattataagaaaaaaattccagtcatcaaatctctactattataaaaattgaagttgtttttgtcggtacttgtataagtcggtttttaaattcattcgtttttggaaatatttatccgtatttgagttgggttttaagtttgttcgtttttgaaaataaataaagagttgtataagaaatctctttaaaataaactcgcatgttaacttgatatgattttctagaaaaatatatatccaagcaaattcttacaatgaattcttagaaaaatatatttccaaacgaattcttataatgaacaataataagattaagatagccttcactcattacaacgcacggatgttatgaaaaaaaagtatgatatgataaagtacggtcctgaattcaacatcttctagcctccttaggtgacagtatttggcttagcacttcacgtttagcgccaatccagccactccaggaggcgaccgttcttttcttcttcggctgggaacacgacgtcgacacacgtgtagcatacagcatgtcagcatgcgtgtcatgcactgctccctccgtcccaaaatataaaattttagaattagataaaacatttcataatactataaatctggataggtatgcccactgtcctaaaatataagaaactagaatcgaatgagatattttctagtattgcatgcctattcagatttatagtccttagaaaatgttattatattttaggactaaagaattttttttttaccggagattttcatgaggcttttgttctcgtggaatcctctctctcaacttatctgtctgtggaatctatgctcctgccatctttgtgcagagacgttgttctcaagctccggtgagagtgatgagtcgacgtgcacaagctgtatctcactttgcttttgtcactggaatctagtaagatcccacggtgcacggaccgcttggcttggatcttgtctcagctttccgatgccatgtgttaacaagtactactacgaattttccctgtatcaatttgtttacggtaaacccaatgtcgtgccagaatgactcctctcatcctctggtactactacgtgctttcgtcatggcaaatttttgcagaatcgacggcgtctgagatgctgtacatatacggtacaccctccttgttgtgaaaacagatgtaacacataaattttatggaaaaaaccacagacgccaaccggcaattatcactattgaggagccgattataaacgttcgtaaataaatttatggtttctatgtccgacgtttgaccgtcatcttattttttaaaaatatgattctttttttaaaagtcacgcatacaatataatccatgttttatcatctaataataataaaaatattaataaaaaaattaaataagactgatggtcaaatgtgggggaaaaaggagcttataaatgaatgtatttcgggacagaggctgtagttaaaatcaattcttgtgattgcacgccgcggctatcatctcatcatttgtacccgtgacatggatacgcgatccagtacgtacgtagtacgtcgccaacgccggatgcaggaaaagctggcgccgcacggcgtgaccgcgcgcagcggtgcgtacgtacgcgcgcgcgcgccgcctcgcaccgctctccgcttggcccggcgcgcgcagccgcaggccgcaggccgcagcgtgcgtacggcgagggaagcaaagcgtggaccaaccgaacacacgggcgggcgactccgctcgccgctcggcctcgcccgcgcgtcacgtaggtacgcatggcagattggcagcggcatcgtattcgatctcgcccccaccgcgtcgcgtcgccatccacccccaaagcatcccgcatcccgtcgtcccccgtgctctctctcttccggctcgatcggcgaatccacgcgagaactaacacacacaaaagacacattgacccatcattactatactaatcactttcataacctaacctaaatcagagttactcctccgtttcatattatatcccattttaactttttactagtaaaaccttctcaagtttgataaaatttatagaaaaatctagtaacatctacaacaccaaattagttatatcaaacttaacattgaatatattttaataatatgtccattctgtattagaaatattattactccatccgttccaaaatataagtatttttagaatattgacaaatcaaatatttttaactttagctattaatagaaaaaaaagatcaataatgtaaaattaatgttataagatttatcattaaacaaactatcataatatgtaactctttttatttaaatcatttgatattgttggtcaaataacatctcggagactgtgtcagattcaaaagatgcttatattttgggagggggagtatttttttacaaatttaaaaatatttgactggagaaaatatcaaaataactttaatgtgaaacggacggagtagttaacaacccaaacgcaccgaccgcgaccggtaatctcatgcatccatccatccgctgcatctgcaattctgcattggcagcatctcttctcttttctctcctcctcgctgtttcgcacgcacgcaccgcaccacgccgccgtttatcaacgactcctttttaccgcaaaggtttcgtttcctttttcctccctctcgtcgcggccgcaccccgaagcggaaggaaggaactccgagagcgccatccatccatcagcaccaccgcgcgcggggggcgtagtggcggcggcggcggcgggagtcgccggggagatgtgagagggagaacgacgtgggggccggagcggagatggctgcggcggtcgtcgtcgccggggaggcggcggctgcggcggcggcggcgggggcgg

SEQ ID NO: 5921 - DNA, 1697 bp, Oryza sativa
aagggagctagcgaattgatacagctgtttttttttaatgtttgaacactgtattttaatgattattacggctctatcgtggtgatttctaacgaattccgtgtttcttcctgctggaattttccttcggtgggtcgagcagcatatcaaggcgatcattactgctgaagaggtgatgtttaattcctttcccccttctgattgtttgtcatgtaagaaggttccatttgggttgggggggggggggggactatgtgcacaattcaaccgtctcttcacttattggttagctatctataatgttgaaattctcatcaggtgattggggattatatacggatgcagcactactttggagttttgtctcaatttctaggagttgcaggatgctcaaaggggaatgatgcatagttttctgaacctatagctccatacaatgctgattttctaggcttctgtcagtttaagattaaatttgttgccactttgaatagagtacaatattgcagttgtctcaagtctgttttctatataataaactaggggctatagtttataatttatataaaactgtgaggatcttaaatgtcattttcatagatgccaagcgatgctggtggtaactcacagtaaatgtttttatgctgtgctcaggttttgctccgggatccattagatgataatgtgattcctgtagtagaggagctccggagacgacttgcaccttcaagtgccactcaacatgatgtggaaggtgctgaagaagatggtaagtttggcttgtgattctttctgaactgctgatgttcatattggcaacacgattctgtctgtatgatgtttgttgtggtaacttttagtatatgtttcttccttgatggtgaaatgccaatacccttttgatgtcaaggaattggacaaaaacaacgcacaacatgtttttaagaaatatgaaagaattcaaaaatattaattggccgcaaaattctttattgggttgcggccacaccatcctgttgtattcttctttaatttgtgtccttttcagttggacattcagttgaacaacgcgacctgtcactccaatagaaaagtccaaagcatacagtcatgaaacataattattattctgcgatgtctattggactttcttgcactagatcaatatattatgtgtcagtctatattgggattttgtcttaaactgagattttgggataaatgaaagaaatttgaaggaccctgatatggattcaactggattcacgagccatgactaaattaacacatcgtggtgggcatataaacacagaaacttgagaataataacattgatctatcactatatgaggactttctgaccctctacagaatagtatttgtttggtttaatttagtctacagtatgtaatacatattacaattgatgtgccattttataaccataagttgatccccttgcatcaaattgacttggaaactttctatctatcctatcactccatcaatcaacactggctggtatgctgataaaatcctaccaatgtctaacaactgttgtggttgttttgattgtaatattctatttgttgtttgtgaactccatcaatagtttgttaatatcccgcaatacaattttatgaactccagaatctccctttgaattccgcgcactggaggttactttggaagccatt

SEQ ID NO: 5922 - DNA, 20635 bp, Oryza sativa
taattgggtacttgattggtaaaataatgcttccacatcatattttacttgtactataaactgttcaattacaatttataaatcaaattctgattcataggttgtgctagtaacatttttcagtaggaatttttgcacagactgaccaaattcatgccacagctgttaccttgattcttttctatagctcaaatgtccatatatgtttcaccatccatataatgccagcaactatgtgataacttaaggttaagaaattatgatatcttgcaatttactgatgtagtgagcatatacttgtctgaacttatgctattcacaattttagcagcataatagtgtagtttgcccaagaagtggagtgctgtattattgatttccgtttgtcgccaaacaaaattgtagctaaagttgcattaagtaattgtacgatgaacagaagttacatttgagaattgtatggcaaatcttcacagctattccttgaaacttctatgcttatcatatagccattataggtctcttaactacttgttacattctcagcacatcaactgcattatgcatactaacttgatctactacaaacacacagattagcagccgcaacttggatagggtgcggaagttaaaaagtggtatgacacgattgaatgcgagggttcagaaggtctgatttcttggtttgctatttgacactactgagtgcagttaattaactttatatttttcagataatagtcatgatgttcactgtatttttatgccatattctcatctgatttctacttttgttgtgagattgttctgataattagccatattagctgaagaatctgtgcacttctgacaggcattgccatgcttttatcatttctttgctatgtcatagcacgtacattcttgtatccagggttagttattttataaacagaattaaagaacctcaatcatctagaagagcattggtaatattatatactattctatatttgacaacatacagttctgctttctattctcttgcatacttggtgtgtatcacccgttatttactagcttttcttgttcatgctttcctattagatcacaaaatgtttgttctctttgccaggtgagagatgaacttgaacaattattggacgatgacgatgacatggctgatctttacttgtccagaaagttggctggggcagcttcccctgtcagtggctctggtggaccaaattggttcccagcatccccgactattggttcaaaaatatcaagagcaagcagagccagtgccccaactatacatggaaatgaaaatgatgttgaagagctagagatgttgttggaggtcttttttgtttttctgcatcacaatgtcttgtcattctctggctgagatactaaaagtttcttaaatttgcaggcatacttcatgcaaattgatggcacattaaacaaattgacaacggtaagttgaggcagctaagtcgaatttacaatatcaaaatgggctagcaaaacatggcctaaggcttttgtttacaacacaacatcgttgaaaattaatagtactctaggctttcaccctttgctgactgtatttgtctgctatactgtttcagctgagagagtacattgatgacacagaagattacattaatatccaggtaacatttccctatgatatagctgtgcacggcatgctgatcttttaatcttggcactcacctcattacctctcgtgcagcttgacaaccaccgtaatcagttaattcaggtaatttctgaactacaagacctcatgattctctcttcttaagtgcaaattccacaaaaatagaattgatttcaaactagcatgctgttaaacccacactgaaataagctaaatgtttcataaaacttggttaccattgattcagctgattgtgctattctagttagtaatgcttgcaagtataaattctagtagttatataaatactctgtcattgtgcctcccgactttctgcaacagtaatataacttggatttgcttcttcctgcagctagagctattcttgagttctgggaccgtatgcctgtcgctttactcattggttgccggaatttttggtatgaacattccatacacctggaatgacaaccatggatacgtattcaaatgggtaagtcaaccattacaaaagggtcgtttaccgtcaataaattgtggcctgtctaaccaagctgtaaactttgttcctgcgtcacaggtggttctcgtgtcaggacttttctgtgccttcatgttcgtctccattgttgcgtacgcacggcacaagggcctcgtcgggtcgtgaaccttgcccaaactgtaaatttgagctagagcaaccttgcgtatgattaatctcttgtaccaaaattcatcagtataaaattgggatgatgaaaaagaacaataaataggaaaaaaaaagagtaaattccaaagagatatatgatgcttgtcttctttacccgtggtttgccacttttaggtgaaaaagaggcaagctggtaccctggacaattttctcgtctgtctcgcatcaccacatgctaattattaatgccctggtaacttcagaagaaagtgttgctacaaatgcattcttccttgcagaagaaagcgttgccatttttctgaaaggtttgtggaagacttttaccatgagttagaagcgaaataacaggacgaacaattcttaatgggaaaaatcaaccaatcgctttcccttctagaagtattaaggcatacataaacataagctaaattacattcgcgggagattacctgcgttagagtttaaatcttgatacaaacaaatatattacacattctctatttaaatagactttaacaggaatttatatttatctagattcattaatatcaatataaatgtgaaaaatgatagaatgacttacattgtgaaacagagtaagtatatgttatattgttacggtgttaagtgtaaagtgttgtgtgtttatcgtgtaatcggaaacaaagaaacggttatgaatgattaattgagatcacaccgcggtctccaacagttcggttatgagtagtatgatcttgtcgatagtacacacaagtagtatgttcttgtcgaacgttcaggggatcggagattaattatgtgcagtaacttcttcacagttagaaaaatcaactaatgccagtatctatcatggacttcacaggtcaagcacaaacagtcaagatggtgtgaaactctctcacatgcatacgcaaggaagaaataaaaagaagaggtatttgcaattccacaaggccgtgagaacgagcattatgcatagcaaatcttcgtttaagtaataaatcctatcaattctgccaagccacattgcaaaaaacctctccgatccgttcatatgatcgttgccctataagtacaaagccagatacaattaagagctgagaaactcatcatgatcatagtactttgtaaggtagttcagacatatatacacattacacaccttttttttttcggagattacacgcctaaaattttgttcctaaacgcagcatcatatatactccataaatcccgtttattggagatcttgatctagcaaggcatatatactaattaagcagtacacatatatatacgtcgttaagcaagtctaaatttggcaaggatgactcccagcttctccttggacagaggctgcacgcacaatagaacaaattaaattaccatatttcatatattacacttacaaagtatatatactcccttaaaaagttatttacacatttatgtcatgtattcctccctgcatggaagattgttaggaaaatgtaactactatgaaaacaatttttatagaaggctaaaatggattatgtgggtctacgggtagtgggccgcctatgaagattatgtttcatagacagcctctttaagtgagccgactgtcataatggatcttcgcagacggacagttatagaacccctaatcacaaatatgcaggcgggttatcgcggctgaaaatagggtttgtttctaaaagatccatagccctcacagtaaaaaagaaagatcttgttttctagtagcgtgtgtgtgtgagagatgtacatatgagacggcattcccatgccattgcatgcatggctgtccctgcgctgcgcgcaggctctcaccttggacgtgaagtcgtcggcgccggcggtgatgaacgcgtcgacgtcggcggggaggccgtcgctcgacacggcgacgatcggcgtggtcacccccatgccccggatccgcctcgtcgcctgcacaacaacaacacacgctagcgcgccgcccgcgccgcgcgtcagccggccacaccagccgccaaatcggccattatttcatccatccatccatccatccatgcgtctcgtcagagatagatcgatcgatgatctcacctcgtggccgtccatgaccggcatctgcttgtccatgagcacgaggtcgtacggcgccgccgcgtcccgcacccgctgcaccgccacctccccgttctccgcctcgtccacgacgtcgccgccgcctgccgccttcagcgccgctctcgccacgacctgcactcaccaccagctcgatcgagccagccattaacgacgatctcttaatcacatattactagctaattaactaagcgatgaattaccctattgatctcctcgtcctcgacgaggagcaccctgatcatcttgcgagccatgaactcttactctgctgctctgcctgcagcagatcattcgcctagctgctagctatatactactcatagcaagcagtaattaacaaagctcgatagctagtagctagcctggttgaactgaactagtagtggaagatcatgaggagagatcgcgctgtccctgttagacgcgctgggctttcacgaagttgcatgggttgcgatccacacgcgatctgcagctgcttggcctatttcctgcaagaatctctctacctccaaaacggcaaaacgcaactacgtgccacgccagccttccacaccgccgctgtccggtttaacctttcatctcttactaacaacgtgtgaacacacatttcataccgctgaacggtacgtttcgtaaaaaaaatatttttatataatatataagtttatatattataagttttttataacataacttcaattttatactaactctgtagttttacgataactttattgttaaatctgtaattttacgatacttcaccttaaacttgtatatttgtgataaatttagtgttaaatctatagttttgttgtaaatatagacacatattaatcgtcggtgtttcaactaatcggtggttctcttttcgtcaaacaaaccgtattccatcattgctggaaattgcacacttccggaagttatagttaggttgcattaatcgttatcttggtttggaggaagattttcaatgcacgtaaaattttaaaaaaactcattaacacataattaattaactattaactattataaaatattctaatagattaaagtttgaagttgaagaaaaaaaatagagtcttaatatctcgcgtccacattgttgcgattgcaacagggatatgtgtacacgtaaaaccgcttacgagcttagccaagctttggggttggtgcaattgtgcagagatcgtggtgctaacatcgtcgatcggacggctggggattggatcagatccacggcacgtgattattcttgcggaataagttcaccggaggtcccttaatttaacggcgagattttttaagacctcttaaccataaaatcagaaatcttcacccctaaactatacaaaaccgttcaccggaggtctctcggcagtatttttgcccgattttactgacgtgacatcctagtcagcaatttttttttaaaaaaagtacttgggcccacatgttagctgcatattctcttttctcttctcttcttcggagaggcgggcagatgcgggtgcggcgaccggcggcggtgcgggcgcggcggggtgtggggaagaagcgggagaggaggagaggagcgcggcgggcggcgcggagcgagctgcaagttgccactcaggtcgagcttgagtagctgcgtgaggtcgccaatcggctaatggtggatggaaccacgacggagctcaacatcacgtcggcgaacatgttgccgtcgaggaatatctcagccaaggtgttgcagttggtcaggttgttcaagaactcccaggcgccgccgtcatcggtcggcgtacggctccgatgagatggatgccccgctcctgcggagcctcccctccctggggtgggcgctcctctcattgtctcccgcgcccgcgcggatgctctccacggcagcatccgacgccctcgttgagatcaagccaggcgagataagcatggtctccgacatccccaaggagcacctccgccgcaaggtgcttctttggacttactctgatttatgtagtgtcgatagattcgctagccctcgcagacccgtgtgggaatcgctcgagatgtctaggtttggtgggttcttttggttgttacttgggttagggatagagcctggaggtgtcggtcgtgaactcgtggtacagactacagtgctattgctagttgatgttcgaatcgtggagtagatagaaatgcgaattcggtgatgaagttttacacttgtatggtttgaactgcgtttagaacttgggaggaatgtgctggtccgcgcgcgcccacgtcgatcggctgggagctcgccacggaacacgttgttcacgagtgtgaggcctcgcaacgacgtcatgttgaagaaactcggcgggatctctccagtgaggctgttatgcgacaaggctaacatgcggagcgctgggaggcttgacaagccgtcggggatggaactttccataaggttctggtcgaactcgagctgcacgatcttcgtgaggttcgccagcgatggcgggatgtggccggagagcgagttgtggctgagccggagcaccgtgagattcggcaacgcgtcgagccaccgtggaacgccgccgacgatcgaggttgttgttgttgaggtacgcgacgtcgagggcggtgcaattgcggagcgcgtcaggtatctcgccggcgaacgcgttgtcgcataggctgagataccacatccgccggagccagccgaggccatcggggatgctcccggagaaggcgttggaggtgaggttgatgagtagctcgagctgcgtgaggttggcgatggctggtgagagctcgccggcgaggcggctcatggacggctcatggacacgtccagcgacgtgacgcaccccgccgcccgcttctctgcctgcggccgcgttcgcgcccgcctccactctgctgccacgctcgccctccgctgctccacctgccgccgcctccctcgctaaagaaaaggagagaggagagaaaagagaagagaaggaaaagaaaaagagaagaaaaaaaaatatgtgcagctgacatgtaggccccacgtactttttaaatttttatttgctgactaggatgccacgtcagcgaaaccacccatatatactgcttagggaccttgagtgaacgactttgtatagtttagggtgaagatttctagttttgtggttaagggacctcaaaaaatctcgctgttaagttgagggacctccggtgaacttattcctattcttgcgcatcccggacacaaccgggccagtgttcaactcgtgtatacgaatgcgtgcggaagcccacgggccaaggcccatagttgttgggccctaaccagtccgtactcgtacaggaataagttcacttttggtccctcatgttaacatcaagtttaaagcacgtacttcaacagcgatatcgggtatagcacatcattttataaaaccggtgtaaataatatcccacggtagtgtgggatccggtaccggtattaactgacgtatgttagtgggtgccagtcaaaaaattgcaatgagctctcctctcctctcctctcttttcccgcttccccttccttctcgccgggtgctttcgccacgagtgcggcgtggtcggtcttcgccgcgcccgtccgcggcttttcgtcgacgagagtgttgcacgcctcgttcgatgtctacgacgtcgacggagacggccgcatcacagctccaccgcgtgtgccgcgctgtacgagcgccgagggtatcggcgccggcaacgacgacgcagagcgcgaggtggccgcgcgctggccgccgccatctcctcgtctcctctctccccgacgccacagccgcagcaaggagaggcgccgccgcctgcgccgctcttctccgcgttggcgccgccctgaagaagagtggagatctcagaggagtgagacgaagtcggaggaagaagactaaagacatgcccctgacatgtgcgccccactgtaaattttctctgacttgcaagtgtcagctagatatcacatgggacgaagacctaattcatgtcacgttagcgtcacgtcggttaaaacttgaaagcggacccaatactatcatcagcatcacatcggttaaaattggactcaatactatcttgagacctgatttacatcggttttgtaaaatgatggatgcgttatacaccaatattgcacttgaaggatgcgatttaaactcgatgtcaaaatgacatgagggatctaaatgagcttattcctactcgtacgggggcctctctgggctctgctctggccacttgatgctgctactggaactggaatctcattaatcctgacaggctgggagtaggagtatcagacagacagctcatcacagttgctctactcttcgcaaactggccgctgctaaaatggaatatgagcattgaaacaacagctttgtttgcttacagagtagggaaaatgaaataaataaatgtcgatgaactcgtgtgtatgtgcttttcgcggttttagttacaaagttattctccaaacttctaactttttcatcacatcaaaactttcctacacacataaggcctcatcgtttggcatattcatatgcttatcagccaaaatttgagttttcaacgtaatatttagagctgattttggggggtttttttatcgaagtttagttttcagcctttgcttttaaatcgctaagaacacatatataaaagttttattcacaaattgattttcgtttgcaaatatgccattcagaaaatatgccaaacgatgaggctgataaacttccaacttttccattacatcgttccaatttcaaccaaacttctaattttaattttaaccaaacttccaattttgatgtgaactaaacacaacctttatttccaaattcatagttctagctaaaaattattcttttctgagaggagaaggtacaattgctatgagctacggtttggttcttgcaggctttgcattgcagcatcactccatctctgaagtctgaagtctgagctgattactgaaggtgagaaagggctgtgtcagtcaaaagctctgctgactctgctcctatgcttgttgtaggagtactagaggacatcagatggctggcgttgaatccattggcttctatctgtcttccttgggaaccaaccatacattaattgcccatgtagaaacaaacgatttatggacaacaaaaataaaacccactggttaaaaagcattttgaagaatattaaggtgatttgatctaatatggaaacaattttgtcgttacggtgattgtggcgcgaaaaacaccttatttctgataataaaaatggaggtggaattcccctccgattaaaagaaatactaacatgaaaatattaaattacacgcgaaaccatgttaaattggcgtgaaaattataatatcacgtcggtgtcggttaatataatttatcccgaatataaagtgtaaattgacaaaaaaattctgtgaagctatcactgtaacaacaggtgcttgggaaagcaactttctggcagctgccgcaagcacgaagatgtcataaccttacaagggaaaccacctgcattttctactgttctgggttagatcaagctgatatgtgcaaaactaccaacaaacaaagaactactactatacactaggagaaaaaatgattaaacgaagctgtcgcgacttcccaaagcagtttggttcttctagtatccgtgtgacaattcgtgttcctgataaaaaagacctgcatcatcgtctcatccgacgttcgtgtcacgatcaagttgacactgactcgatctaccaaccacgggataatcgagttgatttgataatctttcaccaagataagtttcagcaatgttgtgtgtgtactatctcctttttttttatcctcccagctattaaatagccctccgatatcttgctatttaggagtattaaatgtagattactgataaaacctattccataacccctagactattttgcgagacgaatctaacgaggtatattaatccatacttagcggatgattactgtagcatctatgtttaatacttctaaatagcaagatccaaacagggcgtatgaaactttcaaccaatgatttctcttccctcagacaatggaaacaacatgatatatcgtgtaagatgtaagaagctacttgcttcttcagtcccaaaatataacaacttatcaatagattagacactatcgttgctataattttttgacggagagagtagccatcattttcttgtatgcagtactccagttattttttgtcgtgaaaaaaataaataattgtgaatactactgcaacttaaacgtgcatatactgtaataatactgtatacgatacatatacggagaaaaaaatacggggagctgaaaattctcccaggtgcctctcggctacgcgcacccggcgccgcccacacgcaatcgcctccttctcctcctctctatttatacacacaaatacgccaataaaaaattagacttacctcctcagcctccccacccacgcgtctcaccggagctccgccgccgccgccgccgttttctcccgtcgtacgacgctgcgtgttcccgagtctcccttccgccgccgccctccggagccggcctgagtttggacgaggttgggagggaggtcgccttggacgaggagggggaggaggaggaggtggtggtggtggtggggcggcgccgtcgcggggggagatgggggccgcgcgtggcggggtgcggcgcgtccggcgggaggcgctcgtggcgtgcatgacgtgcccgctctgcaaggggctcctccgggaggccaccgccatcaccgagtgcctccacacctgtaagttctctctctctgtctcccatctatcccgtgtctctcccatggccgtctctccctgcgcccgcggttcgccgcgccgccgcgtttggggggcgcgcgctcctctcatggctttctctctcctggcgccgccttgcgtgggttctcgtggcgtggcgtgtcgactgcttgggtttcggtgtcggattcttcgtgtttgatcgaggctggtggtgccccgtgcgagtttctcgatcccgggagagcggcggcggggggagcgccgcctttcgcctggatttgctgcttccggttgttttgcctgcttcggtttcgcgtcgcgttccctccgtggtgttcagctcgacgccgcgttcgcgcacgagcgcgcgcgcgcgcttgctttccccgtggccttggctggccggcgttgtggttggagctcaccatgcttcgcgcgtgcgtgcgtcgtgttcagccagcgtcgtgtcgggcgatggctcgttccacgtcgccatgcctcctccgcctgtgtttcttgttcgagttctctcctcgaacgttctcgaacatcccatggcgtgcagtggtagctccaaacgagcaggtttgtaaccatggattcggtctgctttgtcgtcgtcggcagagtaacagttatgctctccggaggccgcggtcgccggagccactccggcaacgccactcgccgccgccgacgccaccctctgactatagttttctcctcatgctcttgctccatcgcgtgccagcgtttgcccctccggcgctgccatgaccgcgatcctgtcgactcgacaatgtagcaaagctgctgccttaagccaatccaggcagcctctcatcaccgcggccaaagccttcttcctttgagtagagttcatcggcggtggtcgctgttgtcatcctcgtgatatggcgttcgggtccaaattccctcaaagtctgaagtctgaagaaaactttcgatacatgttttctttcggagctttttggtgctgggaaaaagctgtaaagcgtcagcacttgctgcagaatgtatgggggttgtgcggtgttggcggggttccagtagcttccttactgttcgtgtttgctaacggtgggggagcttggaaatggtgggcatttttgcactgattgcgattaggaacacgttatcattttggttaaatgaccgacaccgatgatggattgatgggagttcagtggaaagcaattgtgccatggaatatggttttcccggtgttctggtcagtgtgaccaaatgagtttgcgttaggaaactagttcagatttatgctttcttgattggtccataatttgtatctgttagccacttagcctcttggaatttttcttgttcgttagtcgcataaacttgcacgctgtttaaaaatgcaacttttgtgtaactttactaaatgtttgctttggtctatgtttttggctggttcacctggatatgtttttttgtggtaagttagaaataaatgtaatgtaattatgtaaagtagcgagttgtcggatgttgatctagtggtagaaaaggtgattgatagataagaaaaaataattgcttgattagtgaatgctcacttgttggtatcattgttgcaattggaagtttgtgtcatttgtcatgctatgaaccagatgattgctaagtaggcctagtgcttctgctgcagtgtagatgttaattattgatgcatgaagccatgaatacgttgttaggaaccagagtagaggcagtgctatgctagagtttgcatgtttttaccaaatcactaaaatcaactacgtagtcttagttcattgttgccacttgctgctaaaggagttctcatgcttggtctgaaatatggtagttctgttttacctctgtttgaaactggcatgttctctttatagttactcgtctgaccatttcttaaacagtttgcaaggagtgcattatggagaaaatagatgacgaagaagtcgatcactgcccagtatgcaacattgatcttggctgtgatcctgaagagaaactcaggtgaagtcattgttaggtttcttctgtgaaacattgtctgctctttttacaatgcattctcgacttccatttcgtgtacaacccattaagaatcatcatcatttgaacctccagagaccagaggccatgctatctctaattgattgtgataacacagaacttatctgacaaacttgaccagagaggataaaatggtgatagaccattttacccattcttgagttctctagcaaacttggccagaaaaatatcatatttattgttagtttgttggtttgtcctcaaatacatccttgcttgtattgtaaagcaaaactgtcaagattattcatgtttaatgtgttgtattcatacctaactttggtttctctaacatgattgattgtttccttgtttgaaggcccgaccataatgttcaagatatcaggaataaggtttttccacttaaagtgaaaaaggttggtgctcctaaggctccaactgtgacattgccagtaaagagaaaacagaggtcactttcttccttggttgttgacactccgagggtggcagtacagactggtttgacaggacggagaaccaaaactgcgagaaggacagcagtctcccatgtaaactctcctggtaataatggaaccatcaagctagcaaataaatctgaaggtcgagatcataaaactcagaaaatctcagcagcacaatctgccaagatgacaaaaactggcaataaaaagaaggtaatatcaaagtgttaattacctggtttatgtgtagaatcagatggtttcatgcttaagtttgatctgaactgtcttgtatattggattaatctaactaaacattccactcccaaacagaataatactgatgtagatgtcacaatccagtcatcttctgaagataggaaggatgatcatacaattgacaaggaagatctcaagaagcctttaaatagcttggttgacactgcaaacaggacgaaattttttagatcaggtcctaaaggccaggctgccaaggaagacaaaataaaaaactcaattaagttactggcagaagatgacacagaagacaaactggtagttactggcagaaaggttatgccatgctcaaataagttaaaagttaaagaggaaaataatcgcagtccttcacaatctgcatcatcgaaagataaaaccacctcagactatgagctgaggaaaggacaacatgctgattcacagcagggacagattggttctacaagaactggtgctttgcatgatggaataactagaccagtatggtttttgcttgtcccttcacctgaccagtaagtttgcatcatatccaatatttgggttctcatgggcatttcttttctccccttaatttcatatcaaatgtaaactatttttcaggaaacaagatcccaggctgcctcagctaccaacatattacgtgagaattaagtgagttccccttggtcctgcagtttcttatgatttttaatatgctacaaagaagcctgttggatttaggatcctattattcctgtgtggaatgttaagctgcttgttttaggttgtccagtgtggaatgccaatagtgttatttccttgttctgttgtccactaattattgcaactgcgtcctactatttctttatataatttaacagtatatacttacaaaacaaatttgctcgagatgaagatgtttccttgaaaaatattacatacttttttatcactactaccaacgatctgagctatacaaacatgtgtccgatttccaagaacttctatttattttcttcaatttgtgttttgtccttgtttcagagatggaagtctgcagacttccttgatccagaggtacatcatgaataagcttgacctagcaagtgaagatgaggtaagctttcagatttctcttttcagttcaattgctataaagacatcagttatgcaacatcactcactagactggtatatacgcaaagtagacggttggcaaacaactctcaactatctttgctacagaggctgttgattttgtagatttggatggtgacatatgactggcctacaatctttagctatctctacccttcaaaagtgggctctgaatttgtcctctgtaaactagcctttcttttttttttttttgcgggatgtaaactagcctttctgttccatgtttcttgacaacaacagcaatgcacatgaacagctatgaatctgctcttttgcctgatccctctattctaatctctatccgcaaatgcaggtggagatcacatgccatggcgaggcaatctccccctcgaccacattgcaaggcctgctcgagctgtggctgaagagctcgccggtggagcaggtccaggcgtcgctgggcgctcaagccaaggagttcgtcatggagctcggctaccgccggccacagcggcctccttcctcttagctagctgcaacctctactcctccagtgccacaatccatctgctgcaaaatctgcaggcaattgcaggaggaaagaagactctgaaactaccgattcatcagctcatatcatgttcatccgtcagtcagactagggtaaaaaaaaaaagagaagaaaaaattacacctttctcatttcttagatcatgtaaagagggacaaaagattaaaaaaaaaggtagaacagtgcattaggctactaagataatctaaaagggtaccctaactatgtcttgtttaccatccgatgaagttttcaggtgaagtcccatctcctgtgttaacctgtgctgggcctgtgtgcgcgcgtgctgtgctacagtaaaatagtaattataattactgtagtaaattagtcagctgagtgagatggtctatgctggttttgtagagttgtagtaggagtagcaactgtccatcagcttgtctcgtagcggtctactggtttggctggtttgaccagtaacggtctctgtctggggctatatctgtgcattgtgctgtgctatactgctgtataagcgtacacggcagctgtgctgtgctatactgctgtatacgcgtacatggcagcgactggctaccggcacacagctcatgctcctcacgcactgaacaccagggttcgacttaccgttggttaccggccttactgcgggagtacgataatagaaaaaccacagtaacctctttaaattcaaataaatttaaaaaataatttgaatttttgataaattttacacggtttcgtactgttttttacggttaccgcctggtaaccatgcttaccgccaaggcacagtaaccccagccccgacagtttgggaaaccctgctgaacacgcagttcttttcagctaatttagtggattatcattgtcacaggatcttgaaatacattttcttttttaaaaaagctaatttgtattacttggttttaatccatttgttaagtttttccttacgatctttaatttattatccatacgatcaagtagataatctacaacaataatctgatgaataatttgtttcaaacggtcccccgtgttttacccttagactccctctagaacaaggaattccgtaaaatttaacaggtattgaactaattcatataaaattttcacgttgcaaaagatcccttaatttgttatataacgtatctattgttttacttaacataatagaatccttggagtcaaactttgtaaagtttggtctctgctatatttgaagccatctattttttgttgtatttttaattgaataactagaattctggttagagatgttttcacaatattatattttatcattatatcatacggtttatgcatgctacgaacaaatggctcgtattctggaatataggctgtccatctgaaagaaattggcgaccagctttctggtgcttgtgcttgtagtaggacctgttctgatctgagcagctcggctggtccagccgtccaggaaacaaaaggccaacatcattcattctcgcccaagaaaagagaggctttgttctgagcgaagcaaacatatgctaaggactaaggaataaggattcatttagaaaaacaaaacgaaacaaatgctaagcaacgtgcatacaacactgccacggagtggttttgacatgatcatttttggttacttagatcatacaatgtgatggcatttagaccaaagcagtagaacagcacagaagaagtttcttttcgctgagaataataaacaccaactagctggaagattcttcaatgatacacccttgtgatccagccaaaacttaaacttttttcttttcttccctgcagcaattcaattacgctttctatattggtacagaaaattgcaactacagaaaatttgagaaaaatgaccaaaagaaagtttctttcttccttttccttggttcagaaattcagccgttctcaagatacaggtgataaaccagaccaccattcaggtgaactagcaaaagtgtgaacagtggcatatgaggcaccatcaaacattcaagctgcaacaaagtttgcacagtgaaaagccaacggagcaaatggggcataggcactaatctgccttcaatcttctcctgtccaccagatcgaatctttagtgattcagaccaagaacagtaacaagtagaaatggatggattttggcatttcccccttgtatccaaagccataacattggaaaagaagtcacatcagaacaacacaatctccactgatgcttccccaaagcagacaacgagagaacacaaacataactgagatatttgcattgccatgagtccatgacagttaccacacaaacatagatggatcgatggacatgcaccaaacattacaatttacaaaagattatgatgcatcctatcaagcagatttcactttctatgtttcaacaagaggcacaagcacatcatacatgtgcagaaaaaaaaaagagaagcataattcacaaagcgaaccacgccataagcatgagcattagcatttgcaagataaagaatcagattcaatggccactgcccaacatgtatagcatatttgcaaattaacaccaccaccatactaatttactcaattcagttgcgactcaatatgttcatagtatgatcacacgcaaagctagtatttgtacacgctaacaaaagaatcaacaaacaccgtaccatatatatcatcaaagatcaaatcaactgctaggtttgataattacacagtataaattccagccaggagacacacacaatcattcatagctaatttgcaaggcaagaacatcaattagctacgagtgttggataaagagattgatgcatcttggggggatatcatcataccaagccgagtagatcaagcgatgcgaacgtaggtgggcaagattggtccggcggcgctcatgccggcggccaccaggccgtcgccggcggcctcctgctcggtcaagaagaggtcgtcggtggagcggagcgtggcgtgcgcggcgacgagggcggcgccgatcatgaccgagccgatgacgttccagccgacgttggtgaagagcagcgcgatgacggtgaccccggtgagcgcggcgaggacggtgccgtcctcgaactccatcccgaggaggcggagcggctgccccgccgacgacgcggggcgcgcgaagtagaggaagaaccaggcggcgcagagggcgaggagcgcgaagagcgtcccggggtgccagagcagcgaggccgcgacgacggcgagcacggcgagcgcgtagttggcccggaagtaggccgcgttccgccgcgccctggccaccgcctccccgacgctgggcggcctggagaaggccggcgcccggaacacctccccccacggccgcctcgccgcgatgagcgcctgcccctgctcccggaacctcgtcaccagctccgccgccttggcgatcggggacggcggcgccgtcgggtcatgcagctgcgcgggcggcggcggcacgggctggcccatcaccggaggaggcggggcggcggggtaggcggagggagggggcgggtaggtggggatcttggcgtaccctcctgctcccgaggagggtgaggcgtaggagccgtacatggcggcggaggccggcgcgggctgggcggcggcggaggaggtggagttgcgcatggtggcggcggcgagatcggcgagcggagacagggagaggggatcggattgaggaaagttgtggtggatttcgctggattcgcgttgggctttcgctttgagtttgcgtttgcttcgctgggattgtggggggaacggacggcgtggagttgtggagtcgcgcgtttttaacgacggggtttgcttatcggcaaagcaccttctgtctggctcgtctttggtcatcgcatcgtatcgtgttgacgttaactagagtttttttttgttttccctcttcgacttgaatttcccatgaagttactaattttccatggaaaatgtcccttttatgtccctcaactttgggttgaattttgttcgcattcctcaaccgtaaaaccggatataaagcaccccttaaccattaaaaccagtataaatcgagtccctagatggtattatcatctatcagtacagagaaaaagtagatgttatggaagaaaaataaaaaatagtggaccttcgcgtcagccctaatttcttccctcccatctctcctgctccatcttttctaaccagtcattgccaatgccacctgacggccgacaaggatggcttcaaagagttgaggtgccgaagcagtgcgagctcacagaacgtgatcaccacggctgcacggttgtcttcctcattgagctcaacaatcatgtcgcccacgatatggacaaacaatgtgcaaattgcaagggagcacgacgcagcacgcagtgtcgctgggtcgaagagaaagtagagtcaccggagtcgatgtggaatctcgctggcggcgctcctcccttcgaatctcaccgtcttcccagaacttcatcgcctcgcccgccgccccctagcttcaccaccaagacgcctcggtcaacaccaacgatgacggtgtcatgctggtgttgctcccgatgtagtggggcaggcggatgtttagagttgagcccgtccccattgtaggctcgcatttgtcatcaagggccgcttgcacaacgacgtgggacagatacagggccgtctta

SEQ ID NO: 5923 - DNA, 16805 bp, Oryza sativa
atttttcaatggtacatgatttataaaagtgtatatatatatatatatatatatatatatatatatatatatatatatatatatatatatatatatatatatatatatagtaaatttgtttggtgctccatggtgcccgggcaccattgttgaaattgagtatatacctaattcaaatgagttgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgataccatggtgcccccatatgagtgtcctatatatatatatatatatataagtaaaagtatatttagtcttgaggaagtttgtgccctctagaactggccctggacagatggacggcagtgatatggcgtggtgtgtggcgagggcttacagcgctgctgaggagaggatgagatcctatgttctatcgtctcttctggtgaggcttcgacgaggacctggccttcctgttgcaccccagcggcaccacggcttcccaaggtgaggcccgctgctgcgctactgagtcagctggtgcttgattattctagtattgctgctaatgacgatggtggactggtggtattcacgtagaattgattctcgtccaaggagggggcttcgtcggggaggagagagaggcagagaggaagaaggtaggggaggattatatatttttcttgtgactgacatatgggtctcaatatttctttttttaaattttttttccttgataataatgccacgcaagcgccgtataggattgaagaccaaatcaaattgccacataggaaaaaatcattattcaaaccgccgagagactcaactttcactggttttgattggtgagggatgcctatacccggtttcatggttgagggaataaagcttcgcctatagttcagggattaaaaatgaaccttttccattttcctttaaaaagatggaggtggatcggtgatttagcccaaattctcggcccatttataaggacgggacgaaattagggcccattatattcaagtctttgcgcacttatcccgaacacagaaaacgctcctgtctggtattgttcagaagtccaccgagaaaacgctttgttcgggaacacaaacgaaacttcacgctatgtctccaacctgctttgtttttggactgggcttctagcctcctactacgctgcttggtttgattcttgtagtggagtagtacttttttttttttgaccgtgatgattcttggagtagttattattaattactagctccctcggatgaagctactgaccagatctgatgtgcctgtttgacattgtttgattgcatggttatttgttagctacaccgaccgaccagagcaagtcctcttacctcgatgtcaaatgaaaattttatgagtcacgaccgaaccaaatagtcattgttttgtttgtaattcgcgtcaactctggtaacttggcatttaattagaacctatgaaatataccaagagtacttgctctggagggggttctaatctctcgaaaagggatgtcctatcattatttgtatgtcactccaatacttacgaaaatttttaaaaagatgtattaatacgtgatatatcactccacaaacatgcaacttaaaattcaacttctacatgtctcaaattgttttttttatcgttgtgataaaagttgacttttaagttgtatgtttgtaaagtgatatatcacatgttaatgcatattcttagttttttttcataaatatttgaatgacatgcaaacaactactccctccatcccatacaataaggattttgagttttttttcttctactgtttgaccactcatcttattcaaaaaatttgtgcaaatataaaaaacgaaaagttgtgattaaagtactttggataataaagtaaataaaagaataaataataattttaaatttttttaaataagacaagtggttaaacagtgcaagaaaaagtcaaaatcccttatattatgggacggagggagtagtaggagacatctcctcgagagtttaaaatccactctcttaataaggggcacactaatcatttctcctactactaatttatccgataattgctaaaattaaattctttataagatggagttagcaaaattaacatatactgcatttaacacagcccagaaaaccaaataccggtcttaattttggtacctccgtctcaaatagaaaaaaaaacatgaatatcagggaacgatctaatattaaataattaaaaggggtaaggctcgaattcagattgctagcccaccactttgtgaagctagccagaagatccctaaatgtttatccctccgtctgacatcgtcgttattttgttggagtacgtcttgtagatactggtcacagtttatcgtgtttaattcattaccaccgcatatgtagcatacacatatcgtagtaactattacaattaacaatcttgattattaaacttacagtacacactgtagtacgtatacactacagtacacatgtaaatcgacactgtatagtacgcaggtactgctgatcaatttacagagcgcgagatttatttagagatcatactaggcaaatcgtatgagttgagagacgtgatgagcgccattgcaaggtagcgacaagctacgtactaactaataatcggcggagacggcggccggaacaaacggggtggcgcagagcagcagcggcgagcggcggcgcacgccgaggcccggcgcctcctccatgtcaacctccttgacacccaccaggagcgaccaatcgaagtggtagagcatggcaacgagcacgagctccatactggcgaggccatagttgaagccagggcacatcctcctaccagaaccaaatgggatgaactcgtagctgccacccataaaatcgatagcatcgtcgtcgaactgctctggcttaaactcctcagcatcctcctagtactagtacttagggtctcgaccgatagcccacacgttaacgatgacacgtgatttggctgggatcgtgtacccatctagctcacacgtgtcgatgctctcccgcggcaccagcaacggtgccggtgggtgcagcctgagcgcctccttgatcactagcttcaggtacctcaggttgcttgcctgcaggtcggcctccgtcaccaccgccttcctgtggaacgcctctcggatctgcccctgcaacttcttcatcaccgccgggttccgcatcagctctgacatcgcccactccaacgccgacgccgacgtccccgtcccgccggcgaacatgtcctgcacgtcaagtgtacatatcatatgtgttacaatgacccatggagtagtaacacttttgccttcatgcacatgcaatcaatgtatagggttaccaaaatgatggccttgattttgttgtcgtcgaggtggaagccgaagccgcctttccaccgaagccgcccttctcctgcaaggcgatgagcacgtcgacgaggttctcgtcggcgttctgatcatcggcggcaccgccgttgttgatcttgtcgccgcggacgcaccgcctctcgtcgatgatctcctgcaggatggcgtcgaccgtcttgtggatgccgcggaggctgcgcttcatgccggtgaccgcggcgagcgcggtggtccacgtcgggaagaggtcggggattttgaagccgctcgacagcccgacgccggccttgatggcggccatgaactccggcgcgctcttccgcttcctcccgaacgccgcgcgcgccacgatgtcgttggtcgtgctgtggaacagcacgctcaggttcaccggcgtcgacggcgccgccgcggcgcggatctcctccacccgcgccgtcacctcgtcctccctgatgtggcggaaggagaggacgcgcttggggctgaggatctcggcggcgcagagctggcggagcttgcgccagtagtcgccggagggggagaagaggatgtcggcccagccgtagccgacgatctcgccggcgaggagcctgggcctggtggcgaagttggcgtcgtgggtcttgagcaccgcgcgcgccgcccccctcgacgacgccaccaccaccggcgtctcgccgagccgcagcatcatcagcgggccgtgcacgccggccaggtcacgcatcgcgcggtgcggcagcgcgttcacgaggtggtgcatgctgccgatcaccggcagcctccatggccccggcggcgtcctcggccgccgcctcatggtggcggccaccttcgccagctgcagcagcgccacggcggcgacgcagagcagcagcgactggaggaagaagtagtcgtccatggctagctaaagctaactaattaagctaattaattaactagctagttatagctgctaattaagctgattaatcttacagcagctagggctagctagcttttacactgcttttagtgcagtgctgatgagtgataagttaattgcagcatggcttggacagaataagggtttatataggcaaacaagctaattaaggagaggattgggccatgtaatcgcggatgctgagatataattttatgtattgtgggaactagcttcttggtttgtgaaaaacgtgtggccggttggctaagctaatcaagtatcgtttctccctctgtcaagatgggataaaatggctaattaattaattcccaccacaataatggtttaaatcctaattaaggacaagcttaacactttgagcatgcatggttcaaactcatactcagatagatatagtccatgttttcatttgatgacagctccacaaacatgtcatacaatggttgctgactctaatcaactctcatttttttcacccttctcttctcccgtgttagtttttttttctagcctatatctatctcacgacgcccgggggggggggggcgctccgcctataggcattcctcccacttctgcccttcctcctcccgttcttctcttcctattacagtacaccacaaaaaaaatttaaaaaaaacaaaaagttagaaaaatttatgtataaaaaatttgaattcaaattcaaatttgaatcgggtatgtaaacttttgacttataaactttggatctataaactttaggtgtataaactttagatgtatagaaatactatattaaaaaatatttgaattcaaattcaaatttgaatcggatatataaacttttggtctctaaactttagatgtgtaaacttgaggtgtataaactttaggtgcataaatttattaaaataggaaagtaatacggtgccaaaaaaggaaaccaggtggagggagggagggggagggggggaatcgatcgccctgagcgggcgagcgcgctcacccagtagcatttccgagttgactctcctctctcatccatatcaacactcacctatatttgacagggtcatgtgtagattcatttattgctaatgtaaatgtcttaagtgatgttcagtaccgctcatctgtctgtgctaatatacgggttttgtgttgtcggcaaatatatattgttttattttgttaaaccattactctatacacgtttatatattttgtaccattgctccctttaaacaattaaagtaaaataactttcagttctctagagggtgtgatatagataaaaagtatttccttcgttacataaaaaaccaacatagtataggatacgacacattctagttatatgtccagattcatagtattagaatatatcacacctggcctggtcttagatttgttttttacggggcggatggaatagatctaatacattcacatgtaaagaaatggatcggaacaaaggaaggcgtcacgaagaccttaattttctattgtccaatagctcaatttgtctatgtaatgaaattagcaagttggtgctctcttgagtttgtgcagctagatttggtttgtatattttaacatttttttagccattcgtgtgcttgtggagagcctctgtgatgtattagggaaaacaaatttaatttgcatatgcatgcgtttattaccatccctttcttatatatatatatatatatatatatatatatatatatatatatatatatatatatatatatatatatatatatatatgcgtgtggtgtgtagtgtgtatttcacataacagccatgacatatataccttgtatgtctgacccaaacttgtagtaaaatgaattccagtagcccagtaatttcagctttaatttaccatcacaacttctctagtttggttgtgatttcaatttgctacgtttaggagcatttattttcttttcaaattgttgcacacaagtacttaatacattttttaagttagaataagttacttttaaaaaactaaacatgtaagttgttgtattatatacgtggttgtcaatctagtggccaaaaagaaaaaaaaagaaagacttaatagacagggcaaaccaatcgatgccactatgaataataggcataaaaaggaaaacgaatccaagggatatatcttaggttagaaccctttgatgcccaaattatggggttcactagccttgtactattagtttggaaaataaagttgttgagtattgttcaagttgtcgaaaacaatggcctatatacgtgtatgtaggagtataaaatataagacaattggtcagctatgaatctgtaggacgtcctgacaaagaaaggaaatctaattggccactacattgtcaaccataatacatcacacatgcatgcaacagttcatatttttagctaattaacttgactttctctaaaatagtagtagtaagttagtaactagctagatactctgttcgatagtgctaaaaaaaattgtcgccacaattttcgatcgatttcaatcggatcatcgaatcatttttgcccaaggaatttaacttatgtacatgcggggcagatctagttccttttgctgtattatcctactgaattcagtgaaattctattaaaaagttgctagttgctacaaatttataaagatgaacctataattcagtacagatgatttgaactttcgaagatatatttttatttattccttgagacatcgtcttgtcgtttctacatcactagaaatcatagaaaaagaaagagttgtccctcttcggacgattttgtagccttttgatacctgtcacaggcgaagtctagcttgttctttcactgttcaaaatagtgatatcctatccgtacacgtggcatatgttcgatggggtcccatataatttttttctcgattttctcgtgaaactaatggtgccggatcgccgtgcttgacaggatagttagccctatggctaattagggtcaccaaaatgattatcaggtgatcaattaggcaattagcgtgtcttaagcaggcatgttggacacgaagtgtgtgtacgtgtactactgtgctttgatatgaaaagattgaatctttttgggttggggtcagtgtttaatcaccaaccggtggttagatgggagctggctaataccattagtgtacctgcacttgtaggccagcttgagattgcagtaaacgaaactcaaggcaagcttgatgttttggaacttcagtgcatgaatgagttcatcttaactaaacgtggagcacatgttactacgtattcagacatgaacaattatcttctctaggaaaaggctactccctcatcccaaaataaattaacctaggccttgtttagatcccttgacaaaatttttcaccatgtcacatcgaatgtttggacacatgcatggagtattaaatataaacaaaaaaataattaattacacatattgcgtgtaaattgcgagacaaatcttttaagcctagctaattgctccatgatctgacaatgtggtgctacagtaaacatttgctaatgacagattaattaggcttaataaattcgtctcgcagtttacagccggattctgtaatttgtttttgttattagtctacgtttaatacttcaaatgtgtgtccgtatattcgatgtgacacgccaaaactttacaccgctggatctaaacacagccctactgccctagtatatgatgtgatattttctactaagtactgtgatctgtacagtgcatgattcgtagttttaaaaaagtcatatttcatactagctaggttaattatatttattttgggatggagggagtattaaagtgtaaaaaacaacatgaatttgcaataattctacagacgtacataactgagacatgtcaaattaagttcaagtggggggtcactattcctaagacgatgaacttcgaatgacttttaagaccatatgaaaaaaaagataggggggaaaggataaacacatgaaaaacaggtaactagaaaacatgaaaacacaaaaacaaatacgtactattcctagaaaaagcttgattctagtataaaatgatcagtatgaagaatttgaataagtaattacgaatattcatgccagaacatccattttctcatttaaaacaaaaggtagaaaaacacgtttattctgaataggatgataaatacgctgaaaaaccattgtttatcatgcccccgaatattaatgtggtaatcttcgttgattaaaaaacaattatttatggatattgtcagtaaaaagtttctccgtgtcctgcgaatcgacgagttgacacatgaaaaacagtaaattatttcactaataatcaaataatcaaaactacacaaagtgaaatcttctatttatggagtacttggggcagttgggccttgagtatctggcattagttcaagcttgcctagtgggctagtggctacaaggaaacaggcctttatcacagcccaacaagagaaatgcttagtgctggacatggtgcagttgcactgtaccatttcagacttgcacggtttggactttggacagagtagaacggatacgaatggttgcctgtcactgcgcttgtcagtctgattacagatttcagaagaatgggaatggagatattctctgtaatcgaatttcacattaataagagcacaaaaacagaacattttctaatgacctttttgttttctttgtgaccataatacagcacacattccgttgtcttttctgttataccagccaactgcacaacagtctacagcttggaggcaagcaaccaaacatttgcttcaaaaactgaaatctatcaaaccccattattgcttacagccttgccacattcaccctggaggccacttctacaaatgtgtcatataggcttaagccacatgtgtaaaaaaaacttatttttcttttagaatgtaggtgtttaagtggtattttcaatttttctactccttttttattagccccttatattttctattttaaccctcatatttttccaattaagaagccacaactggtctttttaaaaaaggaatttttaaccctacatggcaagagttcggagtccaaaaggaatttttttttaaaaaaaatcaccaaatcttggcatagaccgaagaaatcccgtgaacaccatgatctcagcaagacctccaaacagagagatcaactggccttctgaatcgctacatggacatgtcaaagaatcaagggacaagagaggcactaggtacaatggctgcatgcgttttcagatcgcccagaaactggcctctgaaatctgaatttcgcaggacaaaacacggtcagaattttaaagcctgacgatcccgtcgcaggatcacacttgtgctagcaaacacatcacaaacaacccgatgcttcccatcacaacaaagattgtactaccattccagactgaagatgagggtacattttgttcctaggtgttgccacttttacaggcactgtcctctccaatcctctaaacagtaaatcaccttcaccaccaccacacccccagacatataactgcagcagctgaatgtcacactgcaacacaagatagtttctaggaccaacatgaagagggcaaaataaaaaggagagaaaaggctacaaaattacgagtctccgatgagaaaatactccatctatgcggtaaattcctttcgccatggattcttctgcaagagctgtctctaccacccaacagttaggaacagagcagtatgtacaaactaggctcctcttgttctttttttttttactttttaatctcttgtctagaaagggatgctatcgaagtgatccggcgactgaaagcctgaaatgtcgatcaggctggctgggcagctaggacccggttgtgattgtgatcaccttcataggtaacaatcaacatcgaggggtcgtcgacgcacctctcaacatgcttcctggctgggcatcctcttacactgctacacttatagtaacccctgaaaaacgatgagcatacgtgaatattcttcagcaatctcttcgacaaaaagaatgagtaatttgtatagggaaaggctgttagctgtaatctttcttggattgcaacaggcatgttaccaaaattagagcttggcattcttgtaactacatgtgtgactgaaggtatcaccaaccacatgagttgcttaaaaccaaaactataactttctcgagatcccaatctccctttgctataaccagcctctaaacagatgtggaaagaaatctagcttgaaacttacagcacatagtatcatgagctacaatcatttattgctgtccaaattagaaaacctttctggtgaataattaatggcatatcatgcattctatgagatgtgcatatacttaaatctgctaagaacagagaagataaaaatttcatgaacagaaataatagctcaatgtaaccaggcaggaccgtttcctaacatactagtactgattactgaataatagtgacaagtcagcaaagcacaagtgtagatatcatgtgcagtatgaactagcaatggcacccaattgtaccagaaaaaacacctggcaacataatgactaaatgactacatgagattgagcatttagctatacctaggatgtggggatccttttattggcttctgtccatacttcctccatgagaactcatcagctggaatgtcagcaaccttattactgattgcagggactttgatagacctccttatcctcagcttcctgcaattacatacaaaagtgacttaagaaaaaacataaggtcaagatactcatatcaatttatcacaaaaagaaaaaaaaatccaaccttttcttcgcacagtgacatcggctcccagttgtgcatcgtccactaccatcctccctaccagtgcacctcctcctctgcatgaggcctaactctggagtgcttgacgtctgtgacccactaactagctggaatggacgactggagcggctaccgtccaaactcgcaatgctcccctccatactcagagacgacaagaatgaacgggaggatgatgccgtgcaattagaactgtcaaacttgagattaacacccttaccaccaccattgctaccaccctgttcaccaaggccactcctctttatcatctcactctgcatcttcatctgctgcatgagctgaaacctctggtagctctgatgctgctggatgaaatgaagatgcgccgaaggcaatgccgggtgaggcgttccagctgggggcgcaacagacaccggctggatgagctggagcggtggcccccgtgatggcccatccgaatcaaccgcagggttatctagaagcaaccttttggggaattgggcagggatcctaacaggatcctttgaagaagagccctccatctgatggtacctcggaaacagctggaggctagtgatcggactcgagttaggtgtcttggctgccatcgccacagccagtgcagggctctccaaaaagaggttgctatcaaagataggcaagggcttcttgatctttctaacccgggcatggccctggaggccattgccattgttcagcctggatgccacggagcagaactttgcaacagcctctcccgtagccgccgcgagatccttgttagggacaagctggctatgggggctggagaggagggtgagcaccctgtgacagctctgcactgcctccctgtttgcttcctccatcccctccatgaatcactcccctcccaccctacctgcacaaacaaatcaatcacctcttgactctgatcatacacacaaatctatcaagctcaccaccaaatgctctaacctagaaattcttgagccccaatatgcaactctaacacagggatcacatcacatcatgagcattttccatatataaataggaaacaagcaacacatgggtagatttgctgatagccctaatcattccattaccatatatatattaaaaaaaacagccacctcactggatgatttcaagaaacagcaccacctgggcgatgcagggggggagattctcacaatcatgcggcgcacacgggtgccatttccgacgagctgagctaaaattgggcacgcgggcacgcaacatggcattcccggtggcctaatcaatactaccaaaattaggcaacctgacacaatccaagaaccacctgagcctacaagaacagaaaaaaaaaaagggaaaaaaatcaccacaccccaccactccactccacaaccatggccatcacccctgcagctgctcccccctaaaaccaatccccaaaaaccaacagaaatttactcccccataaaccccaaacagctgcctctgctactactcgatccacggaaacaagaaacgcatacgcatgcatgatcctaccagcaaagggcaagaacagcagagtaaaaacctcacctcgctggagccagggctgagacctccaccggtggagacgacgacgacgaggaggagagggagtggctgcccctctctctctctctctctctctctccctcggctggtacaagcagggaagcgcagcagcagtagaagtagagtccagtactagtccaagcaagccactgagtgaacgaagaagaaaataaataaatgaataaataaacaaattggtggggaagagggtggggccagggcagtgctctcgcttttttgccccttcttttctttaattttcttttctccctttgtgctctctggtattcctcctcgggcggattaaaataataataaaataaaaaataaataccgcgggcggggccaccgaagtgggccccaggatgatctgcgccgtccatcgcgcccgtctccgtcctgcgccttggactttttccttgtccccgatttttttttcttgagtttttatattttttattttattttattttcctctggggtgtgggggtgtggtgggcccgggggctacgggctgccgtttcgtcaaaggtgtgagctgtgtcaggcgccacagtggtgggcgcgggccccacgcattctctgtttttcttttcttttcttttcttttttccttttttttcttctctccttgctgggctcctgctcctctcgtcgtgtgcgcgcgtttccaatgctgtggaggctgcgcgcgagtgtcaaaccaggggtgacgtacagcagcgacgattttttttccgatgctgctgtgatgggaggaaggaaatgaaccctcaagtctgaagtcaccttgttttgttcgtttgtcatttatagcataaatctttgctcggttatgatggtatctcttaagtcacagtgtttcgttcgtatgtagagtcctatttatagcatacatatttgcttagatatgatgatatcttttaagctatagtgttatgtttgtatgtaggcttcatttatagcataaatctttgctcagttatgatgatatctttttaagtcacaatgttttattcatatatatatagctcatctatggcataaatatttgctcagttatgaaatgatatctttcaagtcacattattttcttcgtatctatagctctgaaatcactttgttttgttcgtttatcatttatggcataaatctttgctcagttatggtgatatatttaatcatttatagcataaatctttgctcaattatggtgatatattcaagtcacagtgtttgattcatatatgcagctcatttaggccattctcaacccaatgactaggatggtgtccatagcattaaataagctgtcacctagaatgaaaaatgatgtggcaagtgaataaatgataaaagagtcttgcatgagacatgatttctacacaacatccaagacattatgtgaggtaagtagcatttaatttaagtatggaatagtggtgtttgcattgggagagtagtgtctaatactagtttcttaatgatgtggagtttatggaaactatgtctagtgtcttgggttgggaatggccttatagcatacatatttactcaattatgagatgatatatttcaagtcacactgttttgttcgtatctagagctaatttatatcataaatatttgctcagttatagtgatatatttaagtcacgatgttttctttgtatctatggttcatttatagcataaatttttgctcacgtatggtgatatatttaagtcataatgtttttttaagtatctatggctcatttaaagcataactttttgctcatttatggtgatatatttttattggtttttctacctagcgtattgcttatattgcttgagcagttttgtgccatattcatttatggcacacctgattacctgaaggatgtaaaacaggtttctcattaatgagatgatttttctagtcactaataaaggatctaaggagtgcacaaatgatttctcaataatagcatatacttgtatttagatttatcattcatacaatgtgtcatatttatgtatagtattcttatagcataaatttccattcgtagcacaatccaaacattttaattattgtactttaagaacggggtttttatccgtaacacagtttcatttttagcacacgtgaaagggttttacatatatagtcatttataatatctgaaagagtttgatgttgattagtcatctataaaatagtttcatgtcacatactcatatactggaaattagttatattatctaaaacatactcgtagtcatttacagcacacatctagatattacgagatatatctttgagattgttcattgttttttctcacgagaaccggcctccttaagtacatcgtcttagatagcagaagtaagtcatttcatgacatattcgcaggtgcaaaacatatttatcatagcaatattgtttctctagatcgatcacatgtggtaacttctttttggaacatcctatatatatgtcgtgcaaacatgttttttcactgatacaataatttcatatctaatcatttacaccacattcaaaacgtacaagtagacatcaagcaaacaatcaatcgaatgaacaaagccttgatgagactttaggatttgtgggtcatcctatatatatagtagatataattaatggagcagtaactattatttcttctcgtttttcttttgcattagtgaggcttgaatgaaatatatatccttacatggtcatcatatgccctttgcatttttcaacaggatttaccactctagcaaacatgtaattcttgttcgtatagtaggaacacatccttagagttgatgatctagatgatggacatacatgtcttactcttacatgatcgagctagttacttttgaaccatatcacatactagtgcgcagtacatcagaacaaagaaacttaaaataatatagaaaaaattggaaccgaatttgctggtgtttggaggaatacatcttttccttaagaaaaaagtatgttagtataaaataaagatgcatcattagaatgacctaatagaatctaatatcattgcaacatatacattgttagaaaaatcaaactttgccggactcaaaaaacaactttctcgtttttttaccatgtttctcgaactgctaaataatacatttggtgcaaatacttttatatataaaagttttttaaaaaaactatataaatctatttttcaaatttataataattaatacttaatcagtaattagctaaaaatggcgtacccgttttccgtaccactgactctaaaatagaactcctcacaaagccagcaatgttcctcacatcttccaactgcaagtctgcagcacacatgggccgcacgcggaggccgccgcacccgatccgggccttcctcccctgaagccgttggagcccagcgaaccaccccgcgacacgtcgcggcaacgaggagttcgagatcgagtctccccggtgcgggccgggcccacgcccgcttggtgggccccacctctcgttagccgaagcgaggcgcacgcgcgcgcactacgcagacccgaccgcgaccggcaccaccaggtcggtctcggcggcgagggcgggcgactcggccgccgggtctcgcgcgcggcgcgagcgagccatgacgcgaacacgtacggggttttgtggtgcgcgagtgccgcgtcgtcgcccactcgatcgatc

SEQ ID NO: 5924 - DNA, 9064 bp, Oryza sativa
taattttacgaatccgaatagatgtcctctcatactagctagttttgtttatttgagacaaagaaagtacaattttatcaaagcattctttctaacatataaagtctttttaggatggagaaaacaaatcattatacaatgagaatctgagatatagggtgctaaaacatataaggtccaaacaaagcaaagtaccacaggcctacaatcatactccggctaaaacagctatggatcagtcggcagctaggctctcgatcgttttgggcggccgtacgcgcgcacgtgtggacgtcgttatctttgggagaagaaatgcatggctagtaatgatggcgatgattcaattccagcacctctaattatggtctctacactgtttctagttaggatggtcatgaatgggcaatcatcatgttcctctcaacaccggaggatgcatgatggtgatcacatacttgtcctcatgatctgatatggtgcgatatatatggagtatccactgaatctaaacaagactgactaattgcaagcatgacagacgccagctgcttagtctaagctaaccaagagtgttccaaattaatcatgggttttcattcggaacttgacataaaactaaacccaaaactcatagtttgaactcaaaccgactgaaattcaaatttaatcttataaagtttgaaatcatagtcttttattcattacccccccccccaagttaggaaaaacatcattaggaaacggtggtaggatgacataggagcacgtgagtttcctagtttaaaattcgtgacaatcttaagtaaccagttcagttaacgtaacaattatagagaattaatcctatggcccaagtcaggccaaagagaaagaaaacaaagactgatactctctccgggttgataatacttgtcgttttagacaagggcacggtcttaaaaaaacaactttgtctattattttctatcataatatgtaaaaaaaatattaacaaatatatgatcttattaattttaagactaatctatacatatggtcaccatatttaaaagacaaatattttaaaaatgattcataatcaaagattctaaaatttgacctcacccttattcaaaacgacaagtattatcagcccggagggagtagctaattaacggtgggcaagtatttccattggaaataaagggttcaataactgatgtacagccccagtatttaaggttaatttatatttatacggagtcaattcaacgccgattttttctcttcaaaaaaaagaaaaaaaaaagaaaaacagcggagtgctaattaaagcaccctatcagtcaatgctgccaaaaaaaaaatccagtgctactatttaatttgctcatgcatactgttttccgttgctaccatggatccatacacatgaccatgcctatacggcatgcactacagcctctacaccaatcatacattcttcagcactagatagttctacgcaatacatactacctctcgttgtaatctctcatcgttgtgaataaatgaattagcaatggcacataataacagtacacatgtaattaattggagcaactttcggctgatcgatctgcggcaaagcacagtacatgcgtgtatactgtagagcgacgggtcaggtgaacaagggtgtgtttagttcacgctaaaattaaaattttggtcgaaattgaaacgatgtgacagaaaagttagaagtttgtgtgtagaaaagttttaatgtgatagaagagttagaagttttttttttaaaaaaagttagaaactaaaccaagcccaagtcgaacaattggtcggggtaataccaatactcctacgtgcaagctagctagcttgtcatttcactcatcgacgcaagcgtgttttttttttctgctggatggccaggtgtttttttttcctcggcttggctcgagatcgatcggtccgtgacgaacgacgtacgtactatacgccggcaaaacggtcgttgctgcggtggaagctttgacccgtcgcgatcgatggaggcggcagctagcgggtgtgtgtccaacagtgcacggcttggacctgcgcgcgtgtggcgcggcgggttgaaaggacatgcatgcggtgcctgcccgggcgagatcggttgatgaggatgcgcccatgcagatgtgcagaggctgagagggcagattcgattggcattggcttgcccatgcatccatgtatgcatgcgcgcgcatgcagatttgatttggggtggaggggttggccgttgtgttgagctgctattgtgtactgtttgtttcgaggtcagatttattatattgtttgttttcgcggaaatcatcgttgggaggtcaatcttcacttcttcagccctgtttagttggcgagcgaaaatatctgaagtgtcatatcggatataccgtcacccattcaaagtattaaacgtagagtaataacaaaataaattacagattccgcctgaaaactgcgagatgaatttattaagcataattaatatgtcattagcaaatgtttactgtagcacccattgtcaaatcatgacgtaattaggcttaaaagattcgtctcgcaatatacacgtaatccgtgtaattagtttttctgtctatatttaatactttatgcatatgtctaaacatttaatgtgacagcgtgaaaagttcttgtttgtgaactaaacaggcctcgtctcaaagaccataatccgtacttaccttgctcaccacgatctagattaacatctattaagatccatgatagtaccttatgtgagactgtatcctattttatactatccatattttaatgtatgacaccgttggctttttgtccaacgtttgaccattcgtcttatttaaaaaatgtatgtcattatcatttattttattgtgacttgattcatcatcaaatgttatttaagcatgacataaatatttttatatttacacaaaaattttgaataaaatgaatggtcaaatattgataaaaagtcagcagcgttatacattaaaatatggagggagtactgcttagtactctccatcatttcgtctactagcactagaaaaggtcaattaacggagttactatttttaaaatttataacaattaacacttaattaataatgtgttaatgattttgtcacgttttacgtgcggctgttgagaatgcaaccatagtaccgaccgtacttccataaacgtaacctcggattctttctttcttttttttttctttttggcaacgttatgagctttccagatttaccgatccctacacagatagtgccattttttttcacactgcctactgggcagctagcaagctacccagctatagccagccagccagcgaagacagcagaacacagcagaagtgtgatccaagcaatttcgcaacatccatatgcatccacccatcgatctcgatcacggcatcacgcgcaccgccgttatttttctcaccacactaagtattcgtaccagtctaccacccgacattcaaccactatgcccgtccatttccagtacctatttctattttccaccacgcgcgcgaaaagcgggcaacgcttgacacagtacgtgcatagctagtgctgctttacctgaaaatttactgcttctttccagcaccaactcgctatcactgcattaccaccaccaccccaccacggcacacaagctcttgccattttcttgttagatcattgaacgatattattgaaatatttgttccatattttaaaaaaaatatattatcaaaaaatgagtatttgttagagtcgactgtaattattaagtttatttattaaaataccataacctgctcaataatactcacttcatttcatgttataagtcattttgattttttaagttaagtttcttaagagtttataactaagcttatagagaaacataacaatatttatagcaccaattagtttcaatgcatctaacattgaatatatgttgatagatttttgttttatgttgaaattattattatagttttctatgaaacttagttaaatctaaagaaaactgaattaaaacaaattaaaacgacttgttacgtgaatcagaggtagtataaaacaactagtcctgtcagcgtcattttggctctacaccccatgagtggttttcttgaccagtactttttactttacctctggttgaaacgttcctaacgacgccggccattttgaccagcactgacgagatgaaccaacttaaggcccgctttctttcaatttgagattattataatccagattattgagagtaagctgagaaaaacagacaacttattaaaatagcttattataatctggaatccagcttattataatctgataaactcatttaggtgagcttttttctaaattattgggtgaaaaattacccaccatgctaccccactctctctttagacttgcaaacccaataatctaggctctaataatctagaaaagaaacaactaaccgtttaatctactacagattataacaatctagtttatagtaatctgacttaataatctagattataataaacccaaactgaaagaaacatggccttattaattaacgcgtacagatttttgtttgaacgaaacaagagacctgaaaatggagctaactgctgttaacctacgtaagcctgttccaaattaaccatatggtactagcactaaattaataacctatcgacgtgttttcttttccctaaaagaaaaaagaaaagcaagctatcatcatcagtgatcgatggatgccacgccaatgcaagcatgcatgcgtgatcgatcgatcgatccgagatgcctatctgaattgaacccggggagagctttaaccaaatcctgtcgccttcaagctgctgcctaaagctaccgcacattcgatcgaatacggaatactaacccaagcgaaagaaggtgaagcccagggcgatcgatcgatcgatcaacgatctacctctcctttccggcctatccatcatgcctaccacttggacacaaggggaaaaaattccattgctttgctttaattgccttttcctcgtcttcttcttcgtcttggtcttctttttggtatctgatgaggttttcttccatggtgctcgagattatatatacatatatgtagtataaattaatgtaggatatatatatacttggacaaattaaagcagcatgcatgagtgagagcttagaattaatggcccaggtcacacggcacttgggaggcgagtgattgatcggtgcgatgcgtggtggatcgttggtgcgtgtgatctgatctgatctgaaacctggaggggattgattgggtgtagcgtgtagtgtaccgacatgatagtcactgtacgaggttgagtttgatcggttaattcgttgggattattgctagtgagtactcactccgtttcaaaatgtttgacaccgttgactttttagtatgtatttaaccatttgttttattaaaaaaaatttaagtaattatttattcttttcatacatttgatttattgttaaatatactttcatgtacacatgtagttttacatatttcataaattttttaataagatgaacggtcaaagatgtgctaaaaagtcaacggtgtcaaacattttaaaaaggatggaattaagttgttgagtactcgatctagtgcggtcctgggaggattgcttcaatattctttgtgatttctgtggggttttgcactgctcttttctgtaggttatcatcatgttcatgtggctaggccgtgatctcgccggcggcttgccggagctcggccggccggcgtcaccgacatgagccgctctgtgtagtgacgtttcagccggcggaggtggttttggtttggggcaaatgaaaactcatggtcggatggtccgattgggaaatttggcccgtctgggttctggatagttgggccaccctcaatccttcatgggccttatgactcctagggcagcatattgggccggaaaggcgtagtatctggaacatgggctatatcatccacagaactcgaccaccgaaacattgggcctgtatgggcgttagatctcaatccgtacactttacatttttgtcccataaattttgtactcccaccgtcccaaataaaaaactaaaaataacccagtaggatgtgacaccacctaaaacaacgaattttaacaaaagattcaataattttttaggaaaatcgtaaaaatcatccaataagacgctagaaatttgatattccaccgcataaatcattttattgcatatgcccaccacttacttaattttattgtaaaaaccaccccagtgcgcatgtgcttaattgaatcagcccattatcgttgatgtagagccaccacagactaagctaactgagtcaatcttattcaagtgcttatattagactcttttttttcatgtttcattgaattttctttcatatagcgaaactcagtgcgacaacgtttaagcttttatcaacaattctatttgtggtatctccaaaaaaaaaaagggtcaagattacactcttagaagtatttaattttggtaaataccacattaatagctcacaattttataaaaatatattgattcagctaagcacgcgcgtactagcgtggtttttacaacaaaactaagtaggtagatggacgtttgtaacaaaataacttatagagtgaaatgccaaactttaagtaacttctggtgtggtttttgtaattttacagtttttccaatgtttcataatataaagcgcgcatgcatacatgcaatttactagcactcccctcctctttaatttattttctttaatcctccatacacaatatctctaatttttttggtgtatttagggtgtgtttgaggagattgggaagatacgcaaaatgagatgagccattagctcatgattaattgagtattaactattttaaatttaaaaaatggattaatatgcttttttaaggcaactttcctatagaatttttttttgcaaaaaacgcaccgttgagtagtttgggaagcgtacgcgtggaaaacgatgtactttctccctcaatgtcacccgaacgaacgctgctagcagtagaaatcttcatactgaaaactaattgggttaatttacaattacaggttggacatattcgtcgtccattgcccgccaccatcaccgaggaccaaatccatctcttttaggcccatagtcaaggcccataaggtagaagcatgcctcatccacctctaccgaaccgtccccttcgtggccctcctcaatcgccgttgcttctccccttcgctgcagctgagcccccttcctaagctcagtgtgacggatccgcctcgcccaagctcggtcacaaccttcgtcatcgtcgaggttgctgtcacgtgcagtcacaatcgtcttcatcattgagatcgccgatcgcaaccatcatcaccaaccccgttttcgccgccaatgtccttccctctagccaaatctggtagggggaggggaggggagtggagtggaggagggagttgttgtcggccgctcctatcgagaaagtgagggaggtgagttgagagagcctgagagggaaggaaggggcaaatgtacttagggcctcttttggggagctcctgtcagttgcagcttctcctagaatttccaactgccaaaagctcccccaaacaattcagattttcacccatattttaaaaagctgtagttgtataatccagaaaataaactagaagccaaaagctgggtttactagcttctccatattctcacctgctgcttcttaaaatcttaagctccaccaacagggtcttatgctcggcgacttctcgctcttgctgtgctgatatttttgtagtgtttccatgttttcgctagtgggcctctttatgcctcgttggtaaaaatcaatttttactaaccgtgtctaaagagggaccatgtgtgaaaatgaggtattttttaaagctgtcctcttaagactctgttagtgaaattcaatttttactagcgggcctagggtgtgttcggtgctctcagtttccaactcatctccctcattttccgcgcgcatgcttttcaaactactaaacggtgcgtttttttaaaaaaagtttatatacgaaagttacttaaaaaatcaaattaattcatttttttaaaaaatagctaatacttaattaatcacgtgctaatggactgcttcattttctgtgtggagaagatgggttcccaaccccaagttacaaacacagccctcttgttatttttataagcgagaatttttagatccacctggaaaaaaaaccatagtgagtatgtggacggtgcagcatggccagagatcatagttgatagcagcaggcctgaagaatgtttctgaaattgctcatcaacaatatggactcaataattgattagaggtagaaacagtgtttcattgacataattctctcatttgtgactaaggcagtggtcgcaatgaaaacatggtaatgcatccagcggcgatggctgagggagaagggcagtgcaagggtggaagtgggaagggggtgagtttatgtgggatgtgaaattgatccctttgtgattggaacaggaagagactgagatatgacaaatctgattcccttttcttttttaactgataaacaagctgcttaaatcttttttgtactcttctctttcttttttccttgtagaaaagagaggaagctattatttgtatgattgtatctacatggacaaaaaaaaggtacattgacaaggagatatggagattttttttccacttgctccatcacaagcttttaaaaaaatgaacaaatgggggtcccagcaggatcatgtttcaaaaccgatcaaaacacattttgcacatgagatgtctgtgtccagcctttgcttccaggaaatggggcatcgctgtcaggctggttcctctctacttccttgagagcttgggccactgcaaaaacaccttcac

SEQ ID NO: 5925 - DNA, 716 bp, Oryza sativa
cgccgccgacctcacaactccggccatgatcgattgatgatgatgagctatatatcagcaatgtaaactttggagagagtatatatatatatatatatatatatatatgtagctagcttaattagcttgcttaatatggcgtatatttataggcatagctagagagatggattgatcgatgcatgggtcaatttaatatgtcggtgttgcatgtgatcgatcattgatatgcgtgatacacgagcgagtatataaacgcattatgcatgcagcatgtgttttgctctcagtggtccggttgctgatcgaatcaaactggcccatgcgcgtatgcatgctgccaaattagtcgtcattgattgtacatatatttcccatttcacgtgaagcacatacccggccgtacgtaactttttctgtttgggataacattatttatccatccctagcacacatccagaatgagaaattatttaatggaggggatcatcccccaaactattgctcctctccctctagcttgttcctcctcccatctttccttgtatcaatgacgattcagcaaggcagaaaagctctattcgctagcacccattgtcgcatccgtccctttatttagctagctatcctaccacgatcaagatgctcactagaacatggcgtgatttttttatatgtttgttgggtggtatccagcaagttgctgcgggtagggg

SEQ ID NO: 5926 - DNA, 39628 bp, Oryza sativa
  unsure (1)..(39628): unsure at all n locations
cggcagcagcaagaatgtgtgagcaaggaaggtgatgaagcttcggcttcatacaactgcaggtacatccccatccgccttcaagacacattcctgccggcttgctgcgatagataccggcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaataacaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttaggtggaagtcccttctcatcccaaccgttctgcaagtagtcaatagcccgcaacatacccgcatgacgatcatgtataaggcaaacgttgggcctcatacgcaccactgcaatatgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcaccttacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtctagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataactttctgttgcacgactcactacaactgatactgacattgtgtagacttcttggtctattctaaatcctctcaacaaccaactataaattgactgaaatgttctctccacaggcctatcgatgcccttagatgtcattacaaaatctgacagatcaacacaatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccaaatcaaactaaactacatcttacaattaacactactgtctatgtctcatttcatactattatattctatgctctggatctacacatatgtgctgtgtgctacagatatgctaaaatatatgaaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggctttataggggggaggcaaaaatcgccctcccccagggcggcaagggggccgcctgcaaaattccatggcccctcgccgcccatttgcaggcggccccccgcacagtacaaaatcgccctcccccagggcggcaagggggccgcctgcaaaattccaggccccccgccgcccatttgcaggcggccccccgcataatacaaaatcgtcgtagcggagggtggcaagggggccgcctgcaaacttcgttgacggccgtcgcccgagagcgaacggccgtctgccacgtcattttcgccgccctctgcgatggcgatttttaaaaatcgccctcccagagagcggtaggcgactacttccgccaattttcaaaatggaaaattatttttgtaaaacttttaataaaaaaaattaaaaataaaaaaaattcgagtcgcgatttgggaggaggggagagaggacgacggtgacggctggtccggtggtggacttggttatgtttgctgggcctgggagcggcccaaatttgctatgcctcttcgtgggccaaatttcgtggttgtgacatgtgggctggtcctggtagccagcccaaatcgcgaaaatcttctttttcaacatcccgacgcacagaaacagagcttttaaatccgcttctgatattaagcaaaaggttaaaaaactattatacactttattaatacggagagaaaataagaagtggggaacactattggttcgatagctaaaaacaagaagaaaaaaagatgatgcagtgttaaagtggtctagtggaatacttcaaaattagatcattccaaaaataatttcttaagctaaaactatactttagcaaatgaaaatgtcattggtatccctcatcatcacacgtataatcaactttgatcagtgattactactttcgaagtggattctttattcgagaattctctcggcctaaacaataatatgcttatgcgcaagaggccatatgccaagaaggccaccacgcccggcccactttccttcactcaatgggcccggtccgcctaagatctaccttttccttttttttcttttgtgtatatgtctagacaatctgtttggttagagggagtttaaaaggatgagactattaactgttttgtttggttgggggatataggaattttggtgggatggggatgaagaattaaggaatgaactccctcctttccaatacctgggtaggggcagggaattaggagggaattcctcctttacttcgcctaaacaaatctcagtcatcggttttcattagtgatctaatctccaactaaactccctatcaatttccaccacctctaccaaacaaaagactgggatgaaaaattaaattcccatcttaatctcaccatcaattacctcgtgtaaacttccaatccccttccctcatgttgccaaacaagccgagaaaagaaatgcgaaaagaagagaaaagaaaaaggcgagaaaaaggcaaatggcaaggggggaagaagagtggaggaagaacctaagcagcaaaccctagtcgcgactacaccaccaccaccaccattgattccgatggacttcgcggagctggaggcggtggagggcctccggtggccgtggcacgcgtggccgccgaccgcctccgccgccgcgtcgctcgtcgtcccgacctccgtcctctgcacgccgctgcacccggcggcgcccgacctcctcccgctcctcccctacgcgccgctccgctgcggcggcggcggaggagggggagggtgcggcgcggcgctcaacccgttctcgcgtgtccaccacgccacagcgcggtgggcgtgcccgttctgcggcgcgtcggccaacccgttcccgcgcctcctcgcccccgacgcgctccccgccgagctcttcccgacccactccagcgtcgagtacgcgctgccgccggacgccgccgaggccggcggcgggccgggccctccgtccgtcgtgttcgtcgtcgacgcggccacctcggggccagagctcgccgcgctcaaggcggaggtgctcagggtcgtgcaggggctgcccgagggggtcagggtcgcgctcgtctccttcgcggcgtcggtgtgggtgcacgatctcggcttcgaggggtgcaccagggtggtggtgatgaacggggagcgcgagctcgagtcggagaaggttcgtgaactgtgaattctgggctaattgacggagccgcttctcaatgctgtggtttgggcaagtttgctcaagttgatccagtcactaggcatgggatttgctttaaaaattatcatattacagagtaaaagctatcgatctcgatattctaagtaaaatgggcattgtgcatttaactttaatagtctgctctcccaattcatgtgagttcaaaattcacactacaatttctgtggtgtataggagttataacaggggatgtaggggtgttcatgtacggttcagaagaaatcatctagagctgcgcatgagcaagtttagtttgtgatggcattaggctaagctgtcagtgggacatggatgaaaattaatacgaccagtttcaagaaactgcctgtgaacagacctaagtggatgccacacctttgtttgctatgttgctcctgtcctatgcatggttcatttatgcatgtagggcagcaactcttagatatgtacaaatgacaatgtatccatgactccatgtagcctaaaaatgtctgaaatgttataattgtagtatgactggagagagtttggcactatctaaataaggcactcttgggatcttgttaatatttggcttacatatgctgttgctatgttgctgttgtctagaagatttggtccttgcaacttgcaagtttgaagatgtttggtttggataggaaaactgtgtggtcatattttcagttgtcccataggctcatatcaatcaatgatccacttatgcaactgctttgcgctttaggatttattatcatcattatgtttaccttacaaaccttctcttattgtttcagatacaggaatttctaggtgttcgtgatgctcgatacaataagttggctatgccaaggtccactaaagtgcagagatttttgctgcctgtttctgaatgtgaatttaacatcacatctgcgatagaagacctgagatccatgtctgcttgcccacgtgggcatcgccctttaagagccactggtgctgctatttccacagctgttgctcttctagaaggttgttgttcacctaatgccggaggtcggatcatggtcttcacatctggtcccacaacagttggtccagggcttgtggtggaaaccgatctcgggaaagcaattcgttctcatcgcgacattttcaatggcaatgctcctctcattgacaaagcccgagaattctataagaaagttgcaaacaggttaacagctcatgcattagttcttgatctatttgcttgttctctagatcaggttggggctgcggagctgagatacccaattgaagtgtctgggggcttaatggtgcatacagaatcatttgagtctgagcagttcaaagcctgtttaagacacatattcaatcgtgagggtgttggttaccttaacatgaactttaatgcaacaattgagatagtaacatcaagggaggtgaaaatttgtggtgcccttggtccctgcatctctcttcacaggaaaaacagctctgttagtgataaagaaattggggagggtgggacaaactattggaaaatgagtacagtggacagcaaaacctgcatcgtgttcttcttccgagtggactgtagccataatactgagcccccaactgtcttctttattcagttcatgacgaggtaccggcatggtgatggtagctatcgcctaagagtaacaactgttgcgagaagatgggctggacctcgttctcctgagattgcagcagggtttgatcaagaagctgctgcagctgttatggccaggcttgccgtgcacagggcagagacataccatgttagagatgtgataagatggcttgataagatgcttattcgctttactgccaagtttgggaactatgtccctgaagatccatctacattccggctgtcaactaacttctcgctgtatccccaattcatgtactacctgcggaggtcacagttcattgatgttttcaatagctcccctgacgaaactgctttctttcggttgatgttgaatagggaaggagttgtggggtccctaatcatgatccagccaactttattccagtactcgtttgatggcccacctattcctgtgttgctagatgtcagctccatctctcccgatgtcattttactatttgattcatacttctatattgttattcattatggctcaaagattgctcaatggaggaaacttggctatcataaggacccaaatcatgaaaatttgcggaagctgcttgaagccccagaagttgatgcggaggcactattggtagaccgtttcccagtgccaaaactcataaaatgtgatcagcatgggagccaggccaggtttcttctagctcggttgaatccatctgtgacacagaaaacacagctttcagatggttctgaagtcatattcaccgacgatgttagtttgcaagtttttattgaacacttgcaggagctggctgttcagggttagtgaggcatggagcctggcgatgtttccacttttgcagttggacccacctctgatcctgaagatatagctttcagaaggattgaatgtcatattcacagatgatgtttgcttgcaagtttattgaacacttgaagtaatttgctgtgcaggattgatggatcatgtggactgtttatatgttactttctggtcttctgttatcttgaaagttccgggagagctttactgcttggaaggatgggatctcctcgagttgttgtacatttcaccagctccagtttgatgtaagccatcacttaatatttttgtatagaatgctataatgtctattatttatgctctacaagtgctggagttctcttgagacatttgctaatttctgagcagtaaaacaccctttgccttccaattctggtaatgcaataggaccgttatgttgttttctggtggattgaggattttaagtcactcttctgttggcatcatacgcccttaagcgcagccgtttaattctctgtaaacacttaaaattttgatatccacaattcttttggttgcggtttcacactttcactactgtgttgcttgtgtgattcttcaagaacgtctgttatttaatactgcccctagagtttatcatatgatgtttgacatattatagaccaaacataacataggcatctttatatgctggaagcatttccctgtcataaatgtgtgctgaatagattatggtttagtttgtttatgcaatgtacttagcttaggtatcaccacagctctagaaagagcaaggaagcttcatgctatgatcataccatcatgtgtcaagacccaaccttcttaataactcaaaagacagataggctagagttatagtaatggattccccatcaccaagcacatggcttgttccccccacttgatcacaccaggttacaaaaatattgtgctgatgattaacaaacatgttaacttaccagataccataataataatagtctcattgataccctttacttcacaatcacacaaacttaaattaacaacattggaataaaatcatcaagtagatcttgggacacacggtaggggacatcacataacaccaatccagctacacacaaatagattattgcttctggtccataaacaaattaaacatgacaactcttccttcttttaatccagctaaacaagtaaaaccttatatttctaaggaaaccataacacactgcaagaacaccattcttatggcaccatgctcagcatcttaatactgcaacattttcagctcttgttcttgtacttgtcctttgctcttggtgctggaagaaaaaccacacacacaaggggtgtgaattaagatataaatcttgacacgaaagcaaattttagctgaagatactgaccaagaccaatggcttcggaacccttcatgatcctcaagcgtttgcatgactcgacaaacatcctgcagagtaaccaatcagctaatgcgagaaacttgaacgtggtatcgctaaaccgcattctaatcatgaggtggaaaataaggaaaacagttaagggggcacaagaatgaagtagtaacatactgccacgggacatctccaacaagcatccagtcaccatccttgtcttcataagttgtaacagcatcagagccattcacctcattcatattgttccctgacagagaggttcatgcacagtgttttcatcaattccggatcaaactttgcattcaaattaattactagttgataatctgtttctgcaggttcccgtggccagcgatttaccagttgcggtgaaggtgccgaacatcttctgcagagcaagggagaggtccttgtagctgttgtacatcttcaggtccaccttgcgcaggtagggtgccccgtccatgctgaccttcacgaaggcagagctgttgctgccgctggcattggcagcgggctgctgctgctgcttgtcagcttcctcttccttcttgctcttcactgactggacggtcatgatgttcctgcggaacgaccgaactggtggccaacccactgcctgcgccctgatgtgtaacattggaaattagctactacatcgatttttttttcttttgctcagttttttcacatcttgttctaacttattggcgctgtgaaaaaactgagatgatttactttcgtgactggaagttccatccagctagatcatgcatgttacaatattcttgctggcgaccaactctgtgttaactaatgtattatgtgtgtatgcctgcagcaactttatggtagtactgtgtgtataatgaaaatgccatcaactttagttattgccacatgaatcatggccaccatgattatttcaggaattaattgtatacagatgtactccttttctgatcgttctaaatattttgttgtgatcctatcttcttttcaggaaaaaaaataaatcaaaacaatacgaaaacaactcctttttcagatggaatctgccaggagatgaaggaaaaaataaaccaaaaacaatagtagtaccactacatcgccagcaatttctgacacctgctgcacaaagcaggcatcagatgagccaatggtgattaaaaatggtgataattatctgctcagcactttgcaagcgacaaagaacatacacgatggtgtcgccatatgcactttctgccagaggatctcttttatatggataatttgtgcttcttttaaaggtgttgcttcatgggcatctcaagtttatgcagcaagctcccaaatatataaatccaaacaaaagaaaggaagagaagagggggggggggggggggggagaactaactaataacctaaacatgcatacaccttttcaccaaatgccattatgctgctactatatgtggatctttttccataaatcaaaactaaacatgcataaagttcctccaaacagcacaccaaataattcatcttttatccctttagcaaaaattaacaatactaatcccactaaattctcactaattattaagtaaactagtaattagacgatgcaactatatatacgaaggatcaaattggaactactgtaacatattaatgccagatttatatatgaaaaaataataaaatcatgctaggtccagtacatacttgggagcaggtggcttctcggcgtcggcggcggcggcctccgccggcctcttggccttctcggcggccggcgcctccgccttgccggcggcggcctcctccatgccggcggtgggcagcttcagcttcaggtcaatggtctcctcgaagcccctcttcgcggccttggccgccgcctcggcggcgccgccgccacctccgggcagccccagccggagctccgtcccgacgtccacgtcggcgccggccatcgcagcagccgccgctgccagctgcttagcctatcgcggctatcgcgtctcctcgccccaaatcaagctgccttctcttctctctctttctctctatggagactggagatttttaagcctttgtggtgattaggaggtgttggaagaagagagaggagccaagaacagcttggagatgagtatatatatagagagagggaagagaagaggagaggagagagaatgcatggtaaatattctaagctaggtagggtggtagagagagagaagaaatatgagttttattttattttttattttttattttggaggggaagagaaagagatcagttagttagagcatgagtgaggccacttggaggttagtagacaataatttttgcatccatgtttcctccggttggattctctattacaacttacaagtatcaagtaatcaaggttaggaggctagagagcaaggtgtgtaactagtgaagttccattggatggttgttcaggatttgtaaagtgttcctgtgccataattgtagctgtggttagtaactgctcctagctacacccaatgtgcataaatatatgacttctggaagcttgcaattagagtttttttttcaaacgtattcaaaaacatatatttgtcaaacaaacacaccttaaaaaatatttgtcaaaaaaaaacaatttccatattgtatcatccctctgccttcaaatacttgtcgttggacgcttttcatcttaaatatttggttgctcgtcttttttataaaaaaaatatttaaatacttcaaaattattctatattaacgaagtatgttgcatcctaaactattcataatactttcatacattatgatctaatcattcagattttattgatagtctaagttaaagtcgtgttaatcaatggtggtatttatttatggaaaccaaagggagtttttttttatttttatttcatgttcatgctacatataacaattgttaaagtaatattggaggagccgcaccctcttgaacaatgagagcaacattaagttgaattgtacatgttttttttccaattacagatttcttgtaaaaaaattaaaattgagaagcagaggtcaaaagtagtcatagcaaaggctacagagaaaatcagtttgactttaataccggataaacataagaatgtaccttattttttataactatatttttttcatcaataaaagagtgcaaaaataagggggaaatgatcttggttcttaggagtattatcattagcaaatttcataaaaccccacctattatgtagtcttagttgaacaaaaccactaaaattttggcacgtgacacataaccccggttctatggctatcaagttttacaaaaccataccatcaatcatttagactttgatataccatattttgaagttctaaaattacatcccaaattatgagttttgtatctattatttaataattgttactttcatggaggtaaagttttataaaattttgatatgtgaatatgttaaattggttaatgttgtggttttgtgaaactttaagggcccctttgaatcgcagggtagaaaaaacggaggaataggaaaaacataggattctgacaagaattgaagtgtaaaacagaggattgcaaaacacaggaaaaacacaggaatggtcgtttgattcgagcgcaggaaaaacgcaggaatcggatgagagagatagactcaaaggaaattttccaagaggttggagctcttgctaaatttcctccaaaatctacatgcaatgtgtcattccataggaatttcataggatttgaaaagcttcaatcctttgaatcaaagggccaaataggaaaattttctataggatttgaatcctatgaaattcctacataaatcctttgattcaaaggggccctaaatccataatacttgggatgagttatgtggcacgtattaaaatctctttggttttatgtaggtttgatcatgatacgtgtgattttatgaaatttactctgttattattacactgattttcttgctggcaatgcaactgatcccaaggctgcaggatgtagaggatccgggggagcctagctcgcgccggtgcatggacccatatggcgccgggcccaccgcgcaggccccggtggcacgacacgtgtcgcctgatgagctggacggcgccgattctgccccctccccgtctccccctcctccggcgtgagggcgtgacgcgatgcctgacgtcaccgccggattttttcaccgtggggccgggctgcaggtggggacaccgtggcgtgtggggctcacacccctccgcggcaggatctaccttcgctttattctttgggtgatgatccacttgcagagatgcatgcatgcattctgaactctgaagccaaggctcaagggaagaatgtgcgtacgtgcaaatctaaaaggaattcatgtacagtttgtgctactaagttttttttttcttgttctagataatgtgaaaaaaatatgaatgtcaagggtcaactctaagtaaattcaaaagtacaaaatggcccacaccaaaaagagatactcagtcgtatccaaatgcatggtcaaaatttgaaatttaacacagtcgtatccaaaataatactccctccgtcctagaaaaaaaatatagagttttagagtttgacacggttattaagaaagtagatagaattaaataaggagttgtgatttgttgagaagtggaaggtatgtgggaaaagtaaatggtggagggttgtgattggttgggaagacagtgttggtggagaagttgctatattttgggacacattctaagtgctaaagttgttatattttatgacggggattttaattcactctaaaaaaagcaatatgttttcgtcggatggaagtaaaatggattcgagtaggactatcaaacaaagcgagcacattcaaaattcgagttcttttgtctcaatattggtactgtccttatagatttttacttcctccatactaaaatataagaatgtaatattaaatgggatattttctaatactacgaatttagaagtatattattacattatcataaaatgccccatctaattctagattcttatattttgggactgatcttgaaactttgtgagaattcatattttttttgctttgattagagtgtactaatactagcttcggaggcctcgctcgtttgtgctagctaaggcaaaaaatagtgaactgccggctgtgcttttgggcgagctgcagcctgcagaggcccaaaatgtctcaaccaccaaacaaattatgaacaacaattactagcagaaaaatgaacaaagcgataaaaaaatttatgtgtataatttctacgtttatatatttgtcaattaaaagctactgcgtcgtaatgttgtaaaataagtacctcaaaatcaactcaaaattaagtttgtaaaatttattttgtttactgcggttgataagaagaaaaagaagaagatcaacaaacaatcagtatgaaaaacacatgtactctacaagtactagggtgtagctctatccttctacccttgatctactgtatactctacaagtaggctgaaggaaaataaaaaaataaaaaccgaagtgaaaaaaaaaacatgacgtatatctgactttgatgggcagcacagcagcaagaagaggagttgttggattcccaggcctccagggtggtgggccccacgtgccgggaggggtggggacaggtcaactcaggtgtcggccccaccactcctgcgtgcatgtgggttgtgaaaaacggattctcagctccacgcgaccaccttatatattcccgcccaaattaatcaactactaaaaccaaattaatcaactaattaaaccgatcgagagagcactagcctacctagcttaacataatggcataggattagtgctgcataatttaatttagtagcagcagcagcatttcttggcttccaatcattctccagccagccagccatggatcgatccccaatttaacttaattattagtagcagtatagtagtaagaagagaagcatgatttgatttgtttaattaaatccgtttgctcagaacatagttactcgaaaaggcaaattagttaacgctgttaattagtggcagtgtgttcagggaaatctctatcagaatctatgcagaatttgacggtgcatatatatatacacacacacatctgccatgtcctactactgagtactgactgatggagcttgttaattgtaagcccctgcatgtatgatcagtttgaacataatccgccctgttttacgcaaagatcgaattaattgtgcagaactcatggactaatatgcgtcgcgcagtccccgggataagctaattgagatgggtgatgagagggcagagtgatgcctagcaagtacaagaaaagtcctgatcgaaatgcccgtgtcccctcaaaagcaatacgccaccatctattgctagctagctaaaccagcaatatcatttgatttgtttcagtccatcagtaaatcgaagtgatgcatcagtagtacatccatgatccatatgcaatggattccctgtcctggtgaggcatcggatggcactactgctttttttcccctccagacggctggaatcacttttcccatgtgggtggagcaaccgcctgaaattagatatacgtacaaaccaggatttttatagacgggcgccacaaccgtttgtaaaaaccgatttttcctggtgagcacgttacgatgtccgaccgcaggaatctttagtaagaaataaaaagtctaaaaatatattccataaaccttagtttagatcgtgttgatggcaatatcgtctccgatctagccaccggatccacacctctggaggcnnnnnnnnnnnnnnnnnnnnnnnnnctgtcattgtctctgctctcagtgcccaccgacagcggatccgtccttcacaagactggcaccatcaacgccgccactactggggtcacaacgatcaatgttgccgctcgcatgcatatcggcagtggatccatcattccagaggctggcatcgttgtcgtcgctgcttctgaggttgttggccgccgttgacgaaaagaggaaagaggacccaagtggcgtcgactcactgcttaagagagggaaaaatgaatagaggaaagaggacccaagtggtgtcgactcaccgcttaggagagggaaaaatgaatagagtaaagaggaggagagaccgagggaagagactagggggaaagagcgggctcaatgcgccctttgattttaaagtggtcgtacgtcgttggtcgatgcgtctggttgtttagatcaactaaaaaaccaccacatgcgaaagttaggttattttcatagacagactgtttaaaagcatcttatgtgaaaatcaattttcacatgaaaatgttgatcaagtgtgttctccgtattttcaccaacaggttttacttaagccattttatatataaaaaaaggagggtgtttatgaaaatagtttattcatatatagttgcggctgatcaaaactcaatgcaataaaaccagcgtgccacgttactagttgtggtgtttgcatgatatatccaatataattaaccatccgttagatcgatgtttgttctgctcgcgcgggctctgagaaattctcgagtgcatgcatactgttcttcgtgaatgggcagtggcggtagcgggggcgagcatgtgatgtggagcgagagtagtggggtgtcgccggcgcgtggagtggcacgaacggccatgtgccccgggccggtgcaccccccaccacccctgacgtaccaaacgaactcctgcatgcctcacgaccgttgcatttgcatttgcctgtggctacccccagcttagctactctctcttcgtctcaaaataaatggacttttcactcatctcatacataccgataaaacactagattatcctttattttatcaagatacaatacaatctattttccaccttatctactaacaatacaattattctttactttctactttagagagtagctagcaccgtgttgtttctctgttctgcatctactagctagctagctagcctgggtctaatttaaggccctagctaagcccctatccaaagcattacttttctctctgcctgttactgttagggatcctaatcttatctcaccatcgtgattaataatcatcacacatacatactccttttattttagggaatagttattaattactccctccattccaaaatataaggcataaccacccctaacccaaagaccgagaaaataattattatcatattgtagtttggatcattctaataaatacaatgtatgcatccaataaaattagagaacatgaaagtggatgatttaaaaaagtaataatttaatggagaagagatcatagttaattacctacatgcatacatgctttagggcagtcccaactcatagtgtccataaatagtgtctatggtgccatgtcaataagacatcatgatagaaactacactccacaaaccatggtttcttaaagtgggccattaataaatacatcatctctcttctctaccaatcatatttattcttcatatattatgaagacactattatctcccaatgcaaaacttgatagtgtctagtgcataggttcttgtgttgaagctgtgtcttgcatgagacccagtttcttcctctcttcactctctctcttaattaatatagtgccatataagttaaaagtcctacatgacaatgtagttaatgccatagacaccatcctaggtggaagattgggactgcacttatattatagaatatctaaaagtggttgtgccttatattatagaacatcattaaaaaattggtagaatggagggagtagttagttaattaattagggcttcgttcatcgtcaagacctggggattaacatgaaaaagtttagcacaggaacaccgactgttacatcgaggacaatcagaagattggaagttccagtggcgcatcaagtggctctgaagaagagaacctctgatctcgacacacgatgccagctttttgccggtgatcgacgctgaccgatgataggatcccagtaagtaattcgtgctagtaataacgtgttctttagcagaaatgttttttttaaaaaaatcagggatgaatttagagaatctatagcaagactattcccgccatctcaaaatataaataatttttaaaatagtgacaagttaaatctttataactttaactgttaataataaaaataaaaataaaaaaagatcaatcatgtaaaattaatatcactagatttatcattaaacaaactatcataatatgcaaaactttttatttaaaatattttatttttatagatattgttggttcgaatactgtgtcgaaagtcttaaaaatatttatattgtgaaacgaacggagtggcagttatgatcaagcattaattatgaactgatcaacatgattgtcatccttttcatcacaagcaatgcgatatatacatgatgtggaagtgatagggaatggagaaagagcagaatacatacatgcacacacctcatgattcatgaatatatatacaataatgctccgtagcatggctcacacccacagataatccatagaagtagcatgactcccaattaagctaacccccctaattattgtattaacctgtctagaaacacgttcctgttgcatgtgcccgattcctcccccggcctacacacacaccgatcgatcgatcagtctcactggccgtagcatacattgcacgatccaagaaacggcaatgtagaggcatgcatgcatgcattcagaatgagatcgaaaactacctgcaactagcccagccccagccaacaagtttgcacactggcaaatgccaactcaataaaagtactcccctttacttcctctgtcccacagaaaccaacctaatactgaatattgacatattctagtattataaatttagacagaccttaacatccagtattagattaagttttttttgggatgaaggaagtaaaatataagtatttttaggttggtaagagtattaaaaaggcatataggaatattggagaaaatatatgattggttgaaaagagaaaacagttaaagatgaatgattattattggctgagagtaggagataaatgaaaaaaaaacctaactttaaaacaaactactgtgatataaattaatagctattgccgtgtttagttgttttggtaaaaaaaatttgacatatacagacacacatttgaagtattaaacgtagactaataacaaaacaaattacagattccgcctgaaattgcgagacgaatctattaagtctaattaatccgttattagcatatatttactgtagcaccacattgtcaaatcatggcgtaattaggctcaaaagattcgtctcgcaatttacatgctaactgtgcaattgctttttttttcattcacatttaatgctccatgcatgtgttcaaatatttaatgtgacggaaaagttggaagtttgaaggaaactaaggccttgtttagattctaacttttccgtcacatcgaactttactatacacaaactttcaatttttccgtcacatcgttttaatttcttcaaacttctaattttagcgtggaactaaacacaaccataatattagtactgtatactactatgtacagtacacagaccctgaccagctagctgctggggagctgtgcctttggatcagctgaaaattgctgcatttctctgcagctgccgctagctgacgccgccgtcatataagcttggtttcccagtgaggttttacactgctctctgacgacggatggatgcatgcatgcacgcacgcactgcagatgtggtgtccgagtagcacggtgcagcgacgtcagatgcacgtcgcaatgtcgtcgtctacgggaggcagcagggaggcatggaaacgagcccatgcccctcccgagtacgcacaggatcgtactatacgtacagtactactgtgttggattttttttccccattcagtgcatgcatatgcactccaatttattgtatttttttttacggattgaccttttggatactgaggtgtggtggtacggtacggtggaaacaatgcagattttgttagcagtagagctaataaccagctgagatgtgacttttgagatctatgcacgcgacatggcttcattttatattgatgtgcgtatatagatgtcagaatgttcatatcagattaatgtagggatggtgaaaataagccccttgtttagatccaaactttttcttcaaaatttcaatttttccatcacatcgaaactttcctacacacataaatttctaacttttctatcacatcgttccaatttcaaccaaacttctaattttaacgtgagctaaacacactcagcgtacgccttgacgaatgacgacgcagcgtacgcatcagattgagacggtccaggccgtgacggcaaaattcagcttcaggcttctgcactggtagcttggctagcaccagaaaattaagtagagcaaaagtgtgaaggtagctagcaagcggagtgaagaggaataatggtcatattgaggagagtaaagttacgtggaaatgttgtttaagattaagatttttatgtggtatttattttaaaaggtagtactataactaaggataatttggctagaagaaattagaagggcatgagtttgagattcttttttttgcatgaaaagtaagacgatacattatttattttttaattgccactttgctaattttttctaaaaatcggtacagttctcttttggtctatatcctcctagtagtatatcatatatatttgagaattgacttgtgggtattgatataaaaacaatgaaactaatccttgtagaaacatctgctatatgttgggtttttctaaattagtagaaatgatatggtctttgataaatccccatctaaatcttatgtataggtactttttatggcaacgtaaaggcttcggtttctgagcacaattacaaatacatgacgagaacaacaaactcatgcgtactgcatgccttaagctagagagacaacggatatatagatttttgtcaacaatgttgattcttcgttgagtgttggtggttgacattagtctatgtttcacttccttctttttttttgctctttgtaagtaatattttgtgcttttttttattattgaacggatatttgtaacgagtggttgtagtttcttcgaagcaaagactgaaatatatttcattacctaaaaaaaaggctagcggagtggaggaagcaagctagcatggccgacctgcctgcctgccaatactacacccccaaatgcccggcagacgacgcgcacgcactggcgtggcctggcgcccatgccatgcacatacagggccgcacttgcacacacacacagtcacactcgcagcattattcctagccttcgatcgatcgatcgatatatgtcgagataatctatatctgatagagcgatagagatgacacgatcacgcgacgagtcgacgagcgctagctaacaaaacgaattataaacgtacacgatatatacacgtgtgtggggacgatacggcggcgaacgaacgaacgaacgcatggggcgcacgcacgcgcgatatggctgtaggggagcaatgccgtgcagccggccggccgcctcaactcaatttccacgcccgtgctgtcgccgtcggcgcccacgctcgcgctgcttcaattccatcgcgatgtgattttccgtcgtctgtacgtacgtcgcgctttgccttctctccaccgcgcgcggcggcgcgattatggttgccagctactttctctattttacaatgtaagactttctaacattgtccacatttatatagatgctaatgaatctaggcacacacacatatatatatatatattcattaacttctaaataaatatgagcaatgctggaaagtcttacaatctgaaacggagggagtagcatgtttaggggtgaatctagcgtgggtgatggaaaactcgggtccccctacgacttcactagatcaccatcgatagaaagagagagagagggggggggtaaataagggagagtacgtaagatgagaagggggactggacgaggaagaaggagataagttccatatattgttttttagatccatcacggaatatgttgatgtatgcgtactgttacactgcagtaagttgtggtggtcaatatatattaagaggagaggaaatacatgtaccatcactaaaataaagtgaagagagtgaaacatcctctttactcgcatgaatggacgagatggacgatatattgtgtgtaatactattcacttgtgcttgtgtcttgtttatatgtcttttggagatttgcttacgagtggtatattttaacgccattttagggcgaatcttgtagccgacagatagctagtgccatcaacctggatttatcatgttcctgatgatggaacagcaccggaaaggttaagttgctacatgagttaggaggtaattaaactaagttgttgccgacacacacctctcacacgcttagatggccatatatatgtttttagagaaaatgaaaacctaagctaaatatgaacatatcatattatcttatagcaatttactcaaaaacaatcgagacaagaatataaagtccctaacatctactccaaaacaactccttcaagaaaaaacgcaacatttatctatcattgccatcagaaacatgagatttttatctgaagcccgagaagacacatgcgaaggaaatacaaataaacgtcgatattactgaatccaggtaaactagagattagatttttcaccctggagtcatctccattactccgtgccaccatctagattaaatgagcacaatctgcgatgtgtagccaccaaagacaaagtgctaagcttcctctattcacaatcaccagcgaatggatgaatccattgtcgagacggattcatagaaatagtaaaataaaaactatcaacgaatatatccaagtgtgtcccacttgatatcttcatgatcagaatggaactcgttagctcagctgcacggaaagacaccaccaaacccttcattagctaggccaaatctcccttcctagatctcaatctaataaaacttgctttcggtagatcgatctataaacccatctgaaatatttcgatcgagaaataggaatgcacatcacattgtcgcattggctggattttcaccttttaaaaaacttattctacaaatagatccctaaaaaaaacttattctaggaatgaacccttttcgcggcgccaacgttattgacgtcaataacgttggcgccgtccccctcatccccaggtgaaaactaagtcactaatatctcgttggcgccaaggacctttttgtaaaaaaaataaaaatgacatatttgtagcagaaaaggacctatttgtaataaaacactagtgccaatgacctatttgtaaatatattattattataaatagatcctatattttaaagaaatacaaattaaataggtacttggcgccaataatgttaacgccgtttcccttcacattagtgacttagcttccatcgggagctagaagaacgtcgccgacatcattgacgccatcccatcatgttggacctaactttggcgtgttgagcaaaaacaagtcgctacaccacaccacacaggatccaacacggcaacgtacatccatccatccattcatccatgcatccgtcgcgcgcgtccgtgataccgcgcagctgctcatacgccccacatgtgtggccggttgggcgcgcgcatgcgtgcggtgtgccttgccgaaggggatcgatagatggccataattttgacaaattgacccttccaaaaaacttattttaaaaataaaccgtgccaaaaactaatttcaggaatagaccgtggcctcagcgccagcccacggttttaacactgatatcagcgccaacccatttggcgctaagctcgtgtcatggtggacaaaaatctcagcgccaacgccggtggcgctgggacgttttagctcacattagataaacaagtgaagctagcctggtggtagtatcgacaagtttgaacttgaaggtcacgggttcaaacctcgttagtgtagtatttcttttcagtttttcttttacttatcctccacgaattattgtcctattaatttcttttccaaagaattataaatataaaattttaaacttgaatcgtataattttggttcttatattcgttccctctaagtctaaaaataaaatgaagttgtaaaaggcacgtgaacattcaaaagaacacataaaaagagcaagttgagaaaaacaataattaaaatgaagaggacaggaatcaaactcccgtgccttggattgctactacgcaacaccaccactgagctatctacgcttccttgcttttgaagcacctatgcgattttatggtatacagaggtcagcgctgtggagtgtggcgctgagctctccatacaagacgagtttgtaccacggcagatgaaatctcagcaccaactgcagtggcgctgatacgctttagctcagcgtcaatgacaggccacggcctattcctgaaattagtttttggtacggtttatttttaaaataagttttttgaaagggtcaatttatcaaaattacgggatagatggagctcgagcgggagcgcgcccccgcccacgtgtgacagtgtgtcgatgacgacggatgagccgaggcgcatgcatggtggccggccatcagttcgccaccggacgacgtacgaggatggattctcatgtgggagtggaaccccggcccgctgctcgcctgcttccctgcatgctgtcccggtgcgtgaggtgccgcacgtgcgtacgcagtacacggtagctagcgccatgctcgtggatcaacgtgatagtagtcgtaaccagggccctgcaggaaaggaagctgctcatctctctcgtagaggccgatcgagctactgagcaccgcgcgcgtcgtgggtatttttgccgtgacaggtcgatcagccactggcagctagttatggcctcctgtagatggtggttggaccgtggtgtggatatcggtcagacacatttgggtgtgtattcataaattatccgtttgttggtggcttcgactcaacaaccatacatctttagattaggaaacggttctgaactgttgagagggatatcctcttgttttttaattattgaaatagttataattttttttagaaaatatttaataagatagattactccataaacatataaggttaatttaacttctacaagctgaaaagaaaaaaaatagtcgaccaactatagtttgatttgtttattcaactaataaaatttaatattaacccgcatgtttgcggattgatacatatatagcatattaaccattttcttgattttctttaaaaagtttcataacactatttgaatgacatgcaaacaacaataggatgttctctcaagagtttaaagtccacttccctctagattgagggactgcttatgtaacatttgcgaggaaatccatttcatcttattcacttttgaactacccataccggtttgagattagtgctgctacgataacttcaccttatccatctccccaacgccgcgtcctccagattgagtagatcgatgtcaatgtcgccgcctcccctactcagcaaggtcccccgcccccatcatcttcactgtctccagtagatccggcctgtagctaaagatatcgccactgactccgtttcctccaacctcgtggttctagcagcgatggcaccaccacaatgtcttcttgtgtttgcacgcccacgattatccctctaagcccaagtggacttcattcccctactctttgcccaaattttgatcccaaacctagtaattcgtagctcatctgtcagagttgggatgctgctgccgtcgaagaagaggaggaacttacgagagctggaggagatgggactcatacatgaatcttagcgcagatatatagcggtgaagaaatctctttaaattttctgttggatgccgtttaacaaatctattagctatctatactctcatgtatgtcagtgtagacacgcttaggcaaccaacaaactagccatcccgaccgttcgaattgaaccacacgtatgcgcacaaaaaaattaacggagagctcgatgtgtggggccgcctcagagcaaggttaatagtagagctcgctattggctacaaaaataacacatcatcctgttatagctagtttcaaaagctaataaataaagtaatgagctctatagttatctctacctatttctcatgtacaacttttattttttaaaaaaatcttaagtagtaccatttgattggctgctcacaaaggatgtacaaagtcacacacatgcagggaaaaaagctaggcctgcagcatgggtagccagcgcctctctcctttcactctctctctctctctcttccaactagataaaaatttactatatgaaacactatagcctactgatgtggacttattgtagctgctctcaccggccggccggaacgcacgcacgtagacatcgacgtacgtgcccgacgacgacggtcatctcgacgggcggccggccagccggcgcttgtctcgcctagctacaaaagcagctacaccacacgcgatccaacacccattaatccattgcgaatcgcgcgtgatcccgtacgcgcgcggccgatggatcgatcgatcagacgatcacactgcacacacgcgcgcagagccgtggcccgtttggctctcccatcccatgtgtgtttagttcacgttaaaattgaaagtttggttgaaactagaacgatgtgatagaaaaattgaaagtttacgtgtgtgaaaaaattatttttaatgtgatggaaaagttgaaagtttaaagaaaaagtttgaaactaaactcggccgttgtgcggtggtggagggaacccacgctgcttcccgccgtacgtacgcgtcgcagcaatggaccaaataccagcaagctgagacgacgctggtcctactgatccatcctaatgcagtagttgtagtgatggccactcgcttttctttggtagctgcatcctactactgcttacacagtacagtagttacaacttaaccggggccccgtgaacgggacctgctccctccatcgatctcgcagcaatccgaccggtccctccccactgcacgcacgaacggcatgggtattcaacagctaattatctaggcaccgacgctctctctcacaactcacaactcacaagtcacaaccatatgacccagcgacgacgataataacatatgacaccgatggctactgacaaactcatagaattcgttcaccgatcgatcgaccgatgcttagctagccaccagccaccgcacccgggcccaagccgaatccaaccatctgcaccattcgtttcaaaataaaccaactcctaactacggatcagtctatgttcgttgataggattgatcttttttttttggacggaaagcaatagctcttgcaacgtgcgtgtgcgtgggcgtggcggacaaacagtggccgtgccgtgcgtgtccctgttgggtctcaaccgaacaacagtggagcgaaccgtggcatccggagacactcggacgacatgagcagtttcacttgtccccctccctcttccctttgctcgattatatccggctgttcagacttcacacccatcagagcactgcactgcaatgcatatgcgacccagaattagtgcctacttggactattgtaccgctgtcttaagactattcccagctgctaatacgcgtaccgaactaactggtacttagtacttggcttaagatagaattaatttgggctgtaccctgtacgtactttgcattagtacatagtactaggctactagctatagctaattagctacttgttcgtaatcaaacatggtgcagaaataacagtggaaccatgtggccagtggatgtatatcgatcatacatgcaatccactgatcctgtgtcgatcagacgatcgaagcgtctcttacttgttctcttcttttgttcggttccctggaggctggagataggatccatatcacacaaaggtcccattcattctccaataagagttggacgaagataaagatttttgtggcacacttttcaaactgctaaacggtgcgtttcgtgcgaaaactttatatatgaaagttgcgctaaaatatcatattaatctatttttcaagttcgtaataattaaaactcaatcaatcatatgttaataccgtctcattttgcgtaaagaacttcatcttcattttcgggagaaaaaaaataccaccaaagtgccactcgaatcacatcaaacgctgcatgcagagttgataaaccagacaatttttcttttgaattcgctcgatcgagatatatatcgccgtatcgatcgaggaatgtacagactggtgtgtcgatgaggagcagggatcgctggtacgcaatctttcctgtcgcctaaccgacatgagaggagggatccatcgatcgatcgatcgatctcatcacccgttgattaactcctcgtcgccaaggttcctgacagatcgaagatccggattacgcttttgtcgatcgatcgattcgagtgttcggtatagacgagagagaaatcgatcgctctgcacatgcatgatggttggtcggtattagtctgatgaactctgacgaagcaagttgatggcagacatggacgggactgaacggctcatatcgaaaagcagatgacatgtatctgctactagtactacactgctggtaatattcctcgggagcaattgggttttgatctggtaaactgaagatcatgttggttgtgatcgagcgataatggtttgccaatggcatacttaaccaggggaatgtgatcagttttcattgtcttgtttgatttgatgagatggggggatggaggtgacgacatatgatgagcaggtgaaggtacaaaactttatggccccttttgaattggaggaaaaatgttcaaaaaaaaaagaggaattgaaatcctacactattcatgtctttaattatttatgtctttaattcgtataggaaagaaaactttcttatttctacgattctagttgaaaaatgtatgaaatttaacatccactctaagtctctaatctcttgaaaattttctttgaatttatctctcttatttgattcctgcgttttttctactgtccaatcaaatggttattcctgtgttttgcaatcatctgttttacacttgcactattatcagaatcaagtgttttccctatttctctttttttttaatcatgcaattcaaaggggcctatatcttgctctcttttttatactaaacttttatcaggggacactgactgaaagtgattagaactggacaagctttcctggatggattagaaagacccttgtttttcatgtgacgtgaatcgaccatggtaaatatggtatccctagaacaaactgagctagcaccgtatgattctcgtctgatttcgatcttgcttgagcataaacggatttcactatatgggtacatgcgcacacactttagtttacacaatttagcttagtactcatttggtttaaaggatttctaaaagattattgtactaattaaaaccataggattttttttatatatacattattcgtttcaaaattcttaagaatcatagtcctataaccttatcgtatatgattcttagtatgagatagacattttagaaaaaaaatcctaggaattggattacatgtgacatcttaatttttctatttttcatattcttatgatttagaaattcttcgaaccaaataagccttacccctccataaaagaaaatcctaactacgaatctaaatatatatgtgctcaggttcataactagaattgtcttttttttgtttttttaacagactagtatggccgttgcaagttgcaacagtgagtttttttctcgggcttccttccagcgtagcgcaattagagggtgggcataatattcagcccatgaagtaatttcgcggcccataatttggcgaacgtttactttagctgttgggcctctgccacgcggcgccgcctcgccgtacgccgccgccgccgccgccgcgaaggcaccggctcggaggcgctgcgggcgccggcggcgaggcggccctctccggacggcctccgccgctcccaaacagcgacggtggtaccgccgcccggggagacggcaggcgccttcgacccgacgcgcgctcccgtctcgccggcggcgggatggcctccaccgccggcgccgggaggccgccgtgggacccgaccgtatcgctccggctgggccacccggcgctcgtcctcctcgagcggtgcggcggcggggcgcggccgttcaaggccatcctcgcccacatgctccgcctccgcctcgccttcgagaccttccccatgagcaggctcctccacttcgccaccgtctccttcccgcaccacgcgcgcgccgccgagaccctcttcgagcacttcacccctcgccccaacctctacatctacaacctcatgctctcttcggccgcggcggcggcggcggcggcctcctcctcgcctagtcgtcggccggctgctctctacatgtcgatgctggcgtcatccattcaccccgatgagcaaaccttcctgtcgctgctcaagtcggtggatgcggagcgccgctccgtcgggaagcaggtgcacgcgcacgtggtggtgactggcctgcattcgcgcgtgtacctccggaactcgctgatcaagatgtacctcgacgccggcgatgtggaggcggcggaggcgatgttccggtgtgcgccgacggcggacgcggtgtcctgcaacatcatgctgtccgggtacgtcaagggaggatgcagcgggaaggcgctgcggtttttccgcggcatggcgtcgagggggatcggtgttgatcagtacacggctgttgctctcctcgcttgctgcgggcggctgaagaaggcagttcttggtaggtccgtccatggcgtcgtcgtgcggaggatcggtgtcgcggataggggattgatcttgagcaatgctctcttggatatgtatgccaaatgcggggaaatgaacacggccatgagagtctttgatgaagctggtgagagggatggcatttcgtggaacactatggttgccggattcgctaatgctggcttgttggaccttgctagcaaatatttcggtgaggcgcctgccagggatataatatcctggaatgcgcttctggctggatatgctcgatatgaagaattctctgcaacaatgatactatttcatgatatgcttgctagtagtgtaatacctgataaggtgactgctgttactttgatctctgcggttgccggcaaggggactttaaattcagcaaggagtgtccatggttgggtggttaaggagcatggtactcaagattctttcttagcatccgctcttgttgatatgtattgcaaatgtggaagtatcaagctagcgtatgccgtatttgagaaggccgtggacaaagatgttaccttatggacagctatgatatctggccttgcattccatggccatggagatgtagcattggatcttttttggaagatgcaagctgagggtacagaacctaatggggtaactttggttgctgttctcagtgcttgtagtcatgctggcctgtttgatgaagggtgcaagatttttgataccttgaagcaaaggttcaacattgaaccaggagtagaacactttggctgtatggttgatctccttgcacgatcaggtaggctgtctgatgcagtagatttggccaggaggatgccaatgaagccaagtcggtctatatggggttccattttaagtgcgagttcagcttgtcagaatactgaagtagcagagattgcttcaaaggaactcctctgtcttgaacccgcagaggagggtggatatgttttgctttccaacatgtatgctgctgaaggtcagtggaactacagcaatgaagtaagggagaatatggaaaggaaaggagtgagaaaatcagcaggtgctagtacttttggcagctgattctgttgcttcatatgctaggtaggagtatgtttcaattgtgtaggcagtactaattttcaattgcacacttctttctcccaataaacacatttactggtgcacatgtcatttactcatcctcttctaacctggaagaatgcagttttcaatctggggaataaagtattattcataaaccactagctataagttattggtgaaaactttgatgctaaaacagtatctgggcttacccgctccctttaattgatttcttctaattctttattcacacaacatattctgaatacatattgatttttctcttcttccagcatgcaggaattgaagcagacatttttattcataaaagatcaaatttcagggcatgatctagattcattaagaacaattttgcacttctccagtaaaaaaaaaatcctgcacttctatgtaagctatacctctagtcataaattctgtatgcactagagattgcttctacaattatcgctggttattatttttttataagtgagtcatcgctaattatttgagtgaagcctgcaatgtttgcactagcatttaagtgtttactgatcaaaagaaacttgatatcaaaatctaccagatctatgagataatcccataatcccattgagtcttttgatttcaaatgttattatgattctaccagacactgagactgcaaagtacaaaggtaaaagtatggaagaaattccacacaatgtttaacacgaatataatgtatagccatgatatccaagctttctctgataaaatctcttaactctttgaactgtagctagccaattggcccagaataaattcgataggaagccccatatctttgttagatgctgatcaagtacggcaacaaagaaagtatactcgtaaaccttattttgagaaactgcaaacggaattttctaaatgcccgaaggttcggaactggaaacaaaatcttgtagatgcctgagggggttgtcttaagtgggaatcttcctcagcagtgcaaaattgaagataccgaactagaagattcaggaattttctcttcttgcatagtaaaataaactaatgatgtttttactacaaacaaaccttgcaacttatgtaacgtgtaaatgcatcttttggcaggtgcagtttcatgaacgttgacaagattgggggtgattgggtgacaatggccggcaacaataccacattcttatcaagctacaatcagcaagattactagtcccagtgcagcaatggataatgtgctggtaactgtccatcaggtttcaggtagtgtttatttgttccagtatttttttttcagaacaagaattccatacaagcaaatttattccagctctcatagatgattttttttcctgctgctattttattatatttaagcagaattgtcaatggtcaccaatttcccctatttttcatcaccacctgagcatattaaatgcatttctgctctcaccatctgtaagtatagtttcaccattcgctaatattatgaataacaatatttaattgttacctcatttcctccttgagccatgccatcccttctcgttcaccacgcttcaccatatggcatatgaaaggagtgcctgcacggctgcaccccatagtcaatggtttccccgattcaagcatttacacacaatccttgtttcggattatccatttttaaccacaggtccactgcaccaactgtgcacattcttgtgccatgacaactagtgcacactcatccccagccttgctgagctcacacatgtacagtaggcaccacaaacatcaatgccagattattaacagtgcatgtaagctgcattttgagggtggaattacttcacagtatgctgttgcttgggtggggtagctgatttatgttccaacatgttcctctgtctgttgcaggtatcatcatgctggcatcgcctcttgggaaatgcatccgtgcagttgaaaaaacggatgtcctgctgaattttcattctttgcataccactccctccatcctcgacaaatacaagcactcctgaaagttttaagataaattatggttgggataaaaatattttcatgcctccggttgaatccctcaaccatcacctgattgtttgggatggggagtaggtgaggaaattgaacgaggggtagctggacaaatttcaaacgctataattgctttatatttgtagaggaggattctctcagggccctgattggacaaaaccaagagttctagaaattgacagtacttcaaaggtgccaacttccaaggttaggagaaactgctttactgctgaaagcctgaaacatgtgcgccgggagcccctggaagtattgccatgccaatgcaaaacaatagaagttctgttcacctatattgatgaggacggggctgcgattaactgctacccgtataattgtacgagcttggtatgaatacgatgggtccactcagtgtatgtacacatagcccttgctcgaggagtttcaggaaactgcaacttttcaaatattctatacttttatacaagttacagaatttagaaaataaattgaaagtgaaaggttagaaaatgtatctttcctatattctcgtcggctatttttttttcgcgaacacgcaaaaggattgcacgtcaatatattagattctcgtcagctaatcaccgtaagtttctcatgtatcttgtgtttccaccagtagttctagcgcttcacacatggattattttggacatacgccccatttgaatttgatgaaaataaagattaattatagacatgtaaaacgagaaagttatctatcctatagttgtaacaaatggtttcactcattcactcgttctttcattcctcatggaacggtccagatcatctgtgtgtaaaatcgaacggtctagatcgatcccccgcctcccacctccatcaatcgcgtgattgcgtgggccccactctgattcgccgcccccaacctgcgcgcaaccctctcacttctctctcgcacacggacgccgccgccgccaccatgccgctgcccccaaaaaccggacgccgccacgccaaccactacgctgcctcacgccaatcgcgatctcctccccatcccgtcgctcccacctcccccctcgcgtgatctcctcatccgtgatttcgcgatttcccctcactcccatctctttgcaggatcgctcccctctctcccatcgcgcctcagcccttctgccaccgccgatggtccaacgcctcttcctcagccgctccccctcaacagcagccacacccagccacccacgatccacgccgacgccgccgtcgccgcagtcctcatccgctccgcacgttctcctacgctggtcgggatctccgtccccgtcgccataccctgcacatgagtcaccgaggtccgtgccgccaagacaccatcgcgccaaccctacatccgccatccccgtcgctgtcggccgtctcctctacgcccgtcccaccacgtagaccgcctccttgcctgcatcgtacacttgaaggtctccatccccgatctcctaaattcctatccctaactctttgaattttaacggagaagcccagacttcctggtcctttctttttttttttatctccattccttgactccaatcccccttctctgattttttttctttgttatttgcgtgtgtgtgcaggacagcgggagcgagaacgtcacaatggtagagagcaccttgcagattggatggatcgatggtaatgcctcgtcaaataattagtacatctttattcacagcaaaatccaaatctatattccggttcctcccctcccaaacgcgaatgcactgaaatccccatctctttataggttacactatcatgagcaggcattttaacgataatgtacattttctaccgttgtgttgaatagtattgccttcagcagttacgatccaatccagatataagttagttttaggtccttcagtatttaagatttgatattggttgtggtctttttattactgtgatatgagtttagataattttatttgtcagagaagaaacttgctgtgaggtggaaactcaaattttacgcatatgttttcttggatcttcttctttaattgtatagcagttggtagagcataagcatgaacagtctgaacatttcaggcctgattgtttagttctattttttttattttttttcattggatcaacgtggcgagcttcatcattagggagcggctccgttctactatgaatcatcctaatattaaattatcaatggctattatgcatctgttcaaagttactgaaatagagataaaatagtgaatacaaatgaatatgtacttgctgtttaattttcctccctcccactatagaatacatcagtgagataattgaaattaaattattatgtgcgtttatgacacaaaaagttattatctgcatgtgtttctcattcgattcctgcctccaaattgactcacactgtcgccgccgctgccacacaaagcgccgactcggccgtagctccgtcgctgattcactgccgctaggttgcgtccatcatctacccgattcaccggcggtctacctgatcagtgtcatcggccctctctgcctggtacatggagatccttttctcttatttcatttgctctttcctcttcttgatttttcctcgattggtccaaaatttaataagcaatggcaattcatttacttgcggattgacagtgccatgtttctgatgtgtgtgcacatatcccactaaattatcaatgatgacgtcatgttttaaacaatttgattagcatctgcaactttttatataatgcaaatgatttaatttctcttatgatcaggatgtttatgtctgtaattcagatgaagcgctttaattagtagcgtgcatatacaaccttcaagtattatatcgttcaactgctgcaacaatggaattaatccaactttcagagtggcttctggtacttttaggttatatccaagttctgctttgtgcagtgataattttttcccttgaaaatgtaacatgacaatgagatggtatgatgtcatgatgatgggattcgttctttccttgagctaattccagccacataaaatttacatgagctaaactatgtactttctgaaaattccataatgcttttgtctatttgtttaaagaaatatccagggtgggtctattatccgtgtggcagtggattcaatgagttacgtcataatattgcttttcaaataatgacacctgaatatgtaaaatgtgctgcattggttatgtgcaagcactgatgtattgcctaaactgattttattgactactatacattgttatgttactctattgagaagatggttctataggtgccatcactctcatccggcctctcagccgctgccgcattccctgattcctgtcgcggtatcgagcaaagcctcatcgccgtccagtcagggacgcagcctcatcgtggccaacctccccttccattggaagcgccgttgccggttcaaactcattcgtcaggttacataggccggctccaatcaggtacaatatacatgctccaaagaaataaatgtctttgatattgtccaattgattgacacatgtatatttacaaataaaatttattgtgtactatatcagtgaaatgtatatttagacccttgtatatttggagtacatgcacccgtgattgatggcgtgcatgtgtgatatgtttccttggattcaaatccaatgtgttctttattatagtcaattatgctaggaggatttgatctgtcagtaagcggattcgtggctatagttccacatgtcaaatactaaaatatatatggcacttaactgcaagagatcaggccaataaactgaaaataatctatgcgtcttatcttatgaaaatagtttatgtccacttccttgtatccgacgttaacagttttgcatgaatcaggaaaaatctgctctgctgttgactacttcactccagttattcaagctatcaaagttactctagagatactccggttactcaattgtatacatctctgtttcacacatgatctatttctgcatgtgtgtcacatttactctaaaaagatgctgtcaaattttaaaagaacactgctttactaaattgtggtgtatgtagcgttagcatgccacccatatggcaaataactgaagagtgatgtatttgagttaacccttttatacgagcctaacctacggtactttcatagccatggatttaaatagattgttcatgtagttcctaatttcatttttgtttcaactaggctggtcctactacatttgcatgtggtagagggcaaggaggaagatattataaagtagaccaatgaatctattgtgatcgggagttttgcaacatttcattgggagtttatttatatattgttttatgctctggatttttggattcaagcccaaccaattccaaggggtataaacagaatgccttgagggaacagaaagaatcaccttgcctgtgcctaattgctccaaagtaaaaggtaagcacatatggaatgattaattcttgttttcaagaaagtttcaccatctaaattaggaatgaatagctctcatagcattaggtatatttctagggacctgaaacaatacactgttgtgtggatgtaatatgcccgcttgtcaatgtttgtagctgtatttgagacgttttactttagaatatcttgataagaagtattgcgtgcataacttatgccatatagcaccctaattttattagtgcaatcagaggataaattattaagaggacatgggtaagtgattccacactaattaacatagtggtattgtataataataaccagtgttgatgcagaactgcttaacagtaccaattgtggtatacatggttttgaaatctgcattaaaatagcagcggaccagcggttacacctattgagttttacaaataaaaatgacagacctagctacagtgtacatctactgtaaactaaaatgcaatcttgaaaataaaatcatgtttactttcaagccagggcagatgtattgaaattcattttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5927 - DNA, 16861 bp, Oryza sativa
  unsure (1)..(16861): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaaacaacgcaggcactgcatgattgaatgcatccctatcccctccgaagtttcaaacaatgctcccatgtacttcaagaaggtcggttgtctgttgctttgtccatgattgagaacaatttatttcttatgtgcttcaggttctaacaaaatccaacctatttacttcaggcaattgatgaagcggaagaagaatggacccagcatgacatgaagaaacttattccaacaaagggaaacctgcaccaagtcatcccagagaactttgcctactttcatgtagagttcgggctcgaccgtggatttgcccatgtcatagacgatgagagcaaattcagtgcaggttttgggttgaatgtcatcagagggatgctccagttgcgggaagaggacatgcacaggcgccgaaggcatgaatcgatggataatcagaaacaagctgttgctaatttcatgaaggactgggaaccctttgattggaccaaacagcttgattagatgtaaatacagtcaccagaacctctgtaagaacagccttctggaaattgtacgacgaatttttgtaggaaatgtcatgtcctgtattcatgttaacacatttgtttcttcacctgatactgaatgtagcttaaatctataatttcgaaattgacatcaaccccggccataacgccattaaaacatttgatcattcgttttatttaaaatttagtataaatatgtaaaagtttaggtttagattgtagttctaaaataagtcacaataaaataaacaatttttaaaattagatggtaccgtatgctaaaaaaccggagattgtaataaggaaggtgcgaggctggtacttgatcgcaacaagctggtttgagcggcttttcattctagttagtctgacgttgacagtttggactgaatgcattacttgcttgtctagggttgacgctataggctactactacatacgattcatcagtattcagaagaccagaataattcatcagtacttagaagaccagaatattttttccggtgttttgtccttgtaatgtcactattcagtttcgcatttcattcaaactggaaatcctatttgctatatgaacttttcattcttgttgatcctgtcctgaaatctgcacctaatcttttgttgccttatgttcgagcgaagcacgaaaagcaagtaggtgcagcatgccagcatcagcatgccatgccagcaacagcaagtaggtaggtagtaccaacctgtgcatccaatccaagctagcaaagttcatccaaaacaagcagccagtgcctagtggcactgcgattctgcaaaatcccaaacatgaaaaccttcagaaatctcaacagaattgaatggacatctgcctacctgcctacctgccttccctgcaatcttggttggttgctgatcataattcatacgaagctgaagctcacaggatcagtacacacgtgtgggttccatgagtcatggggaatgaagcctggtccgaagccaccgcctggggacggcgatcttcagaccggacgtcattcctctcaacagccatggatcatcatctcagaacttcagaagatccaaaaaaaaaatcatatccctgacaaattgatcatctctttctgtctttctgtatgtttcgtttgccatagcatgccagaagaggggactcactcgcctaaggcgagtattatatgcttagcaccagcagaacaaaaagatcagatgcgatattatgtggagaactgaacgcgacacaaaatctttttagttgagcacaaaaaacaaacaaaagcagcatcagcagcagcagcgcccgatcagatgctattcgcgtcactttcttttgagattggcgatccagccttcttcgccggtgaccgtgaaaaaaaaaagcagtggaagatcagtcgatgaatcatgatggctgttttatatatattcctcgtggcagcgacaacaacaaaattaaagcaacagagggagagagaaccatagcctgtctgttagtaatcaggtccatgacgttgaaatgcgaagtgattctcctgcaaagcgtggcaactttgtgactccacttgtgaattgatgatgatgaaatgatcatggaaatggtttcgattccaagcttagggttgaagctacaggctaaagaggcggccacgacacgacttactccctccgtcccctaaaaaataaatctaggactagatatgacatattctatgtccagattcgttgtaataggatgtgtcacatctagtcctaggttggttttttatgggacggagggagtacgttcgatcgatcgatgcgtggtgtggtccttcgattctcaaacaagataaggattaaatgcgcacgcaaacgacacaagtcattaccatattgattaattgaattttaattactaaaacttgaaaaatagatttatttgattttttataacaacttttatgtagaaagttttcacacaaaatacacagtttagcatttgaaaaacgtgctaatgaaaatcgatgaaaaatgggtaaagtttagaacggggcaagtggtcaaatcttgagattctttagagagagagagagagagagagagagagagagagagagagagagagagagagagagagagagagagctttttagctacttgtgaaagaaagggcactattatggaattataggattcttgttgcttgaggtcttgatgagctgagagtgtcaactacagtttttttttaaaaaatagtgtgtcaaactgtcaacttagaccatgcttttggtttttagattaatgcacatatttgtaaagaactgtagaaagatctttgacaatatagtgccatgatgtctatttgacaataaagatcaatctacatggcggtggaaagaaacaagactgatataatatggcagagaatcgacgtactgatcataatctagctttatatcctcgcttagatatgttggtcgagtttatatttgaaattttgtgggggtgttttatatctaaggtcgaaacattgattttttttttcataaatgcctgagttttttttatgatcttttatattaagcattattttgggttatgagggggacattcccttaagtactacccactccatttcataataactgatacggggcactatttaccttttaactttgaccacttgttttatcaatatttataagcactagagatgttctatgttattaacgtgggtatactctaagacataaacataaaactttgatcttgtaattcaagcacaattaatagtcaaagtttaaataagaaaatacaaatcgtcacttattaaaaatggagggagtaaatgagttttctcccatcattacgagtcaaaactcaaaagtaatcccaccgaaggattttctttaatataaaaataagagtaaatttcataaaattcctattatgatctaggttacacgaaaccataaggattttggcacatgacacataaccccgagtattatgatcttaaagttccacaaaacaacaccgttaatcattttgatatacctatctatcaaataaaaaagaatataatatttacaggatatatgatggataaagttttcataaatttgagatgcgattatagaacttaaaattatggtagatcaaagacaaaatgatcaatagcaaggctttgtgaaaagttagtaccataatatctgagattatgtcccacttgccaaaatacctatggttttatacaactcagatcataataggtgaggtttcacgaaatttactctaaaaataaactaacggaatgaattaaacagttggtattgggtaacaaaggcctggttggcctggtttagttcccaaatttttttccaaaaaacatcacatcgaaactttggacacatgtatggagcattaaatatagattaaaaaaactaattgcacagttaggggggaaatcgcgagacgaatcttttgagcctaattagtccatgattagccataagtattacagtagctcacatgtactaatgatggattataattaggcttaaaagattcgtctcgtgattttcagtcgaattatgaagttagttttttcattcgtctccgaaaaccccttccgacatccggtcaaacatcggatgtgacacccaaaaattttcttttcgccaacttacacaggcccaaaagaaaatgaaaataaggttactactattactattggcagtatggcaggcacgtatttttttgacttttcgatgaattttgtgagggctcgcacctgggcccttgatttgaaccaacagtagcaatcggacggcccatacgaattcaaagcccgcgtgttctcccgaacagccaccgccgccgccgccgccgccgatccatggcgacctcgacggcggcgcccaggcacagctgcgcgaagctctcggtggcggtggaggaccccaaggcgggcggcggcggagccgtcttcgtgaaggccacgtggcaccccacgcgcttctccctcgccgtcaccgacggcggcgccgcgtgggtcgcccaggcctccgacgccgaggtgcgcctccgcgccgagcagtgggaccagcccgtcgccgactacctcgccctcgccgagcgctacctcgccttccagcagccctcctccacctactccttccacgacgccgccaacggcaatcgaagggttcgttctttcttatccctttctttttttatctatatatggaagaatgctactgcttttagggcaagttggaagtagagcaatcgatatcatctttgtaactgtatggtaggattgttatttaatgctcacagtgtcacatttctctctcgcttacatgtgtatactgcaaggtccagcaatgtttgtttaggggcgaaacgacgcagtttgctggtaattttgtagctggagactgcatttagctcccgattgtagttcaccttcactcatccacgagtaatgcattcagtagttaatgttgattcttttacgaagttttgtgaagtatctgatctctatctcctcttttgcgctcaatctgggaagtaatttctgagcacgttgactgcggcgtaaagataatatttccccactctcttttattttttttttcacaatgcaagttgcttacaatctcttctgtttttggattttggccttaaggatatactcctaccaattagttatatggattaaattgtacacacccaattttgacgaagagtatgcttttatgcatagatgaactaaaatgcgaagaaattcctgtttgacattttatttaagtcggatacgaatatacacgtgttatctaatttttgtgctaactgtttctagcgttggaatggtgcctcatctcaaactttgcatataaaccaggatcagtctatcaagttattgtataatgatcacatcatgtaggactcagaatgcttccttctcttatattaatacataatgtttttaagacctcttaattgtttgagggttagcccttgcgcctcgacgatttactagaccctgattacttaaagtcactatctgttagggacaacatggattcccttgatgtcataatatcctaaatatgagcaccattgacgatatgatacatgattttcaaatggtgatgaaattatgttaaacacaagtagtactgctttacaggcatgtcttggtttatgaggagaccatttcatgtccttgcttgttttgtaccaaacacgtttttctccttttgtttcccgagttattgattatttatttttccatgtagctgtcatggacatttgagaaacaaggcaccaagttagaatggcgatggaaactgcagcctgcacctaacactcagcagactatagctgagatcttggattttcttatggatgcaaatatacgcttgagcgtatgtcactttccttttccattccatggatataatgctataatattttctatggaagtagtgaattgttgtcaagattccgatgaacttgattcgacctcactgcaacctaccaccaagtcatcttcatatatgatttacttgacctgaatgactaaactgttgccttcccttcatttttcaggaagaggttgttaggaaaacacaatcctttgacaagttgaaacaagaatctgagaagtgcttgcaacaaagtgaaagatttaacattgagaaagctgagttcgaacaatccacattttcaaaggtacattccctggtgtttgtgaaagacgaacatttcttgcagttcaaaaaatttcatcctttagccttgcttgtttgcatcatcacaaactattctcacggtgaacactatatgatgatattcacattctccccaattagttagctttgatattttgttccctctcgtggtcatattttgactttggcatttagtgattttctcattcagttattagttgactggaactcaagaaaactgtatattgagcttaccatagtagttctctactcactgttgtgtcatgtctctagtttgtggctgtcttaaattcgaagaaagccaagctcagacaactcaaggacaaactcacagaatttgaatctgctgacaaggctccaaaggaggaggatgagaactccactgataagacagagctttttgaggaagcaagtgacaaagatgcaagcgttaatgatgaaccctctgagactggtggcggcgatcttcatagctctcctgagaaaactgcagccacctccagaggggggaggggtcgcaagaggactagaaaatagcctgaacaagcaacctaactgctagactgaatatgacagtataacaagacctacatgcgaattcttaatgttaaggatatcaacaggacctacatgggagttcttaatatccttaacacttaatccatgtgatatccttaacacttaatccatgtgatgcatctgtcatgcaactaattttcatttcgtcaagtgtgtcaatcatgtaccttgtgaacatttaagtgcatgtggagctaaaccttgagtcctataattgccaagcttgtcttcaatgttcttcacgtgtttttggctgaggatggtgataatactgatggtggctgtactcctatagtttaatatgttaatgaagaatctatgcacaaggcagcatgtgctttgctcccataccatgattttttgcccctgcacttctcctccttttgctcggggactatttgaagtcaatgcaagcatgtgttttgcattgcacaatgagctcaaaatcatgtgccttttctgggttagaaaagaagcatcatcaaccagattagtccactagtttggctcctttttttgtacttaacttcagctaaaagttgggagtcgaaaatgtatagaagattatgatttctggtgtgttactctgctcttactcgttttctgcctgatcatgcgatggagccatccttactgttcatgcagcggtgcaggccttggatgagaacgtgttgataaaattgtacataagttgctgccgatacgatttttgatgtcacgaaaaccattctttcaaccgcagtttaatcttaaaaatatcgcaaattcgcagttcttcagcttgcaccagagctactgttcttcatccaccttttgttttccatgaacaaaaaaaaaatctcagcctttttttctcttgaaacaagtcacaccttttgcacgtccttttcatgcttggaaaaaaaacaaacaaagaaaaaggaatgttcgtttaatcacgtgtaaattatgcatttcaggggcagtcaggtccgcgttttccagtcaaagtttgagacttttccctgctttgcagttttgtggaccaaataagcgtttgcattctggaatccacgcggcaaaacacttcctgctgttgaccaccacctctcctcccatcggatgggggaagaagcggagaagccgagctgagcaagagggggcggaaatggaggagaaacggatcaagaaacagagacgacgaggtaagaaatttcctgctgatttgctgtggtttgttgcttgattcggtcttttcttttcctctacgagctctgatttagcaggttggttttgctgctgggtttcagtttcttctggtgattttggtttggttttctcgattgtttcttgtgttctagctgatgttatttttgacttttgagctttcctgattgggcacttcagctgcatgagtttttgcttgggagttgggaagactagcatggtttcattcttgatcagcttgaatcgaattttcccgagagaattttggtttcattcatcgatcgcttctgagaaccagagttcttgtgagaagagaggaagattgacatgtaaaactatggatgaagaccttctgtcttggacatatcaagattgagaatttaagattgttcagagagaaaaagaagggtgaattgaagaaccttcaatatgtcttatcaggggatttatctgctacctttaatttatctcttgggtttttgtttggatagttttcctcgcaggtcggcagggattttatgttaaccacacaaaatgcaacttttggtttcttgtttgcattcagaagagagaacgatccaaataatgcaaaatagtgagttttgaaaaccaataacacatgaatactgaagcataaagttttggatcgtttactgaatctttggatcattttctgagatttcataagaatattcaaggcatattgcttggaagaagatttctatcatcttattctcctgatttgcatcaccaaattggtaatcgacgacacacatcgttagaaggaattaagttattttgcatcaaaaccaacagctctcgagtccaaacatcagaagaagcttattggctccatggccatgggcagattattattatttttccttttatctttggatatcccatggtttttcttttctgtatcactctgctttatctttcactttgcgatgtgaagatgcctttccatttgttacgatttatgtgatggcttaccgctgatttttttacagaatttcttggaggaaaccctgttacaggaggggagacatggagggtgtgtttagtgcacgctaaaattggaagtttagttgaaattggaacgatgtgacggaaaagttggaagtttatgtgtgtagaaaaattttgatgtgatggaaaagttaaaagtttgaagaaaaagttggaaactaaaccagaccaaccaggcctcagacggttcgtcagagatggaattgctgagtccctactgttgaggtattttctgaccctgacactggttttttctgaaaatattcccattttccctcttggattgatgcttgcttggatattgctgtgcttaaactcatcctgttttatgcactagactagcccccccccccttttttttaaaaaaaaagaatggtttaggccatttatttagttgcacttgacacttctggttattgtgttttgcttatttttaagttgatgtgggaatacaaagttataatggttatagtttgtctaacagatcaaatatcaacatcgttcaacataatattattgtcgttttgcaacatagattaaaagaaaagcaattcatcacacaaaatcttagagcaactacaccaaacaaaaacaagatttggagggagagaaaattgtgagtgagttaaggattgaacacggtaccttaaaattacaaccacacacaccccttaccatctccaactacaccaaacgaggttatcgtaacccaccgcaaaccaaaacgaagccttaaatgcttttaagccgcgtgcttaagaacttaatcgacgagagctaaccaagaaatcactagcccttgaccgctgaacactgaacagcattcttggccgtgaaaggcagggatttttattttcgaagctcactgaacactgcacaactagcggcataggccacagccatttcgatttataacgagttcacccaagaactcaactggaggacgccaagaactcaaccggaggacgccgtgttgctgactatgtatgtgaagccgatgcgcgccggcggcgccgcaaaaatttgcgagctgcagccgatggtcaactgcaaattctgtcgactgaaaagctggtcagataattgccgacatataaatatagtaacaaaaacttatttgattgatttctttcaaaaaaaaatataacttgtttgatggacaaatggccacataccttttacttttcaaagaaaaaactatttcaatataatttaaaataaatcatcttataattttaattttagatctaaatcttttggctaaactaatggtgtggctgaatcatgttcccagcatggctgaaaaccatgatgtggcaaggtatggcaaattttgctacaggacactgcttatgtgtggttttatccctagaacactgctcaaacccacttttggagaaaacactccataaacatggtaatttgacagtggacaccgcgctgattaaaataatactttctggttgaagaggagagagaaatcgcgtgaaatgtcaaaaatacccttgggcacacatgtcagctctatctcctatctctcttctcatctctctctctctctattctctctcactaccagaggcgcacggggcggcatcggcgccggcgaggctggaggtgcttgagcagatggagccatgggtggagcagcacttgctgccattgctcaagccagcggaggaggacgaggcggcatcggtcgtggcggagatggcgaggacagcggcgaggagcatctcgacgacgcgggtgtaggcggcctcgtggcgctcttgtcggcggcgatggcgccgcagatgcgggcgagcgcgtcgtcgccatgggcgcggacgttgcgtgccgtgttgccgcggtggcgcgctcctggaaggcgacatagctgaagccgtggtcggggctcaccagcgcgtgcatggccatgccggagctgatcagccggtgcaccgtgcgctccacctggcgcatgtcaaggcggccggagaggtacatgtaccggttgagcacgtcgtcgtggtggttctcctcggcggaccacctgcagatccatcgcgcccatgccgtcccgtcggcgccggtgacgtcgcgcgccgactcgaaccggttcaccatgctttggtacgtgggcagcgcctcctccgtcaccatgttccctaccaggcacactaggtgcgcgtcgggcacgccgcgcagcgcactcccggagctcaaggcacgccgcgcagcgcactcccggagctcaaggcacgccgcgtggaacccgtccgcgccgagcgccgccgcgtcgggcaccatgtcctccggctgccatgcctccttcgccggcttgagcagcaacagcacatgctgctccacccacggctccatctgctcaagcaccaccagcctcgccggcactgacgccgcccccgtgcgcctatgagagtgagagagaatatagagagagatgagaagagagataggagatagagctgacatgtgggcctaagggcatttttgacatttcacgcgatttctctctcctcttcaaccggaaagtattattttaatcggcgcggtgtccactggcaaattaccacgtttatggagtgttttcccccaaaagtgagtttgggcaatgtcctagggctaaaaccacacataagtagtgtcctgtagcaaaatttgccggcaaggtattggtttctagaataatttttttaagatctatttatagaataagatttttaaaaggaccaaaagttaggcactgattagttcccaaaacaaaaattttcatgctatcacatcgaatgtttggacacatgcatggagtattaaatgtaggaaaaaaagcaattacacagattgcgtgtaaattgcgagacgaatcttttaagcctaattgcgccatgatttaacaatgtggtgctatagtaaacatttgctaatgatggattgattaggcttaataaattcgtctcgtagtttcttggtggaatctgtaatttgttttgttattagactgcgtttaatactttaaatatgtctctgtatatctgatgtgacaaccaaacccaaaaaattttcacaactaaacaagggctgtgtttagttcacaccgaaattgaaagtttggttgaaattggaacgatgtgacgaaaaagtttgaagtttatgtgtgtagaaaagtttaatgtgatggaaaagttggaagtttaaagaaaaactttggatctaaacacggtgaagaccttaaagaaaaattcagctgacatgaaccttagatctctcaccagctgaggcggcgcagcatgcaccgcgcacaagacggccggatccccgccttgcaggggtcgcaggcctcgtgaccgcgtagctccggccgcgcggtggccgtttgccgggtgggtatccccccggtcggcacacgcgcgtcacggtgaaacgcagcgcggatcgcgtacgtgaaaaacccatcatatcctttcgttttttgcacgagaaggaaggagggccgcggcctacctagcttcctcggcgtaccgcgcggcgacgcttagcttttcagctcacctctcctccacccaaccatcgaacgaccgagtcgcttggacggcacactccgctagctctgaccgcgaccagtcgttcgtacctggctacgtactgcactccattctagtactgtacgcctgtgtaccgctcgtgtcgactaacctacatgtacgactgcttgatgagctcactatagctagcaacaccaacacgtatgcacgcgcatatagtagctttcgcacgggttaattgattaatccttaattaatcgcgtcgcctgctggtcttgggtcgtcgtcttggcacatgtggtcttgtagaagctactacatgaaatagcagaagctatttttcctccccgcgaccaccggtcgacgctgcattgttggcacgtttgctctgtcccctggaatttgcaagagcaccttctctgcttttttatcatgcggctggtattagttgcaggtgagcaccggtttctctagcgaagctgcttactggctcaaccgtcgtttactcatttgatcaacagagggatagtggatagctttttattagccctgtttggaacagaaaagtattctgtacgatttttttttggtggggtgtggggagggggaataaattaatttctagtaataaatcgggaaattgctaagttcaaaaggggcttggaattcttctctcccttttttttggaatatagtctttttagaaataaaccgggaaattcgtagttgaaaggagttttgaaaatttgaatgctacatgaaaatcttctatatataaagtcattttcaacaattatattaattccattggaaatatatacgatctcataatttatcctgtttgtgtcttacgacttctttggggggtttgccaagttgtcgtgttattttaagttcataacctcttcttatgacgattctcaattcacgtggctttactatatgctgttttcaatctctaattttctatatcattattaaacatgtgcctgtgagttttttagtctccggtccggtagtatagaggaatttcatttgcctgatagacaaattgcgatagaaattacagcacagaaggaggaaattgttatacaatttttttgagcacatgataaacaactgagagactacgacaagttaacacacgaggaggctatcacggggaacacattgtaataactgaataattggaatcactcatcactcatgactttgccttgaccatttaattaagccttgatttatataaacagcattatcagagtatcagtccataactcctccatgcatgcatccatgcacatgctaaaaacatcctcaaggtattttataaaggtcctaattaattagtaaattgaaaggtacaccttgtcaacagtaaactaaccacttccaatagaacccccaaaaaaaaaacagcacagtaaccactctatgaacaatttagaagtttccataggtttctgtgccgccaaaaaaaatggtgtgccggaaggagaagattcagctggtccaggagaagtctttactcgtcattagctcttcaaacatcgcactagcgacagcgtgtggtaaaatcatttgacgtgttgattaatagttgggatgctgattcaagttcacatttgtgtgagcgtctcctgttcaatctactcgttgcttgaatttttcccccttttgttcgacagtcggagaaatactattttaagtgtattgaagggagaaaaatacgccaacatgctaataagataatcatgttgattagttgcaatgatgccttgaaaatttgggatccctttcatcagagaattgttaattgttgttgaggaaaattgcaggaatccctctaaacttgaagtacagtgccgaacaagtcccttgaactttaaagtaaatttgaaaatgtataaaatcaacaataaggttcaattagatctcaataagtgtttgcttagctaaaagtttggtggtataccttaactttcttccttctgttgaaagtatataccaacaattatttttccttatgtccccgcaaaagaaaaaaaaacaatttcttccttctgtttactttttgattttttttccgagaaaaaagtactttgttatcctatttcattgcaaaaccaggattagagcactagcctgccaaattttcttttttttcttaagaaaaagataatggtttgtcaatttactgtatttatacatttaaatgcatggcattttgctaccataattttagctgtcatccacggtattcgtgtggttgcaaagcagaggcctcattgattgcccaagagcttattatgaacttattagcgattaaaaaaatattttttaaatctctaatacatatgtacttagcgacttaaaaggcaatgaaaaagaaactatgttaaaaatatcttaaaatcaagtttaaaattaagtttcagaattagcatagagaaaatgtgtgttactctatatacatactgtaaatccatcatgtaaataccgaatctgtaagggtctaatccgcgaaaaagcaatcaacgcaaaacttcccaatcaatcggcctcctacgtggaaccttctctgcctgccgacgtgtacagccgcaagctgacgtcacacccccttcaaaccgcgtagccgtacccccctccgtttctaatcccacgtgctcttttgcatcccaacccctcctcctccgaataataacttatttatttattaatcattttttcatcatttgaccgcccggttttagtagccaatcccactcgcctcacatttgcgcacacggctattttgaccacgtgacccaaaaaaaccacacgtgaacttgttcttccattttccgcccccgcctatttatatcccgcgttcgaatatttcccgggaaaccatcgccaaccatcacatctgatcgagaacaagaagaagaagaagaagaagcaagaacagcaagaggaagagatgcaaatggagtcgtactacggcgcgttccacgccgacgaggccgcgttcttcttcccccaccacgtgccggcgtcgccggagctgccgttcggcctcattgcgtcgccggagccggagccggagccggagcaggcggcggcggaggcgaggcagagcgcgttccaggagtacggcggcgcggtgcacgccggagcgccggcggcggcgggggctgtcaccaccggtgggacgaacatccaccggagggtgatggacgtgctgggcaggatgggcggcggcggcggcgggggggagaagggggagggtgaggagatggaggaggaggaggaggtgccgcagcggcggcggcgcgggcagggcgccgacgtggagagcagccgcggtttccgccacatgatgcgcgagcgccagcgccgcgagaagctcagccagagctacgccgacctctacgccatggtctcctctcgctccaaggttcgtcggcctcctctgctcacagcctaagcttatcactctcacttagtactctacttcacttcgccgctcacttcatttcaagctccatttcatctttcacctagattccatcgagaaatgcctaatgtagactgctaatttggccttctttaagctcagattttcgtttaccatcgcattgtcccatttcattggcttcaatttgcctcttcttgatttccccaatgttaatctgaaattcagagcatcttcagctcaaaccaattctgttcagcttcagaatgttcgaaatccccctttaatacctcttaaatggagtgtttaccaaaatcgggctgacaaaaaaccgttcgtgtcactgcagggggacaagaactcgatcgtgcagtcggcggcgatctacatccacgagctgaaggtcgcgagggaccagctgcagaggaggaacgaggagctgaaggcccagatcatgggccacgacgagcagcagccgtgcgtcacgctgcagttcgaggtcgacgagccgtcgccgtcgatcga

SEQ ID NO: 5928 - DNA, 1142 bp, Oryza sativa
tcaaaactcaggagtagtgggtatttttgtctatatatgctttgtagaatagaaaaaataacactgccatgatacgacgattaataaactatgctgttatagtacaagaaaccttaaagcacacttaacattctagaataaccatgtcacaactacctacaagtttcattcattatactactgcacatatagaacagcactgagttttggtagtaaccgtttgtgcatcatgctatactcacaagagattaaaaccaaattggaaactgttcgatcacaaatctggggaaaaggggtaaaacttttggtacctcatgaagaccagccaaactttttcatggcatccttggttctcttccggagcctcatgaacacaatgaccatgcaagccagtacccatggtgggaagttcagattgccgagcttggattccttaagccactcgggcatcttgccctccttcagcaatactgcagcaactgctgtcatagctgccacaccaatcatcaccttcgtgacgggcttcagcaaagaatcctaaccaaccaaccaaacagaccaatccatcaagtactcacatgatcacatcacttcgactacctaaaattgagcgagccagagagagccaaccgatccgtaaggcttaccttgggctcgccgtcgaggaagatggtggaaccagcgacgtaggtgaggagggagcggccgttgcgggggtggaagcggatggcgacgccgcgggtgcgggaggcggggtggaagacgaagacggacttgaggccgtgctgctccaggatgtcccccacctccagctggtcctgcgtgtacccgcccagcggcgaccggaacacggccaccggcccccgcccacgccggaacagctgcacctcgacctccggcttggccgccgcctccgatccaggcttcccgctgggagccggtgccggtgactcctcttgaatcgcgtcgtcgctcgtctccgctaccgacgccgccgctgccggcgccggcgcggcggccttgtcagcttcggactccatcggattgtttcgatcggcgactcagggttcagaggcgaaaggatctgacaacctggtgttctgccgtctcctgctttggactgcttgccttatcaggcagga

SEQ ID NO: 5929 - DNA, 1450 bp, Oryza sativa
  unsure (1)..(1450): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatactcacaaatttcaaatccgataatggaatatctgtggttttcagttcttttattttataaagttagaatccacgtataacagacctttaggctcttttatcgtagcaattgtctcttactctgatgctcatgcatgtaagagcatgtgacattatcaagtttttgcttttgtaacactaacaaaaccatgttccagtttacattcaaatcggtgaatgtattgattggatttgcgtgttcattgttgagtttgtagtgaatattgaagaaatctgttgatcaaaagattttatgtttatgttgtaaaatggaaataaaaaaatgtgttctatttctttactattattttaataaaaacagaagtgaacgaggtggttttttaaaatgcgaatactaagatttgaaaaacgtgtcttgcatactagtatgttctataagggactctcattgtaatgaagtattgatagggactctaatcaggcctcctataaatcgttattgatttgtcaaaatatctctggaaaagaattactactacctgccggcgatcacaacaccgatttggacaggttttattgtttgagcacgacgcgaaatctaacaaaagctgctccacacgaacactgcttgtagaaaatgacgataaattcacaggctcacagtgcagtggcccatctctttggacggagagggccaccggagacaggaaggcagaaagaaaaaatggcgataggatggcataggtcacagagcctggcgtctgcagggctcgggctgcacgtcctcctctgctcgtcgttgctgctcaacgccgtcttcatcgcgcaccaattcctcggggcctcaccgccggcaacgccggagcggctcggcgacgggctgagctgggcactgcaggcggccaaggaggccgaggacgtggccgccgtcgactgctccggccacgggagcgtgttcctggatggcgtcaccggcgaggacgggcggcccgggtgcgagtgcaacagctgcttctccggtccggactgctccgtccgaatccccaactgcgccgccgacggtcaagggtaatgactggcctctcctcgcttgctcgtgctcttnnnnnnnnnnnnnnnnnnnnnnnnnnnnnnnnnnnnnnnnnnnnnnnnnnnnnnnnnnnnnnnnnn

SEQ ID NO: 5930 - DNA, 2013 bp, Oryza sativa
gactactatagggcgaattcgagctcggtacccatgaagaacttgaaaattttgagagaaacaaagtttggactttagttgaaccaccttctggacataatattattggaaccaagtgggttttcaaaaataaacaaaatgaggatggtttgattgtgagaaataaagctagacttattgctcaaggttttactcaaaatgagggtttggattttgatgaaacttttgctcctgttgctagaattgaggcaattagacttttgttggcttttgctgcttcaaaaggttttaaattgtatcaaatggatgtgaaaattgcttttctaaatggttttatacaggaggaagtttatgtcaaacaaccaccaggttttgaaaatcctgattttcccaaccatgttttgaaattgtctaaagctttgtatggtttgaaacaaactcctagggtatggtatgataggcttaagaactttttgcttgcaaaaggttttacaatgggaaaggttgacaacacactttttgttcttaagcatggtgataatcaactttttgttcagatttatgtggatgatatcatctttggttgttcgactcacgctttggttgtagattttgctgagactatgtgcagggaatttgagatgagcatgatgggtgagttatcgtactttttgggattgcaaattaagcaaacacctcaaggtacttttgtgcatcaaacgaagtatacgaaggatcttttgagacggtttagatggagaattgcaagccaatttcaacaccaattggttctacagctgtgttggatcctgatgaagatggtgaagctgttgatcaaaaggaatatagaagaatgattggatctttgttgtatctaactgcttctagaccagacatacaatttgctgtgtatttgtgtgcacgctttcaagcttctcctcgtgcttcacatcgtcaagcggtcaagcgaataatgaggtatttgaatcatacacttgagtttggaatttggtattctacttcatcttctatatgcttaagtggatattccgatgctgatttcggtggttgtagaattgatagaaaaagtactagtggaacatgtcattttcttggtacatcgttgattgcaaggtcttctaggaaacaatttagtgttgctcaatcaactgctgaatctgaatatgttgctgctgctagttgttgttcacagattctttggcttttatctattttaaaagattatggtcttacttttgagaaagtacctctattttgtgataatactagtgctatcaatattgctaagaatcctgttcaacactcacgcacaaagcacattgatattcgttttcactttttgagggatcatgttgagaagggagatgttgaattgtagtttttggacacaaagttgcaaattgctgatattttcactaaatctttggattctaatcgttttgcttttcttcatggtgaattgggaataattcatccttttggcatggtttgagggggagtttgtacctcatggttttatcaagcaataatatgacaatgaaaaaattgataaaagagagctttggttatacatatggtattttcttgtgcatgctagcaatactttgaaggtttatttgtctctagcatagcttgtatgtattctagtcttttcataagatttagattttgcttttaagggagatgatgcatgacacttaaattctacttgaattaagaaaatatgcaatgttgatgctagcatatggtttgatttataaatgctctatatatatatatgctttattgacttgttattcctcaaatagctttaattgctcattgtgaaaaagagaataaaaaatatgaaaaaaaatgaataccgaatccttggaaacagtcttgacgacaaggacgtattcgatgtgagcaaaataatgggtgccgaatccctggaaacagtcttgacgacagggacgtacccggaataaaagaaaaaaaatatgagcaaaa

SEQ ID NO: 5931 - DNA, 756 bp, Oryza sativa
  unsure (1)..(756): unsure at all n locations
ctaccagatccacccaccatggccactatcgcaaatcctcatcttcatcaaccggttcgtgctgacgctccctatcgtgcctgctgccaaccctgacgctcctcgttcgtcaaggtagccaagcgcctcctctctacgtgtaaccccatgcgctacaatgtccggccatggattgggtcgttggtgcacaccgacggccgccaccattaccggcgctgctcaggagagagaagtcgaggaggctggtcgagctaagtgcgctgctcaaggcctttacgttgttcgggccgttcagattggaaatcatcaacccgtcggtttgtcatgcaatttcctcttgtcatggtctcacctggagaaaactatccgtgtgtctgcgtccgtagtgggcctttgaagtaaacacacacacaatcaacgataccaactgaccacaacagttgggcaaatgagtggtcgagggggccatcaaccagaccggctatgtttcagagagtgattggcgaatttcgtaacatatactcttaagagtaaatatatttttacttataatacatatttttttataaaatatatatgatctaaggcgatacaaataatcattactaacatgattaacacctaaaattacgatgtaaattaaacaacaagaacaaaacaaaatcctatcctaattttcaaactaaatagatggggatgagcgnnnnnnnnnnnnnnnnnnnnnnnnnnnnnnnnnnnnnnnnnnnnnnnnnnnnn

SEQ ID NO: 5932 - DNA, 1173 bp, Oryza sativa
gtgataacatgtttggttgctaagtttgataaagatgtgatgttttggcatcgtagacttggacatgttggttttgatcatctcactaggttaagtggtttggatcttgttcgtggtttgcctaaacttaagaaagatcttgatttggtttgtacaccgtgtcgtcatgctaagatgattgctttttcacatgctcctattgtttctgtgatgacggatgcaccgggacagctattacatatggacactgttggtccagctggagtgcaatctgttggaggaaagtggtatgtgttggttattgttgacgatttttctcgatattcttgggttttctttatggcaactaaggacgaagcttttcaacactttcgtggtttgtttcttcgatttgagcttgaatttcctggttatttgaaaaagaattcgaagtgataatggtggtgaatttaaaaatgcttcatttgaacaattttgcaatgaaagaggtcttgaacatgaattttcttctcctaatgttcctcaacaaaacggtgttgttgaaaggaaaaatcgtgttttggttgagatggctagatcgatgttggatgaatataaaactcctagaaaattttgggctgaggcaattaacactgcttgttatatttcaaatcgggttttcttgagatgtaaacttggaaaaacttcttatgaacttcgatttggacatcaacccaaagtttcacatttgcgtgtttttggttgcaagtgctttgtcttgaaatctgaaaatttggataagtttaaggcacgttctaccgatggattgtttcttggttacctcacacatactcgtggctatcgtgtacttattttggagactaacaaaattgttgaaacttgcgacgttttttttgatgaggctagtctaggtactagacccgacattgcaggtacactgtcacaggttcagggggaggatggtcgtattttttaagacgagagcgatgacaacgacgacgacgaggtcggctcagctggtcagaccgggcgccaggccggtccgaccgccggcacacctccggacagaccggcccatgaggagcggtcaaactggccaggttcgtcgggttccggtactgttgatgctgatcgagatggacctccagagattacaacttcgaccagtactaa

SEQ ID NO: 5933 - DNA, 600 bp, Oryza sativa
  unsure (1)..(600): unsure at all n locations
nnnnnnnnnnnnnnnnnnnnnnnnnnnnnnnnnnnnnnnatcaacaattccaaggggcgatgcagatgacaggtggatgtgggtggccacactcccatacgcacgtaatgtagcggtgtactaggtgtgagtgtgaccggtgcagcttactagtactactactagagttgtactacgattccaagcaggcaccgtcctcgatcgagtgcaacgcaccgaatcttcccctcgataaatagccttctctgtacacaacctggtgttccatgaacaggtatatattttttcaagtgaaatgtactccataatgaagtatttcctggagtagtatagaatataatgaagtatttcttccattccaaaataagtttaattgaaaagatgtacttcctccgtcctagaatatagagatactactagagaaacatctttattgggttgaccaaaaatcttttttttctcggttgaaaaacccaacgccactttgtcccgggtcaaaaagcgtgcgaccccttactatttttagnnnnnnnnnnnnnnnnnnnnnnnnnnnnnnnnnnnnnnnnnnnnnnnnnnnnnnnnnnnnnnnnnnnnnnnnnn

SEQ ID NO: 5934 - DNA, 798 bp, Oryza sativa
  unsure (1)..(798): unsure at all n locations
catctttattgatagataatttctggttacatcatcaggaggtattctacagaaaataagctctactagtttagcccggccaccatgggagaagcacaatttcacaagctggctgctctgattaccaaataatcaagtggtaatttttcttaaaacatactgtacttgaagaaagtaataggtagagatgatgacgggatttgaaccccctcacaggcagtcacagctacttgtgtactgttttggacacagtcggcaggagtggcctcctttgtagtagtataacaccaacaagtacgaggatcttttagctttgtccgagtctgcaactgcaagcaagcgaggttctggtcaaggaaacagtacacaaggaaacgatgaagaacgaaccaaacaccccccataaatcaaccagcaaaccgagagaagaagaaagaaaaaggaaaacagagaggcaagaatcacacatcaactgaacggtgcgacgttgccatcaaacccaaccgtgcgggcatgcctggcgggccaccaccacccacccacccaccccaactcgcacacgcacacgcacacgcacccgcacggttgggtttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5935 - DNA, 10190 bp, Oryza sativa
  unsure (1)..(10190): unsure at all n locations
cttattaggcgaaacgatgggtcattaatatgcgcacttgcaagttgcaactgcatgtatcatctggagtttattttgccgggatgtgattgaagtttcagttttttagtttgaacctcattactactcagtgcttaatactcttttcattctaggctattacaatctaatataggatataatacaattcataatactataagtattatagtgtgtgtttgattgctttattttaaaacggaggtagtactccctccgttttttaataaatgacgccgttgtcttttgaacatatatttgatcattcgtcttattaaaaaaatatgtaaatgtatagatataaatcatgcttaaagtagtttgagtgataaaataactcataacaaataaattataattacgtaaattttttgaataagacgaatggtcatatgtgtgataaaaagtcaacagcgtcatctattttaaaaacggaggtagtaccattttatcatggaccctaatctcttactactcgtttcactactagtatttgtcagtttcaggtgctttggtttgattgctacgtcgtcttaatctacacatgcgtacgacaaatgttgtgggccattttctattcatcgtgggctacacaaactaaccgttcatttaaccggagaaacgatgcctcccgggcctatcatttcggccaacgcccacccgtgcaaacccgcctattcaggacgatccagacacatcacatgtggccccatgcttccatcccccacgcttccgggcgcgcctcctttttgtcttaaccaagcttccccccgcgccattaattaacgggcaagtaatttaattattaccatctctcacagcctaaatcgggggccgcgtcctcttcgggatcccgaaatagtaatttactttcccccccccccccccttcccgatccatcgcacgctacagcaagaaaacccccccaccgggccttcgctgtcgtcgatgaccagtgggcccgcgagacaatctagccgttcttcatttttttcgctttcctgccacgtaaaccgacccgtgggatatctcgcccctttttctagtatttttttttcttttcggtactccacgctcgttctttcgcttttcatccccttcgcgtccgtttcttccctttctccccccatttttctacctcccttctccatagctcacgctccttcacgcacacgcctcgctcgcgcgcgcacacaggggggaggaggaggcaggtcggcggcatggcggtggcgagctggagcattccggcgatcccgcgggcgggtccgacagcgaggggtgtgctgctcggcggcgccttcgtgacggccgcgcggccgcccgtggcgtggcggtgccgggccacgctccctaggagagtgaggctcggtggcgtggtggcccgtgccggtgcggcggagacgccggtggccggctccggggaagccgggttgctgttctccgagaagttccccttgcgccgatcccgaacggtaacttgttctgctctgttgttgtgatctgcggcgaagctatgcttcgttgttttttttttgttggtgatggggtctgtggtgttcaggtggaagggaaggcgtgggtgagggtcgatgcggagccggatggggagggcaagtgcaaggttgtgatcgggtgtgatgtagaggggaagtgggtgctgcattggggtgtctcctacgatggtgagcagggaaggtactcgctgattctctctccgagctgtgtctctgtttgcatgatttatgaactatgagtgcatccttgttttgatcatccgtggggagttgatttgtgcattgttgagagcgtcgtttgaatcaacgatggttgtcagactggcaggtatgtcctcatggtaggctgctttccatatctatgtagcctcaccggtccagtctaagcacttgtatatgtatatagtgaaattactgtcaagtgtcaatgcaaccccttaatctttatttggcttcgattagaggaaattataaacaggttcattatgaaaaattcttacaaggtgggtgccattgatttatggctatacttggaaaatgcgcgcgaaaagagaattttgattaggtgacggggtagtgccgtaaccatgtaggttggctcttatcctgtttttcttttttatttggaatttcgatatagcgttgaagcgcgaggtgattagaaataggcatatctgcaagataggaatgataagttcttaaatttcaattgcaggttgcccggtgttatgtctccttatctcctttggagttgtcttgatattccaatattctatacgttacttaaatggcacgatagttttgcaaggaatatttagaattaatatttgtcatatcttttgtttttgtatgtattcaagcttcaacatacatacatttctccccgcaaaaaaaaaagaacatttctgtaaaaggcaaaaaattgaattttgtcgtctttcagatttagttgttgctgtaatgtccttccttgaatgcaaaaataaatgatctagctcctgaaatatatggcattctttatccttatttagtgacccaatttattgttatcacttgtttctataattttttgcagagaatgggaccaacctccttcagacatgagacctcccggttcagtgcctattaaggttgttctaatcctatgaaaaacatgttaaagaactcactactgacattcacatcccagggatctctaagtttgtttgatgtctgagtcgaaagctcgttgcatcctgtagccatattttttctcatttgatcttcctattgctgaacaatatttcaaactttcaggactatgcaattgaaacatctttggacactccacacaattcagaaggcaagacgattcatgaagtgcaaatcaaaattgataagggcacatcaattgctgctatcaattttgttctaaaggttcaaattttacgctgctgtatgctttctctgctgtcagttttatttcctaggcattctgtaccatgtgtcaaaaggcctagaagtctacgactggcccattagattcgtaaaattgctgaaagtgcctaaggtgggaagttgtcttcccattttttagttgtctaagaaaagaataatatataacccctacaggtatatntgcaaantaaagtattgggagcggatatantaaacacatgccttttagatntatagattagttgttaaatgcactactctttcttttaattatnacattttggaattaatttttngannngaaggtnnngatgcactttgcagggtntagnnnnngnnnnngggngnttggtttcagcacaagggtcaggatttcagaatacctttagtggatcctttggtggagatctactaggaacagaacaagatattgatgtcaggccaggttaggaagtattttagtgaatcatgttttagattattactatagtggtttggcactttgttcttttcattggttggtttttatgttatataaaaatgcatttccttctataagaaaataatcttatttagggttaaaatcttagtaattttcataggatgcttgatcatgaatattaccacattgaaaatttaccccatttgcacctttcatatttcagttatctaacatactcacatctctgatttcttaggggctttaggtcacctatctaacgtgttacagaaacctgagggacctattgctgagcctcataaaactgtacccgatgataaaggttcaagaaccaaacacatttcaggtttctatgaggaatacccaatcttaaaaacggtgtatgttcagaattttataactgttaatgtgagggaaaacaatggaacaactaaacatgctgtggaattcgacactgatattcctggagaagttatcattcattggggagtttgcaaagacaataccatgacatgggagatccccccagaaccacatccacctgcaacgaagatattccgacagaaagctcttcagaccatgctacaagtaaggaccttgatcccttggtagaggcaaagaaatgacatttaattgtatcaagctaaagtacaagataaatgtacttacaagctgtgctatataaaaattaacaagtaaaggtgttctggaaaagtaagtcaggctcatttgtatttttggtatgtcctgattctatctgcgctccaaaaacagggaattgtatcatttgcacttcttaggttgtctgaacttgaatttaccactatggcatatgcatatgtggtaaatcatgaaagaatgctcgctatagaaaaataaaaaaaggaacattttttaagtgtacagaaatgatttcacttttttcttattgcttaagaaaagtttaaaactcttctttgttttcctttttgaatggtaccttcaaatgatccattattaagagggttacttttagtctccctttgatcaggggaaatgtgcaaaactttatatcaagattcaagtcaacattttgaaaatctgaaggaaattgtgaagttctttgtttgtctccctactccattaccgacagactggcttctttttgggtttgatttcttcctttactagtctagtgagggcaagcattttcttatcagcaattctctttcaacaatcctacatcttcaatgtaggtgctgttttttggggatattttggtagtagtacactatgttctctaaaatcactgaaaatgcctcaattgatgccttttcatttttcaagatggttttgtattaatgttttcaatagtttcagctgtgggaaatcagttaagtatcactcttcacacatctcttatcatactgcagcaaaaagctgatggaacaggcaactctctatcattcttactggatggagagtattctggtctgatttttgtggtaaaacttgatgagtatacttggttgagaaatgtggagaatggatttgatttctacattcctcttacaagagcagacgccgaggctgacaaacagaaagccgatgataagtcttcacaagatgatggcttaatcagtgatataaggaatctggtggttgggctgtcgtctagaagaggtcagcgagcgaagaataaagttctgcaagaggatatcctacaagaaattgagaggttagcggcagaagcttatagcatttttaggagccccacaattgatactgtagaggaatctgtttacattgatgactcatccattgtgaagcctgcttgttctggtactggatctggatttgaaatattgtgtcaaggatttaactgggaatctcataagtcaggaaaatggtatgtggaacttggctcaaaggccaaggagttgtcatcgatgggtttcaccattgtctggtcaccaccacctactgattctgtgtcgcctgaaggatacatgccaagggatttgtataatctaaattccaggtatatctctgtgtgcacaattattgtgttactttagtaatgttttctatgaaatttgaaatattagtaatattggtgctaagctggaagtttacacttccgctatctacaaaaaaatgagatgggatagttggtaagttagagataaagctagtaaccaagttagagctaagatggtgctatgctccagcttgttttatgtaaagccatgctgtgtacatgagttgattatgatggataatcagtctaccctaccttaagtttccttcttctccgttgccaaagcttcttcctccttgctgtttccaaaccaatctactgctaattctccattgcctacctcagctaaccttctacaatctagcatatagcacttgtgctgaagattttagtactacgctatctagtagaaacgaaaacctgggtagcatatgaaattcacatatggattctaaaggagaaaaccccttttatacccctaaaatctctattaaaggcactattactgctgcagtagcttgttgttcttctatggttaacactaccaccactatgcaataaatatttatatgtcgcttgaggcatcacttgtccactatgatgcatggatacgcgatactggtacggcgatacgagattttttaaaaaacatcaatacgtcgatacggcgagtatatataaaaatatgtttaaaaataaaatatagggaactacaaaagggtaaagcaataagattatcttaaaatatattctatgaattgttgcctgttacaaaaaatatagcaaatatagccttgtattacaaatatagcaagtatattaaagttataaatatatcagaagtatagcattgggtctttaatgtgctattgaacaaggaggttacactgctaggtatcaaagaagtatctgataagtatcgtgtgagtatcggtatttattttttcttttttttccattgtttaatgaccgatactcctccgataccgtatcgacagagtatcggacgtatcgccgtatcggataccggtacggcaagaaattgaagtatcggtgcatcatagcttgtccagaaaactggctctcatcctacttgattttgactacccttatgaagcttcttagttgttgtcttccttgtttccaaaaaaaaaaaaaaaacaatgattttcaaagggaaaattatgacactgaaagatctatgcctttatacagcataatagtatgaacccatcatgtcagctcatgccattcattaatatgatatcatcaatgtttcagatatgggaccatggaagagttgaaggaggctgtgaaacgttttcatgaagccggtatgaaggttcttggtgatgccgtcctgaatcacaggtgtgctcaatttcagaaccaaaatggcgtctggaatatttttggtggacgccttaactgggatgatcgagcagttgttgcagatgatccacatttccaggtgaggttccaccttcccttgcaaactatttaattagaattatttgaaaatgtcattcatgaatgttcattatgttaactaagtatcacaacattatgattttcttcatgaactgctggtttcatttgcacaaatattttcctccagtggagcttgataaagttatgcgaaaataagcttaatttaaccaacaaatgatgcttggagatagtctcattgagtgacctacaaactttgatagactccaccttttcaacttgcatacatttagtattggaagtaaacacagattagcatccgaaataacatagaaattgacatagttccaaaatggaaaaaagacatactcaaacttcagcagccatgaacattgatcaatcataatattgttctacatgcctattccatttcattttacttaacaatgcactatgtgatgtactagacttactttctaatttttgggtaaaactatatgtccttgtagggaagaggaaacaagagcagtggagataacttccatgcagccccaaacattgatcactcgcaagagtttgtgaggagtgatcttaaagaatggctttgttggatgaggtatgctatcttgttttttcttggctaaaactccttttgttgctcatgcttaactatatatgtgtattccccatgcgaagggttgtatgttatagcatccccatgcaacagattaaatagatttgatgtacatacattgtttctggatggcgtgtttagctgagtgctagttttctttcctcatatcacattcttttcaaagctatgttttcatatatgttagtttaccttgctcttaccacaaaatggaatgtacacagtgcacatcctcatcaatatcacaagattctttttcatgctacgataataggtatatattgtaggctgctaagctcctataataacaaactggattggacaaatgctacacctgaatatctgcaaattgtcatgggttccaccatatatatatgtatatatatttttgccatgtagcttagggatgatcgattctgtatctatgtaattgtgtagtgcttggacatatgcaaaaaaaaggggaagatattgcaggagctttaccctcattaatactgaaactatttcttggagccaatttattagggagtattgttgggaacagtagcttactagtcctaatgtggttgctgcatattttcattagctgaacaggataaattaaatcatagaacatagcattagagcagcattcctgaaaacgttagcatcagatgacttcattgtatgtttgcttctgcttgacttgcagaaaggaagttggatacgatggatggcgacttgattttgttcgcggattttggggtggatatgtccacgattacttggaagcaagcgaaccatattttgcagtaggagagtactgggattctctcagttacacctatggtgaaatggattataatcaagatgcccacaggcagagaatagttgattggataaatgctacaaatggaactgctggtgcatttgatgttaccacgaaaggaatacttcactctgtgagactccattttcttaccaagttttataatagtgcttatgggtgatttagtatttttgaaactctagaatttatatgcctttccatggtttgagcttctcagttcggatatgcatcatgaagaatttcctgccctttagcatttttcttttgggtggaggtatactttgtccttcaattatttgataattaaagttttattgctgctatgaagacgcagcatgctgaaccacattaattaaacttgcatctttggcagtattcctgttccatggcaatatttaaagtctcattaatctgttgtaaagtggttttctgatgatagttaactcatccatgattgtaatagccaattctgccagtttgagaaggatgctattgctctggattagccatgcatattttgtcttacacatcttttctggtatacaggcactggaaagatctgagtactggcgtctgtctgatgaaaaaggaaaaccccctggagtgttaggttggtggccttcgcgtgctgtcacatttatagaaaatcatgacactggttctactcaggtacattacaaaatccctacatacacaaataagtattactccgtagcattatcttcagaaggttactatatggcagcatgattctggcaaatctgacatcatatttttgttatatttgcatagaaacatcacaaatgtgcaacgacctgcatgcatttcttaataatagtcagatagttgtccctttttttgaacgctgcttaatttcttgttttcaaacaactaaattttgctcagcccatccttgtagaactcttttgaaactggaatgcttttatggatactaatcaaattataactggagctgttaagctgtgttcgaacaaaatcatggctaactttctttgatatctttgtagggtcattggagattcccctttggtatggagttgcaaggctatgtctacatcttaactcacccaggcactcctgcaatcttctatgatcatatattttcgcatttacagccagagattgctaaattaatttctattagaaatcgccaaaagatccattgccgtagcaaggtaaaacttcctcttgtatcgtatggtaccccctcttaccctccttgcccttccccactctattcatgttctctaatgcttgaatttatataacatttacagatcaagatactgaaagcagagggaaatttatatgcggcagagattgatgagagggtaacaatgaagattggcgcaggacattttgagccaagcggccccacaaactgggtagttgctgccgagggacaggattacaaggtctgggaagtgtcatcgtagacttgccgcgctggtacttgcagaacttctattgtagacagtatacaaccattcggtatagctcacaaaaggaaaactgaatagcacaaagctagagttcggcatcctgctgatggtaccaagaaaagaagtggacagcaagggcaatggaaccacttgtcctaccgaaaagatttcaccaatgcagtgaaattacattgtaaattcgaacatttgatcatgcagaatcaccggttatcctgtgaataatttgtctgcaggcaattcgcctgttgatgtatgcatgttctttatacatttttgcagagatacctccaccatgttgga

SEQ ID NO: 5936 - DNA, 747 bp, Oryza sativa
  unsure (1)..(747): unsure at all n locations
atcctgctgatggtaccaagaaaagaagtggacagcaagggcaatggaaccacttgtcctaccgaaaagatttcaccaatgcagtgaaattacattgtaaattcgaacatttgatcatgcagaatcaccggttatcctgtgaataatttgtctgcaggcaattcgcctgttgatgtatgcatgttctttatacatttttgcagagatacctccaccatgttggagctatgtaatactatgtgatacactttggcgataaataaatgaagtgcatgcatttcttgctatctgcaaatgttagtaccaatttttcctgcagtgtgtgtgagtggatcataaaaggttgagacatctcccatttcaaattgcaccagttttcgatgtagtattgaaaccaacatggagcttacagtaagatatccaacaatagacaagatgccagtgacaagaacattagtatggattcagttttaacttctaaaacatgccacggggaaacactatactactactactactactactactactactactactaggtgggaaatactcagaatgatgctacgaggccaagtttccagagtaaagatgccacggcaccaaagaggttaaccagacttagtttcactagacatcaggagctgctgatacgggacgataccatcctgtcctactagtatnnnnnnnnnnnnnnnnnnnnnnnnnnnnnnnnnnnnnnnnnnnnnnnnnnnnnnnnnnnnnnnn

SEQ ID NO: 5937 - DNA, 834 bp, Oryza sativa
tgacgtgatttagaagattccccgttccaatcttgccccctactacataaaaagtattcacggtaacatcgacgacgacggaatgggagggcaagatgaacggagcaaatgctccactacaacagacagacagacagacagacagttttgagctaggttggtaaggatacttactacagccggttttttttagcacaagaatacggggagaacaatatgattagtatggaagtacagccattgccatccgccgtgatagtgcgggcgttcggtggcgcgtgcacctcgtcgaacgcatcgacgtgttaacggtaaagtaaggcatcaatcagcaggatgatgagtgttaagtcgagtcaccatcacttgcgacgatgccaaaagaaaagaaacaccgaagcttcggtagttaggagcatcaacaaaagcatgacatctcccttagctcttttccaattccaaagtccaaagatccggaggcaacagggaagagacggataagggcatcgcatcgtgatttaatacacatccaaatacctaattatcacgccgaccggatgggccaaaaggaccagccaactaccaaccccggtcggctagctcgcgagctcgatcgacctgacctccgccggcacgcacgggcggaacagcgcggcaacatggttgatttcaacgattatgcgtagcaataaacatgatgacgtcgcgcgttgttgagggcagtaatggcctatagggccgtacgtaggtggcaacaattaactgagactagagaccgtatacgaggtactcgagcccacaacacgcgatacccagctgctgcggcggggtcat

SEQ ID NO: 5938 - DNA, 525 bp, Oryza sativa
  unsure (1)..(525): unsure at all n locations
nnnnnnnnnnnnnnnnnnnnnnnnnnnnnnnnnnnnnnnnnnnnnnnnnnnnnnnnnnnnnnnnnnnnnnnnnnacaataaaaagagaagcagcggacggggtgtataagagtatagttgcagagccgccgacggttgacgagacttctagaaaataaaaaataaattccaacgataattatgttcgatttttagaatcacaatgacaataatgagtagggggcggatgggctgtagaggggcatagtggcatcgtttgatggaatttctaaaaattataaaaaatgaaactacaagtccatttaaaaagtaaaaaaaaccaatgataatcatgttcgattttgaaatctcaatgacaataaaaaagggaggcaacgggcgagtcatataggagtataatggcaaagccgctgatggtttggcaggacttttagaaagtaaaaaataaaccaaacgataattattttcgatttttaaaatctcaatgataataaaggggtaccgagctcgaattcgccctatagt

SEQ ID NO: 5939 - DNA, 708 bp, Oryza sativa
agatcccggtcgttcgtttccgtaaaccgccgccatgcacccggtccaccatgagccgagcccgctgatgcaataattcccttttccttttcaaaaataattctttattgtgtcataattcaattaaaatctatataaatgttttaatccggtttaatctttaaaaattcataactaattcatcttagctcggatttagttggttcaagtttctaaagttgtataaaataaagatctacatattaaaattatccataaattgaattaaatttatttagttctttttaaatgggctttaattagattaaatcttgtaaaattcataattaattcatatgaagtcagaatggggccgttcaagtctcataattcatctaaaattatgatttacgtgtttgtttactttttatgtattgtttgtttggagtttcttagtctttttccttgttttgcgttttagcttgtcgtttccgtcgtttcgaaggttcgcgagtgcgccggaagtattcaagaagattaattgaagacccgttattgcaaggcaagtcacacagatcgcaaacacaattcctttgagcatgttgatcctacatttaaattctctatttatttcaattgtgcatttattttcgaatgtcactaggtggtgtgaacttattcctttgttatggcctgtttgcattgattactctattccttgataccttg

SEQ ID NO: 5940 - DNA, 582 bp, Oryza sativa
  unsure (1)..(582): unsure at all n locations
nnnnnnnnnnnnnnnnnnnnnnnnnnnnnnnnnnnnnnnnnnnnnnnnnnnnnnnnnnnnnnnnnattttgttcctgccatcttgcctcttgttaatgcacttttgatctggagctctctgcaaatgttgctgctagcttgtcccaaacctttctatagttttatggggtcatcgtttttaaaagtttcagaaaaggaaacataaacagccagccctgcagaaagaaaatttgtgtcctaaaaaactgatgagttggctgtctgatctatacctaaacattagtaactgctgacacattagcacctcttcgttttcttttggaagttatagaagaactgatcagataatatgtcccaggctttttgaagttatataatttgccattgttttggacctttggtgcaggcacgtagggcattccgtgcattaaaaggtatcataagactccaggcactgatccgaggacatcttgtaaggagacaagctgcatcaacccttcgtgtgacatggttgatcgtgaaacttcaagctttagttcgtggaagaaatgttaggggtaccgagctcgaattcgccctata

SEQ ID NO: 5941 - DNA, 729 bp, Oryza sativa
  unsure (1)..(729): unsure at all n locations
nnnnnnnnnnnnnnnnnnnnnnnnnnnnnnnnnnnnnnnnnnnnnnnnnnnnnnnnntattgggggccttttgggatccggattcaaatttggaaggagttcaaatttggtccaattggttatgtaaagtttctttcttgtactagaaggtttcctaaggtgtttaggactcttaatatgagtttggtttgtggctttatgctgcctacctcatgtataaatagagggggagcgtgaggcttcccggtatcgctttagagagcaattgagttgagttttgagttagggtttcgagtttagtcgaaatttttgtaaggagtgctgttggtgcactttgtaaacacagagagaatcaataaagtcgtcatctactttaagagttcttcgatttgtgtttatcgggtttcggtagtctacccagtgatctaccggcggtcagaccggcggcaagcggcagtcagaccggcagcatttgggcggtccgaccggcggccgcgacaggcacgacgaacgacttcggcggtcagaccggttgatctataccataccggtcagaccggcggcatctgagcggtcagaccggcaaggcaacttccgtcagaccgatttccatcgatttcgagagtaacttttatttccgctaaaagttttcggtttttgggtataccaaccattcacccccctctggttggcttaattcttgggattcaatcctacaaccggccctac

SEQ ID NO: 5942 - DNA, 1052 bp, Oryza sativa
  unsure (1)..(1052): unsure at all n locations
nnnnnnnnnnnnnnnnnnnnnnnnnnnnnnnnnnnnnnnnnnnnnnnnnnnnnnnnnnnnnatgcaagcatgctggtgggctagtaatgttggtgctacaaacctgtgtgcaacagaagatgcaacgatgtggacgatggtgaccaccaacaatattttgtcaggtagtagcaattcttttccagagatattttgacaaatcaataacgatttataggaggcctgattagagtccctatcaatacttcattacaatgagagtcccttttagaacatatttagcaacaaccaacaatccctattttaaaacctctaaaaataaaataggggttgtccccgtttcccaagaacataaagaatccctccaactccaagaataaccccgtttctcagttcatgtttcctttttttcctcctactttaatatacactatatgtttacgactagttgaacacaacaataatttaaaattaaatatttttagtgcatagaatttatcgttgaaaattaattgtagctcgtgataaaagtattttcggctttaacaggtccgatcaatatttaattattgagacgagatgtgtttgacctatctgggtaggtcaaaataattatataattgatttttggcctgaaccataagggcaaaactacggaaataaccctgacgagacgtagtagtagcagtaggtcttgtcggatttttttcatttgtctgagtcattcccgtagattttgtccttgtggttcttgaggtggtcgttaccattggcattgtggggctcatcgtcgggtttagtcctgtcggcaagtcgcagcgtcaacagtgtcctactcgtcagctgggatgcttccacatctgcacaagaagaggtcacgcgggccttcaccgtcatatccgacgagctcgttccaagggtgcaggccttctttctgagctccggtggaagttcttcatagggaggctgatgttgttgactcaagctgaactgacgttaaactcccatgtgtgaaggcctcttttaaatataatctttggtttcttatgcag

SEQ ID NO: 5943 - DNA, 508 bp, Oryza sativa
aatccctcccccgaaaaccccgcgagtttcttcaatagctcacccggtttcgttcttgcggcttcggtttgatttcccaggtgaagccgcagaagaagagcagcaacaagtgggtgtgcgtggtgtgcaaccagcgccagtccgtgatgcgcgtccacgcccgcgggcaccgcgccgccgacctccgccgcttcgtccaggaagccaacctctcgcgcggccgcgccgcgcatgtgcccgtgcccgaggaagactgggtccctgcggtgccgggggagcagcgggatgagttcccgaaggagaggaagaggcggatggactggtccgactatctggaagatccgggggagtacgatggcggcggccaccacgaggaagctcgagatgaaggtatgcgcgaaacctgtttgatgtgatgtcgcaatgtatgtgtatcacagtatcagtatgatattgggtagcgtgtaaaatgatatgctcattaggaccaatggtaagttgattttgc

SEQ ID NO: 5944 - DNA, 771 bp, Oryza sativa
  unsure (1)..(771): unsure at all n locations
nnnnnnnnnnnnnnnnnnnnnnnnnnnnnnnnnnnnnnnnnnnnnnnnnnnnnnnnnnnnnnnnnnnnccatctgtaacagacgctgaattcccacggttggaaccaattgtagaagacgatggagaagaacgcacccatcgcggatgcatgtcatatggagaatatgcatccacaccagccgatgctggggcaaaactatcggctgagctgctcaaagattggttctgtagcttttatgaaggcttccagaaagatgcccgggtttggtttctttatgaagactcagcaaaccttgagctcccattagacttcagatttgaagacatcaatcatgaaagatatcaaacgcccagggaagtctttatagctgcaatcagcccatgcatcctacctgtcggtattcaccaaggaagaaatatccaagtctcctacgaattctatcaccctataagttcagttagacaacttggatttggccaactcccaatcggcttagtctttgctgacaagatccaatgccgaggagaaatttcttcaactctaatgatggatcgactgcttaacctccaaggaccccccttaggcagtatcgacaatattgagttagcaggattcaggagcaggaactttgacagatggtggggtgaatggaagttgcatctatttcatcaatcggccacaatgtacatgacagatctattccctgacatcataccccaggtaaactttgtcatcactaaatttcataacgggtagctaattcattact

SEQ ID NO: 5945 - DNA, 6370 bp, Oryza sativa
  unsure (1)..(6370): unsure at all n locations
aagttaaaacctcttattaccttgaaacgggggaagtaccagttatgaactaaaaagtgataaatccatgttaccagaaaaaaaatgtcgctgttaaacattaagcaaaggtaaccatctgaaaagataagatgatgttctaggctatcagaatgtgacaaattttgagtaatgatagcaaaaatgttcacagggagttcatggtattattctattgatcccagaagaaacacaactgtttattccatgtttaaaatactcccttttttctagtacaacaggggctttttgggtaatattaaatctgagaataaataaaaatggttgcacacattgtatttacattcatattctgaagtattgcatggattataaatctgtcgccttgactatgcatctttctgaagttctgcaactaccatattctacatagtcgcaccgggtggcctattgccacatttgttagcattgtatgtacttgtgttatttaggcttttactgacgttagaatggatctgtttgcatctgatcagtttaaaattcagacttcacagctcatgagccaacattcagtttttccttttcgtttctgaattctgatgtcccattttgcttgtttattttttatttttaccatctatcagacagagcgatcagagctgaatggagacggtggtgaggacaaccaacttccatttgaacggtgcaacgttgtggtggatgaagtgccctgctgtccgtgagattgtcgccattgtttgttcaagatgtaaaaatatgttggccctgtgttgatctattatctgttgcatatttgagttgttaatttattatccattgtttcttgtgcaatgtcttgttcatagctacatcttactagtttcgggcatatgctctcgtttccacccaaggcaccctgcctgataaatggtcagggggctgatgccctaagcgtgttttaatagaacggcttcatcctactttcatgctttcccaagttccctttgtgctaacacgtactctatccgttcctataaaatataagatgtacttattttatggaaaatcaatattttaaaattctaagtaaagagtaaactatgtgttgacagaaaacacgaggcctgngagatttgcttaactccagtgcaggtccaaagctcgcctttgactccaccttgatctaatctctttttccgatgctgatattaccaaatttggtcgttaacacatgtcccccaagtccgggatatttgataatgttccggatttgctgtgtaccgactccgagcaagtttcgcactctgccgttttttgaccgttattctatcgctttaaataccaaccgttgccctcaaaaaatctcacgccgtgacttccgttttcaccgctcaagtgaaactttgtcctttctctatccggcgattcctccgacgtaaaagcaatccccaggcgatttcgcttttgatcagatctccgtctgcggcgatgtcgtcttccactagcccatctactgcgccatcggccaagtacgctgaggtaagttctcaccggctagatcccttttcctcgcatgaaatcgatttctccttttctcattatgttttatgctccccgattcctttggatttgcagcaccttttcaacctagttgcgattcccagcctatcgcacaaaaaccactattttcttggcccaatcggcaatcttgaccccactgatttcatcattggtgaaaccaatagaatcccctttagactagccaaccctaacttgggtcactggaagaataccttcaagtcttggccatctctcgaaaagcctacccctgataagagctggaccacctggtaccaacgcatatcggctagtaagaaagcccactgggatgagattgggatcggccaagcgcttgctctcaccatagccaattcttctaaggatgaacctctgatggctgccgccacctatttctggtccaacaccatcaatgccttcttatttaaccaagggccgatgactccaactttgatcgacatcatcatgattactggattagatgtaacttcatcggctaaccctatgagtatgaataccaagaaccaatttgacttcaagaccaaaagcataggagggtggtctggttatgtagcggcatacatgggcaaagggcctgtcactcctcgggagcacgtagctttcttgctaatgtggctagaaaagtttctcttctgtggatccagctgtggtcccacaaccaattggcaatttgtagccgaagccttaggatcaaagaaacaatttcccttgggcaaaatccttctcagctatctataccaaatgttgaacaatgcatcggctaagatagccgtcggctcaatagttggagcaggtggaccatggtggctactgcagacctggctaaacctggtagtcatgaaagttgtcaatcggccatctgtaacagacgctgaattcccacggttggaaccaattgtagaagacgatggagaagaacgcacccatcgcggatgcatgtcatatggagaatatgcatccacaccagccgatgctggggcaaaactatcggctgagctgctcaaagattggttctgtagcttttatgaaggcttccagaaagatgcccgggtttggtttctttatgaagactcagcaaaccttgagctcccattagacttcagatttgaagacatcaatcatgaaagatatcaaacgcccagggaagtctttatagctgcaatcagcccatgcatcctacctgtcggtattcaccaaggaagaaatatccaagtctcctacgaattctatcaccctataagttcagttagacaacttggatttggccaactcccaatcggcttagtctttgctgacaagatccaatgccgaggagaaatttcttcaactctaatgatggatcgactgcttaacctccaaggaccccccttaggcagtatcgacaatattgagttagcaggattcaggagcaggaactttgacagatggtggggtgaatggaagttgcatctatttcatcaatcggccacaatgtacatgacagatctattccctgacatcataccccaggtaaactttgtcatcactaaatttcataacggttagctaattcattacttgactaatcttttgttcctgttttgcagacaacaaagtcctcccctccacatcagagcaatagtggtagaaacattgaatatgccccaggtctgattcctaatggaggcgaattgtctcccccaaggtctcaaccctcctccaaggcgccattagggaaccaaccgatgtaaccaagaaaagaaaaactagatcatcggctatgaacaccttgactctagttccaaagaaaaaaggccaaatctaagaaaaccaagccaaccgacgacctgcctgctttggatccatccattgaacatgctctggatgaagaagatattgaggatgatgttgatcaggctacagccgaagcaagtgatactgaaaaaacaccatcggcttcgcctaagcagataccttcaactccttctgcccccactcacttcttcagagtaaaacatctttccttgcaaacccttttataatcattatttttcagctgactactcataggttttgtagttgcagaagaagaaaactgctataaagaagaaatcggcagcaccaattctcaaaccagctccaccagtaagacactctcaattttactagttgatttcagccgattttgtctaacacttgtctttttacagcctcctcctcctccttcttctcctgtacaacaatcattgagtgactgaactccatcggccgtggggagtcatcatattgtggaagaagaacaaccggctgctcctgctatcccagtaagctttcctttaatgcaagaatttagatcgactatattgacttagctctcaaactttctgaacttatacctgcaagttctagccgatctcttttcttttgatatcaaagattatcttgatgaggcagaaaaagatacttcaagcaaagctctagctcccttatctgatgatgcaaagaaaacactggaagatatctcgcgtcggctagaggcctcttctctggatagcttagtggtcgactatggatcgattaggacacgattgcacgaagttcaagctctaattcctgaagaactggccgatgtcctaactctagccacttatcttgagcaacatcaatttaaactagaaaaagccaagctaagattagccgaacgccgtgagcgcaaggagattgaagccacaatccaagtcaatcggcagcttgtgcatgaagaaaaagtcaaactcgatcaactatccgaaggtccgatcaaatccaatatcgatcggcttgaagcccgcaagatcaaatccaatattctcttggcacagcttgaagaatgcaatgctgaattggatatggagcacaaaaaactagccgatctcccaaaatttgtcgaatagcaaaaagcaaggctcaaatcggctatcaagaatgttgctgacctaaccaagttcctgaagatcatttctgggactgatgctcaagatgcccaagccattgaagaagtcgaacaaattaggcaaagaactatttcggctatccagcagtacttgtctcaataacttttgtgtaatcggctaagataccttaataacaatcctttgtgccgattaacataacttctaattttcactttcatttttgtatttatgtgcccaagccattgaagaagtcgaacaaattaggcaaagagctatttcggctatccagcagtacttgtctcaataacttttgtgtaataggacttagaaattcttgtaatcggctaagataccttaatgacaatcctttgtgccgattaacataacttctaattttcactttcatttttttttgtatatatgtgcctcccaattttataatgtcaacagcattgataaaattagaaaaacaactaagggcgatataacaatattggccgttatatatcggcaaaccataactgcttacaattggaaaaacgactaagggcgatataacaatatcgaccatctcaagactatgtaaaacacatcggctgtcatgcattagcaacactagccgattatgcgtcaacccaaacacttcggtaatacttcttcaagtatttgccattgagcgctcatccataaacctcaccatcaagcccttgcaacatatatgcccctttagacacaactttatagatttgaaacgttccttcccaatttggtgaccacttgccgaacttgttatcccgagttccaatcgacaaaatcaacttccatacaagttcaccttccgaaaaatccttaggcactattttcttgttatgatgcctagctactcgttccttatctttggtaaccttagcaagggctcgtaaacgccattgaaccaagtcctccctctcatcggccataaggttataatactcatcggctgtcaaaccgtcttgcaattctatccttctagagccgattctaacttcccatggcaaaacaacttcatgtccataaacaagcttataaggaggaacttgaattgatccatgacaagccatccgataagaccacaatgctttggccaaccgagtatgccattgccgaggataattagaaatcttccgcttaattaatttgatcaagctcttgttagatgcctcggcctgcccattagcttgtgcataatatggtgaagaattcaacaatttgatacccacgctatcggcaaaccgaacaaactcatcggacacgaagattgaaccttgatcagttgtaatagtttgaggaataccaaatcggtagattatatgttcttgaacaaattgaattgcatccacagaatcaactttcttcaaaggaatggcctccacccacttggtgaaataatcagtcgccaccatactgatggtggctttatcatactgatcatatcaattccccaacctctaaatggccatggtttaataataggattcatagccgacgccggcactcgttgaattgccccaaacttctgacaatcttgacaccccttataatatctgaagcaatcctccagcattgtcggccaaaaataccctgcacgccgaagtaaccacttcattttatgggccgattggtgagtgccacaaattccttcatgaacttcgccgattgaaactttagcctgatcggcactcaaacacttaagtaacactccatcaatcgtccgataataaagctcattatccaatagagtgtacttcaacgccttatattttaatttctagaagccgattgatggattatgtaaatat

SEQ ID NO: 5946 - DNA, 9705 bp, Oryza sativa
ttaacgtatcattcttgcattcatactcccctgccaattgactgattaccagcaaagaatctcccatgatttcaatagcatcggcttcaacttccttaagcaattgcaaccctttaagcactgcttcatactcagcttgattattagtcgcataaggtttaatagtataagcaaactcgaaacatgcccccctaggggaaattataactaggccgataccacaaccatgagtacacaccgatccatcaaagaataaagtccatggcaccatttcaaccgagccgattgaatcatcacgatgttccacaataaaatcggctatagcttgtcccttaatcgtcttcggagactcataccaaagatcaaactcagttaaggaaaatatccactttccaacccttcctttcaatattggagccgataacatgtacctaacaacgtcggccttgcatataatagcacattcattggacagtaaataatgccttaaccttgtgcatgaaaaatataaacataagcataacttctccacaggagaatatctagtctctgcatccaagagccgacgactgagataaaatacaactcgttcttttccatccaactcctgaatcaggactgagccgattgacttctcaccggccgacagatacaatctaaaaggtatccctttctgtggaggaatcaaaacaggaggggaacttaggtatcctttaatatcatccaaagccttttgctgctctgccccccaagtaaactgctgatcggccttcaatctcaacaatggtgtaaaaggttctaattttccggacaaattagaaataaaccttcgaacaaaattagtcttgccgatcatctcctgcaatttggtcttgttttccggaggcttaatctttttgatcgcattgatacttctctgagttatctcaattcccctctcatggacaagaaattccaagaactggccagccgatacaccaaaagcacactttgtcggattcatcttcaagccatatttcctggtcccctcgaaaacttttcttaaatcggctatgtggtcttttacttccttagatttaacaaccacatcatcaatatagacctcaaccagccagccgattagatcatgataaatataattcatggcccgttgatatgtagctccagcactcttcaagccgaaagtcataacaacccattcaaataagacgattgcaccaggacatctaaaagctgtcttatggatatcttcttcagccataaaaatttgattatacattgtgtttccatccataaaactcaaaattctgttccctgacgtagcatcaaccagctgaacggctactggcattggatattcatctttcggtttagctttattcagatctctaaaatcaatgcataccctcaccttgccgttcttcttgatgacaggaactatgctagaaacccactcagcatatcggcaaggacgaataaaaccagcatcatataaatgtttaatctcagctttgacaggttcaagcatatcggctttgcatctccttggaggctgctggtgcggcctaacccctaacttgataggtagccgatgttctacaattgatcggctgagtccaggcatctcgtaatactcccaagcgaagcaatctctaaactcttttaagagctctatcagcttggttctaaattctggagacaaattcttactaataaatgttggccttggccgatcgcttggacctatatatatttcttccaaatcatcggccgacataaaaccttgaccttgcttgtcatcgagatcatctaccgtatccttagtgtagatacttaaaccctccacgacgccctcaaaataatagcttgggttctccatcttcaactgcctgtatatcagaatcggacacttttagaaaatctccattccaaacttttccagataaacaatcaaggccatccatctcccaaagagctaaatcggcactggcaacattaactgacctgtcggctggtacgatctctattttgtcgccttgccactgagtcaagcattgatgcatagttgaaggaatacaacaattggcgtgaatccaatcccttccaagcaacaagctgtaagaacccttcctatcgatgacaaaaaacgtggtaggaatagtcttactgccgactgtcagctccacatttagaacacctttggtttccgatggattgccaccaaagtccttgagcaccatatttttcttgatgagatcctcggcatttctacccagcttcctgaacgtagcataaggcatcaaattcaccgcggtcccaccatcaaccatcattttagacatcggcttcccattgacataaccatttatatacaatggtttaagatgccgattctctgtcccctcaggcttctcgaacaccgcctgctctggtgatagaaccaacttagccgattcctcttccacctcgtcgacatcggcttgatcgatcccgaattcggctggcaaggtaaaaaccatgttaactggtgccgtcacaacactctttccttttgccaacctctttgcctcatcagttgcaacatcgtcggctacaggagcctgattcttaacacgccactcctgcctcggttttgctttcttcagccgatgattaatttcttgctcgacctcctggaagcgttccctactcctcaatctttgaacccttcttttctgattcttcgtaaaaataccaggaggacaccattgagtcttcttattttcgtcatcttccaaatcaccatgttggtttactgggcccaatctctgatggacatgcactcttgtctgttttggccaattgcctccatcgtataatcggcttgaaccccctgcaacatcactgcatccaggacaatcctcgatagatggtaacctcataccttcattccaacagaacctaaagaactcacagccccaatgaggatcaaagccaccattatcttcttcatgatgcctttcctgttgcttgtcgtatttcctttgatatttgtttataattctagccgaacttacttgataacccctcatgcgccccgtatcggttgttcggccagctgtgtgtaccatgttaacgggaaatgggttaccatcgaccctcatcggctttttggaatcatcaaacttaatcttgcctccctcaatggccacctgaatctgttgtctaaacaccttgcaatcgttagtagaatgggacccagaattatgccatttgcaatatctctttttgcctaattcctcagccgatggaatcgtatgaccagcagggagttgaatttgcttctctcggagtagcagatcaaaaatcttgtcaactttaataatatcaaaatcatacttctcttcctttccagaactctttacccattggcacggtatgacctttttactcctcacccattcggctgtagctatctcagagtcatcctcatcatcatctgacccatacatgtaagggcaaacatgattaaccttttagagcttttcctagcctccgcagacctatgctcgtgcaaggttaccttttatatcagatgtgacaagctatcaaagtcttcagatgagaatttctccgtaatcggagcaatcataccctgaaaggctagatcggctaactgagcgtcagttaaactcaagctgaagcacttgttcctcatctccctgaatctctgaatatactcgtgcacgggttcatcatgccgctgcttaatcgctgtcaagtcagataacttcatctcatgaaccccactgtagaaatagctgtggaattgcttctccaaatcggcccaactattgatcgacccatacagcaaagaagaaaaccaagtaaaagccgatccagacaaagataaccggaacaacctaaccctcagagcgtccacagccgatgcttcaccacactgagctaaaaatcggctaatgtgctcataagttgacataccatcttgtcccgaaaatttggagaagtctggaactttgaaccgattggggagaggaactctcttaaaccactcagggtaaggctgccgatataagcttccagtctcttttggtttaagcccaaactgttccctcattacatcagcaatcacatcggcccacggtcgttgctgagctgctccctatgactgttgttgcatgggctcgaactgactgtactgagacgcaaactgaggttgagccagtccccctagctgatattgggcttgcggggaaggatgctgatattgataattcaagttgcccctctggtaattatgaaggttcagctgcatattacgtgccaaatgctcgggaacaacttgaggcattattgtgccatccggctgtacatggtgaaccaagtgttctgggacgacttgatttaaaaattgttgtacaggctgtccaccaggcgtcacaaacccagccgatgcgcaggcttggtgctgaatcggctgaacgatttgctgtcttaacggcgtttgctgaatcggccgcggaggctgttgccttggtggcgtttgctggactggttgcacaacttgttgctggactggttgtacaacctgctgaatcgggagtgtctgttgaatcggctgctgctgtattggatcaacagcaggttgaggcggcagaaacatggcagcaacctgatcttgcgtcggccgattcacaacctgcccactatgctgtggctgctctctcattaacaactgagggttcaccagctggcctggtgccaatgctgacggagcaggtaagggagtcgatgccggcgccgtcggctgagctaatggtgcgacgggggaaactacctgaatagatggctgggcatcagtgatcaaaggccgataatttggaaagacacctccttgcaaataaactgggcctgcagcctgatgctcagctattgatccatcggctattgacttcatcatgtttgataaggtattgactaacaccccagactgattgatcaaagcatggtgcacagcatagtcgacctggtcttggaaattattgaaaaaatcttgtgccgcatcactattctgattaagatttcccccttgcaacccctgagcaccatcaccttgaactccatgcactccatcgccttgaactccatggaccccttgagagttgtcaccttgacttcctagagaaccgccggtagcacctttgtcactcagttgagccgagccatctggagcttgtttcccgtcttcacctttggaagaactggtcctaggatcattggcaactacctttactttatacttctgaactaatgttcccttgcgggtctgcatgaatgagtttaagaactgatcccgggctttctgcaacattgcttcaaaatccttcttctgctcaggtgtgaatttctctggatcgatgggcacgacgtttccttcattgacgtcagtcaaccccaacttctggatcttttctttaacaaggcttgggctagtcgaggatggcgacagcggtggcttctcggccatgaggaagaattgcttgctgacttctaatcggtcccaccaggagtgccaaaagcgtgttgaaagaaaacacggggcctgtgagatctgcttaactccagtgcaggtccaaagctcgccttcgactccaccttgatctaatctcctttttcgatgctaatattaccaaatttggtcgttaacactatgacaatacatgtcatgcatatatcatcgttactttcgtatttgaaaatatttttatatgatgttaagtcatagctgataatatgttagaaatgaaagttgttgataatatgtcatgaataaaaccaatgggtcaaggtatactcttagacaccgtgtagaaaaaactaatacttctatgttttacgcaatttagaacggaggaagtaaccagaaatccatggcgcagcgaagtggccgaccttcatgaatcgtcaaatttgaatgatgctaacctgttctaaaggagaattttgctgtgagcctgtgatacgagaattttgctccagttctaaaggagattgaactattttcttggaaattccacataaattaagtgaaatcaggcgaaaaatgtgcgtgatgtgttctttcttgtgggtttccaacaaggtaataaatagcgtatagcgggttgttagcggattagtgtctgtatagcggattgcgaatagcggacgctattacggacgctaagttccaatagcaaatataagaaaataaccataaatatatctatattaacatcaatttcacgtaaaaattagaatttataatacattttttattactcatatatttcataacataaaaaatataaaataacatatagatatataagataaataagataaataatgaaaagttctacaatccatatatgaaaaacaacatttaagcgttatagcggtccaacaaagtcaatagcggactgttatagctatcgtgaagcgctataatagactaatatagcgggcgctaagttacaacatgctatcttcagtccgctaccttgtagcagcagcggtagaggtccgctaccgctattgtggccgctactgcggccgctacgaacgttatttattagcttggtttctaacccatttccctcgttttccgcgtgcatatttttcaaacggttaaacggtatgcgttttgctaaaattttatataggaaagttgcttttaaaaaaatcatattaatccagttttatgcgttttgtgaaaagtttatatatgaaagttgctttaaaaatcatattaatcaagttttcaagtctttttatagctaatacttagagcaggtacaatagcaggctataatccagctataaatatattttaaaaagataaaggaagagagagaaaagcagcgggctacagatctatagccagttgtagcacgggctccaagacgtaatatgtgatattaatagtataacaaaaaactatgatatgaattggttattacattggttatagatgatttggagttaatagtaagctatactattaaacttgctcttaattaatcatgtgttaatctatggctcttttttttttccgccggaacggttccaagtcccaacccctcagaaggctggtactgggctactagtcatcttctgcctcttcctcatgcaaacacaacaaactgccgtaatcagactatcagaggaaagcgttccgcggcgccgccgtggcgtccggcgtccggcctgtcacctgtgagtcgaggccgcactttggcgcccgcggcagagcccgcgacatgccttgccgcaccgcgccgaggcgtccaaacacacgctccgcccagcccagagagcccactcccgccgccgcgcgtcccatccaaacctccctccgcctccgcgtcccgccggccgccgccaatggaggcgccgccaagcctcccctaccgccacctgccgcagcatctcgccggcctcctcaagacccggccgctccacgacctactctccgacgcgtccacctcccgcgccgcacgccacctgttcgacgctgtgccgcgcccgacccccgccctctgcggcacgctcatctccgctctctcaaggctctgctcgcaccaggagcttctcgacgccttctcatcgcttcaccgcaggggctccgacgtcccgcccggctgtgtgcccctcgttgtgaagtcgtgcgcgatcttggccgcgtcacgtcagggaaagcaggtgcactgtcacgccattgtccgtggtctccttggggatatctttgtgcagactgctctggtggatttctatgcaaagaacggggacatggattgtgctgtgaaggtgtttgacgagatgccggtgaaggacccgataccgatgaactgcttgatcactgggtattccaagtccggtgatgtggtgaaggcgaggaggctatttgatggcatggtaagaaggacatctgcatcctggaattcaatgatcgcctgttatgcgcatggtggggaataccaggaagctttgaggttgttccgtaggatgttgagtgagggtgcaaggccaaatgcgatcactattgcgacgatgttttccatttgtgccaagactggtgatcttgaaacaggaaagtgggcaaggtctttgatcgcagagcaggatttgcagaacatgatagtgcacactgccttgatggaaatgtatgtcaagtgtcgggctattgacgaggcacgccgtgagtttgatcggatgcagcagagagatgtcgtggcatggagcactatgatcgctggttatgcacagaatgggaggccacatgaatctctagagctgtttgagaggatgaaggcaaccagttgcaagccaaatgaggtgactcttgttggtgtactatctgcctgtgctcagctgggctctgatgaattaggaggacagattggtagccatgtcgagagccagaacctaccactcaccagctacctcggatccgcactaattgacatgtacacaaagtgtgggcacgttggcagagctcgcagtgtcttcaaccggatggaacacaaggttgtcataacctggaactccatgatgagaggcctagcactgaatggctttgcgcaagatgcaatcaccttgtacaaagagatgacagaggaggacgtccagccaaacgagattactttcgttgcgctgttaacggcgtgcacccatgctggattggtagaccaaggtatgtcctttttcaaagagatgaagacaattcaccatgtttcccctcaagtggagcactgcgcgtgcatagtggacctcctctgcaaatctggaaggctgcgggaagcgtacaagttcatctgcgacatggaggtcgaaccaaacgcggtgatctggagcacgctgctgagcgcctgcagggctcacgccgacgtcgagctggccaagctcgccgcgagcaagctcctggttcttgagccggacaactcctccatctatgtcctgctgtccaacatctacgcggatgccggcctctggggcgacgtgagggagatcagggacctgatgaggagcaagaacgtgcagaagctgtctgcttatagttggatagagctggacggtgaagtgcacaagttcctggtgcaggatacgtaccacccgaaatcagctgagattttcaacgtcgtcgacggcatggggttgcatctggacgacgttgattctgaccccgatttatttgttctagagcactattgaacatttgaacatgctaacaaacaattgcagcagggcatccttcgttcactgcagattgattgtactttgcataatttatatacatgcatgatccatcgattcgattattattagttagtactagaaagtatgtagaaagtataattggtaagtgttgaattgttgggccttcttgcctagcccaataagaacaatgactaccagtaggccttattgatgatgagcccagttctgagttatcccgagtcctgcctgataaagcaagcagtccaaagcaggagacggcagaacaccaggttgtcagatcccttcgcctctgaaccctgagtcgccgatcgaaacaatccgatggagtccgaagctgacaaggccgccgcgccggcgccggcagcggcggcgtcggtagcggagacgagcgacgacgcgattcaagaggagtcaccggcaccggct

SEQ ID NO: 5947 - DNA, 10395 bp, Oryza sativa
cttgcatggtcattgtgttcatgaggctccggaagagaaccaaggatgccatgaaaaagtttggctggtcttcatgaggtaccaaaagttttaccccttttccccagatttgtgatcgaacagtttccaatttggttttaatctcttgtgagtatagcatgatgcacaaacggttactaccaaaactcagtgctgttctatatgtgcagtagtataatgaatgaaacttgtaggtagttgtgacatggttattctagaatgttaagtgtgctttaaggtttcttgtactataacagcatagtttattaatcgtcgtatcatggcagtgttattttttctattctacaaagcatatatagacaaaaatacccactactcctgagttttgattattaaacagaataactatccgctcctagttacccctctccagtctccaaagcgtgtcgttttggacatatatctcatcaaacttttgaaactttgaatatcaatacatttttaatatttagatttgatacatggaaataatgtgcatatttgtctcttaagtactctatgatactataatatctatcaacatttgtaaatatattcaaaatttgcaatagaaattagtggtgaaagatgcattttgataccatgtcaatgttccaaacatgttttcgcaaccagacggagcattacaacacaaaacctccgtagagtactaattagtctattcaaaacattattcatgtatcatgagttcttggcgaaagggcatgtagtctagtagttacagtgacctgagtaacaccccaaggtcctgagttcaaattttaataggagcgaatttcagattgggttgtttgaggagctaagttcccaatttaaatggttgcatatatctggttggatgtagaggccgggtaaaaaatacccatctctaaaaaaagagtatcatgagttcttgtcattcataatttctgctgaaatatacttataggctgttcctagaggaaccaaagtaagatgtcacgcatgtgcttccgcctcattcattgtattattaggatatgggaaactaactgcatctctgagttcttttactgaattttatctaagctgtatttcaatattccacaggttcgtaatgacaaatgtgtgtttttggctgctgcttcaaatttgttgccaatactggacatgtaccaagcgggtgacacgctaagtgaagaactattacacaaaaaacactagttttaccctttatttgcatactcgatgccggaaactcgatagatttttacttgtacttatgttcatgaataaaaaatagcaaaacaatccttatcatatctcttcctgctcgctaattggtttatccatttttctggaaggcttcccaggtactccctccgtcccataaaaaaccaacctagatgtgacacatcctagtactacaaatctggacattctagattcattatactagaatatgtcaaatccagtactagattcgttttttttttggacggagggagtattccttatatgctggtagattcatagttcatatcctgtagcaaacatggagtttcagtttacaaaacaatgatccttgatatatgctattgatgatttttgcatctgtgcattggcacacttcgatgtgcccatcttgcttcgcccttaataaagagctattggataccacaaactgtattttcttgtgcctaagctagatctcggcttaccattatctataggatttaaacactggatttactataaaatgtcatcctgaaaattgtgattgtttcaattatcatacagagaaatcatcaagtaatccccgcatgagaatgctttaggttttgtcacatagtcgaggggcacacttacattgtcatttgctactggcagaatgtcacaaagttctgtgcccatttgccagccatgtgagaatggcaaagttgcccatatctccttccgatctatctatccgctaatctctaccttcgaccatcaccgtgccttggctccagagtgatgctattctcgcgcatttatatgttagaatggatgcgctagaatagcatcaaaattgatcaccagtaatccttacaggagcatgctccatccttgaaatggtgaaacctattcctatctctcataacaatctccctgttgaagaccttggatatcatcttggtataatcatggcagtcctcacatactctcaggttcttcactatcctaatctccatgtcttccggcaacgcgactaggccaaatgcaatggccagcttctcactatgcaaggagattgcatcttctttgtcctcttcctcgatatcaaacaacacctcttttgtgttcgcaatgtacccttgcagcctcagcctctgattcatctctgcaagcatcatctcgatctccttgtgtcttgggtgtgtcttgcctccaacaaagaactcatgcaccttgccaccaacctcaatggcactacacccaggcacctttttcactcccttggccttcatcatgttccgaacattgctgacacccttccagttctgcgagtctgcatagatgttagagagcaggacatgggcggcatcattcttggactcgatcgccatgagcttatccattgcatatttccccagttcaacgtttttgtggatccgtgacgcattgagtagtgctccccacacgccttcgtgtggctccaatggcatgccattgatgaagttcacggcatcatccagacgcccagctcgaccatacaaatcaaccatgcaaccgtagtgttcaagccaaggatcaattccatgattgctcttcatcgaatcgaagcatgctcgtccctcatctaccaacccagccatggagcatccacggaggaccacgacaaaggtgacaccgttaggctcaacccctgtgctctccatgcgcttgaacagcgcaaggcagtctctccccatgccattcatcgcaaggccactcactgcactggtccaagtgtaaacgttcctttcgcccatgctgtcaaacacctccatggctgccgccaccgcgccacacttggaatacatatcaatcaacgcggtgccgagcgtgaccgacagccgcatcccacggctatgtgcacacgagtgcacccacttgcctcgttccagcgcgcccaattgcgcacaggcagtgagcgctgacaccagcgtcacctcccccacggcagcgccagcatgacgcatttcgtcgaacagcctcaaggcctcccttgaccggcccgtgtgcacatacccggcgatcatggcgttccacgcgacatggtccctctgaggcattccgtcaaacagctcgcgcgcagcgtccgcttcgccgccagtggcgagagcccccaccatcgcggtgacgcacaccacgtccgggctcgcgatctccgcgaacgcggcccgcgcggcacccacatccccggccgcggcgtacatggagacggccccgctctgcacgtgcgggtcgcccgcgtgtccgtggcggagcgccgacgcgtgcacgctccccgcgatcagggccgcgtccagcgcggacgccgcggcggcggccagggcggtcgcggcgcggacgaggaaggtgaaggagtagttgtcgggcgcgagcggcaggtcgcggaacgcgccgaaggcgaggtgcgggcgccggccgcgagcgagggcgcggaggagggagttgtgcgcgaggagcgtggcggggcgccgcggcaggaggaggcgcgcgtaggagaggtcgccatcgtcgtcgtcgtcggaggaggaggaggcgagggaggcgaggaaagcggccaggtgggacggggacgcgatgcggcccgagacgaggaggtgcgcgtggatctcgcggaggtgccgctgcgaggaggccgccgctgccagcttcgccgggtcgcggagcggtcgcatttggtttgacacgctacggcctacggcttgtgagctactctgacgaaaggacttcccgtttcgagcattcgccgcgcgcgggctgacgaggccgaacgcgactacgaaccctggcccgcgtgggagtggcccgttccatggaaattgctatacgtacgagatacaactcaattattggaactgagtttgatcgacggcagccatgcgttgaacatctgctcctttcattgatcagtggttgcatttgcatatgattgcgcccgtccataccactacactcgcagggctaaccgacgaaggaagagtgaaaaccagtggattatcggggaaggctcggcagagcctgcaagcaagacagtaacattttcacgttgccacggcgaatagcggcacctcgctttaggcctggtttagttctcgaaactttggatacatgtatggagcattagatatagattaaaaataaactaattgtgcagttaggggggaaatcgcgagacgagtcttttgatcctaattagtccatgattagccataagtgctacagtaacccacatgtgctaatgagggattaattaggctcaaaagattcgtctcgcagtttccacgcgagttatgaaattagtttttttattcgtgtccgaaaaccccttccgacatccagtcaaacatccgatgtgacaccaaaaattttcttttcgcgaactaaacgtgcccttactctgaagattgatgtgcctttcagcaagcctcctggaagggaccaagttcactgaatcacggtcacagacatgcaaagtagaggggagtaaaaaagccaaggagatactctgtgaagccttgcaaaatcagatcagaatggtaacctgcaaacttgcaagggctgctgcctactccagctctttggcgtgtgtaaaacaaacctgacaaaagtcctggacagatgttttgctgtcggattaatcttacttcctccgttcaagaatccttctgaagagacccccttttacaagcatcttggcctagagtttgatccatgcaaagaagtgataggttttacaagcatcttagctgcaggatagagtttgatccatgcaaagaagtgataggatgggcggtggtaaagttaaaaagatgcaaaactggggaacctgctagcttgcaaggattgacggccacaaattcttcagagaacagctgatgaagagcataaagagaagtcgtaaatgcaaaccctgagcaaagatgatgcaatgttgctatttatggggaaaacgcaaagcaagtttcaccgaagcactcattccagtcttttgccatatttggagaaacatggaaaatctggtgaactgtaaatgtacatctcttcgttgcttgattgcttcctccacaattaacttctttattcttgccttcgacctatcagctttgtaggactggtacattgcaggaacctggagcaaagttttttttttcccgagaaaatgacagcaaacctgaaaggacaataaacagcacaattatcttttgaacagcatactttcaaaggaatgagcccgtcactgcactccaaatggcaatttgatcaatttacgaggatgtgaaaacaattgatatattcatacataggatcagtacaagtaaggtattgtagtcgaaatatcagaattttttaacagcatgtaaacagagaggtgaggccgccatacggtctagaaaccaatgcacaacaactcaaatataaacttgtgtaaaagtacaaatcaagtgagtgctgttcacggtcaagtgagaccgtgaggaccacaatgccactactaaaatttaacgctgatgatcagtgaaacaccaaaccgacaagctatgccaaagcttctgtgttatttgctggaattgtcacccaatttctttttctcaagtcttgttctgctgactagaaacaaaaagaaaaagaaaaagaaatgctattctgactttaaactgttggagcacatgctttggtcattctactgcttagcatgctgcataatgtttccctactgataaatcatggggaaacaaactggctgcagaatgtagaagagacatagtccattaaacacggcctgatttcgcacatcatcaagacatctttgccgtgatacgtcagtccagacaggcaatgcaacatgtaactctgtcaaagtcacgaaaacagtttctttgccctaaaaaaatcttaaagagtataaaacatcgagagtctcttttatgcaagctctacctgaaggccactacaaagattgaaaggttcataaaaaatacatcagattttctctgttatggcattaatgttaataaatatagaggtctaaaggcccactgagtcaacaacataaagagaagaatatcaaaacttcacacactttttgcactgggttttcaccattattctgaactgggtttcactgttattatgtctaataacataagaaaacaccaggagactttttgcagattgaaaacaatgaatcaggatttagtccaagcagtgttttacttctttagaattccacataaatatggtcaaatcattatcattattcactcaaacagatgtccttactgcacacataggaacgataacggaactggcatttatccagcatgggcaatttggacaatttttccaaagactctgctaatgctaaaacctgcatggaaaagtttgcacaaaacctggcttctgtctgtggtctatataagacagctacagtatgcccaaaactttctacatcccagttgggcaggagagttggagtgttcttcaggttcatccattatggtgtcctggaaggacatctacctcgttcttgaagcgacagttccactatatgtagctatgatactggcctacctatccataaaatggtggaagctgttcaccccagagcagtgctctgggatcaacaagtttgtggcgaagttttctattcctctgctctcttttcaggtcatttccacaaccgatccttatgacatgaatatcaagctcatatactcggatatcctacaaaagtcgcttgccttgctgggatttgcagccatttccaaagcatgctgtgcagagaagtttgactggctgattactggtttttctttatcaacacttcccaatacactgattgttggcatcccgttgctgaaaggaatgtatggtgagcaagccggcaaactactaagtcagatagtagtcctccagagcctaatttggtacactcttcttctatttttgtttgaacttcgggctgctaatggaatggccaccactacatcatctgaaactacaggtacgtacctaaactgactgactcgatttaggatgaaatttgaagttgcttcctcgaaacagcatggcttaaacacatttacatctttatttaagattagaaatccaagatcctggctccaattcgaaataacattgttcaagtaatgaactagtatttgagcatcgtttcctagtaccaactatatttcttctgattttcattattttttttgtgtgtgcgcccatgctaaccttcacaaatagttgcaaaaatgaaaaactcctgcaaatgttatagatcttactttccaaacgaaagaagcctgctagatactcaaataaatgtcgtttaagtgaccaatgtaagaaaatatgcattctatgatggtagctcaaactgatcttatagatgtcgtataatgcaatcatattattgtgaactgagaatacactaagcaaagagaacatagctaattctccgtttaatagaagaaccaatgaagtgaaatactgttctacttgcatcacttctattttaatctgcagtagcaactatagtgtcatactaacaggaactggcctactctgcacaaatatacaactaagtaactatattgtctagaaaccacctgtagtatttaaagttcagaatgaaacagagatttgaatcgctacagcccaatttaaagttgcctgtacaatcatttaaattacttcatttttttagataatccagcctctatatccaaaagtggatatacacagccaaggagaaattgcttcatactttttcattgtaatgcagttcactttacgcaatagatttgtctgaaacattgtacatgaacttgcttgaattatccagtgattgaagtatattttgaacttctttttcatatacgcctcaccagcaagcagcttaacttatcttctgggaatttaacttattattctttattaaattagttcgatggtttttatcccatgtcatgtttcaaaattgaagcagaatcaggtactagaggacctacacagcaaagatatggagatgttcaggcaaaaggtgtatcagcaagatgttcttgtgcttttcgctttttgttggtggttggtaagaagctagtgatgaaccccaacatgtatgcatgcctgataggtttaatttgggcactggtcggcttcaggtatgttaatgagtttatatgaatcaatttggcttcaagcagaaatgcagctgttattgacttacttcatacaactccataacatacccacaggtggcacataagattaccgttgattgtcagcaattctataaggatgctctcggatggagggctgggaatggcaatgttcagcctaggtaagaatagcaggatatctgattcagcttgatgcaatgcagataaacttctaaatacgtctaaactttgcgaaaaccaattatgttattataaattctaaatacttctaatcacaggccttttcactgctctacaaactaaaattatagcctgtggagctaaaaggatgctactagcattagccatcaggttctttctaggaccagcactaatgggtatgtcttcttatgctattggaatgcgtggagtattgctgaagatagccattgtacaggtatattctagttctttctttggacgagctattatttgtaactttgaacaattcaaccacagaaattacgattaacctgtcaaaatcacattcaggcagctctacctcaaggaatagttccgtttgtgtttgcaaaggagtacaatgtccaagcagatattctgagcactgcgtaagtagatcacctaccacgatacgatcctatgcttgtatatatgaagaagcagggaagcatcattaaccaacaccttacactgatctctcttatggcaggataattgttggcatgatggttgcagttcctgtggcgctggcttactactttgcaatgatcatcccagctatcaaataactatttgcagaagctagcctgattgtgttcatttgagaaaacaatgacggctcgctgtggagaataagttcagttatgagtgaatattttgctagactgtatatatatgtgcccttgggtttgtggtgaaccataataaggatatctgatttgtatcttagtgcatagtggccatacataattcttaccgtttcaactatgaacaactctaatgaacagaacatgtagagaaagctcacattccccggcgacgcggcgtgctctgttcctgtcaggcgctccgtccaacagacggtgcaccgtgcaccccgcccatgagctgctggcacccctgtggggcattctgccgaacatcttgcaggcgtacccagggctgaatagcagattatctggctcagcttgatgcaatgcaacagcagccaagagcttcatgtgcatcaaccatttcttggcctcattttttcctctccggagaacaattacatggcaatatggcattcacacaccgttcccttccaactgtggtgtggaagaacaaacagttcgcttcaccggcagcgtggaacttgcaactgttcgacattttgtagttgggaataagttcactttattaccctcaaaactgatcgaaatcgaccctaaaccacaaaaccggatatctcgacccccaaacttttaaaatcggtgtaatttgactctctaggcggttttggagggcggtttcgctgacgtggcgcctacgtggcagtattgactcggtattctttccacgtggcattgacgtggcgcttagttggcattagaaataaaaaaattatgcatgggacccattagtcattcacacacaaaaaattgtggggctcactgacatgtggaccccacatgtcatcctctctctgcctttcttcttcctcccctcttcctcccttctctctttctttctctctcttctctccccttcggctggccgcagggagcacgggcgactgaagctggagtggcggcggtcgggggccagagcggcggcgaccgcgggagctgaagcggcggcggcggcctcgccatcggcctcaccaagtggagagaggagaggagaggagaccaggtgagggaagaacggaggtggtgggtatgacgtccggggcggc

SEQ ID NO: 5948 - DNA, 2477 bp, Oryza sativa
  unsure (1)..(2477): unsure at all n locations
acatgccagtggggcccccaatttttttattttgtgtgtgaataaacatatgggtcccacgcatattttttatttctaatgccacgtcaacgccatgtggaaagaagactgagtcaatactatcacgtagacgccacgtcagcgaaaccgccctccgaaactaactagggagtcaaattacactggttttaagagtttggtggtcgaaatattcgattttgtggtttagggtaatggattagatttcaatcgcttttgatttgagggtcatgaagtgaacttattccttgtagttgcgcaagataaaagcccaatgggttaaaccaagcccagtgtcacccacggctcaccagtattgtggcccactggtttgtggtcttcggattagcacaaaagtgggcccagtttagtctagaacttttcttttttcttttttttttcttttgcgaaagtttggtactacaatctttgagttctggacacgtataggtaataattaactgtaagtaaagttttgtactgtaacttaatactagtaattcgtggggaatctgtattactgtagacaaaagggggagaggggatgtgataatgacacggattaactcagtataatgccattttaccaagccaccaactcactccccaagaaagcacaaagccacatcaacctcaccttcttgcccccgaagaaaaagaaggccacggaagccacgggagagtgatctgggccgtccatctcacaacaagccacggcggggagagatctgtgccgtccatctcacaaccagctcctcccccacggccccacccccgccgctataaatagacgcttcctcttcctccccccctcttccccaccactccaaagttccaaaccccacaccaccaccgcgcgcccgcatttctccccgctcctcgcgccgccgccgccgccgcgtagtcatcgagtcgagcagaagcgttcctcctgccatggaggcggagacggagtgcaaggtccccggcgtctactccgagaccggcattcccgtggaggatccggctcccggcctcaactccgacgtcagcaagaaggacgcccctcctgccgttgcggcgccgggtcccggcctctacttcgagatcggcaagaaggccagaggtgtacacgcgctcttcatcttgtttggttctcttttttctgggtggtttttgaggggggggggattggtggtggcggttgctggcttgagcaaattttagtggagtggtttgctgatttctgctgcttttcctggtgtttttgcagatcttctgtacaaggacttccacacggaccagaagtttaccctgaccacctacaccaacaatggagttgtgagcattaccgatttccgcatgctttttactggttcctttcttgtggacatcttggctcgcttgctttcgattgtttgtgtgtatgtggtggtttggaatggtttgagtaggaggatctcggtggctgtgtgatgtgcgtgtcggagttgtgttggttagcggggctcggtgtggtccgagcttgtgtgtgtggcgggttgcggccagtgtgtttgtggaattgacctgcgggtttactgagttttggtctgatttgattttgagttgagttgggttgaagagttgatggatagtgcattttactttttctccttcctggtgttggatgagatggtgaatcggtgatcgaagcgtcgattgggtttttctgttcgattgacaggtggtcaatctgtcaggttgatgtttgttacgatgtttccactgggttttttgttcgttggatggttggtaaatctgtcaggtttcggtttggtgatcgaagaattgactgggtttatttgttcggtccatgggtggtcaatctgtcagtgtcaggtttcggtttgtgatggaagagtcgattgagttttttctgttcgatcaacaggtgatcaatctgtcgggtttcagtttgtgatcgaagattcactgggttttttgttggatgaatgggtggtcaatccgtcatgtttcggtttgtgatggaagggtcgattggggtttttgtgttcgatcgacaggtggctaatcagtcaggtttcggtttgtgatcgaagagtgctttggattttttatgtatttctgttagatcgatgggtggtcaatctgtcagcgtcaggtttcactttgttatagtaagatgcttccattccgttgccagtttagtgggtttctttttgttagaatttactactaatttcgtagttcttaaattgtgcaacgagttgacttgttgataattttgggtttcagtcgagaggttcccagtgataattttttatggtttagcttatacgagtactgctttgtttgatctttccttcagtagatgctgcatgtcaacgtcaacttgtgtgnnnnnnnnnnnnnnnnnnnnnnnnnnnnnnnnnnnnnnnnnnnnnnnnnnnnnnnnn

SEQ ID NO: 5949 - DNA, 747 bp, Oryza sativa
  unsure (1)..(747): unsure at all n locations
ctaatcagtcaggtttcggtttgtgatcgaagagtgctttggattttttatgtatttctgttagatcgatgggtggtcaatctgtcagcgtcaggtttcactttgttatagtaagatgcttccattccgttgccagtttagtgggtttctttttgttagaatttactactaatttcgtagttcttaaattgtgcaacgagttgacttgttgataattttgggtttcagtcgagaggttcccagtgataattttttatggtttagcttatacgagtactgctttgtttgatctttccttcagtagatgctgcatgtcaacgtcaacttgtgtgtgtttgtacggatcagaggatctcaatccgtgtttgtactgatgctttgtatcatgggtgtcaattgcagattgcgttggatatcttgttgtctactaatataataatcaaatatgactcttattatttgatttctgtgattctgtctataggtaatcactgctgcaagcacaatgaaagatgaagctatctttagcgagatccagaccaagctgaagagcaataatgtgatgctggatgtgaaagctacttccgattctcaggcaagtttctccttgaaaatgcccttcatctatcaaatgttatctgattattacttcctgattaaactcgctggtgatggactataaattgnnnnnnnnnnnnnnnnnnnnnnnnnnnnnnnnnnnnnnnnnnnnnnnnnnnnnnnnnnnnn

SEQ ID NO: 5950 - DNA, 828 bp, Oryza sativa
  unsure (1)..(828): unsure at all n locations
nnnnnnnnnnnnnnnnnnnnnnnnnnnnnnnnnnnnnnntttattccatgtttaaaatactcccttttttctagtacaacaggggctttttgggtaatattaaatctgagaataaataaaaatggttgcacacattgtatttacattcatattctgaagtattgcatggattataaatctgtcgccttgactatgcatctttctgaagttctgcaactaccatattctacatagtcgcaccgggtggcctattgccacatttgttagcattgtatgtacttgtgttatttaggcttttactgacgttagaatggatctgtttgcatctgatcagtttaaaattcagacttcacagctcatgagccaacattcagtttttccttttcgtttctgaattctgatgtcccattttgcttgtttattttttatttttaccatctatcagacagagcgatcagagctgaatggagacggtggtgaggacaaccaacttccatttgaacggtgcaacgttgtggtggatgaagtgccctgctgtccgtgagattgtcgccattgttttgttcaagatgtaaaaatatgttggccctgtgttgatctattatctgttgcatatttgagttgttaatttattatccattgtttcttgtgcaatgtcttgttcatagctacatcttactagtttcgggcatatgctctcgtttccacccaaggcaccctgcctgataaatgctcagcgggctgatgccctaagnnnnnnnnnnnnnnnnnnnnnnnnnnnnnnnnnnnnnnnnnnnnnnnnnnnnnnnnnnnnnnnnnnnnnnnnnn

SEQ ID NO: 5951 - DNA, 1055 bp, Oryza sativa
  unsure (1)..(1055): unsure at all n locations
nnnnnnnnnnnnnnnnnnnnnnnnnnnnnnnnnnnnnnnnnnnnnnnnnnnnnnnnnnnnnnnnnnntgcgtaatgtagtcatgtcctccgagcaggtggtacgcgacagcgacgcgtacgtacaggcgtcaaccgcgactccgcccctgcgcgcgcgcgctacggtttccaaccgaatcgaaaggtaaaaagcgaacagggaatgcgaccccagatatcacccggctgctctacaaccccggcgtttgtcacgttgagacttgtacggttccgcgcgtggaaccgatgcggccgaacgcgccgtggccactcgctgcgtcgcgcgtcgcggtccacgcagtgaagtggtgagcgcttcaggggggggggggggggggataagacgaaggtgaagttagcggtgcagcaggagtattccgcaagaggccgcgaggtgaaaagacagcacgcatgtatgggcacgtatcaccatttaccacggagaaccggtgttgttgatctcaccatccatttcggctgacatgacgaccgctcaattatccgcacattatatgctttgcacagatgctgaattgccagtgggatgacggattttggtgcttttgtttcgcatcatctgcgaatgggagtatagtggtgcatatggcgtcatgctagacgcaaactgtgaaagctgcacaaggccctgtttttgcttatcccttaagtactagctctccgtcgccatcagcccatcgccgatcgatagaacaatgccaatgaggttataaaacgtgaactggcttggtttagttccaatttttcccctaaaaacatcacgtcgaatctttgatacatgcatagagcattaaatatagataaaaactaaaactaattgcacagtttgcatggaaatcgcgagacggatattttaagcctagttagtccatgattagccataaaagtgctacagtaactcgcatgtgctaatgacagtttaattaggctcaaaagattcgtctcgcggtttccagacgagttttgaaattagttttttttattcgtgtccaaaaac

SEQ ID NO: 5952 - DNA, 741 bp, Oryza sativa
  unsure (1)..(741): unsure at all n locations
atctaaactgaaattgagccatcatctccaaaagagtatcaaatggcatggataaaaaacatgcttagtttagctagagctttaggaattgcgtactgagcttctagtgttttagagttgcaagtttacgtacttactcatggtcatatatagtcttaggcatgctaactctggaaaccggattaaatattgtccttcgatggatttcttgcacatcagcattccttttcagttcatctccatccttttctccagaggtcaggtggcaacatataaagcaaaagagtgtttgataaatggacatgcttactgctattgatccctggagcatgtcaagtaagaaaaattagcccattgttttctaaatagcacattgacttaccagcgcatagtaaatgtacatgagatggtacgaccaaagtgcacaaaactaggtgctaaaacgaaagtgtaatatgatcattaagaaaacaaatatagtataaaagaatgctaattttggctgtgcctaacagtagaggccggagatgtaaaccatttctattatccaaaaaaaggaatgctaattgttttctacatatttggaattgctaaaggaattgagaatgatgtgcttcacgggaacttgccttattaccaatataacccatagcaccgacacctacggttgatnnnnnnnnnnnnnnnnnnnnnnnnnnnnnnnnnnnnnnnnnnnnnnnnnnnnnnnnnnnnnnnnnnnnn

SEQ ID NO: 5953 - DNA, 1052 bp, Oryza sativa
ctggcgctgtcctcctgccaccgtggcgcacgcgaaccgacgtggcaggagaagggcgccagccatgctggcgccgccccaggctagcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactaaaattagaccataactcctttagtaaaaccctttgatcagcatgttaaacataatacactctaccactatatgaaattacttaatctaattcaaaatataaccatatgaaatgacatatataagttaaacagtacatagagatataatttttttatttttatttcatttttttgatatttttttcacacttaggagaacataggaaccaaccgtataaaaaataaactcaaacggacaaaatatgtgacatgtagaattttccaaaactctaccgaaacggacaaaatatgccatctattaaaataggcgtaactttctcatacggactcggaatcaggcaaataatatatgcacggagatctacagaaaaagttacatccgattctccccagctttgctgggttcggcgatattaaaacctccaaattccgcttgcaagattgtgttttcgaggagagaagtttttcggtggagctttggaaaattccatatgccacatatttcgtccgtttgagtttattttttacgtggttggttcctgtgagttcctaagtgtgaaaaaaatatcaaaaaaataaaataaaaataaaaaagttgcacatctctctcctctgcactagttcggagagaggagaggagaggaaaaattatacatgtcacatattacgtccatttgagttcaatttttctatggttggttcttgtgtgtccctaagcgtgaaaaaaatatcaaacaaataaaacaaaaataaaaaaattcggggggggggggg

SEQ ID NO: 5954 - DNA, 1044 bp, Oryza sativa
  unsure (1)..(1044): unsure at all n locations
nnnnnnnnnnnnnnnnnnnnnnnnnnnnnnnnnnnnnnnnnnnnnnnnnnnnnnnnnnnnnnnnnnntttgtttctctattgagtccacaggaaaggaatgtttcctctgattttcctttgggttgattcatgtgaagaaatatttcctatatacagtattcctctggaaatcctctaaaaatccctcaatccgaagaggccctaacagagttgtcaaatgactctataacccaaaatttaaccagcttgctgaaaaaaaaatgctctcccataaccttgccaactagccaagttttggcctggcataactggcttgctaagcgtgagctctacgtgtctattctcctccctatgagcgacggcggtgacgatgaggtgaaggcaaggatggagcaagcggcgcgtgaggataggccaggggtggatccgagggcgggtcgtggtgacccaagctgccctcttgagaccgagtcctaaccctctgtgtcgaggttctagatcagtccaccaagctccagtggtcgtcacgacggcatcgttggaacccatgccttatcttccccttcaacctctccgtcatcaccatcatcgttgtcgactcctcgccttctagtcacctccatgtctgccaccatctccactctccaacattggagcacctgagaataggcatcagaggggaaggatgggtcgggtggggagaaggaagatgagggagggagaaagaagtaaaaagagaatgacacgtggaacccactcatcatgtagctctttgccaacttcgggtggagattcaccaatagaatttagtagttgtggggtctttaccttgcttggtttttgattagtttgcttttacttttggttttgttactttggctacatactcactgtatgagtttacttttgtgtgaaccttgtaataattggctgtatctcttgagcaaatgccagaatgtttcattccattatataaaaaaagagagggtgttggaataaacgataaatttgactctttactttctttagttttagcaaaccgg

SEQ ID NO: 5955 - DNA, 7180 bp, Oryza sativa
attaaatcagattactctaaactggattataataagctggcatagaataagctgcgagttgtttgtttctctggattattggaggcatctaaggtagtgggtttttagccacccaataatctgagaaaagctccttcacaggagattattagattataataatctatcataacaatctacttgtttgtttcagcttattcctaataattcagattataataatcttaaactgaatcaaacagggtcttaatactttaaatatgtgtcggtatatccgataggaaaaagtacaaattaccccctgaactattgcgatcgactgaattcccccctaaacccaaaaaccagacaccgttcactctaaactttcaataccggacaaattacccccctcaattcaattccaagcggttttgcgcgtggcagtccagtcagcattttatttataaaaaaaatatgagacccatatgtgatactcctctctcacttttcccctctctctcctctctctctcactctctttctcacactcttcctctctctttctcgccggtcagcggcaggcgggggacgcggagcggcggcggcggcggccgtggccacgacgaacggccgcccctcggcgtggggacggatggaggcgggcggcggcggcggcggtggaagaattcgtgctagcagagcagcagtgcacatactactcctacccattgtcaggaaagaagacgacgacggcgtgtgtaggcgagctagcacgtcttcttcctccgccacggcccaacgaggcggctggcaaagctaggcaggcgtacgaacttgtggccgggaaaaccgccggcgtcgcaccgtgcaggggccaacctgccgtccatcatcaatgcctaaaggaatcctatgtctcgacgcaccaagcagctagcagcacagtgcagctctgctctgctgctctgagagattcggtcatctgcactgtcaccgtgtcgcgtcttacttacacggggcacctcttcaacgacgacgacgccgccgccgtggcgctggccaccgccgagatgacgccgctgtggacgccagcccgctcccactcccacagccctggccccgcggcgccgagccggcatcgcggtcgcatcaccgactcgtcgttcgccgcgaacaacggcgacgacaactactcggcggcgtcggccggcggtggcgcgcagcagcaggtggacaggaaggccgctgacgaccagtgagagagagatagagaggaagagtgagcagcgagtgagagagagaagagtgagagagagaggaagagtggaagaggatgacacatgggtcccacatttttttaataaatagaatgctgactgtactgccacgcgtacgccatgtaaactaaaaccaccgcagattgggtcgagggggtaattcgtccggtttgcatagttagggatgaaaaatgtccggttttatggttcagggggtaattcggacgaccacgatagttcaggagggtaattcgtactttttcctatccgataatatataccaaaacttttcaccctagaattattcctcgccaggagccttgcgggcagcgaaaactggactgggcaacttttgcccttctccacatggaccacgtccatctgattccacctccggacttgggccgcacgtcgtgttccagccaacacatatgggccgcttgttagcggcaatcccgttccacttatatgggccgtcataaacgggtattgagatctcgttccgggctcacaagcgacgcgtcatggaattccacgcgtcatcgatcttcctcttcgcagcccagcgtggggaaggagaaaggagagagggttagagattgacgaaaggcgaaatggcgatgagccgatgaaacaaagtcaggaggaagaggcagcgaaagctgatatccatcacagccgttcggacggatttttcgtcaggtatcaccaacatcaggcagctcatacctcgtagctcgtctgcaccagagagcaacgaagatgacctgaactgctgaacatggccacgttaaagctttggtacacgccatattattatcaggtagtatcaacaaccaaaataacagtgcagctgtataggctatttcttcaacagggcagtcatgtaagcatagtacaatatggactaaatggaggcactgtctcgactctcgagtcgacgaaagcaagatccattatgtaacatatatttaggtatacatacacatgaaacacgacggcactactagccccacaagcggcctctagtttgtcgagcaaacaaacacgcaaccaggggctttttcttcgctgcctttcagactataaacaaagcaaccaaagcccacagcttcctcctgaagctgaaccttacggaaatttcgggatgagaactcctgatcccgaaagggtttcttcttcattatcatcttcatctttcttcttttcacagggagttatgtgtcagtaacatcgcacaagttatgtgcagcacaggccttcaggtacgacctgacgccttcaggcaattcatgaagttaaaagtgcttgcttcttctgccaatactgctcgaatctctgccttgcatactccttgtagtcgaagtcaatatcattgacatgatcctgcagaagatagaggtcagataatagcacaggtttacagtgacagaatggattcatatagttcttttgaaaaaagaaacaggcaatggacatccagaaatatgaacataccgatattattccccagaggccccaaactagatgactggcgagcgtgtatttctcaatgctttggagaaggttctccacctcttccgcatcaggttcttcacttactaaacaaaattaggagcatatcttagctagttattgtgaaaaaagtagtattcaatggaagctgaattcgaatttgtaacagaaatattcctccaaaaagaatggttgcagtcaaataatcatggtagtgccaaagaaatcttcagataatgaaacgagaaatgaatttgcacttaccagaattgcttaggtacgtcttcacaaaacgcttctgctcatcagtgtctgccacatgtagaatagcaaataagcaaggtggaccaagattgtgtaaactgatttaagtaccaaaacataagcaaaacagcgcattggtagtatttttgggtacctggatatttactgtagtccagtctatgtggcttctctgaatgatagtctgctgccatctcgcagaaatgattagcgatgtcatacgcaactggattgaagctggcatattcataatcctgtatatatatgagaagaacagaaaggatcaaattgccaacaattaattggggcttgtcatatatgtaaagaaaaaggaatcagatttccttaagaaacagtcgtgacaaattggtatacagaagggaaaaaaaaaggagcaaagcatcagtcctccataaggtaggtagtgtccaaaaccaaaactatgttgttttttagcagagccgtgacaatttaaaatgtcgagggggaagggaacgcaacaaacaaaaaacaagttgtatgaaagggaaaagggctggcgctattccaactagtgaaaatgatacggcagttccaactatcccatatcgcttgttgttcaacagatgatcacatgagagaagaaacttaaaagttctacaacctacgttcaatagcctcttctacatttcacatttgcacataatagatacacgcaaaaaaaatgcagcaaaaaacaaatatgatcacagggacattattgtgaatgaatattactcacgatgatagtcaacatgttggtgtcttcatcaatcatgatgttgccatactgaagatcgttgtggcaaaaaccaatcccgtggtaatcccctgaaaattctttctccaatgcagcaatctcgttctccaggctacccagccgaaatttcttggattcatcagatgagcacaggttccttgcagttttgagccagtttctagaaaaagcacggccaggtttagttttatatacttattaaaagtgccaagtgtatatttatctgagaaaatgctcttacttcagtcggtcccaaatgagtacagatttcgggccaggcatgtcaaggttgtggaattccctcagttttgacgccaccagagctgaaatttcaggatcacgaaggtctgctgcagatagtgtctgaaagaaagtaattgcattaatttttgtatatgcttgagttgctgacgtaacaggttggacagttattccatcgtgataacatttcattatcaccagaaaacttgaggagaaaaatctgatagtaggagtattgcacgaaatttcgttctttttttccttttgttcgtccaagaaaacaacacaagatatcccttttatgagagtgacacatgtattaaagcaaaatgaagaatccagaaagtgcttcgactcgcaatttaacagctatagcctaattcactttctaaaagagattccgcaagagaaatagaccatgtatggtctagatttactccattcagtccttactttacaccagtttagtcagctatcttgcttttctcaagtccaataaattgttttcaatcaacagcttctctgaaagagacatctcctgttgtcgaatggacaattatcaattctagctgactaattcaaacgaaagaaaaaaaaatctttcaaacgagttattaatagcttcaccgactattgactttgtatcacaattttactgacaatacaggaaagagtgcaaagaaaactaaattccagctgttgacaatacccttaaaaataagattgtacgcctcatgccacagaggcaaataattttgggagataattggtgtgggcataaacaattcctgttaagtaggagagatatttgactagggcatgaagagagattttatgaactgatagataagaaaggtctaaggaattgcagattcccacggcagaaccttttagaaaacgataaccagactgcaataaataagtcggaatagtgcctgtagaatctttaaagtatcaagaagaacgttaaagcccaaattgctacgagttcagctaaaaaaattatcagtatgcaagaacaaactccaaaatctgcctaattttggtgctaataaacttaggaaaataacttttcactaacgcggtaaaatcaacaaagatttattcgtccaaagcacaaaaggtaccaccaaaatcccctaaaaatccctacccaatttaatagttcaagagagtcgaagataaacagaggaaaactaaagggaaaaaacgggaggagaaaacacaatccgtggcgcgaggaaggctagacagtttggctacagcagcgcggaatcatatcatattcatgtgcacctacccttgcgtggatgaactcctcgacgcggccgttggtgaaccggccgaggaggcgggggccttggccatggcgagacatgcactcgaaggtgcgcacctcgtcctcgcggtcgaagaagagctccacgccgtcgccgtatatccgcacgaggaccttcctcacctccctctcccttgcggccgccccgcctccacctcgccgccgtcggcggtggccggggcgccgttgagccagcgcacctggtacacctcgttggtcatggcgcccttgagcggaatcacctgcagcgcccggcagtcggcaacgtccgcccacgacgccgccatctcgtgcagtagccgccgcgcctccctggggatccgtggctgcgccgccgcctccgccgcccgctggccctggctctggttctcgatcgccaccatccttgctaatcacgtccttttaccgtttttttttctctctccctttttgctcgcgatcaagaaagaagaaaagctgaagcgaagtggctagagatgagaagaggaatggctaatcacgctttctaatttttttttctttttcttcgatttggatatctttccgaagcaagattagagaaagagttgcaagtaacaagcgtactagcgagttttcctccaatctgatccgctatcgctacgattcaccctcggggatcaaggagcggggccgcgtataaatagagtccgctgcgccgggattttgtagatgccccctccaagttttatctacgttctataccagggcctcccttgtcaaacaactgttgacctagcgtatttttgttgcttagcttggaagtctcacaggttacaaagtcactgggtcgtcagcaacttctttttttcttgtacggtttacgatatacggtatacatatttcaaggggtgaaaactgtcacagaaattcccgatcgaccggacgccgttccgtttaaggggtacctttttgtctatttttatattttgttttttctaatttctttatacatcgtattaatgtcgatattgagtagtttaaatgataaatatggtcaattaccagccgatcgagcatcgtttccgaaaaagtgctaccgaatcagaccgttttcaccctatttcataaggtttccaagactaaatttctactattgatcggttaaaaatatttctgactatacggtatacaaatacattttaaaatataagactaaacttcattaaatttcaactgccgagtactcttaatatatagctgtaaatagaattatatcaattaaacaaagtaactagttaatttttgacggaagttgttgatttaccttaatagagtctaaagagatgcactatataggttgtgttctttccccaggtttccaactcccctctcttgtttttttccaaaaaaattctatatgaaagttgttttaaaaaatcaaattaatctatttttgaatattttttgctaatacttaattaatcacgctctaatgggccgctccgttttctgtgtgtgggacatgggttcctaaccggaactagcgaacacatccatagtatagttgcaagaggtgtgtgactttaatcttaagatcttgtgtttaattttttaatgcgctcacaatttcttataattatatttgataaccaagcttctccttggttgtccttatttttcacaaagtttactccattttgacatatagcatctttgctatacaatttcatcttccctttattttccaccgacttatcatttcaaaca

SEQ ID NO: 5956 - DNA, 9143 bp, Oryza sativa
  unsure (1)..(9143): unsure at all n locations
ccttcacgagtttaagtcactcacaaaccaaaccacatgtctattgtcaactcctcacaattagtactacaaccaggctcctcatctgccctcccgtccctacaaccaggctagctattgcacttattctctctatttatattataagtcgttttaatttttttcagactatatccttatacaaaacgataaatattatcaatttaaagtgagcaataaggactaaagtgaccagggatcaaaattagaaaccaaactagttgtccttacccataacatttttggacaaaaaccataatatcgatccatatagcagagtcgagtaccccacgttacaaaataataaaccagctaatgaaaaaaaatccatatattccaggctggccgagccaaggggcacacgctccattctttcagaagccagggtctattccatgaaaaggcaacaaccgacccatcgcactgcacctatcagcgagcgccacctgtacggcccgcggccggccacggcggatcccgtgtggaggtggcagcggcgactcgcgtccgcgctggccgccgtctaccgcgcggctcacacgcgtggtgcgggcggttggggatttgattatcttcagagcagttacagtaatagtaggctataagccagctgtaaatatattttaaaaaaataaataaggagagagaaaaacagcgggctacagatttgtagccacctttagcatagactctaagacgtattgtgtgtataacaggtgggaccatgtattaatagtgtagtatataactattatatgaatgagctgctaaattgattataaatgaattggagctagtagttagctatattattattaaacttgttctcacataggagcacgcgggcacacggccatgcgatctgcgtgggcaaattcatcgccgtgtttttgcttcgttcgagcctatataataatcgattttatagagaagctagcaaaggcgtttttgtcaaatccacgtcacaaattcgttgcgacttgcgagccttatcctgtagtatgaatatgtgtatatcgaaacaaataaggggatggccgatcgatattgacctctaacacttgcctctttgttagcaacatttggacccacggtcccgcggcgaagtcacggttccatttttagcacacggcacacgtgctctgacttttgcgaccgcttgctgatggcatgatacggtgttgctgctaagggggtgtttgggagagaggggctaaactttagcctctctcttaaaaacataagtccctccctaggtttgacagtgttgcttgtttggttcttgtgaagctgtgattagttaattccagaagcaaatcatctcccattgtctatgcgaggggatgttacgcaccaaacaatatgacctttagctccccgagaatggaataaagtagctcacgctttagaaattttaggttgtaacttgtgagtgtcctcataataacgtcatgcaattgcaatgggatggtacgtcttcgggcatggagaatttggtggccaacgattatgctgagtccttaagttaatggaaagctattttcctctcaaaaaagagcaatatgaccttacaccgtaacgctggatatgcaaatgttcttttacgtggggacgagaatatatttatatgttttgggataggtcatggggtcaccggcagtacatacgatagattaataaagaacctatagagcatgatcctttttgtttgctcttgattcacactaccatcttcctcccatgtgatccatggagatagagaaatttggggctaatttattttgatgacaattttcaccctaccaacatattggtagtaccaaaatcctgataagttttgaaactaccaaatttgttataaaatttgttatagtatcatttgtactagtgtggataaaatttagcatcaaacaaacatccttataatactagtattaaagttaccaacaatttagaagaacaaaaattagcataaatccaaacaagcccatggatttgagtaagggcatgtacacctatggtagaatgggtaaagctacgagcccacttgctagtgacaatagctagggaaaagacagctacccgtacaagggccactcacatagtcgggcccaaagacattgagacaaccagcgagatgaacgattaatttatctggaactagggatgctagcgggtcaacccacgagcccgcttatagattaaataaagataacccatgtatttagagatgtaggtgggtcgacccattaaccgatttatatataaatcaataggtaacctagaagttaatttacgaggtacctgctaattttacttaattagggcatccacgatgtagtctaaaagtggtccataagtaataaaatatttgtttcagccacctaacaacattgtggaactagtccatagcaaaagctacccataagcatatgggttgcccatagagaataaaatatattatttgtctctatcttttctctctttccaatactatttgctatccatatatattatgaatgttttaatagttaaagttcatataagtgggttttatatactacttttattatatatattgttattgcccttataaacgatgtaggaatcttcgtttttttagggaaggcaacagctacatacgccatcgctttcctgaaaagttccccagaaactgcacactgcacagcacagaagcaaggtcctttcaacagtaactattttagaagtaggccttgtttaattaaaaaattttaacaaaaacatcacatcaaatatttagacatatacatagagctcgtgtgtaaattgcgagatgaatctcttgagtctaattgcaccataatttaacaatgttgtgctacagtaaacatttgttaataacagattaattaggcttaataaatttgtctcgcagtttacagacataacctgaaatttgttttgttattagtctgtgtttaatactttaaatttgtgtccgtatactttaaaaatttatatccatggaagtaaacacggccgcagtagagcctacatgctgagagccacttgttccagaaaaagatcaagactcccggtcgctatactgtccatcaagacgtgtcacacgtcgccggtgtcggcgccgagtcagcatgctggagtagtacattgctatatcaagtacagtacctgctaatgcgttcgagttctcaaaatctcaagttaaaagtcagagggtgtgtttagttttatgctaaaattaaaagtttgattaaaattgaaagtctatttaaaaaggttgaaagtatatgtgttgaaaaattttgatgtgataaaaaaagttagaagtttgaaaaaaaaagttgggaaataaaaacaagggccgagtgacccatcatgctccgaagtctgaaccaccctgtttgcgttgcaccaatgcgtacagtacgtatcactgtatgaccgtataagggtgtgcgtcacgtagacttttgtctgcaactacaaagacggtgagctcgtcagacgggcggttccaggttaaagagtcaggcgtgaggtcgtgacgaacaggtgaggcgagcggtggatggattggtatcaacaattccaaggggcgatgcagatgacaggtggatgtgggtggccacactcccatacgcacgtaatgtagcggtgtactaggtgtgagtgtgaccggtgcagcttactagtactactactagagttgtactacgattccaagcaggcaccgtcctcgatcgagtgcaacgcaccgaatcttcccctcgataaatagccttctctgtacacaacctggtgttccatgaacaggtatatattttttcaagtgaaatgtactccataatgaagtatttcctggagtagtatagaatataatgaagtatttcttccattccaaaataagtttaattgaaaagatgtacttcctccgtcctagaatatagagatactactagagaaacatctttattgggttgaccaaaaatcttttttttctcggttgaaaaacccaacgccactttgtcccgggtcaaaaagcgtgcgaccccttactatttttagtctcggttggtattaataaccgagactaaaattcaacccgtcgtatataatccctcgcacttatcctcaaatcttctatcgcaaagtctttatcctcatcttttaacttcctcctctctcttatcctctcctcttttcttgctcttatcctctcctctttacttgcagaagcagtagcgaggcgatggcctggcgtggcgcgggcggaggcagcggcagcggcccacgcgagggtgacgacggccagcgcaggggcatcggcgccctagcgcggggcgaaggcggcggcccgcacgggggcagcggcagcgagtggcctagcacaagtaaatttgtaatttgtgatgtttttggatctgtaaatctgcgacgtgaattgtgaatgtgtgatgtcagtttgatcggtgaatttgtggataattttgtgatgtttctatgaatgtggatgattttattgttgagttttgttagaaatcaatatgcaaatagcaaaaaacaatgaaaaaaaagaaaaaataactttagtctcggtggtaacaccaactgggactaaagatggtagcaccggccacgtggcgttaccatctttagttccggattcgagatcccggttgtatacccgtgattgaaggggattacaaaccgggagtgtagttgcattctccagcagtgagagttttagagttggacatggttattaagaaaagtgatagaattaaatatgtaattggttgagaagtgtaagtagataaaaaaagtgaatggtggagggttgtgattggttggtgaagaagttgttatactttaggacaattcattagtgctaaaagttattatattttggaacggagggagtatctgtatatatgtatgttatccaaaaacattctcatgtttagttttttttttcttttgacatagaagtactaatgcctacgaattgtgctcctcgccttcttcttgggctcaacttggcctctaccggtctctgaaaaacgcgagcccttttttggcgaaatgtcctgcaccatccgctggaaataaaaaagagagagaagagatccaattcctcgatcggtcaccatggaatgctgtagtactagcgatctgtactatatagcgtagctgcataggcgatcggttgactgtctctgtgccaaccatgtcgccgtccctcccccacaccgaattccgtcgtctcggacctctgctttttagcggttcgagctgatatgatatttttttttgtccgagcgactagcgagaatctgagacggttggtaattggttggtcccgaaactatgccctccctagaagaacacctttcggtcggtcccatttcgcggcaaaaagaaaacagaaacggagcagcacgcgatcagcggcaaacagtagtattctgattcgctgagcgttcggaatatatgggctcgcgcggtcgcgcctcgcggaatgatgagcagattgaattgctgaaggaaacatactaggcctgtttagattgtagccaaaataaatcttatcaaattttgttaatgtcaaagttttggtaaaatagcgatattgctaaaaatttttagcaggatttcttatgtattgacctaaatttgacgacaaactaaacgtagatatttttttttggtaacttaaacaatagtattgttgaaaatggcatcaaagtgaacgggtctaatgtagtctgtatagcattagcactagttgctgagcacttttttttttttgccagttgattgatgtttcatatttgttgatgcgtcgatggctcgatgcatcatgggcctcatggcgtcgtggtcatggctgcacatcttcgacatacatccaccatggcacctcgagtattcgttatttacgtatatgttttccaagctattaaacaatatatttttcttaaaaaattactatgaaaaaataattttgaaaaatcatattaatatgtttttaaatttaaagtaattaatatataattaatcataagctaatgacttatgttaatttatgtatttcttaatcttttcttttccttttctgttaaacactcacctttgcaaaaggtgtgaagcagcagcaaagggaagaggcattcccggcctatgttgacggctttccctgcaacaagccaacaacattcgcactccaatttacagccaagtgaccattattatttcacttggagtggtagaccggtagtgacagcgagatgcgcgatcatttggggatcacaggacgcgtaatcgctgcacatccatcggaacacgaagcctaaacgtcatagggacatctacaatccaagccacactagtagtgtcctcgttgactgaagccactacatatgactacactcacctttcaataaagaatactctcagttggacccttaaaaaactgagggtatatgaagatgctacagcccacaatgtgtgtcccaacccacaaagccgtttgtaatattttcctatcctacccttgtgtcgctgcctcgcctctctcttcctccgcccacatctctctccctccgcccgtcgtctctgtcccagcgcactgccaccgccctccctccgctggtgaccgatggcgagcagcgtgggcgagacgcaaatcgtcgccgtccccggatttggtgggcccgctccatccccgggtcgctggtggccgatggatggggcgcacgaggcgtggctccgtgtcctcgccaacctcccgcctcgcgctgcatccgacggtgatggctccatcgtcttcttcaccggcaccggcattgtctccgccaccgtagccagcttcgccttcgccgccgccgctgaacaggtagcccaacgagatttgccccttccctgctgctcacccctctttctcccccctccctttctctacgctttgacggtggatctgccctccccgaagcttgctctcacggggacgacgacgattgcggccggtgaagtgagaaggcgaggcggccgccgaggaggtcgatgagaacgaggggcgagagtgggagagtcccgaggagtcgtttgggaaattttggggtgggagcagtgaccatgagctacattggtagccactgtgcgcccaacacagagctcggctccgtggcttagccaaaagtgggcgaagggcgcgtcccccgcgagcaaacgcacgaaaggcaatggaggccgatggcgtgagccaggggaatgacctagggctaggcattgtacgtgctctaatgtcacgaaagcgacataaacttggacatgcacagtgacatcgccttgtaacatctactacatcgaaaactttcacaaagatgttcttagagagaaaaaggaacaaattcagaaacaggaccagagaacataatcacaaacatagaacaagaaccagagctggggccgaataacactgaaaaatggaccatcatcagccaacgaacggttgctcgctttctggaagaagcaaaagcacagacggccaaaaatatcacgtaccacgccaaaatattccgaggatttttcataaaagaaaacgagaaacaaatggtaggagcctgcgttaagggtaaagaaggtgagctaccaagaccaaatctgtacgaacatcacaaggaaaaaagatgaacgacatgacaccaatcacaccatggaactcctgaagttgttgcacgagtggaaggcttcgggtgtgagcttgatttgaagtgttctttacagcgaactacaaacagagtaagagaaaacagggtgaccggcagtaaggaatgcacacgctttactcctaactttggatgcgatttggcgctattggattcaaacagcccgttctcgccgtgttggatgcgattcgcatgggctggcccgagcgcaacgccaccgttgtagttgcgtctatatcctgaaatctaaggctacattaaacatagaaatgttcacttcaggtcctcacagtaatatcgagtttagatcacgtcatttgaaccgtaatatcagatttcttaatttacgaaaccggattacttgagaccttaacaatattatgcctggttttgactgatattgcgagttgacggtaatagagtcggttgagttagcatgagacctagatggtgcaaaatcaaaggtgtttttgattattattctgtgatgaacatttgtcattggagattattagttttgttatttggaatttattcacgaagtggttttggagatgattggatttcacaggtgaatctgcagatactgctgttatttcatgcgaccggtcagaccgggcaggtattgtcggtcagaccggctagcccgcggtttgtcacgcccagaaattcactagtaattacagaacttatttgtgcattaaatcatcgtccaggaatcagccgagatacacaaactgataatttaatatacagattcatcaaattaactaaaacgataaatacttacttaagaggcacttagtccttaccatgaagaaaactgcagcggaaaataaaatctagcgaagctccggctccactcccacaagcagctcaactggggtataaaccaaacgtcttctccttcgcaacttgtcttcaactgaggtttgattgattattgcaaggtgagcatatgacatactcagcaagctgcacagcaaatatgcaagtgcacaaggataccaaagaatggcataatatagggctcatttgcaaaagcagcatttagcaaataattgagaattgtaaaacagtagagtaattaatcatcaatattaatcaacactgaacagcacacccatgctgcacaggcccaaccatcctgaacaaccatacccggctgcacagatctatctccaaaccaggaatataccattccaaaccaggagctaaattaattaccatcaattaccacattattattaatgagtagcgtgtgactaatcacgaaagacattgttcgacccgcccaggaccgcgggcaggnnnnnnnnnnnnnnnnnnnnnnnnnnnnnnnnnnnnnnnnnnnnnnnnnnnnnnnnnnnn

SEQ ID NO: 5957 - DNA, 1075 bp, Oryza sativa
ggggaaaataaaattttaccaaacttccggttcccttcccacaagcagctcatctggggtataaaccaaacgtcttctccttcgcaacttgtcttcaactgaggtttgattgattattgcaaggtgagcatatgacatactcagcaagctgcacagcaaatatgcaagtgcacaaggataccaaagaatggcataatatagggctcatttgcaaaagcagcatttagcaaataattgagaattgtaaaacagtagagtaattaatcatcaatattaatcaacactgaacagcacacccatgctgcacaggcccaaccatcctgaacaaccatacccggctgcacagatctatctccaaaccaggaatataccattccaaaccaggagctaaattaattaccatcaattaccacattattattaatgagtagcgtgtgactaatcacgaaagacattgttcgacccgcccataaccgcgggcacggctattcgaatagttttactctggccagaggtgtaccactgtactcacaagacacaacccaccgtcatgtcaccgtgtctgcgcagacatgtcaccatgacgaatgattgtgacaagacccttcgcataactcaacccaaagcagtgcaccgttcctggatcgtagtcaccccctaaaaaaccagaggcatggactccccagctacccccgtgggcttatctccgccacttctcagtctggtgctccgcaatgagccttgttatacaaagtgtccagctgttgcccattctggcttgtggttggcacggttaatgtttcacaaccgaaactcgtgaaccggtccttaattgtcatgagcacgaccatcaaaaccatgtgctcacaacccaccattatcaagttttagttggcacattaattaattaaccaatcacgattagccatcgtgagctaccattatcatgtccatcattaagtaacagtgaaacattagttatcctaattgtgtgctaatgtttctaagcatggctaagcaattatgtctaacatctagctgaaccaatatataaagctcaactagtcaaattata

SEQ ID NO: 5958 - DNA, 4329 bp, Oryza sativa
  unsure (1)..(4329): unsure at all n locations
nnnnnnnnnnnnnnnnnnnnnnnnnnnnnnnnnnnnnnnnnnnnnnnnnnnnnnnnnnnnnnnnnnnnnnnnnnccgcaatgagccttgttatacaaagtgtccagctgttgcccattctggcttgtggttggcacggttaatgtttcacaaccgaaactcgtgaaccggtccttaattgtcatgagcacgaccatcaaaaccatgtgctcacaacccaccattatcaagttttagttggcacattaattaattaaccaatcacgattagccatcgtgagctaccattatcatgtccatcattaagtaacagtgaaacattagttatcctaattgtgtgctaatgtttctaagcatggctaagcaattatgtctaacatctagctgaaccaatatataaagctcaactagtcaaattataataacccaaggtatcaaggaatagagtaatcaatgcaaacaggccataacaaaggaataagttcacaccacctagtgacattcgaaaataaatgcacaattgaaataaatagagaatttaaatgtaggatcaacatgctcaaaggaattgtgtttgcgatctgtgtgacttgccttgcaataacgggtcttcaattaatcttcttgaatacttccggcgcactcgcgaaccttcgaaacgacggaaacgacaagctaaaacgcaaaacaaggaaaaagactaagaaactccaaacaaacaatacataaaaagtaaacaaacacgtaaatcataattttagatgaattatgagacttgaacggccccattctgacttcatatgaattaattatgaattttacaagatttaatctaattaaagcccatttaaaaagaactaaataaatttaattcaatttatggataattttaatatgtagatctttattttatacaactttagaaacttgaaccaactaaatccgagctaagatgaattagttatgaatttttaaagattaaaccggattaaaacatttatatagattttaattgaattatgacacaataaagaattatttttgaaaaggaaaagggaattattgcatcagcgggctcggctcatggtggaccgggtgcatggcggcggtttacggaaacgaacgaccgggatctaatcgattcaaaacgaacggccgagatcatcttgatctatcgcgggtctacggggacatcgacgatgacgtcggcgatgacgtcatcaccggcgatgactcggcctcgcatgctcgccggcgaacgacggcgcggtggcgcaaacggagggaaccaacgcgtagcgggcgacgcgcgaactcaccgagggcttagacggcggcggacggcaaccggacggcgacggcgacgaggttgaagcggcggtgacgatcgggtcgacgacgacggcggtgctccggcgatcctcggcagcaacggaggacgggacgaggacggcgacgacttcgcgaacccggcggtgaccttcccgagcgacgacgacgaccggagcggcggtggcgcacggctggacaagcggcggcgacggcggcacaagagctctcgcggctagggcgctacgagcggcgacgagctaaggcgagggtggcgacggagagaggaggtcccggggatccttttataggggctaggaggcggcgacggaggcccacggaggctggcgacgggatggaaagtttagggttcgggggagagagacgaatccgattcgagatcgaatccgatgatttccaaacgaaattagccgatgtttccaaaagagaaaaggaagaggagatctcgaggatcatttcccctcaaacaattcagccggaggaggaaaggggcgggcgaatttggaaggagatcggcggcggcttgcgcggctaggagcggctggaggaagaagacgactgacatgtgggtcccacctgtcagcggcaccgagagagagagaggagggagggcgtggcagactgggccgaacgggccggcgcaagcaggccgaggagagggagagagagagacttgggctgacttttggcccaaagctaaaaggagaattttaaaacatttttcaatttaaattattcatgaaatgcaattccatttattaaaaatacttccttggctcaaataaatcccagaaaaatctaggaactatagaaacaagagaagtatttaacaaaattttatctagcccacttttatattgagatttaacaaattaaaattagatcttctcttttaggcttttaagattatttctaataattccttttaaacaacaatttataatttaaggatttttaaatgagaaaagcacttaacataattataactagatcattaatgattattgattaactaattattgaactgttctttgtatcatttaggaattgagctctgaaaaaaccgagaaaatttcagagagtataattaatcatggagaatttaataaaaattaaatcctgccatgctttaaatttaggaaattttatttcccacatttaacttcacttgtaaattaaagaacatttaatataaattctattaataatttattaaataatttataaatcctaaaacgaaaatcaggctgtgacacggtttgaccggccgacgctgtgtcggtttcagtttcgggttgtttgtttggatatccgtgattatttcatgattatggcttctagatgaatactatacgtatgtaatactgttgtttgctactaatgagtcaagttggagatagcttggtctcagaatatggtttctttgtttatttcatgtgtaggtgactcgatgtcttgggacagtatttgcggtgatggaccgggagtcggcttggggataagacgatgtccgtggtggtcagagatcatgcgggatactaattctagagttgatgtacttggttgatggagattccatatggcatacaatggaggtattgtgtgcgtgtgggatgcggagtcgaatttggaaagagtccaaatttggtatgattggttatgtaaagtttctttcttgtactagagggtttcctaaggtgtttaggactcctaatatgagtttggttcgtggctttaggctgcctacctcatgtataaatagagggggagcgtgaggcttcccggtatcgctttagagagcaattgagttgagttttgagttagggtttcaagtttagtcgaaatttttgtaaggagtgctgttggtgcactttgtaaacacagagagaatcaataaagtcgtcatctactttaagagttcttcgatttgtgtttaccgggtttcggcggtctaaccggcgatctaccggcggtcagaccggcggcattcgggcggtccgaccgacggcggcgataggcacggcgaacgactttggcggtcagaccggttgatctataccggtcagaccggcggcatctgagcggtcagaccggcaaggcaactgcggtcagaccgatctccgtcgatttagagggtaacttttatttccgctaaaagttttcggtttttgggtataccaaccattcaccccctctggttggcttagttctggtgattcgatcctacaagtggtatcagagacttgttttcttctttggatttttatcgatctaaagtttttgccatggctactcctgctaggttttcaactaagcctcatgttttcgacggaacggatttttctcattggtgtagtaggatgcaatcttatattatgactgaagattatgatatttggagaaaagtttcttatccttatgtgattcctgaagctattaatactgccgctgaaaaaactgcttttgagcaaaattgcaaagctcgcaacattcttttgagtggtatttctcgttcggattatgatcgtgttgcgcactttcgaactgctcatgaaatttggaatgctttgagtaacttttatcaaggaacaaataacattaaagaacttcgtcgtgatattttcaaaaaggagtatattaaatttgagatgaaacctggagaagcgttggatgactatcttttaggtttaataaaattttgagtaatcttagatctgttaattcttcttatgatgctaattatccacaatctgagatttctcgtcactttttaaatggtcttgatatgtctatttgggatatgaaagttatatctattcaggagtctgttgacatgtctactttgactttggattcactttatataaaattgaaaacacatgagatgaatgttctttctcgaaaaggggattctaannnnnnnnnnnnnnnnnnnnnnnnnnnnnnnnnnnnnnnnnnnnnnnnnnnnnnnnnnnnnnnn

SEQ ID NO: 5959 - DNA, 713 bp, Oryza sativa
  unsure (1)..(713): unsure at all n locations
ctgtggaaaagatggacatattgttggtttttgtttcagattagctcataaacagaaaaaggagagagagagagattgcttttgcaaaatcaaagtggcaaaaatctggttttccctcgaggaaaccggtcagaccgcagtgggtcccgtggtcagaccggcgaccggtcagaccggttactgagcgtcggttagaccgggcaccggtcagaccggtggtacagaggtagtcagaccggcccccggtcagaccggccactatacctcggtcagaccggtctcggaggaatttttctgaaaattctaaaattgattttacacgtggatatatgcctattggatcttctggtcatgtgtctcagtactggattcctaaatttttattatcatctaaccccagtactgaggcttcgacttctacttgtgtgtaggcttttgtggcaaggaaggagaatgtgtggatcatggattccggttgttcgcggcacatgaccggtgataaaaattggttctcctcactcaagaaggcatccaagactgaatctattatctttggtgatgcttctacaagtgtcgttctcgctataggtttggttaaggtaaaggaaaaatttgaattgaagaaggaagcctcggttgagaacttaaannnnnnnnnnnnnnnnnnnnnnnnnnnnnnnnnnnnnnnnnnnnnnnnnnnnnnnnnnnnnnnn

SEQ ID NO: 5960 - DNA, 676 bp, Oryza sativa
taaagaactcacagccccaatgaggatcaaagccaccattatcttcttcatgatgcctttcctgttgcttgtcgtatttcctttgatatttgtttataattctagccgaacttacttgataacccctcatgcgccccgtatcggttgttcggccagctgtgtgtaccatgttaacgggaaatgggttaccatcgaccctcatcggctttttggaatcatcaaacttaatcttgcctccctcaatggccacctgaatctgttgtctaaacaccttgcaatcgttagtagaatgggacccagaattatgccatttgcaatatctctttttgcctaattcctcagccgatggaatcgtatgaccagcagggagttgaatttgcttctctcggagtagcagatcaaaaatcttgtcaactttaataatatcaaaatcatacttctcttcctttccagaactctttacccattggcacggtatgacctttttactcctcacccattcggctgtagctatctcagagtcatcctcatcatcatctgacccatacatgtaagggcaaacatgattaaccttttagagcttttcctagcctccgcagacctatgctcgtgcaaggttaccttttatatcagatgtgacaagctatcaaagtcttcagatgagaatttctccgta

SEQ ID NO: 5961 - DNA, 775 bp, Oryza sativa
  unsure (1)..(775): unsure at all n locations
nnnnnnnnnnnnnnnnnnnnnnnnnnnnnnnnnnnnnnnnnnnnnnnnnnnnnnnnnnnnnnnnnagcactacacaattacatagatacagaatcgatcatccctaagctacatggcaaaaatatatatacatatatatatggtggaacccatgacaatttgcagatattcaggtgtagcatttgtccaatccagtttgttattataggagcttagcagcctacaatatatacctattatcgtagcatgaaaaagaatcttgtgatattgatgaggatgtgcactgtgtacattccattttgtggtaagagcaaggtaaactaacatatatgaaaacatagctttgaaaagaatgtgatatgaggaaagaaaactagcactcagctaaacacgccatccagaaacaatgtatgtacatcaaatctatttaatctgttgcatggggatgctataacatacaacccttcgcatggggaatacacatatatagttaagcatgagcaacaaaaggagttttagccaagaaaaaacaagatagcatacctcatccaacaaagccattctttaagatcactcctcacaaactcttgcgagtgatcaatgtttggggctgcatggaagttatctccactgctcttgtttcctcttccctacaaggacatatagttttacccaaaaattagaaagtaagtctagtacatcacatagtgcattgttaagtaaaatgaaatggaataggcatgtagaacaatattatgattgatcaatgttcatg

SEQ ID NO: 5962 - DNA, 737 bp, Oryza sativa
  unsure (1)..(737): unsure at all n locations
nnnnnnnnnnnnnnnnnnnnnnnnnnnnnnnnnnnnnnnnnnnnnnnnnnnnnnnnnnnnnncgcgtactgatccagagtttcgcctggctccatcaccatggcaccaaattcacccttcaacgtctgcaagcgcgcttcgcgaacgcggtccgcgcccacgaaccttgtcttcaagcaatcccacacttccttcgccgatctcttctttgccacctgcatcagcaagtcctccggcaggactgcaacagatgggacctcgccttcttgtcccttcttgggtcgacggccaccccggccgccggctcgatggcgtcccagacaccctggtcctccatcatcgcctgaacccgaatgcaccagctggtgtagttcgttgccgtgagttgtgggtaggagaaagcactccccgagctctccctcgccggatccgctcccgctcccgccggaaccaacgccatggtgtcagatcagccctcaacctgagtgctctgataccacttgttggcaatagcaaaaaaactccgatcaaacaccttgctggcagactgttcacgcccggcacggcaagaactgcagcggcaacaacgaacagagcagcaaacagagcagaggaaaagtttcagagaaagaattcttgcaagaatgtatggggcaattttttctgggtttttctcattcaactgaatgtaaaccttacaaaaagaataaagagctaagagaactacttatactcaa

SEQ ID NO: 5963 - DNA, 845 bp, Oryza sativa
tttttttatctacttacacttctcaaccaattacatatttaattctatcacttttcttaataaccatgtccaactctaaaactctcactgctggagaatgcaactacactcccggtttgtaatccccttcaatcacgggtatacaaccgggatctcgaatccggaactaaagatggtaacgccacgtggccggtgctaccatctttagtcccagttggtgttaccaccgagactaaagttattttttcttttttttcattgttttttgctatttgcatattgatttctaacaaaactcaacaataaaatcatccacattcatagaaacatcacaaaattatccacaaattcaccgatcaaactgacatcacaaattcacaattcacgtcgcagatttacagatccaaaaacatcacaaattacaaatttacttgtgctaggccactcgctgccgctgcccccgtgcgggccgccgccttcgccccgcgctagggcgccgatgcccctgcgctggccgtcgtcaccctcgcgtgggccgctgccgctgcctccgcccgcgccacgccaggccatcgcctcgctactgcttctgcaagtaaagaggagaggataagagcaagaaaagaggagaggataagagagaggaggaagttaaaagatgaggataaagactttgcgatagaagatttgaggataagtgcgagggattatatacgacgggttgaattttagtctcggttattaataccaaccgagactaaaaatagtaaggggtcgcacgctttttgacccgggccaaaggggcgttgggtttttaaccgaaaaaaaaaagattttggtcaccc

SEQ ID NO: 5964 - DNA, 778 bp, Oryza sativa
  unsure (1)..(778): unsure at all n locations
nnnnnnnnnnnnnnnnnnnnnnnnnnnnnnnnnnnnnnnnnnnnnnnnnnnnnnnnnnnnnnnnnnnnagatcaccgtcaatggcatggttcgcatgcaggttgtcagcgtgtggtggtgtttggaatcacggaccgggtaatacggcacggtggcgacgacgcttgccggcggcgagtcggcgttgccgtcgggggagagcgcgtacaccaacgcgttgatgagctgcatggagccggccccgaagaccaagtacttgtcgtcgacgaccgcgttgccgacggccctgtgcagcagccggatgtggcgatcgagctcgacggaatggaagcggccgccggtggtgatgtagctcaagcggtgccacccggagaacaccacggcgctggctgccgcgtgccgtctccagtacggctccaggaacaacgggttcccgctgcacaaaaccattgcaggattagtgttagggagtacgtgccgtgctacgtaccagcggctgtgctacacattctgtacggaatgatagctcatttgagcatttgcaatgtgggggccccaaaccagagagaagaataaaagaccgactctacacattgtatggaccttttgcatagatacacctaaaggagagaggggaaatgatctcgagtcaaataccaggagaatactagtacacgcgcccggttagacaagaaaaataaaaatgcggcgctgctactgctacatcttcctccctcgttcccatcttaaataatttttattttaaactacttatctg

SEQ ID NO: 5965 - DNA, 726 bp, Oryza sativa
  unsure (1)..(726): unsure at all n locations
nnnnnnnnnnnnnnnnnnnnnnnnnnnnnnnnnnnnnnnnnnnnnnnnnnnnnnnnnnnnnnnnctcgttatccacttccatgggttggaccgtccaagtaaatcgattcttttaggaaaaagtacaccggaggtccctcaacttgtcatcgagttacaaaatcgtgctccaaccacaaaagcagatatagcacatcaatcattttacaaaaatcaatcattttacaaaaaaacattcactttaggtcattcggtggttttgaccacagttttattctacgtggcagttgagtcagcgtggaacccacgtgggctccacatgtcagcatggccacgtcgggctcattctctgttttcctcctcccctctctctctctcacattcttctctcttctctgggcaagccgaccgacgactggggcggaggccaccggggcgaggcaggagagcaggaggcggctgcggctgcggcgggcgttgcgagccggggtggagaagtcgcgggcgctcaaccacgcactagcagggcggggcccaagcttggggagatccaggcgaggttcccggtgatggagacggcgttgtgcccgatcacgccccgcgggacacactcgagggcgctggggagtacatcaaccgcgctgtggggccggccgtcgccgtgcgcggcctcgagccgccgttcctcgcggcctccgccgtcgccgacgacctcctcggatacct

SEQ ID NO: 5966 - DNA, 703 bp, Oryza sativa
  unsure (1)..(703): unsure at all n locations
aagaacacgagagccaaattagttacctgtcggcgtcggcggtgcagttgggcgtccggacggagcagtccggcccggagaagcagcggttgcactcgcacccgggccgcccatcctcgccggtgacgccatccaggaacacgttgccgtggccggagcagtcggcggcggccacggcctcggcctccctggccgcctgcagcgcccagctcagcccgtcgccgagccgctccggcgttgccgtcggcgaggacctgaggaggtggtgcgcgaagaagacggcgttgagcagcaacgacgagcagaggagtgcgtggaacgcgagccctgcagatcccaggctctgtgacctatgccgtcccgtctccattgctttcctgtctcggggtgtctccaatgacctcaccgtcggccactgggccactgcactgtgagcctgtgagcctaccggtttattaatcggtttctagcacagcgcgtgtggccccagctttggttcgattataaaatctgtgcttataaaatattttgtccaaatcggagttgtgatcgcgtgcaggtaattctttcatacaaagtacaatattttcgatttgaacagtccccgtcaattatatgtttttctgagaagtttgagatgcgttttnnnnnnnnnnnnnnnnnnnnnnnnnnnnnnnnnnnnnnnnnnnnnnnnnnnnnnnnn

SEQ ID NO: 5967 - DNA, 587 bp, Oryza sativa
tgtgtatttgtgtgcacgctttcaagcttctcctcgtgcttcacatcgtcaagcggtcaagcgaataatgaggtatttgaatcatacacttgagtttggaatttggtattctacttcatcttctatatgcttaagtggatattccgatgctgatttcggtggttgtagaattgatagaaaaagtactagtggaacatgtcattttcttggtacatcgttgattgcaaggtcttctaggaaacaatttagtgttgctcaatcaactgctgaatctgaatatgttgctgctgctagttgttgttcacagattctttggcttttatctattttaaaagattatggtcttacttttgagaaagtacctctattttgtgataatactagtgctatcaatattgctaagaatcctgttcaacactcacgcacaaagcacattgatattcgttttcactttttgagggatcatgttgagaagggagatgttgaattgtagtttttggacacaaagttgcaaattgctgatattttcactaaatctttggattctaatcgttttgcttttcttcatggtgaattggggaataatt

SEQ ID NO: 5968 - DNA, 618 bp, Oryza sativa
  unsure (1)..(618): unsure at all n locations
nnnnnnnnnnnnnnnnnnnnnnnnnnnnnnnnnnnnnnnnnnnnnnnnnnnnnnnnnnnnnnnnnnnnnnnnnntacagccattgccatccgccgtgatagtgcgggcgttcggtggcgcgtgcacctcgtcgaacgcatcgacgtgttaacggtaaagtaaggcatcaatcagcaggatgatgagtgttaagtcgagtcaccatcacttgcgacgatgccaaaagaaaagaaacaccgaagcttcggtagttaggagcatcaacaaaagcatgacatctcccttagctcttttccaattccaaagtccaaagatccggaggcaacagggaagagacggataagggcatcgcatcgtgatttaatacacatccaaatacctaattatcacgccgaccggatgggccaaaaggaccagccaactaccaaccccggtcggctagctcgcgagctcgatcgacctgacctccgccggcacgcacgggcggaacagcgcggcaacatggttgatttcaacgattatgcgtagcaataaacatgatgacgtcgcgcgttgttgagggcagtaatggcctatagggccgtacgtaggtggcaacaattaactgagactagagac

SEQ ID NO: 5969 - DNA, 552 bp, Oryza sativa
gtgccgagctctaccccggcccctactctttttcccctatccgcctacgaaacgccgccgccacgttcaccatctctctccgtcaccattgccgcctccagccgcgccgcatcgcctctctggtccacctcgcgctgcgccgtcgccttccccagcaccgcagccatcgtgcgcagctcggcatccactccatctccctccttcacccccgaagcactgctcccaccgtgaacccgagacgccactgccatttgccacctccagctgccgcttgccgccactccgagacatccccggccgtcgcaccttcctccatcagcttcgcagcgacgaggggaggtccggcgttcgcttctcgtcgtcgggaacccaccggagctccgtcctcctcgcgcgccggtaagctccacctctcacctcctcctccggccggcgattcacaccgtctcgggccacttgtccccatcctaacctctctaccaccctccctaggtcgtcccgcgcctcgggcatcctttccgcaccactggtcgttgcccgaggccgcccccg

SEQ ID NO: 5970 - DNA, 723 bp, Oryza sativa
cattcgccctcgaattgaagaacttgtctctaaatttagtgttcgagacttggtcgaggagttcatttatcttggtattcgacctctttctgccaactggactttatctcttggtgaaattcctgagggttctagttctttgcttcctcctttcgagatatctgcgaatagtaagtgtttaccttgtatatgtattttttatttcaagcattatatatatatatatatatgtaattcatttttttcttctttttttcttctctttttttcttttttttgcagcaaaattgtgaaggacgtggatgggccaagcaagaaatatattggcccttataccaagaaagagcatggcacatatcttgcggttcagcaaggtagaaaacaaaacaggattctaagtgccctcggccaagatatgatggttcgagttcatcctgatttgaagaagaaaaagaagaaaaactcgaatatcaatccaaaagatgctgcatcttcatcttctgataatgaggagaatagcttggatggggagtctgattcaagtgatgaatcgtctgatgacagcggctcctctgagtcgagcgaacatactcacactgctccttttgtgcaagaaaactcgagtcctgctttgaagcgtaaaaagatgccttcaagttctcctgttgactcgaacttgaaaaaagttcgaattgctctggatagtgatgatgaggatgaaaa

SEQ ID NO: 5971 - DNA, 486 bp, Oryza sativa
cacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagtgccaagttatcagctgcgtgctcccactcttgtatcgtcggctgaaccgtggtcacaataactagctcgtaggaaagcccgagcccctttctggagtacctgcacaacaacaaattcacacattagaaaaaatgttgtgcagtgatttattttaaaaaatgtaggattaaacaactgtgatgtgaactaacctatgaagactatcagccaaaggacgaccatctctcggaggg

SEQ ID NO: 5972 - DNA, 635 bp, Oryza sativa
gcagttaacttctaaactgtgatggctattcactaggtagcttcacaacagtacttatttagttttataatgccatgaggtcgggaacttgggattctgttttgcattgtatgataattcttgtgtcatcaaggcatattttattatttgctgctgacattttggctcactgcatcacagggtaagaagagaaaagacaccatctgcattgttcttgctgatgacacctgcgaggagccgaagatcagaatgaacaaggttgtcaggaagaacctgagagtacgacttggtgatgtcgtgtctgttcatcaatgcccagatgtcaaatacggcaagcgtgtgcacatacttccaattgatgatactgttgagggcatcaccggaaacttgtttgatgccttcctgaaacgtaagatttctttatcactgaagtattttgatttttctcttatagaaggttctagatagagaattttagagctttgctgccatgttctaaaacagtattagccatttcatttgaacttgcttgtttgatacttaattatgtcgaggaaagtttttgtggctcctaatttccatgaactgtagtacctatattacgatgtacattataacattaactacattgttgc

SEQ ID NO: 5973 - DNA, 146 bp, Oryza sativa
cctatgtgtaccaaaattatgtgatatctgtgtatataaagaaccagatagtaaatatttggtatatccctcagagaaaaagggtctttccggtaaatttgatgacttcctcacggcacttgataagtttattgaagaaaatggac

SEQ ID NO: 5974 - DNA, 786 bp, Oryza sativa
tataaatgtgttgaagcttatgctcaaagattaccctgactagcgtgagaagtgtatataatatgaacacttgcatttaatcttaaaatgcaccttctagatttatttcatcaatatcaattgattcagtgagattgtaccatgtcgactattgtgaagtatgttatgtttccacttcttttttcaggtatgaagcactttcagattgttttttcttatattgcaggaacttcaaaaacatggtagtcctgatattatcatggttttggttggtaataaagctgatctacatgaaaatcgacatgtatcttctcaggtcagatcttgtgtgaagttgtagtaaacatagtatcacaatatgctgcaaaattgttttgacgatatggtgcacattctgaaggaagcacaagagtatgcagagaagaataatatggttttcatcgagacatcagcaaagacagctgataatataaaccaagtatttgaggtatgccccctagcatatgaagctatttgctttcacgatgtccaagaagcaggatagctaacaagagaacatgctattttatttcaaattaatcaagctgaacaaaaacaccaaagcttcaaattcatggaaatcctaactgtttcacccacccccttacgtgtaagcattgaatggacagctactgcgttaggccatcaatggtcatcatcatactaactcgttatggtatgatatttttccattcacaggtcaccgtttttgcattagggtaccgagctcgaattcgccctatagta

SEQ ID NO: 5975 - DNA, 614 bp, Oryza sativa
aggtcttgtattcttcataacccagttatacactccagcaagatttgttgtcatcacaccatacctcgatccatctgtatcgtacaacaacgaccatttctcccttggctcaaattctacccactccgtgaagcacttcgtgacccttccacgcttcctgcgccgagtaatacttggtgcttcattaggaatgggttcaagtccctccggctcctcctgtctggcaactataggttttttcctaacctcttccatgtgtgtagtggtcaaacgatccagttgatcccatatggcatcaaactttctttgttgattctgcttgcataacttcttgaacaggtccatcaatctcttactcctgaattgtctataaaaattagccccaaaatgtcgcatgcatcatctgctatgtaaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccatagccagcttgatgtgttctcgctttcaacaaatgcaaaagcaataggaacgacatggctat

SEQ ID NO: 5976 - DNA, 683 bp, Oryza sativa
ccaatgagttcttgattgagaaaaaccatatgcatgtgtggcacgtaagatggatcaattgtaaaaatcagtaacacatactactagaactttctcacaaaaccaatgcttctaatgcaccaacagcatgccattatcccaagattggaagaagctaaaaccatagtgctgtatgtgtacctctcttgtccagcggtatcccatatttcaaatttcactattgttgagtcctccaaagccaatgtttgtgataaaaatgatgcaccgacagttacctgaaattatttgaggaaataagtttaaaacaatcgaacttctgaaagtaagaatcatgcatctaaggtgaagaataacattatcaactgaaactaagagactcaaaacagtaatcaccttggaagtgggatcaaactgaccacgaacaaagcgaagaacaatgcaacttttccctacaccagagtcaccaagcaataccaactacaacatcaaaaggatggacacgttaaagaaagctgctagtaacatgatatagaggcattattgtagtaataaagggcaaaatgtgcagtaaaccttagcacgcaagtcctttgaatcagtagcggagttatcgttgctaatattgttcaaccctccagtgcttcgagctggatgacaaaacagtgctatgtgttaacaaatgg

SEQ ID NO: 5977 - DNA, 1036 bp, Oryza sativa
  unsure (1)..(1036): unsure at all n locations
cacatagatttatactcctactttttaattttaaaatatactccatccgtttcacaatataagtcattttagcatttctcacgttcatattgatgtgattaacatctagattcattaatatcaatattaatatgagaaatgtgagaatgacttatattgtgaaacaaagaagtagcaattacgattggatacaacatatcctactactatcaatgtggtactgttctgatttctatcaatgtggtactgttctgatttgtagtaatatatatcatgtttgatgctgaggccgagtttagttccaaaatttctctttaaactttcaacttttccatcacatcaaaacttttctacacacaagctttcaacttttccgtcacatcattccaatttcaaccaaatttccagtttttacgtgaactaaacacactctttgttactctctcaatatcaaaatatagcaaatagtataagaataaacattgtactactaggttactatatttaaatataacggagataagatattttaggacagagggagtaatttcagttcggcgagaggcgacgaccatggctatatacggtccatacggagaatgcagcacgcgatggagatcccctcttgctcgtcacaaatctgaatatacggtccatacggagaatgcagcacgcgatggagatcccctcttgcttgtcacaaatctgaatgcacgagggagagagtgagtgtcaacctcaaccggattgatctaggtgaagtccaataaagctttgaacagttcgtcattataaatcccgatacgcaactactgtttggctaatttggtatttggacaactatcttacggtccagaaaaatggcaagtggcattgtggcgacctcatgttggaggatgaaagggatgtttgaacaaatctcttactaggccattccattgtttcgcttattcatacgttgattcgaaatcacttattagcannnnnnnnnnnnnnnnnnnnnnnnnnnnnnnnnnnnnnnnnnnnnnnnnnnnnn

SEQ ID NO: 5978 - DNA, 635 bp, Oryza sativa
tttgaaaaattctagtaggctggtccatcatttgcctgacccacagtgattaggttatttgcatacatcagagaatgaagaattgtacctcctgtcgtcgttatccctttaatataacctgattgcctgcatctaaaagagactcagaaagttcattaattacgagaacaaataaataagaagataaaggacatctttgtcatatctttatcgtgttctctcctctactttatcatgcgttatctccgtctaaaatatattcatgtgttctctctgtcttaacatatactcctagatgctttgtggttcgaggcagccgtaatatctcaattccgttatactagtacttcaattccacacgttgagacggagagaacatgggaaattctaggaagcgtcatttgagaccttacagcaggggacagcgagtacagcgagaaaattgatattttaccatggtcaaaaactggatttcgctggaatgccactttcaaaagtggtttcgttaaaaaaccaccctcaaacaggagcaacatattacaatgtcatttcatccatttcttctcaaattaatgattttttaatgtttttttattgctgagtgaccaaaatagcattggatcctatctcatctc

SEQ ID NO: 5979 - DNA, 718 bp, Oryza sativa
aatgatttagcatacttgttaatataaatgggcacagaaagcattagaggtaatgattaaaatatacaatcaaatgagtgcttcaatattaaacacttcgaataatcaatgaaattccaaaacacaaggcaatcatgtgagcaacaaatgaacaatagaagctttcaaaacaaaatgaacaatggataaaaaaggcaagtaatttgtgtggatgcagacagccaacattctgcttgttagcttctctttggggagtgaatattgatggcttccaacaaacatggaattgttacagtggcagaatccatagggatgtaatcatcagcacttacttccatttcttttgtttcgataaagcatatattttggaccttttggcttcttctgttgtttcaattgtttatcatttcagatttccatgtccgaagatataggctgtgttcggcactgttcccaaaagaacagtgctcacggaaaacggagcgatccattagcgcgtgattaattaagtattagcttttttttcaaaaatggattaatttgattttttttaaagcaactttcatatagaaactttttgcaaaaaacgcaccgtttagcagtttgaaaagcgtgcgcacggaaaacaagggagatgggttgggaagaaggggtgccgaacacagccatagtcagttgtacttattcggtaacgggtaccgagctgaattcgcctata

SEQ ID NO: 5980 - DNA, 415 bp, Oryza sativa
aaaattaaaaaatatatgcgggcccatttgtcattcacacaaaaaagtttttgtcggactcactgacatatgggtcccacatgtcatcctctcttatcccttcttcctcctctctctctccacctttctctatctctccctctttttcttcgtgcgtggggagcggcgtccggatttgcgccgcctctgccgccaccgcagcagtagggattcgggtttggtggtggcggcgctggagaggcatcggtggtgcgttcgccgcgggggatgatggcggctgggctagggccgcgcctcgccatgcagcagcagtcgacagtcttcgtgccgcctccaccgtcgcagcagggttcggcttcaacgggtccgggaatgaagcggcgctggcgccacgggagatggggatggtggcgag

SEQ ID NO: 5981 - DNA, 967 bp, Oryza sativa
agcttagctattagcgcgcggcgcggcgagcgatgcgtttgccggataactggatatagactgctctctgtgttggcacagctgcaggttaacttgagctgagatggtatcatctgcttgcttgcttgattaatccgcatgcaggaaaggggtgaagtgccgggtgctggagtcgtcgccggagctccgggcgtcggggttagccatcgcgacgtggaggaatgcgttgcaagcgcttgacgcccttggggtgggtgacaagatcaggaagtgtcatcttcatcttcaggagtaagtactagtgtactttcttcgtccactcactaaagtgcggttaaacttggcgcaatttttaaaactaatttgtaactttaaatttctcatatattataatgtttgtcgcaataaaattataattatatgaaagtaaatttaaataacaatccaataatattattttcatcgaataaaatttaatttatagtttattggtcaaatatttaaagagttaaatattaaaaaacgtgcgcatttaaagagttaaatattaaaaaacgtgcgcgccttaatgagtggacgaagtcgcacaagacttaacaaagacctaaacactgcaggagatacacctttgttatttcgtttttgcatgtcactcaaacatgcataatttatttttagatgaaacaaaataaattcatgtgtatactttattaccatgtatgtctaattcgagctctacaagttgcaaaaaaaaaagaatatacggccgtacgtgatatatgaatattatgtacattttaatttgttagtagttaattcttaattgagaaattgtagtagttaatttaattttgtactttttgagtgatatactgtatattaattattttttgaaaaaaatataaatgcaagacacaagtggacatttcctagagcgggtaccgagctcgaattcgccctatagaag

SEQ ID NO: 5982 - DNA, 1001 bp, Oryza sativa
atcaggaatgtcacagaattttaagtgaagattggcaacagttggaagagcctttctattaagtctccaaataaaagttttaaatttaggaggaatgcacttagtggaacagattttcaaaagaatattaagctgcaaagaagtaacaattgtgaaaactgaatgtgatagattatatacctgcttgtatgcactctttgaagtacattcacctgaagaattatgaatccagcaaattttgtcttcattgtcccgaggaacgatctgaactttcattatatgttgtaccattggctgatcaaatatttgattgagtttgctcagttcccaacatgtcctgtcatcccaaagctgagaaatagtattaggagatgcatttgcaaaaatcattccaagaccgccaggaaatacctttcttagagccttcattatgcactcttgtccaccaaaaccgcgctaataatagctgtcaacttgttcaataagctcttagaatgtaaaatcgtggacatacagtaaatagggattgaagcgaaaacatatttaattaaagacaagtggctagcatgagagagcatgttagctttaagagaggtaagacgagctttgaatttggaaataataaacttataagcagaagctctagttcttgtgttaataatcaaagggtgaccaagatgtttagtggaattttctatcagagggacatgaaaaatattgagaatttgatgtttttgttgattaggagtgcttgagctaaagaaaatagaaaattcccccagttaggagtttgaacagattgagcacaacaagtttgaacagtttgaaaaattctagtagcttctccatcatttgcctgacccacagtgattaggttatttgcatacatcagagaatgaagaattgtacctcctgtcgtcgttatccctttaatataacctgattgcctgcatctaaaagagactcagaaagttcattaattacgagaacaaataaataag

SEQ ID NO: 5983 - DNA, 226 bp, Oryza sativa
tggcatttgctctatgaatgaaacacagtttctagggaattactctgttttttttcctacctttgctctgagaattgcggcgtcggcaaggtgtatgatcttggcgttgccatcctcttcgattgcaacgatcttggaggagtaacggatggtgccttttggtagctcttcctctagtgctcggagcagccagtcccgcctgacgcagcgcagttcattgggtcct

SEQ ID NO: 5984 - DNA, 378 bp, Oryza sativa
  unsure (1)..(378): unsure at all n locations
nnnnnnnnnnnnnnnnnnnnnnnnnnnnnnnnnnnnnnnnnnnnnnnnnnnnnnnnnnnnnnnnagttacaaataatagctcgtccaaagaaagaactagaatatacctgtacaatggctatcttcagcaatactccacgcattccaatagcataagaagacatacccattagtgctggtcctagaaagaacctgatggctaatgctagtagcatccttttagctccacaggctataattttagtttgtagagcagtgaaaaggcctgtgattagaagtatttagaatttataataacataattggttttcgcaaagtttagacgtatttaaaagtttatctnnnnnnnnnnnnnnnnnnnnnnnnnnnnnnnnnnnn

SEQ ID NO: 5985 - DNA, 538 bp, Oryza sativa
  unsure (1)..(538): unsure at all n locations
nnnnnnnnnnnnnnnnnnnnnnnnnnnnnnnnnnnnnnnnnnnnnnnnnnnnnnnnnnnnnnnntttatcgggtttcggtagtctacccagtgatctaccggcggtcagaccggcggcaagcggcagtcagaccggcagcatttgggcggtccgaccggcggccgcgacaggcacgacgaacgacttcggcggtcagaccggttgatctataccataccggtcagaccggcggcatctgagcggtcagaccggcaaggcaacttcggtcagaccgatttccatcgatttcgagagtaacttttatttccgctaaaagttttcggtttttgggtataccaaccattcacccccctctggttggcttagttcttgtgattcgatcctacagacgggccctacatgtcagtagccaagtctttcttcccgccctttgtacctttcttacccatcttttcccaggggacaaccaataaaggataaggaccgcgtgtggtgggcggcaaggagaagggcggtggctaacaagacgggtaccga

SEQ ID NO: 5986 - DNA, 699 bp, Oryza sativa
tgtctgggacgccatcgagccggcggccggggtggccgtcgacccaagaagggacaagaaggcgaggtcccatctgttgcagtccctgccggaggacttgctgatgcaggtggcaaagaagagatcggcgaaggaagtgtgggattgcttgaagacaaggttcgtgggcgcggaccgcgttcgcgaagcgcgcttgcagacgttgaagggtgaatttggtgccatggtgatggagccaggggaaactctggatcagtacgcgggccgcatcaccgcgatgagcgtgcgtcactcggcgttgggctcgacgctgggtgattccgcgatggtgaagaagctgttcgacacggtgccggaaaaattcgtcagcctcgtcgcaggtattgagcaattttatgacattgatactatgccatttgaggaggcagtgggtcgaccgaaggcctacgaggagcgcatgcggaagaagaaggctgccgctggcggggtcaccaccgatgggcaggtgctcctcactcaagcggagtgggaagctcacttcaagaagaacggcggggaatcctcgccaccacagaagaacaaaccttcaggtgaaggtgctgggcgcggccagggcggtcgcggtcgcggcagaggccgtggcgcaggcggacgcggcgggacgccgcggggcgaatcaggggcaggctttggcggcgg

SEQ ID NO: 5987 - DNA, 693 bp, Oryza sativa
atgttctttcttttagaacttgttacatcaaacattaaaagcacaacacgtgcacaagggatacatttgttagagtacgcagcctgggccaccgaccatgtcacccagatcacattgggcctgctccaatacaggcccaaccggagccacaactttaggtcctgagcctacacaacccaaaagactagctccggtttggaacccggaacaatttccatgggtcacatggtggagagcccgggtaacaagttttcggggtcacatggggttaatgtgacgagggagattgttgggcctgaggccaggtaacaagtcttcgaggtcacatgggttaatgtgacggggagattgttgggcccgatgtgtgacgagggagattgctgggtttagtcccacttaaaaggtggggcggtcctcaccccatcagactagtcttttgggttgtgtaatcctaggacctaaagttatggcttcggttgggtctgtggtggagcagacccaatgtgacctgggtggcccacggttggtgggccgggctgcgcactctaacaacatttcagctgctcaagaggcaaaaagcaggatttgtttggtggaactagtatttgctattacaaacatgattaatatttttgacagcttgctataggcaaaacaacccttgcttctctggccttttcctagataagtaat

SEQ ID NO: 5988 - DNA, 364 bp, Oryza sativa
tctttgtctatcttcaccatccgcaccaacttaacgtacaggcattggtgtggagtagctttcaccttgacgtgagaaggagcaattgctattcttcgatggagttgtgcggatccacattaccgtcgaaattagcacccgtggacccaggttttcactgtacttcttgccttccagtgacttgagatcagtttgtttaagttcaacaaacttcccaattctgaacatgtaacatccaacaagggttaatattcagtgttatttttcctcccagtctgtaagaataaatggaaaacaaaaaggtccaggataccaaattaatttatcattttgtgcatggaatcatgcctctaaaatgatggca

SEQ ID NO: 5989 - DNA, 811 bp, Oryza sativa
cccctagcatatgaagctatttgctgtcacgatgtccaagaagcaggatagctaacaagagaacatgctattttatttcaaattaatcaagctgaacaaaaacaccaaagcttcaaattcatggaaatcctaactgtttcacccacccccttacgtgtaagcattgaatggacagctactgcgttaggccatcaatggtcatcatcatactaactcgttatggtatgatatttttccattaacaggtcaccgtttttgcattattaattaaaaacagaaagattcctgagttagttagaagaggtttggggtatggaagaacagctctaacctcatattaaactctcactaagtcactagcacatatatgtgtggataaacaatctcagcacaagaatcagtgattttctctgatctcgcctaaggatcaccacagatagggacagcctaatgtgggcattttaacaacaaagttcaactctacacagcctacgccctacggataaacacttcgttgcattttcatcagtcaggttcctggacattgtccacatgcactgtcaccttcatgttcttttcctattgatgtttttatcctcttatgtttaaatcttttgctacactacatagctgggaaaagaaactttgtgaacgtcgtcctcataacttgatcatgttccttgtacaggaaattgcgaagaggttgcccaggccaacggcgtcttgataattagcttcggtgtttgttgaagtggaacacatacaagctggtaatgtgcatgtaacatctctgtcagggcaaaaactgctg

SEQ ID NO: 5990 - DNA, 637 bp, Oryza sativa
tcagggattaaaagaactgcacaaattaattaagagcagaggccatcggaatggataaccttcggatatataagaacaaaatgattattaggatttccatgtgagattagacagtggaagaaaatgatatttaaggataattcaccaggaaggtttcaatcatgaacaggacacgtgtccccatggagagagaccatacccctctgaccctgtagtccaatcccgggactaattgttcgtagtctaaatatgcttaatacggtcatattccaaagctagtgcagtctaatcgctttctttattctcttatcaattgccgcgttcttcaaacatgggcgtgttagtgatttggattgcttcaatggtaggtgaccgtgtggcacgccaaacctgcaaaatgtgggcgaaaaggacgtgggcatttcattccggataacgaagaccttgatgaacattgttgactccctgtctggaacgctgaaatttttgttattttttttcttattcccatgtgaaaattgcacagaacatgtgtagatcacagagctagaattgctgtatacaaatattgccgaggtgatagttctggatttcacaagttgcaggtagatcagaaaatgcagttgttctgaaatgg

SEQ ID NO: 5991 - DNA, 641 bp, Oryza sativa
agacttgcagctgggcggcggccaaaacccaaatcacgtcaacaagcaccggaactcgagagcgtgccgcaatcgtagtcgggcatcatgagcagcgtcttggcgagcaccccggacaacagcttgtcacgcaggaagcccacggcggggtggtcgctctgctgcacgaaccccaccgcgtacgacgcaccggtcagctgcgcactcctccaccgccgggcgtccgcgtaccggcgcagcgcggcctcgacgacccggtgactctcctcggcggcgcagtcgccggtacggagcagcagcgcctcgccgaggcacctcgccaggacgacggcgtcctccagcgccgtgcacgcgccctgcgccaggtccggcgtcgtcgggtggagcgcgtcgccggcgacgcacacgttccccttgctgatgctcgcgaacgggagcgacagcggcgatcggaaccgcagcggcgccgcgagcacgtcgttcatctcgctccgctcgaccgcctcgagcacctgtggtggcacgttcgtgctccggagctttgtcagcacgaactgcttcgtcgcggctgaactcttgtcgacatccttatctgtcaaaagacacggcattaatcagtaatacgattcagtgttcatgtc

SEQ ID NO: 5992 - DNA, 758 bp, Oryza sativa
ctcactttatatctgagagtcaacctatctatgagattcatttactttgtggaaccaaaagaaacaatttgtagattgtggtatgttgtagaaactgaatatccaatgcagtcagcagcatgtcatgttcagtagattccttattttattttgttgctatgcatgctatcggcaactctaatgttcgtgtaatataatacaggattcaattgtggagaagctgccaattttgcgactccccaatggttgaagtttgctaaagaggctgcagttcgaagggctgtgatgaattatcttccaatgctctcccatcaacaactattgtacttgctagcagtttcatttatatccaggtttttttttctttttctttttggagtttggttttgtgctgtccaaagtgtctttttagtttttgcacctcattaataggttgatgaaacaaaatatattacctttgtcctccaacaaaccaaatgctacagctagtgggtaggggttagatgcttgttaggtctgccatacagaaggattacgcataaccgcaaaggtgaagttgtcatggtgctcctgggagacgccgcattacaggatcaccacaatgctaggtgtaagctagacttcaactaaatcacattatattccaagtatatcagatggaaatataaacggcaaatggaaaatgtagcgcataaaacccactcaagccgctacacccacccgctacccagtccatgagcccatttctacaccctctc

SEQ ID NO: 5993 - DNA, 751 bp, Oryza sativa
aaagatcatatacatataggatcaattcagagtttgccgcaaggatagattgatatagcacaccaaaccttctgaaattgtcgtggcttactagaataatttcgtgcatatattatttatttattaaaaaaatgcttagcaggagctctttccattcactaaagaaagaatcatatagaatagagctggttacaatcagaacaccaaagagagaataatataggattatttctgggctccgttcgtcatgtatcttaacatttttgtcttgagcataccataacctcaccttttcttttttatggaatttcctgtcttttttgtttactctactgatagattgcatctactgagattacaatacactgaaaagccttttctctattaccatttaccaaagcacatatttatagatgggagttgtctgaataagatccttcttgttttagtatccactataacaatcataacaggaatccaacctaatgcttgtgttttgtcttgcttgagcacgcgtcatattttgtccaatatatggaaatagctaatcatctcctttattttacttctttagattgcacctgccgagcttgaagggttacttctatctcatccagagattctagatgctgttgttatcccgtaagttgaaccacctaaaaatttaagtgtttcttgctccttatgatataaactgttcgcttgttacaacattgttgttttggatcgttctctctctgttgtgccttgt

SEQ ID NO: 5994 - DNA, 542 bp, Oryza sativa
  unsure (1)..(542): unsure at all n locations
ctatagggcgaattcgagctcggtacccctaaaatcttcagcacaagtgctatatgctagattgtagaaggttagctgaggtaggcaatggagaattagcagtagattggtttggaaacagcaaggaggaagaagctttggcaacggagaagaaggaaacttaaggtagggtagactgattatccatcataatcaactcatgtacacagcatggctttacataaaacaagctggagcatagcaccatcttagctctaacttggttactagctttatctctaacttaccaactatcccatctcatttttttgtagatagcggaagtgtaaacttccagcttagcaccaatattactaatatttcaaatttcatagaaaacattactaaagtaacacaataattgtgcacacagagatatacctggaatttagattatacaaatcccttggcatgtatccttcaggcgacacagaatcagtagnnnnnnnnnnnnnnnnnnnnnnnnnnnnnnnnnnnnnnnnnnnnnnnnnnnnnnnnnnnnn

SEQ ID NO: 5995 - DNA, 675 bp, Oryza sativa
attccccaacctctaaatggccatggtttaataataggattcatagccgacgccggcactcgttgaattgccccaaacttctgacaatcttgacaccccttataatatctgaagcaatcctccagcattgtcggccaaaataccctgcacgccgaagtaaccacttcattttatgggccgattggtgagtgccacaaattccttcatgaacttcgccgattgaaactttagcctgatcggcactcaaacacttaagtaacactccatcaatcgtccgataataaagctcattatccaatagagtgtacttcaacgccttatattttaatttcctagaagccgattgatggattatgtaaatattgatgcacatcatacctccaatcatcggctgttattgctgcaatttcaaccttaacatctttgatcatcggcttataccccgatgccccttgggctaaataattagtttcaatattttgttctcgagatacatgccttaaagtaaccagccgaaattccttcatcagttcttgacacttctcattataaactattaacgtatcattcttgcattcatactcccctgccaattgactgattaccagcaaagaatctcccatgatttcaatagcatcggcttcaacttccttaagcaattgcaaccctttaagc

SEQ ID NO: 5996 - DNA, 941 bp, Oryza sativa
ctagttggcaaggttatgggagagcatttttttttcagcaagctggttaaattttgggttatagagtcatttgacaactctgttagggcctcttcggattgagggatttttagaggatttccagaggaatactgtatataggaaatatttcttcacatgaatcaacccaaaggaaaatcagaggaaacattcctttcctgtggaatcaatagagaaacaaaggaaaatttacatctagtcctaccttattttttccatttcctacgtttttcctctgtctatccaaacacatgtttatctacagaattcttgtgtttttcaatcctctgttttacccatgtattcctatcatattcctatgatttttctattcctacgtttttataatcccatggttcgaataagcccttagagttgcttcataggatttggtcgcaatatttgtcatgtgccatgtgtgccgtgctgtcacgcaaggatacgtgatagcaggcgcgtgacctacgacgggccagaccaatcaatcaatcaattggagcgggccgcaggctgggacaggatgccaagtgccaacctagccacgtactccgtacgcctgatcccaccggaaggcccgcgttgtgcgttgtgcgttgtgcgttgtgcctccctttctcgtgcgccgccgggctccgttccatcacccgcggtgccaactgccaactgccgattgcggaagtggaacctggcatcggcggcaacggcacgagcgcacgaggcagccagccgcgcatccaccgatccacgggccgggggaccccgagcgtccgcccacccagcagggcaccgcaggcagccgcgaccgcgagcctcgtgtaatcgtgctggatttttcacattttggtccttttgaaaaacttatttcgcaagtagatccctacaaaaacttattccaaaaaagg

SEQ ID NO: 5997 - DNA, 1159 bp, Oryza sativa
cgtcccgttggatgacggcgccagccactccggcgccccaaaaaggaccatttctgggataagttttttcaggagtctatttgcgaaataagtttttcaaaaggatcaaaatgtgaaaaatccagtgtaatcgtgttgcctacttgccagcccccacgagaaaacgtcgtcttgccctatttctgggcgcagaatcgcagatagcgtggtgccgtggtggcacagggcaggcacatcaagtcatcgaggaggtcaagtcatcaaagacagagtccagctcgctctcctccatccaacgggggaggttgactgatcgcccttgtccaggtccaggctgcagtgtgccatcggagctactacgcagcttcacactcagcagtcagcacatgtaagttcacaaaacttgcagccttctgaagcaaaaactacaccgtactccctccgtcccataaaaaattaacctaatgctaaatgtagcacatcctagtactacgaatctggacatacctctgtccagatttattgtactagaatatgtgttcagttttagttttagattcgtttttctctggacgaagggagtatgtccatatatcagggtcaagcaatcctaataactgaactaaactgcacatagattttaatattttacttgcactgtttgatcacttaaaaaattgtgcaaatataaaaatgaaaagttgtgcttaaggtattttggataataaagtaagtcaaaaaaaataaataataattctaatattttttaaataagacgaatggtcaaacagtacaagcaaaatatcaaagatcccttatattaggagacggagagagtactaattaatgtacactggtttgcttccttactggtagcaatagattcaaaactgcacataggagtataggtcaaaccccaactgaactgcacaatcggtctgcctaggaatctacagtattcaaatgtttaattacaaaatcagatcgtcacggaggccattattgcgtacaaactcctcatagtcagaagaggcacacaagagtaaagctaaaaaaaaaaaaacatgccacgccctggtctccaaatacagagtgtggaaggaatgtacatgatggccgatgctaattgcgagtaggatggatactggaaatagcggat

SEQ ID NO: 5998 - DNA, 8814 bp, Oryza sativa
  unsure (1)..(8814): unsure at all n locations
nnnnnnnnnnnnnnnnnnnnnnnnnnnnnnnnnnnnnnnnnnnnnnnaatacccagtgtggaaggaatgtacatgatggccgatgctaattgcgagtaggatggatactggaaatagcggatgaaatgtgagaacaataattcctcggagacttcagaaaagcatcgcaattcattacataaattccccgatgtacttggtgctcatcctagtcaaaagctaaagattccagaagtgctctcttcctcaaatgagaattggtcctcaacctctgcatcggtgaaggtaagagctctctgcaactttttgggacagaaaacctcaacatcggaagtgtacacagctgtcacagggcggtgatcggatagcctgatatcaactgtcctgtaggcctgcagcctcattcccttgccaaaggaaagaattcggtcacacctacaaagttaaacaatatttttttttgttagcacgcatcgctcatcgcaacttagagatttcctcatacacaacctcaattcttacaatacctcttattaaatagtagtaatgaggtgattaatcgtgagttatgaggaccaattctttcctcttacacaatacctcttacaatacctcttacaccttcatgagttatgaggtgattaatcgtgtaaacaacgaggaaaaatgttactacctccgtcccattctaggttgtttagcatgtattagggttagaaaaaaaatactacaatacctcttattaaatagtagtaatgtataggtggatctgagattatagttgaggggtagaatggtgagaaatttgaattgtaagtggttgatgtcacaagtaatacttcaaagtgataactattttaggacaacttttgaatgctagaaagacaagtattttatgacggagggagtattaagaaaggacaggataaaaaaaaatgaagagcgtatgcagatcaagttacgaatgatcagattagcataccaggcaggtgttctccttccagattttggctcatcactcgtgtatttctctgagttaaccttgtacttgtatgtcgggggaaagctgataactccttcagtccacccatcaaataaatgccctttcttaaattctcgttttagctatcatagagtagaaaacagtgaggtactatgtatttataaagtagtaggagtatgtcacaagatgctgcactgctgccaaaactttacctggtcattctggaacaaaccattccagtccttcatggatatgaattcatgtgttttttcatatgataagttgatcctataattgagatctcctaaccatattatccttctgaaatattcaagaaaataaaaatattagacaaactgataagatttatataaactaataagcaatgtttcctgcaattcttgatcaaataaaactaaaatgaacaaaagaagtataagaaaaatttcaaatgtgtgcaaccctcgaacacatgcttcattatgtgatttttgccactaatatgcacagattcacttcaaccatttatcccttgttataccatcatatttaaacaagtaaacagtgacgccaaacacaatctaaactgaaattgagccatcatctgcttcattatgtgatttttgccactaatatgcacagattcactttaatcatttatcccttgttatcccatcatatttaaacaagtaaacagtgacgccaaacacaatctaaactgaaattgagccatcatctccaaaagagtatcaaatggcatggataaaaaacatgcttagtttagctagagctttaggaattgcgtactgagcttctagtgttttagagttgcaagtttacgtacttactcatggtcatatatagtcttaggcatgctaactctggaaaccggattaaatattgtccttcgatggatttcttgcacatcagcattccttttcagttcatctccatccttttctccagaggtcaggtggcaacatataaagcaaaagagtgtttgataaatggacatgcttactgctattgatccctggagcatgtcaagtaagaaaaattagcccattgttttctaaatagcacattgacttaccagcgcatagtaaatgtacatgagatggtacgaccaaagtgcacaaaactaggtgctaaaacgaaagtgtaatatgatcattaagaaaacaaatatagtataaaagaatgctaattttggctgtgcctaacagtagaggccggagatgtaaaccatttctattatccaaaaaaaggaatgctaattgttttctacatatttggaattgctaaaggaattgagaatgatgtgcttcacgggaacttgccttattaccaatataacccatagcaccgacacctacggttgatactttcaaattttgaatatgcttccgcaggcttcttcgtacccatattgaaataaaaactccaaccatctgcttgcttattatccttacgaagtatggtcttttcgttttgactagtgcacttttgatgttaaaatcatgaactaaacaatcatctggaaaagcattggaatctccatgtgctgatttgaaagacaaacatgacctcagtgccttctctgaaataaatggtttcgtgctgtctggaagacgctgggccaatatatccaacggttgttcaggccaaatcattccaagcctctctgagtagctgagtgttttagttaacattttttgatggattggctcttccaaactagatacatagtctttaaaacttaagttgtgtgatctatcgaaaatcttcattgaaggcaccctgctgaagttgtttccatttacggtagtttcagtaggaccagaagtagagtgctcatatttattactatgaacactgtcatcatcaacggtaaaatcttgttcattccatgggtgcacttccccgccactttcgctgtcagattcactaacaagttcatcttccacatcgtcagaaggcttgaaccttgatggagaaggaggatcactgtgacatttatattttggtttatcaggactaatcttattcaatgtttcacgaatgatatgttcccacattgcgacaggacggttgtcttcagcaccaaatatattcccagcatttaatggaacaatttcttgaaatctaaaagataataagttcaatttgtttaataggtgaaaaaaataaaaaggagaaatatcagtcatagtgtaatatgaataagtaacaagatgggatgcaacaatttacccaagaacataaatatcagctggctcctccatatccaaccaatcttgaatatccaagtcatcaggtggaagtcttcctgcaacattccatgttcctacgcagaccctgcatatcaaaccaacattttaaggaatagtgacagaacggcagtagattttataggtttcagctgcaattaggcttgatcttaaggggttattcttgtgctaggaaagataaatatattgaggaacaaaccaagtcatttagcttatctgaagcaaattcttacggaaaatactgtgaacaaacaactaggcaagtccagataatctgaagggagaacaaatgcatgcctgagttccttaatgtcgatatattgggcacgaagggtctctgacttgcgccttctattaagcttgtagggagcaccctccatttggctatctgaagatttgatagtcttcgtcagtgcacaaggaagctacctgggttttctctgataggatgtgtatgccagaggtgcttaagaggtagtactagttcccatcgaaaattggtgaaagggtggactagtatgtaccatgtagtatctcttagtttggcagaatcaacaccgtatttcacaattttcagtgtgtggcaaaacaaagaagaaaacatactattaaacaaaacctggaaataagcatccagaaaaaaagaagtttgctactgtgattaatatagtaacttatttcgttggtgatatgtagttcaaatttttcatgtgatgctttgtcaataacccttttgccgatgaatgtgttgaacacaataattatgcgaatcaaataaataccaattgtctcagcgcccaaaccacgcagtctcctctcctcatcatatagttggcgctcccaatggcacatttctgcacaaatcccattataagttcaactattattagaaccaatttttgaaaaagaactgaacatacatatgccgtagccaacaaatttaagtgcaaaatttacacttgttttcccttttttaaagctgcctcctttttgtcagcatacatgtgcggcaaatgtatttatggccgtcagattcagatgtcctttcattttttttccttatttcctttagaaagattgtactagtatactatcttaggaataggatgggagagcttgtcgttttgaaattcactaaacaaaagaaacattggttttaacattctttgaattcaacgtctaattttgtttttttgttctaggtaaacggaggaataaacaaaccaaaggaatagcctaggagttgggaatacaccaccacaagaaaccaaaagaacaatacagtccacctctactttttttaagagcgaggatagtagtgagttataaaaaagctatatgcttaagtggaagagagagaaaaaattgagtgactctcatagaaaagctagctctaaacatgctccaaaaatatgcattaacttcgtggtgagggaaagaaagaggaggaaaacaaatagagctaacctcgtagctaatatattatacatgttagttctacaatgaatttagtaaggagtaagctctactattaaacttgctctaatgagcaaggttagaaaggcatctccaaatttcgttaactccccttccacttcctatcctttttcccccctgaaataccagaatcttacggttgtgctaagtgctaactggaccagctcaagttgaaagaagcaaccgtcaaagctctcatctttattggttgtaagcaaaaacatccacctaccaaaccaatcgatgcattcttctggtccacaacttttcttttccaaagaattatgatggacaaaaagatcaattctggagacgagggaccagtggttgaaccaaaacccgaatgcatttcccgatccattgagcttcacagcgaattttggtttcgatttttttttatttttattttgcaataatgaagcccatgtggtagagagagggagagggtctagatcaccttcgtactcgaactcgctatcggtgtcgtcgtcgccggtggcttcgccctcgtcggcgctgaagtcggattccggcgacctgatgttgagccatttccgaagcaccgtcttcggccacagctgtgtgcatgccccgcgtcgcgtccgaccaaacgtatcagttagcccccgagcaacgaaactccgatccgagagagagagagagagagagagagagcgagcgagctttagctagcgcggcgctcacctgcttctgcttccttcccttgcgccgcatcggcctggacgaggcgccggcgccggcggcgtggtggctcgcagtggcagccggctcctgctggctccccgacgcgccgagcggaggcaatgagcgagccggtggcgtggcccgcgccgacgcggaggtggaggaggcgccggccattcgcgccctcgtcacagcccaccaacacagcgcacacagcaaaaggcaacttctccgtccgccttccctttccggttcccttttttatcgagtccggtgcgaagctataaaacggcaaatttattagcgcttggacttggacttggacttggactgcacggcagctggcctagagggaccctagagtagagccgcagcccgcagcaagcaaagcacccccccctacttgtaccagcgccgctggtggcggtggaatggtggatggatcacggccgcgacgtgcaggctcacgatgtggcgccacgcggcgcgtgggttggctgtgtcgtggtctctccccaagttgcacgtacgcgcgcgaccaatcgcccgcggcgcccgcccgtgccttgaccaccccggcttgggccaccgtcgtcccggctggctctcggtgactggaagaacagctatcgcggtgaccaaaccaagctccgcgttctcctcgtgccgacctgtgctggtgctgtgccccgctgcgcaccgtacgtccattgctatacttgaactggacggagacccggtttatcctcctatcacggtcacggggattccctactcctgtactacagctaccgctgccgctaccacttgctcttcttcctcgcagcgaacgaagcttctttcgacgcgaaaaaacctgtagctatctttcttcgctcgtctcgtcgccgttgtacgtgacctgtatcgcggaccagggttaattagttcgatgtgactgaaatcttgacatgggcttggtttagttctcaactttttctttaagcttataacttttttatcatatcaaaactttcaattttagtcaaactttcaactttttttttaacttttaattttagtcaaactttcaattttaacatggaactaaacacacccatgtttgtgcagtttgccgaccaccgcgcgtgtcaaagttacattcttcgtgtaccacactacctcggtacctatccgaatactacggatttgtcgctagagtcttaacggttgttgcatcgtcatttcatccggtgggagtttcacacttcttcaggttccaacttggagcgtatggccgagtgaaaaaaatggacggtgcgtatgcacggcggtgggccggtggctgccatggcatgggcacagcgtatgcgcggagagatttccaagcaaatccgcatgcacgtgttttccacgcaaagcagcttggtttggaggctgtttcaccagtagcttgacagcgatcagccggattagctagggcaattgatgttgcttgcctggctgccgcctgcagatctcccttcctacttcgctttatctcaccttttgggtgcactcctcatctgggccagcataaccattgcactagtttttgtttcgttataaaagtttctcctcttcttcttttttttttctttcttacacaggaaaaacaactgccatgttcacacaaatttgtttgggcattcctgcatctcttcatttttctctagtgttttacgtgtgacttcagctagtctacagttatgctgttatatggggcactctcaaatattaatactgatcacgcagaacttgtggttggtagcatattgttactttacacaaatgatgtaaaagaaggcgtgttgtctggcccagagcacaacaggtcgaagaagaatcctcttgaagatcgtaaacaacaggcatgctagccaaccaagaaagatcgaatggggcaatgctcaaccatgattgacttgtaaaaagatcaggagctcatctttcctcgtctgagattattcagctgtatcaatactaggattgacatttggtacaagcatagctggttcgtattgcttctggattccgtgggcaatgatttttcttaagcaaaactgttctctatgttggtattaggtgtgtgctttgactagattacgttctgaaacaaaatacctactatacatgattcaggggaaggaaacgctatgccacgatggatcacgtacagagaaatgtttccaacttctttaacattttattatctaagtcggtgtcactgtcttccatcaaacaaggagtataatacattaaattgtactggaatatatttgtttaccaattcatggcatgacaggtcgaagcactgtaccagacagtggtcatatgttttcctcaatacaaaggacggtggtcatcatgcccactgctcctattatcatcactgcaattttgttgttctctatatttttcgaaccatattgaaagtttgcatatttttctagtgaggcatcacctggtcagtttgagacaatagaatccaatcaagtctgctgataggggaataaaccatcatggcacctctttctccctcttttctgaagggagacaaaccatgttctctagtaccgggcgtctgattaaaattctttagtgcaatttatgcaactaaatctgccccatttgcagtacacgcaccactcatcttctctagagagagctagtgcttgcacatgaaagcagagcatgaacagatcaggccatggatgttggtcgtttggagatgccccattcgtccaacagctgcattattggcaacctgacataaccgcactacaaatcaatccaatgcatccgaattttagaggctgtttatttcgtgaaaagaaaatttttggttgtcacatcagatgtttgaccggatgtcggaaaaggtttttggacacgaataaaaaaaactaatttcaaaactcgtctggaaaccgcgagacgaatcttttgagcctaattaaactgtcattagcacatgcgagttactgtagcacttttatggctaatcatggactaactaggcttaaaatatccgtctcgcgatttccatgcaaactgtgcaattagttttagtttttatctatatttaatgctctatgcatgtatcaaagattcgacgtgatgtttttaggggaaaaattggaactaaaccaagccagttcacgttttataacctcattggcattgttctatcgatcggcgatgggctgatggcgacggagagctagtacttaagggataagcaaaaacagggccttgtgcagctttcacagtttgcgtctagcatgacgccatatgcac

SEQ ID NO: 5999 - DNA, 2750 bp, Oryza sativa
cgggtggaaaccgtaacgccccccccccagggccgaattcccgggtgacccctgtacgtacgcgtcgctgtcgcgtaccacctgctcggagtacatgactacattacgcacgggccggccggtataccgaaagctagtacgggggcagtagatttttgatgccgcagaaaagacggagcgagcgggggtgtggtggagacgtcgacacgcggccgcgagtggtgcgcgcggtgtggttttgactcccgggtgacatatgtacacggattagattatgttatcttcagatgggcgcgcgtacgttgcagaaagcgtgaggtaccgagatggcatgaatgggatgggagccagtcagtttttttatatcagaaagatcataggtaaaggtgcaagcagaccgatccacgaacctatgtatgatacaaataataaacagacaaccttttgggttatctattaatttgaattataaatgggtttgcgaatctttccacttgcacctttaatcatgggagtgcacatactacttgtgcttgacacataatttcctttttatctcatatctgaaagagattaagggtgtgttcgaagagaaggggattgaggagattgagaagatacgtaaaacgaggtgagccattagctcatgattaattaaatattaactattttaaatttcaaaaatagattaatatgattttttaaagcaacattcctatagaacttttttacaaaaaacgcatcgtttagtagtttaaaaagtgtgcgcgcggaaaacgagacttaatctcccctatcaccctggaatgaacagagcctaagggtctctctgaatcgcaggaatggaaaaacgagggaataagaaaaacatagaattttgataggaatataagtacaaaacaaaaaaaaagaagaattagactgcagaaaaatcacaggaattagataaaagagattttcagttgaagctctagctaaaattcctttaaaatctctatagaattgtctattccatatgaattttaaaagatcaacatatgatccaatcatttgtttaaaaacattcacaggaattttttcctataatattgaaatctttcaaatttttttatgttttttcttcgaattaaagatgccctaactttttttttaagatgaaatgaaagagaactaatcactcggcaggaagagccgcacagggcagggatagcctcgtgagagcgactcatccgagacgtgacagagaacccggttccaatagggctatatgccgcgaagtgggagcataaacagaagcaaccaaacgctcgcattctcgcactacagctctgcagcctttcctccccttcccaatgcattactgctagaacaggagacggacggacagcgaaactttggttacaatagcaggctataagccagctgcaaacatattttaaagagataaataaggagaaaaaggagcagcgggctacagatttatagctagctgtagcacggactccaagacgcggtatgtgtatgataggtaggaccagatatttatagtatagtatgtaactattgtatgaatgagctattagattggctatagatgaattggaggctagtagttgactatactattaaacttgctctaagaaaaagtatcatatacggcgaaaacgagactccagtagcagccacaaaaggagctatctccattctgtatcacttgactttcgaatgttgaagaagatgtgttacatttacagagagattgcacgcaagcatggccttgaacccatcttcgtgcactcgtgtgctgtgtattccacggtgctcctgcgtgtgactcaagcactgggatcattttgtatgtgcgttcgccgatcgatgtgttcttcgatcgaaccataccgatcacggggaaaaggagtaatcgaggcgcaccgggggcaccgagcccgtaatctttcaatcctgctttttgtgaaagtagcacgtacggatcgagcggctccgacgttgcctcggctgccaggaacggaacgtgattcctcgagtatagatactctttttttttaagtagctatacaactgttgacagtttttgggatgaaaaacttttaaatataactactatgtaattacattgtaactactatgtaactactatataactaatatataactcgagtgtaactaaaaaaacccgatgggagaattggttaggtgaacaatccctactgcacgcgtctgaattttttaaaccgttttccctcactagcacaaatctcaaagcatattagacggcttaaaatttaaaagtttttaccccctattaactgtcgccagttgtatagcaaatccatttttttttaaacctccaaggtagatactcgacggacgtcataagatttgctttcgtttgtttactcactgtttacatggtgcagcatcgtgcttgtcgatactagtagatatttgggcgtacaacacgacaaagaaggttccgaggcttgggaggctggcccccggcgtccgaggccttgagggtagtagggtggctccggcggtctgcttcgctgttccatggttctgaattaaacgggcctctgatgggcgatgtcgcatattttttgggccagaatcctaaggcctactgttgaagtggacgtgcgggtttgtttaggtgggctcgttatccacatacatgggttggaccgtccaagtaaatcgattcttttagggaaaaatacaccggaggg

SEQ ID NO: 6000 - DNA, 4747 bp, Oryza sativa
  unsure (1)..(4747): unsure at all n locations
attttacaaaattaatcattttaccaaaaaacattcactttaggtcattcgggggttttgaccacagttttattttacggggaagtggagtcagcgtgggacccacgtgggcctccacatgtcagcatggccacgtcgggctcattctctgttttcctcctcccctctctctctctcacattcttctctcttctctgggcagccgaccgacgactggggcgggaggccaccggggcgaggcaggagagcaggaggcggctgcggctgcggcgggcgttgcgagccggggtggagaagtcgcgggcgctcaaccacgcactagcagggcggggcccaagcttggggagatccaggcgaggttcccggtgatggagacggcgttgtgcccgatcacgccccgcgggacacactcgagggcgctggggagtacatcaaccgcgctgtggggccggccgtcgccgtgcgcggcctcgagccgccgttcctcgcggcctccgccgtcgccgacgacctcctcggatacctcgtcgtgttgtcccgcctcgaggaggtgctccacttcctctccgacaactgcggcatcgcctcccagtggctcagcttcgccgagtacctcggggaccgcagcctcgccgacccctgcttcgtgtccgacctcgccgaggtgctctctcacctcaagaccccctccgcaaacctggacggcggcctcctcgtcgctgccttggacattcttgaggacgagttctgtcgccttctcaaggaacactcagcttcgctcgccatgaaagaacccaactatagccggccccgcctccaccttcgtgcccactgccgcgggcgttcggccccgcctccgcctccgcgcccaacaccgcggtgcccgcctgcacggggccgcttcaccggcggtggcgacacagcgcgacgacgccattcgcaaccggccgccgccctcgccttctcctgcatcgcagctgccgccgtcacctcctctcccgcctcactctagcggcatccgccccagccgccgtccggcttgcccagagaagagagaagggtgagagagagagaggaggaagggagagaataagggaaagagaggaggccgacgtgccacgctgatatgtggggtccacgtgggtcccacactaactcagctacgtaacgaaaacgggtcaaaaccaccgaaggatctaaagtgaacgatttttataaattgagggatgtgctatatctagtttcacagttaggggacgattttgtaactcagatgacaagttgagggaccttcggtgtactttttccactcttttagctttattaggactgtgttcttccctttctttttcaactcatcttcattttttttacgtgtatgtttttcaaattactaaacagtgtgtttttttcgcgccgaggttgaagaagctggtgagcaggaccgaaacaaagtttgtttcaaactggcaatgccaactataccgtcccattaccacactaatcttttaggccctacttgcctgatgcatctgccgaatttaaaccccggaaacgatattatttgctgatgacgctggcgaaaattcccttgttttaggcatataaaatgcagaattgcagataccgtgcagtatatccaataccagctcgaacttattcggcaaaaaggggtgcccagcatcgcagtgcaatgggctgcgacaaagcggcaaacataaagcaacatcacaaccgtgcacaaccccgaagcagtcaggtggtgtttagatccagggacttaactttagtccctgtctttagacactaatttagagtattaaatatagactacttacaaaactaattacataaataaaagctaattcacaagataaattttttaagcctaattaatctataattagagaatgtttactgtagcatcacataggctaatcatggattaattaggctcattagatttgtctcgcaaattagtccaagattatggatgagttttattaatagtctacgtttaatatttataattaattttcaaacatccgatatgatagggacttaaaaatagtttcatctaaacagggcctcagtcgtctctccggaatttattctggtgaagtcaccaatctatcgcaacgaaacaagacgcggttgaccaatgatcagcaatcagcggttcagcgtacgtttcagttcagcactttgggcttcccggcgagcatgaaggccttgaacacgagcttcctcgccaccgccgggtctccccactccgcctccacccccttcatcacgtccttggtcaccgcctccaggtctactcccttctccctcgccgtcgtcacgacggagccggtcttcaggaacccgacgaggtcgtccagcgtcatgtccacctctatgtcgacgtcggccggctcgccctcgcggcccacgccgacgggctcgaacgggaacggcaggtcgcggtacctgtccatggccagcctcgtcctcgggtccatatacgggcgcatggccgggtacagctggccgtgcagcttgtcctcgaacgggtggatctcgtagttgtagccccacaccgcgaggacgccgccgggcctcttgaggacgcggttggccacggcgtagaagagcgggatgtcgaaccagtggatggaggtcgccaccacgacgaggtccagcgagccctcgccgccgaccatggcgacgaggtcgtcctcggagaggtccaccggggtgtgcaggtaccgcaccttggggtgcgcgacggcgtggcggatctgcccctcgctcgcgtccgtcgcgaccacgctgtcgtagtgctccgcgatctgaacgcacacggagaaacactgatgataaagacggtcgatcgccggcgaaatttttcgttttttttcagagttcagaagatgatgaagcggcgagagtggttcagagattgggcgcttacgctgatggaggcctggccggtgccgcagccggcgtcccaggcgcggtggtggccggctgtgagggcggcgagcttggagaaccaagcgtcagggtaccgaggccgcttcttggtgtacgtctccgacggtctctcatacagcccagccattcttgctctctgcttcttctctataacctccaccggaccacagctccagtcctggactgtgaagagcgcgaattgttggggtggatctggatggaatttatagatcaccgaagatgacagattcagagtcaaagtcaaaatcagcagttgtcatctgatccatctcagtgaacaactttgcatttgcattatccactagtgtattctagtggcggttacaccatttttctcctcctaatagtacaccaccacatgctgaaactgctgcaacaaaaattatgcacaagataaaataattttcaaaggcaatcaggaaagtagaagcatgctgctaacaggacaaggaaaaatatggggtaaaaggtaggtaaaaacaggcaatgcatcaaatctgaaagatgtggattgtagaaagatgaggtaaagacaggaatagcaatctgaaacctgtagattgaaaaatagcctgggtcttgcaagtcaaccagacgtgggcaagttgcttacttcgatttgtggctaagatggccctccacattagtcctgcgctgaactaactgaacccaaaaagatgcttcagcagccgtatatgggaaaacaataagatgctttataacatggatcatctgccagatgaaggcttttacggttaggtcttgattacatcttcacagtaaaaacagatatctttggtttcatcagcatggatataaacatctctgcacaaatcagagtgttgcaacctactataataacgctacaacttaggaaatagaggattctgaataacaagacaactatacaacaataacatgggaattccagagtctgtgactgggaattttagactggcacagcatatgcagggactggaggtgtgcctctgccaacttcagctgaggtttggaggtttaggtaagtgccttggtcactacatgtaaatatttagcttaggtacagcaatatttaaccaaatacacttaagtatttaaccgtgtcttatttgttcttttagataagggttaagtccgatttatttgttagcacttgaagacatggtgacagtaaaaaaggcatgacattagatgataactatataagataaagaaccgctcattttacataattactcttttcagcgatacctgaatgttattcttacatatttgtagtctagtgggtgcaacagtgcaagcaattcctgcactggatcaagtccgcagtatccacagaccacagtccacactgcctgacttagaggtgcaaccgtgcaagtcatctgggaaccttctgtgccgttagaacacatcaccctgtctgcaaaatacctgattcttttccaggagcaatctgataatgcagctttgcatctccaggagttcccaaaggtgcaccagtgcaggaacagttatcaaccatataaagctcccacttcttgatcccacacttatctaaagcagatgccagtcttgggtcatcaatctggacaagagccatctgggctaacgagcactgctccagtgtatgctagtccagcggcctgagcggctccgtgataatggaacagaccccagctgaaatcatctgaaacatcaacgattgannnnnnnnnnnnnnnnnnnnnnnnnnnnnnnnnnnnnn

SEQ ID NO: 6001 - DNA, 17558 bp, Oryza sativa
agtctagtgggtgcaacagtgcaagcaattcctgcactggatcaagtccgcagtatccacagaccacagtccacactgcctgacttaaggtgcaaccgtgcaagtcatctgggaaccttctgtgccgttagaacacatcaccctgtctgcaaaatacctgattcttttccaggagcaatctgataatgcagctttgcatctccaggagttcccaaaggtgcaccagtgcaggaacagttatcaaccatataaagctcccacttcttgatcccacacttatctaaagcagatgccagtcttgggtcatccaaatctggacaagagccatctgggctaacgagcactgctccagtgtatgctagtccagcggcctgagcggctccgtgataatggaacagaccccagctgaaatcatctgaaacatcaacgattgtccaaaactcctttgaaaccacaccattatccagcacactgaagtaaaatgtaccagggatgagagctcttcttactcggtactttctgcgcctccaaaccagttccccttccagggttctgacttgaaaaattggctcataccaaaatgaacctttagcttttcccctgtaaaataattgatactgacatgggaattgatcatatgctggattttgtccagctacaactctccaactccattccaagttgtccaaccatccaacaaacatgtcttctgcaagttcatggcttagcatttgttctctgaacatggttagtgggggtacagagggcttactggggatctcggcattgagatcaagacaattgttcttctgcaaaacacataaagaaaaggcctccagatgcggactctcatacgacgcaatgcagcgatagttgcaaacttgatcagttggagaacatgaatttaaacactgaagggctttcctacagttgggatcgaacagacaattcagtatctgaggaccacaatttcttatcatacagcttagggtagacagaccttttgccctaaggttttgcagcatatcaacaggtcttatgtacgcattaaccacaacaagtaagcaaaatctaatgtcatctgaattatgcctttcccaggcattagatacagccttaaggacttcagcagattccttcatgccacctgtttctccaatatttgttagcttgcaaaacatgtcctgacgtccagtgtattgaacatacctgccacctaacttgttttctaaggttggagatgattgaaagcagattatattgggaatgtcctcactgttatttataagccactgaacagtctcctgactcgttattgcaacattgactagcatatcacactgtgccagctctttcctaagttcatcatggccaattgacttgtctgtgaagacaagcatttcaaatccttcgtcaacccacttcatcctattagcctaaaaagacagaaaaaacgagatgcatggttactggcagtaaatttatgcagagagatattctgcatattcatattaagtacgacaataaatcagaggacctgtttcttgctttctgaatgaacaaatgtgtcatcttgtaatcctcagatgcacaaataagcttggactctacatgtttttccttatgtgcatgctaactcaaaaaacaaaaagttaaacaatttcgatgatactactatattagattgagttcacatgagtggcatcttgggtttgatcgtcatccacaagaccacaaatgggaaaacaaaggaaaccaacttacaacatatttcccatgaatggctctgcaagggttgcagttttgtacactatcactaaataaatgatggccaggaaagactgaaatatatgtgcggattttttttgggtgattccacgcacatgccccttttcataagcccacaggtatgacacacaattgtattatggaaattatgtaaatcctacacaaaccatggtatcatatatggacatatcaatccacaaaacttgaacagaaattccacacttgcattgtatagcgtcacatcttacagaatctaagattgtggcatcgataggtttattaaatcacaaggcaaacaaggtaaaataagcgatacaaaattataatcaagtactaaaacaaggtaaaataagcgatacaaaattataatcaagtactaagtactaacacattttggaggtaccagaaatttagaatgttcgtgcccatataatcacatatacttgaatacttctacaactagttctccaagtgagcgtgcgaaatggttctgtgtgagtgtgcaattgaccaatcgcgtatttgcatgtgctttgccgttacaacattctatctatagaagttcttcagttatcagcatattccgaatcggcttattgcaatactgtcgagttctcctttgcactgcgactccgcactagcatttgatagcggtgaatcggtgctaggttcagagctcagagcggaagcataccgtgtggcgcataacctcctcccatggcgtgtccttcagcgggctgatgctcccgtcgcctactatggagactatgcggacggcgcccttcccggtgatggttccgccggccccgccgccaagctcgcccgcggcggcgcgcggtggcccgagagagcggacgccgccggagtagcggcgggcgatggtgcgcgaaggggcaggcacggaagcggtttcatggaggtggcggcgagtaggtaggaagaggcgagtggtggccgccgcggaggcggacgtggtgggcgtggctgccatgggagtctgggaagaggaggtggacgaagcggctggacctcgagtctcgagccttcgagaacctttcgactcatccctaccgttcgatcagaaaatcgacggtggatactaatctcagggaaaaaaattctggaaaacgtttttctacacaaacaaaatacgagttataaaaactagctggtggcccgcgcaattgcgcggcaaaccccaaacaaaattatatatttttaagtatgattttacttaaaaaatttattaaatagctatctcattgtcttaagacattgaaaggccaaaccttatcatcatcgtgtttctaaatatatagtttttaaaagtcacaccagttgctatccattatgtcatcctcttctttatttgcttgctcgattatcactatttctattcattcttcttggaatcattaaaaattggattttatagttttagagtttattgtcatgttgtgtttcgtttttacaattcctagatgtcccgtcaaatgttgccattatacacctctacggccagtccactgtctcttctctttattatcattgagattttaaaaatcgaaaataattatcgtttggtttattttttactttctaaaagtcctgccaaaccatcagcggctttgccattatactcctatatgactcgcccgttgcctcccttttttattgtcattgagatttcaaaatcgaacatgattatcattggttttttttactttttaaattggacttgtagtttcattttttataatttttagaaattccatcaaacgatgccactatgcccctctacagcccatccgccccctactcattattgtcattgtgattctaaaaatcgaacataattatcgttggaatttattttttattttctagaagtctcgtcaaccgtcggcggctctgcaactatactcttatacaccccgtccgctgcttctctttttattgtcattgagattttaaaaatcaaatatgattatcaatgtggtttattttttttactttctagaagtcccgataaccgtcttactcgtttgcttcacggcctgcctgacatccctccttttaatcgtcattaggattctatttggtgttttattaacattttttatatgtcgtatcaaccgccaacactctactctgttttagatggtattttctttcaatagtctttatttttatcacaaattttagttatttataaattgtattcctaattgaaatcttatttttctttttctaatttcagaattttttttaaaaaaaattagttagtaccgtattgtgttatcttaatgtttttattttttattttcaatttcagttgttttaaaaattgtatttctacttgaactctctttaatttttctaattttagatattattttattttttactctaaattttaattaatctcatattgggttcttatatggattattctttcaatgttgcttatttttaattccgaatttcagctaattttaaattgtattactacttgagctcttcttttattttcttttactaatttcggatttatttctatttttattctgaatttaattaatctcgtattgagttcttatatggactcttcttttaatattccttatttttaattttgaatttcagctatttttaaattgtattcctacttggaatctcctttccttttctaattttggattttattttatttttatttcgaattttgattaatctcgtattgtgttcttatatggaaacttctttcaatattgcttatttttaattccgaatttcagttaattttaaattgtattcctacttggactctccttttattttcttttgctaattttggttttatttttatttttattctgaattttaattaatctcgtattcggttcttctatggactatcttttaatattccttatttttagttccgaattttagctatttttaaattgtattcctacttggactctcctttccttttcttattttggattttattttatttttatttttatttttaattaatctcgtattgggttcttatatggaaacttcttttaatattgcttatttttaatttcgaatttcaactattttaaaattgtattcctacttacactctcctttcctttaataattttggattttattttatttttatttcggattttgattaatctcgtattgggttcttatatggaaatttctttcaatattgcttatttttaattccgaatttcagctattttaaaattgtatttctacttggactctccttttctttttctccgattaatgtgggaatttctaacccccacagcgaacgtggtgtctcctttcaaagctgttttaataacataatagatagatacccgcgcaattgcgcggctagcaccgatataaaattatctaatttttaatatagttttacttaaaattttgttaaatagatatctcgttgtcttaagactttgaaaaaccaaaccttatcatccctgtgtttctagttttattttttaaaaagttatatcagttgcaaatcctaaattctttgtcacccctcatttatttgctttctcgatcaccactacgtctatttgttctcactaaaaacctctaaaaattagacttatagtttttagagtttattgtctcgtttgggttttgtttttataattttcagaagtctcatcaaatgctgccactatactactctacggtccatccactgcctcttctctttattttcattgggattttaaaaatcaaacgtaattaccatttgggttctttttttactttctagaagttccaccaagctgtcagcacctttaccactgtacacatgtactgctcgcccgctgccccctctttattgtctttgagattttaaaattcgaacatgattatcattggggtttatttttttactttttagaagtcccgtcaaccgttgtaaccatgctacttaatgacccatccatcgtccctccttttaatcatcattgggattctatttggggttttgtttatagtttttagatattccatcaaccgccaccactctaatcctttacatgcatgttgcttctcctatatttgttgtcatttgtcatagttttataatttttagaagtcatatcaaaccctgtcaccatacttctcttcggcctatccactgcctcttctctttattgtcattgggattttaaaaatcgaacataattattatttgggttcatattttactttctataagtcccgccaaccgccatgaccaggctgcttaacggcccatccatcgtccctccttttaatcatcattgggattctatttgaggttttgttaatagtttttagatgtcctatcaatcgccaccattctacttctttataaacttgttgcttctccccctctttattgttgtttgttatcatttgtgttctagatgaagttttttagaagtccatatttttcagtccgatattttatttacaaattatattcctacttaaactcttataattatttttctattttcagtatttatttttttgttatttcaaattttagttaatctcgtcacatgttctagatggtatcttatttcaatagtttttatttttttatgacgaatttaagttatttataaattttattcctaggtgaactattattttttctttttctatttttggaatttattttaattttgatttagaattttggttaatatcgtattatgtcttatatgaattattttttaatgtttttttattttcaattttatagttgttttatcctactcaaactatcttttttatttctctaattccggattttattttatttttattctgaattttaattaatctcgtactggattcttatatatactcttcttttaatattccttatttttaattccgaattccagttatttctagattgtattcctatatggactcttcttttttcaatttcagattttattttatttttattccgaattttaattaatctcgtattggattcttatacgaactctatattgcttatttgtaattccgaatttcagctatttttaaattgtatttctatttggactcttctttttttcttctccgattaatgtgggaatttctaacccccataacgaacgtgatgcttttttttcgagcagttttaataatataatagatagatagatatcttcgaaactcccgcccgccaccgagcgggatacgcaaaaatctccaaaattttccccaacccgcgcgcccccagttttcctctcctccgaatcccaatctctcgcagttcgttcgaggagctgagacgctgcgacggccatggcgacgagtctcttcctcgcgctgcagtgcgtccagtgctccactatgcaggtgcgcgtcctcgcccaaatccctcccccgaaaaccccgcgagtttcttcaatagctcacccggtttcgttcttgcggcttcggtttgatttcccaggtgaagccgcagaagaagagcagcaacaagtgggtgtgcgtggtgtgcaaccagcgccagtccgtgatgcgcgtccacgcccgcgggcaccgcgccgccgacctccgccgcttcgtccaggaagccaacctctcgcgcggccgcgccgcgcatgtgcccgtgccgaggaagactgggtccctgcggtgccgggggagcagcgggatgagttcccgaaggagaggaagaggcggatggactggtccgactatctggaagatccgggggagtacgatggcggcggccaccacgaggaagctcgagatgaaggtatgcgcgaaacctgtttgatgtgatgtcgcaatgtatgtgtatcacagtatcagtatgatattgggtagcgtgtaaaatgatatgctcattaggaccaatggtaagttgattttgctaggggcctagtgttactacttaaaatcaacttgcttgccgcatggtttagtatcgtgttttcaagcttggacgcagtgagtacgggtaatgatacttgtggttcaaggcttaacaaaggcattgctgaactaaaattataagcacctgtttgtgaatagtcttgtatttcatattccatgcatgaatataaatgttattggggcaagctatacattgcttatgcagcgctagcatgatcacaggtctgttacgcagttacaatggctagtacctgaatgctcggctataaaaaagttgaatatctgcattatgtttcaggatgaggttgtattatgtatagcacttctaagtcttgagttagttctcttcatctttgtttatctgcacttatctgggaaggaatgaccagtctttaatgcatgatctaattgttttcatacctcaatttacaaatagatgtagggattcaagtaacaactgaattacctgaaaagaggcctaaagtcacttccttgaagagggcccccaaagcccaattgggattaggtggaaagaggcccaagacaccagtcacttccactttacccaagaggcaaccgatcgaagaaggttcactcccatgttctgcagctcctactgctgaaggcacattcaaatcctaacacatattgtacttgtcattaacaaaacatgtaagttaaacgggttgtatgttttctgcagcacaaagatcaaaatggagcaattatttggatacaagtttctctgaagggggaagtgggtttgaagactctgagcgacattgcagtgaactggaatgctccattactgatgttgtggtggatgatgaggtacaccctgattttgtgtgatatatatgtgtcttgtcttggtctgtagcattttatgctttgaatagtgcagtagttagaaaagatctgatgtgcagttggcaaaatattatcatataggatgggcactttattatgcactgaatcgcaacttgctatgttaaaattgaggagaaattaagatgcatgctaaccttttgaaacaatgatgttaacagtgcatctgcttaacctactttcagagttctctgaacttagtcctttgagtttaaaatgtatatgtataaggtgacaggcttatgtcacaacaagagttcagttagttgtatactccacttaacaatacccccacccctgtaatttcaaaaaaatccctggcaaaaagagagaggatgggaaaacacaagtggtgactcttttcttcattttggaactccacaaagttatcctaaaaggtaccccgtataaaatcttctgcagtacttcaactggaagtagggatatgtaattccgagttaactgaagattttgttggatgtatatggggattatgcactactaaataactactgattgcatgcttcatttgttatgcttgtgtctggctgagtgcatcactgcatcttccaaacataaactgatattccgaaacaataatccctacacgaagcctgaatcacaatgaacaaatttgaaacttgctgatgtctgaacaattcaacaacttctgatttctgaaaccattgttagtttaaacaattttgatcattgaccatgatgaagatgtgcactcttctgacatgaacctatcaccgatcactgtttcgctgccatcaacctgctaagttatgttataacctattaacttggtaagttcatacgtctcaacatctttctaaatccagaagagggacttgaacaaatggtcattatggtagggcagtctgaagctcaagcgggaatataaagcatcatatctgtgtcctgctactttgtagagaggggttggataaagaataccttacattgctttcaacccagttccaccatttccttttcatcattaaccctcttttgcatttataatcaagtgaaagttcacatacctcccttatttggcgatacaagccacataatgctttttctgagccctgccgccagacacgcaaagaaccaaacaaaatacttattgcccttctaatctggagcaatagctccttcggttagccagtcaaccactttttggtccagtcaatcatttcgtttctccctgaatctgttgagtggtcacacagtattttaacctcgaattcaatttggcatattatttatttgctatttagagtacattggttttagattattaccgtgtaagttattgcaatatatttaccgtaatccttgcttccaattatgcataatttcaattttttgttttcatgactcaaaaactgtaccaaatccagatcattcaatcttgtactctaagagaaaaagaccattccatcgttaatacgctactaacaagtcatgcatttggtcatacatatgttaaatttcattagacaactaccagatgcaattacattctcctattatatcctcaccacagttcactggcaagcacatagttgtgcctgtggggtggcgtgctctgaagtgcgcctataaagttagcaagagccgacagctctgcttgcggtgataatctccgtttggtagcgaacaattttgtacgacctcccgcagacccactgcttgccgtagccagcacgacggcaacgtctcaactgcatttcctagtaattcatcacttgtactggccatgtcttcctggtgtttgtttacagtctgtcagtggcagtcagatgaacctgccatttggtgttctgtgtgtcgttacggctttacgcgatctgggtggatttggtggtagttggaagtataacggactgaatatcttgacatgtcagcctgtttattcagtaattctagaaccgtgggagtcagtgcagcattgatggaatttctatcccgcaacttgaggcacttggccatgtgtggtactagcataatcagtactacatcttgagcacttgaatatctttatattgtggcctgtgggagtctgggagatctatacaacatagttacacagtagtgccaacatacactgatattatcctattactgtattgcttaactgggctcgtgtcattctgacctgacgcttcgcgtcacagcctgtgaacaaatatgttttgccgtctcatggtcatgggcgataggtcatataatgatataaagctgtgcaatgtgccaaacttgtgtgatggcacgggctggcggcgtaagcggcagccgacaccgtcagccaggttgccccaaatcgtcgcggcccgcccgtgctcggggcagtggctatcgcgacgccgcggccgcgcgggcgatcaggcgccgtgccgcgcgagatgccaaccgcgaagcgcgtcgcgcgcgtcgcatgcggctggggcgaaatcatagccaacaacgacactcccagcaatggtacggcacaatcatggagcatcaactggtgcgtccaaggatctcaccccatgatgaccccgccgcagcagctgggtatcgcgtgttgtgggctcgagtacctcgtatacggtctctagtctcagttaattgttgccacctacgtacggccctataggccattactgccctcaacaacgcgcgacgtcatcatgtttattgctacgcataatcgttgaaatcaaccatgttgccgcgctgttccgcccgtgcgtgccggcggaggtcaggtcgatcgagctcgcgagctagccgaccggggttggtagttggctggtccttttggcccatccggtcggcgtgataattaggtatttggatgtgtattaaatcacgatgcgatgcccttatccgtctcttccctgttgcctccggatctttggactttggaattggaaaagagctaagggagatgtcatgcttttgttgatgctcctaactaccgaagcttcggtgtttcttttcttttggcatcgtcgcaagtgatggtgactcgacttaacactcatcatcctgctgattgatgccttactttaccgttaacacgtcgatgcgttcgacgaggtgcacgcgccaccgaacgcccgcactatcacggcggatggcaatggctgtacttccatactaatcatattgttctccccgtattcttgtgctaaaaaaaaccggctgtagtaagtatccttaccaacctagctcaaaactgtctgtctgtctgtctgtctgttgtagtggagcatttgctccgttcatcttgccctcccattccgtcgtcgtcgatgttaccgtgaatactttttatgtagtagggggcaagattggaacggggaatcttctaaatcacgtcattaccataactatgtaggctcacataggcatgctagacagcacggcactggtcctcattgcctcagggcaagtataatagtaggttataagccggctaaatgctgagttggaagaagaagcgggctgtaaattaacagccggcttgaacacaggaactaagaaactttgtgagagagacaagtgggtcctgtattaattgtgaagagctaactattatatggataggatgagaaaaggctataaagaaccttatagtcagcaggtcggctgtattattagccttgctctcactggctccaaagcgaagccaatttctaatcttcttttaagcgcgcggattaggatgctttaaaccttaaccagtaacacgatgcaggggtcccaccacccgacaccagctttcactgacaggcggtcccagaggcagcgcatgtagtagtactattactactccggaaaaagagtcctggcagccgttggaaacgttcgttaccaaccgtaaaattttgcatgtgtcactgacagcttgtccccgaagtattctggccccaccagccggcgtcaggggctcatcggatgtcggtgttggattccttttcctgtgggcccccgcgctgcactgttcctctgtctgtcagtcacttgcgctgtgtgcttctgctcgggctcaaagtcgtcagctttttctgtgtcttcccctcgccgtctcgcgcctgagccctgaactagacagaccaagcctctgtctaccaatggaggcctgagtcttagaggccggatttggtcgttggagagagagagagagagagagagagagcgagccgagcctgtgcggtgcggcgacgcctgctcctcttcgctcgcgcgcggcattccggtcgtgtttctgaagtgattttcctcgttagatttttggcgtagtgtttggtgccttgttgatggcttcgtgtggaatggtgtagtttggtcgtcagattcgtgtctgctcatacttggccccgttctgctcggcttctggtggttctctaagttttcttcgttgtcctcggcctctggtggtttcttgtgctggttgtttgctcgggcagtcgggcctgtgtgattttctgccgctgcattcgcatcaccttctcccagtctgtgccctgtgctagtgtgctactctctctactgagctctctcgcctttccgcgttcgacattctcttccagctttgtctcacgctcgcaactggttttcccggttatttcgggtgcgttgttgcctttttgttttgttcaggaaggggaaaaagaaatgttgtttgaggtttggatctgcgtactgatgtctgatgagctgctctgtaacaggatccggattgcacggtgttcgggctgtttcgtcaaccatggggaagtctccggcgaagtggatcaagtctgtgctcctcgggaagaaatcagccaagtccaactctaccaaggccaaggatttggcggtaagtacttctttgtgtttgctgctccgaattcgtggtaaaagatgatatctgtttcctcgcaaaaaagaaaaaagatgatatctgtttccctgtaaaaaagaattatctgttggtagcacgaaaagagaagtcagaagtgtatctatttaaatttttcaaagaagtaatcgacttaaagtaagatactaaggcttgaaattgccattacggctcctggactggattgtacaatgaaaaagttgcgtatgggtatgggtgccttttatatgaagcattgcagcattcttttttgttttatccatgttgtaggtctgtagcatactttgattcttcctcctactttcactgattggttggttgaatcacaattttgttgctgatatatagaaggctgcaaataacaagcctgtgctttctgaggatccccctgtgatttctgagccagctcttgttaattctcacaacgatggaaatgctgaaaattgcaagttaccaaacggagttgcagttgaagccatgggtcaaggagtggagaaccaaaacattgttggctccaaggcaccaactagtccagagaaactaagcgaagagctagctgcagtgaaggcacaagcggccttccgaggttacctggtaacaccttttgcttggactgatccattttgttcctgccatcttgcctcttgttaatgcacttttgatctggagctctctgcaaatgttgctgctagcttgtcccaaacctttctatagttttatggggtcatcgtttttaaaagtttcagaaaaggaaacataaacagccagccctgcagaaagaaaatttgtgtcctaaaaaactgatgagttggctgtctgatctatacctaaacattagtaactgctgacacattagcacctcttcgttttcttttggaagttatagaagaactgatcagataatatgtcccaggctttttgaagttatataatttgccattgttttggacctttggtgcaggcacgtagggcattccgtgcattaaaaggtatcataagactccaggcactgatccgaggacatcttgtaaggagacaagctgcatcaacccttcgtgtgacatggttgatcgtgaaacttcaagctttagttcgtggaagaaatgttagactctccggtgcttccattcaatttgttgtgaagtccggccaacataagtttctggtaagtatcttgacatgtggcagttcaaatatttgatttcttgtatccttccctgcttttctacctgttctatttgtattatgttaaacctctgtttcaaagaatgaatgtatgcaatattgaaagcaatgtaattagtctggcaaactgaaactttttttttgtcgggacggccaaaggtaggccggccaatttcattaagattgggggaaacaaagttttaattacaacgaggcaaactgaaacttttcacacacacttcagacatctcttcagtgctgcataaaatcagtaatgacacatgttcagaactacagatcttttggctaaaccccaagatggacatatcagccaagtaacattcagtacgccccagaaaatagagaattagctagatactagtatttactggtggttgatgattattattatgtacctggatttttataaatagcatggcaataatgttaattctgtgcatatctctatcatattggtacttggtacaatgtttcgtcattgttgtgggagcaagttctggtgtattattgtattgtactaggttgccctttattctttaacttaattttctacttgatttgtggtttgttctcacagatcattaactaccttcatgtggtcatattgcaactgaaaacaatactccctccgttgcatattataaggtgttttagttttaccctaaatcaaagttctctaaatttgaccaagtttatagaaaaataattaatgtctacaataccaaataaatagactatcaagaaatatttcatggcggattttgttgaaaccaatttgatgttgtagatgttggtgcatttttctattaacttggtcaaaatagaaaagtttgacttggacaaaactcaaagccttacaatatggaacggagtgaatacacactttcttttggtattcttttattcaaacattaaatacctccctaactatcctatcgaataacccacaccgttcccttcaacacaatatagaaatgcaaactgtcttttcaaaactataaatgtcgaagcttttcatcagataggtgtctttcatactcaaaagtttacaattaaatatttaccttgttatcctgattgagtatggaggtaaatctgctgaactacagtataacttaaattgcatacatcatggagcatgcatttatattttcttttcatgattcctactaaatgtatgacccatatgcaatattttctgcttgatgtctttatgtggccaaaaatctaaaacatgttctgtttgcaattattagagtgataaaccatcggacgcttggaaagagaaggtatcttcaaacgcatatgttcgaaaggtatgccatttgttttaaaaaaacaagacttaccagtgagatttgctgtatgtctaaaaaaggtgtcatgatcctgctcatttcatctatgagaaatgcatgagcccaaatcaaatcgctcaccatttatacatttcagaggtgtgctcactcacttttgtacattttgtagcttctatcttcatcaattgggttagaagctcttcacttgcagtatgacaagagggaccccaattcattgtacaactggttggagagatggactataagccagatttggaagtcctcttcccaaccaaaaaaagttgctgatggcaaaccacaagtaaggaaggccagttatgcaatggaaactgagtcagccaaattaaagcgcaatgttcggaagagttctgctgtcactgttgatagcttccaaactaatatgacagttgaacctgaaaaaattaaacgaaattcaagaaaattctctagttccgctgctgattcagtaccagatagccagttatctgaacttgagaaggttaagaggaaccttcggaaggtaactaattccatggctgaagcatcaaagatatctagctccagggcagatgcctcaaaggtatctagctccatggctgatgcctcaaaggtgtctagctccacggctgatgcctcaaaggtatctgattccgtggctcaaatcccacctagtctcgtgaatgggatctctgatcatcaagacaaccaatgtgaggaagcacaacagaatgcatgcgtgtcatttcctcctgaaactcaggagttgcacagtggcattctgttggaggacaattcacatatgaatctgttggaacctgatttaatatctaacccggaaactcctttcacttcgattttaacctgggaaaaatttaatgattctactgctgatgctcaagaagttgaagttctgccactgcagaacattgataatgaagataatttcccagaaaatggtgtcttaggaaagaaagagaagccaaggtccaaggaagaacctctgtctaatggaaaccttaaaactagcaagaggaggtcttcgttctccaccaaatcagattacccggaaaatggagcccagaatacgccagttccacgaaggaagccaagctatatggctgcaacagaatctgcaaaggcaaagttgcgaggacagaattcaccaagactggattctgattcaccagcagacatgaatggcttcacacgccgccagtctctaccttcttctacaaacagtaagttgaacccacactcacctcatacacaaggaccaatctatttcaaatttgactaagtccatagacaaattagtttcatcaaatcaataattgaatatatttctaaaactaaattagttttatcaaatcaataattgaatatattttcataataaatttgttttgggttgaaaatgttactacttttttctacaaacttggtcaaacttaaagcagtttgac

SEQ ID NO: 6002 - DNA, 1040 bp, Oryza sativa
  unsure (1)..(1040): unsure at all n locations
taaaactagcaagaggaggtcttcgttctccaccaaatcagattacccggaaaatggagcccagaatacgccagttccacgaaggaagccaagctatatggctgcaacagaatctgcaaaggcaaagttgcgaggacagaattcaccaagactggattctgattcaccagcagacatgaatggcttcacacgccgccagtctctaccttcttctacaaacagtaagttgaacccacactcacctcatacacaaggaccaatctatttcaaatttgactaagtccatagacaaattagtttcatcaaatcaataattgaatatatttctaaaactaaattagttttatcaaatcaataattgaatatattttcataataaatttgttttgggttgaaaatgttactacttttttctacaaacttggtcaaacttaaagcagtttgactttgaccaaagttaaaacgtcttataacctgaaacggaggaagtaacagttatgaactaaaaagtgataaatccatgttaccagaaaaaaaatgtcgctgttaaacattaagcaaaggtaaccatctgaaaagataagatgatgttctaggctatcagaatgtgacaaattttgagtaatgatagcaaaaatgttcacagggagttcatggtattattctattgatcccagaagaaacacaactgtttattccatgtttaaaatactcccttttttctagtacaacaggggctttttgggtaatattaaatctgagaataaataaaaatggttgcacacattgtatttacattcatattctgaagtattgcatggattataaatctgtcgccttgactatgcatctttctgaagttctgcaactaccatattctacatagtcgcaccgggtggcctattgccacatttgttagcattgtatgtacttgtgttatttaggcttttactgacgttagaatggnnnnnnnnnnnnnnnnnnnnnnnnnnnnnnnnnnnnnnnnnnnnnnnnnnnnnnnnnnnnnnnnnnnnnnnnnn

SEQ ID NO: 6003 - DNA, 701 bp, Oryza sativa
  unsure (1)..(701): unsure at all n locations
caagtgtggcgcggtggcgccagccatggaggtgtttgacagcatgggcgaaaggaacgtttacacttggaccagtgcagtgagtggccttgcgatgaatggcatggggagagactgccttgcgctgttcaagcgcatggagagcacaggggttgagcctaacggtgtcacctttgtcgtggtcctccgtggatgctccatggctgggttggtagatgagggacgagcatgcttcgattcgatgaagagcaatcatggaattgatccttggcttgaacactacggttgcatggttgatttgtatggtcgagctgggcgtctggatgatgccgtgaacttcatcaatggcatgccattggagccacacgaaggcgtgtggggagcactactcaatgcgtcacggatccacaaaaacgttgaactggggaaatatgcaatggataagctcatggcgatcgagtccaagaatgatgccgcccatgtcctgctctctaacatctatgcagactcgcagaactggaagggtgtcagcaatgttcggaacatgatgaaggccaagggagtgaaaaaggtgcctgggtgtagggccattaaggttgggggcaagggggattagttttttgttgaagcgcaagccccccccaagacccaaggagnnnnnnnnnnnnnnnnnnnnnnnnnnnnnnnnnnnnnnnnnnnnn

SEQ ID NO: 6004 - DNA, 938 bp, Oryza sativa
atggctttgtgaatgggtttccttccactcttggaggccccactaaacaccagctgtgtaataaagggtgcgtgcctcctgtcacaccagggtccaattttgtcaaaagatttttctttaggccaggaggaggagattagtatggtactagaagcgatctctcgctaatctgtcaaggttcgataggctctttcaataaagggggactagtatgttgaccaggatacgtaatactactagattttagcaaagcatgtgaatgggggtctagttgggattagttattagcttatggatgatctgttagtagtaaagaattcagagttctcgagctgaatggttcagaaaagttggttgatcaattgctacgttacatataatcgggtgggtactccatagtataattaaaccatcaagttgaggaaccttaattggatcaaggaaaagggggttaattaagatctgaccgatcagcttcttaggcttttccgagttatcagtgagttggtgcaggtgttatatgtcagaaaattctgtcatcattggttatttatttatatctgcttctattggctcgagcacgctgtcatcggctgttctttatagctgctttaatttgttagctcaagcacgaatcttcactacgtcatattggacccgtccagttgtagggtcccttttaaattatagggttgaaaaaaatagagaaatagaaaaaacacatgattctgatagggattgaagggtaaaacagagaaatacaaaacacagaaaaaacactggaatggtcgtttgattggagcgcatgaaaaatacaggaatcggatgagagagatagactcaaaggaaatttttcaagaagttggagctcttgatatatttcctctaaaatccacatgcaatgtgccattccataggaatttcataggatttagaaa

SEQ ID NO: 6005 - DNA, 3405 bp, Oryza sativa
  unsure (1)..(3405): unsure at all n locations
nnnnnnnnnnnnnnnnnnnnnnnnnnnnnnnnnnnnnnnnnnnnnnnnnnnnnnnnnnnnnnnnnnnncgtttgatggaagcccatgaaaaatacaggaatcggatgaaaaagatagactcaaaggaaatttttcaagaggttggagctcttgatatatttcctctaaaatccacatgcaatgtgccattccataggaatttcataggatttagaaagcttcaatcctttgaatcaaagggccaaataggaaaatttcctataggatttgaataatatgaaattcctgcataaatcctttgattgggcccctttgaatcgcaggaatggaaaaacggaggaataggaaaaacgcaggattctgacaggaatgcatgtgtaaaacagaggattggaaaatacaggaaaaacacaggaatgaccgtttgattggaccatataaaaaacgaaggaatcggatgagagagatatactcaaaggaatttttccaaaaggttggacctcttgctaactttcctctaaaatctctctataggattacccattccataggaattttaaaggatactataggattcaatcctttgtttcaaagggtttcatagaaaattttttcataggattaaaatccttcaaatttcctacacttttcctacaaatcaaaagggaccctaagtttcgtgcttaatggatctacatccagtacgtatacgcaggtcctcaatcatacggtccaagtcaatagaacaaaagaaaaatatcgcaccagctgccggtacgtacgcaggtatatgattggggtacatcttgcacgatcatgcatatgccccatgatagacacttgtatgtgacagagaattttagtagtattactccagcagcaggcagtactagtcagcaagcagctgcctgggcatcgatctgcagcaagccaacgaaccgtagccgcgcagacgtcgatccgtcacgcaatggcactatggcaggtatgggccgtatggcgccatggcaatggcatattggggtagcatgcagcgatacatggcaggtggtggtgactctctcgctgggacctagctagcgagtgtgcgtgtgtgcgcgcgcgcctgtggttggtgagagcgacaggtacgtgcatgcgcgcgcgacgcaaccaccggccgggccacgcgtacataaaagcagggggccagccgcgggcaactaaccgatcgaggaggcgcccggcctccgagcctcggacggcgaccgtgcggggcggccacggcgcagcgaggggacacgcggggccaccccggcctgccggccgaacgcgacggacgaatcgatcgatcgatcgatcgatcgcccgcgcgcccgcgatcgaaagctacggcggtgacggccaccggacgagccacggccacgcgcacgctcgtgctgactgcggaccgcgcgcccgggttgcaaacggcacaggaatcccttgttgcaaccgacgaaccgagctaagacaaaaacaccttgcattggaacttggaagtaatctttgtaggcacccttgacagagttttacgcagtagtcggtatacaccgtagtagtaacttttttgcgggtagtgtcttgagatctgcaatcatgtccaaatctattggaaaggggagagcaaggaggagtaataaaagacaaaagaccggtaacacctgaagtgtcttcgcacaagtagcggcatcaaaaagaagaatgtatggtgatgccatgattgcagggggcctaaagacggaatggccatcgcacgttgttggtgggtagtagtagaagctttaatctaagctaagttcacaactatgggtctatctggtagaggctcaactcctaaatttagtttcagaagataagtttgtagtggagttatgaagctgcctaaacccaacttcacctatctagctagttcgttttgtgagagagtttcacccagctctactcctatttcagatgaaactgaaactatttggataattgaaagatagaaaaaacatcatcctatattcacgaagcaattgcgggcatagaaaattttcattgggtgatttaatctgagcttgcaaataaaaaagacgtgtttctaatctcactctcttttctttctattaaaataacgatgcacacgtgcacacccataaatatgtctcttaacatatgctaaaaagagacggagactaaaaacatattcgtcaccccactaaactcctattgaaagtgcactcatgtctaggtaatatttcaagtctaatgaataagtcacgtacctgcgacacttcaccatcagtagtggtgaaaaaaaaaaactcaactagtggctgggatcgacttatatcatgcttagttcagatcagctctaacttgtagtcataacaagttgaatcaagctaggcttttagcacgtgaacggcttgttagtataaaatagggtaaattggctataaaatatcaccatatgttcatattcttagtgcatattaactagcatttagtcgtttaattacatgttaactatatttaggaaaatctttagtaattagtgtttattattatgtcaatacctactaaaattgtaaatttaaaattacaattcataaccactggaaaaccaaatacaatatcataaacgttgctcaacagagagctacttgaagatctaatgagataaattattgttgggattattctcatggcaatcaataacccagtgaagctgaaaagaacatggattcatcgcaacagtatttttcattgtatatcctcttctaaagaaactgtattgcactttaaaaagaaaaaagacatggtactgtattggcatagtctttacagttttttttttctttttgcaagacgatgcatgcccggcgtacacggcactaatatattatatactaaaagtccattaaactccctacaaacgctcctaagccgtcacatggtgtttctacaaacactcctaaaccgccacgtggcactatctaatctcaccgttgattttctcttaagttggtgcacccgttaatttagaccattagattagatctattattaaaaaggtgatagtttttcctaaaaaaaatatgcaactggtggctaggaaaaggaaagaaaactaaatttccatacgcaagtataattgagaaaaaaaaacaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6006 - DNA, 887 bp, Oryza sativa
  unsure (1)..(887): unsure at all n locations
nnnnnnnnnnnnnnnnnnnnnnnnnnnnnnnnnnnnnnnnnnnnnnnnnnnnnnnnnnnnnnnnnnttagatgatattttaccgtgcgtctggtatagtctagtccccatatagaagtaaatataagtcttagcaccttatttacgaaaaaaaatatatttaatatttaatgttgaaaaataaaactacgttaaaaggcgtaaaaaattaatcttaaaatcaagttttaaaatttaaatcttaataacgacttctatagtgagttgtgtgtctatattaaaaaaaatactatacaaagatcatatatagatttttaataaagaaaattcgtgcatttattaatgtagctaagttagacatacatgagtggttataggtgtagattgggatacatctagttttgcaaagaagccccttagcaatggaaaaaatacactttcgagctacatgttatagagaaggacttaggaagaattaaaaaaaacaattgggtctttcttcttcaattgcttgcagtgtaaacaatgaagttttggagctcgattccaacaaaatttgaagcaaggtgagctgcatatgatcgaatcaccgcataatctcaaaagaggcctcacacatatggaggttcaagtaatgacatacaaatcgaaatttcagccacactacttaggatttccacataatcatatggcaaagaaagacgcaacaacaacagttcctaagatcaagcctagatctataataccagcatagtatggtgaagaagcatagaagctgcataagaaaccaaagattatatttaaaagaggccttcacacatgggnnnnnnnnnnnnnnnnnnnnnnnnnnnnnnnnnnnnnnnnnnnnnnnnnnnnnnnnnnnnnnnn

SEQ ID NO: 6007 - DNA, 6784 bp, Oryza sativa
tttctttcttttaaaaagggtgaagaagttttcttttggatttttgagcacgatttttgagcacgatgtgtacatttgtacgaattgtgctttttaccactttcgtttttatttttccaaacaccaaaacattttttatgagtttgccaatgtgttcatcaagggggagattgtaaaatcaaaggtgtttttgattattattctgtgatgaacaattggcattggagataattagttttgttatttgaaatttattcacgaagtggttttggagatgattggatttcacaggtgaatctataggatattgttgttatttcatgtgactggtcagaccgggcaggtgttgccggtcagaccggcggtgatcgagcggtcagaccggctagcccgcggtctgaccggccgacgctgtgtcggtttctgtttcgggttgtttgtttagatatccgtgattattttatgattatggcttctagatggatactatatgtatgtaatactgttgtttgctattaatgagtcaagttggagataacttggtctcggaatatggttttttgtttatttcatgtgtaggtgactcgatgtcttgggagagtatttgcggtgatggaccgggagtcagcttggggataagacaacgttcgtggtggtcaaagatcatgcgggatactaaggctagagttgatgcacgtggttgatggagattccatatggcatacgatggaggtattgtgtgcgtatgggatgcggagtcgaatttggaaggagttcaaatttggtacgattggttatgtaaagtttctttcttgtactagaaggtttcctaaggtgtttaggactcttaatatgagtttggtttgtggctttatgctgcctacctcatgtataaatagagggggagcgtgaggcttcccggtatcgctttagagagcaattgagttgagttttgagttagggtttcgagtttagtcgaaatttttgtaaggagtgctgttggtgcactttgtaaacacagagagaatcaataaagtcgtcatctactttaagagttcttcgatttgtgtttatcgggtttcggtagtctacccagtgatctaccggcggtcagaccggcggcaagcggcagtcagaccggcagcatttgggcggtccgaccggcggccgcgacaggcacgacgaacgacttcggcggtcagaccggttgatctataccataccggtcagaccggcggcatctgagcggtcagaccggcaaggcaacttcggtcagaccgatttccatcgatttcgagagtaacttttatttccgctaaaagttttcggtttttgggtataccaaccattcacccccctctggttggcttagttcttgtgattcgatcctacagacgggccctacatgtcagtagccaagtctttcttcccgccctttgtacctttcttacccatcttttcccaggggacaaccaataaaggataaggaccgcgtgtggtgggcggcaaggagaagggcggtggctaacaagacaacccattcacccccatcttcttcaaggctcccatgacctccgtgtttgtcccccaactcgattcccccatccttgaccggctcgccttcttccgttccgttaggcggctggaggagcacaataggttcccgtgcttcctattcgagaagtccatgtgcagggccatatgcctccttaatcacctccgcatacccccgaaggagtggcccgacacctggtggcgcccatgtgcaggatctcctaccagatccacccaccatggccactatcgcaaatcctcatcttcatcatgcggttcgtgctgacgctccctatcgtgcctgctgccaaccttgacgctcctcgttcgtcaaggtagccaagcgcctcctctctacgtgtaaccccatgcgctacaatgtccggccatggattgggtcgttggtgcacaccgacggccgccaccattaccggcgctgctcaggagagagaagtcgaggaggctggtcgagctaagtgcgctgctcaaggcctttacgttgttcgggccgttcagattggaaatcatcaacccgtcggtttgtcatgcaatttcctcttgtcatggtctcacctggagaaaactatccgtgtgtctgcgtccgtagtgggcctttgaagtaaacacacacacaatcaacgataccaactgaccacaacagttgggcaaatgagtggtcgagggggccatcaaccagaccggctatgtttcagagagtgattggcgaatttcgtaacatatactcttaagagtaaatatatttttacttataatacatatttttttataaaatatatatgatctaaggcgatacaaataatcattactaacatgattaacacctaaaattacgatgtaaattaaacaacaagaacaaaacaaaatcctatcctaattttcaaactaaatagatgtaaatgagaagatgaaaaaaaaaatagaagacctcactttaaacctttgccatgataaatagtgtggtcgggtgggagtcgattgtgaggacggacaatgacatcctcctggcttggttggttagtgatgggttccctaaacccttaaacggtcctgccattaaccgcacgcgcatggttctcggatagcaaattggcagcttgggaaagcagggcgcctcaacactacagacgtgcgattttgagaatctacgagaatctcttcccctctatcgctgtccagctggtatcatttagctttcaggagatgtacggcagtactactaggagaagggtgagtcctggattcctaactgccagtattttagatttttagatgatattttaccgtgcgtctggtatagtctagtccccatatagaagtaaatataagtcttagcaccttatttacgaaaaaaaatatatttaatatttaatgttgaaaaataaaactacgttaaaaggcgtaaaaaattaatcttaaaatcaagttttaaaatttaaatcttaataacgacttctatagtgagttgtgtgtctatattaaaaaaaatactatacaaagatcatatatagatttttaataaagaaaattcgtgcatttattaatgtagctaagttagacatacatgagtggttataggtgtagattgggatacatctagttttgcaaagaagccccttagcaatggaaaaaatacactttcgagctacatgttatagagaaggacttaggaagaattaaaaaaaacaattgggtctttcttcttcaattgcttgcagtgtaaacaatgaagttttggagctcgattccaacaaaatttgaagcaaggtgagctgcatatgatcgaatcaccgcataatctcaaaagaggcctcacacatatggaggttcaagtaatgacatacaaatcgaaatttcagccacactacttaggatttccacataatcatatggcaaagaaagacgcaacaacaacagttcctaagatcaagcctagatctataataccagcatagtatggtgaagaagcatagaagctgcataagaaaccaaagattatatttaaaagaggccttcacacatgggagtttaacgtcagttcagcttgagtcaacaacatcagcctccctatgaagaacttccaccggagctcagaaagaaggcctgcacccttggaacgagctcgtcggatatgacggtgaaggcccgcgtgacctcttcttgtgcagatgtggaagcatcccagctgacgagtaggacactgttgacgctgcgacttgccgacaggactaaacccgacgatgagccccacaatgccaatggtaacgaccacctcaagaaccacaaggacaaaatctacgggaatgactcagacaaatgaaaaaaatccgacaagacctactgctactactacgtctcgtcagggttatttccgtagttttgcccttatggttcaggccaaaaatcaattatataattattttgacctacccagataggtcaaacacatctcgtctcaataattaaataattgatcggacctgttaaagccgaaaatacttttatcacgagctacaattaattttcaacgataaattctatgcactaaaaatatttaattttaaattattgttgtgttcaactagtcgtaaacatatagtgtatattaaagtaggaggaaaaaaaggaaacatgaactgagaaacggggttattcttggagttggagggattctttatgttcttgggaaacggggacaacccctattttatttttagaggttttaaaatagggattgttggttgttgctaaatatgttctaaaagggactctcattgtaatgaagtattgatagggactctaatcaggcctcctataaatcgttattgatttgtcaaaatatctctggaaaagaattgctactacctgacaaaatattgttggtggtcaccatcgtccacatcgttgcatcttctgttgcacacaggtttgtagcaccaacattactatgctaccagcatgcttgcatagtttttgagccctgcagttgctgacacaactagctattcagaatttctcaatgtactgacgttttctttcactgttccttttttttttcatctattccaggatggatgtttgtgcacgaagggttgggaattcggagtcaggatggtagttggtgatctcatgtcatctctttctcaatcatagcaagcattgtttttagttaatgctctcatttctgatcttgcagttacataaatctggttattgaaatccacttcaatcaccaatgtgttcgtgaggtatgtgaaaatactattgtgtttcttggacttccatctaagaaattttttttagcccttgcatatgaagtatcactgtcacatattaggatgtcttgcagattgtctttggattttgggacatgcaattcattcgcttcctaatcctgatcatgctcatgttcacaaatttaggaaatcactgttatgcatttgaaggattttctatacataaatcttagtcttcactctacacatctattgccggttgtacaattctgggagatgatgctttagaaccaatgctttttaactgcaattgccaaaatgctcccaattatgtcccgtagaaaatttaatcttgataaagttataatgcatgccgtagatctgaaatttcagacaaacttctagagatttaaattttaaaaatttgcaaaaacataatggtcaccttggttttggagccgggagtacatttatcaccaacatcactaatgttgtattatagtttgtttaagatatctaaaaaatttctcctaattatctacaccatgtatctgaagcttttattgcagaaggttcaacaacttattacattttatgtgccatgggatattgggatatttctccatttttacacttgaagcaaattttttgtgtttgttttatcaggtacataaaatagatagaaagagaatagaacattaagaaacttgcctggagcaatgcccctgccagtccactccatcacactgtttaattttttattactgagtgttagctatccctgtgttccttattactaaatgctaatacatagacttaatttcagttgttgaactcctttccaacagcctatctgttcacaacaaggaatactaggtgcaaagaagactacctaggacatgtttaggattctattgccttcttagtccaactaggtaattttcattgggaatcatgtgactttctacagcttacaccaaggtaattaaacttcagtgtcattgcacttgtgaagttcatttcattgctttcttggttttaattcccgccatcacattttatacatttagttaggaacgaagcaatgactatcacttttttgtttgtttctatatttatgcaaccgtggatatcaactaaccaagttgtggtatcttatattactacttttagagctgatgatgacctacaactgatatcatgaatttgtgactcaattatattgatgtccctaactttttttaatgttcttgaattgattctctaggaatttcatgaactcagtaactaaaaggtaattcagagcagttatttatatgtcctcaaattttatcatttggctgtagaatatgaatttgttccacaggacgaaatgcatggtataatctgagatgttctgcactaacagccgtgccagtgtcacctaattatctgtcgtttattttatattgttagcagttaaaagaattgattaagccatcatttgatatgattttttttcaattcaaaattttaataagtgagcaatctaaagggcagaagcatactcacaaatttcaaatccgataatggaatatctgtggttttcagttcttttattttataaagttagaatccacgtataacagacctttaggctcttttatcgtagcaattgtctcttactctgatgctcatgcatgtaagagcatgtgacattatcaagtttttgcttttgtaacactaacaaaaccatgttccagtttacattcaaatcggtgaatgtattgattggatttgcgtgttcattgttgagtttgtagtgaatattgaagaaatctgttgatcaaaagattttatgtttatgttgtaaaatggaaataaaaaaatgtgttctatttcttcactattattttaataaaaacagaagtgaacgaggtggttttttaaaatgcgaatactaagatttgaaaaacgtgtcttgcatactagtatgt

SEQ ID NO: 6008 - DNA, 7517 bp, Oryza sativa
  unsure (1)..(7517): unsure at all n locations
tgcagtggcccatctctttggacggagagggccaccggagacaggaaggcagaaagaaaaaatggcgataggatggcataggtcacagagcctggcgtctgcagggctcgggctgcacgtcctcctctgctcgtcgttgctgctcaacgccgtcttcatcgcgcaccaattcctcggggcctcaccgccggcaacgccggagcggctcggcgacgggctgagctgggcactgcaggcggccaaggaggccgaggacgtggccgccgtcgactgctccggccacgggagcgtgttcctggatggcgtcaccggcgaggacgggcggcccgggtgcgagtgcaacagctgcttctccggtccggactgctccgtccgaatccccaactgcgccgccgacggtcaagggtaatgactggcctctcctcgcttgctcgtgctcttgcgcgctgctccacaacgccttgcatgcacgcagcttccctcctctttgtctttggtgtgaaatacttttgaactctcgagggtatcgaggacagtttgcacttacatcactcaaatagttataaaaaaatcataaaaatatctaacactggtacaatatacatataacgcttcatcacaaaatttaaacataaactcaactcacacataaaaaaaagagagaaatttcaacgtacaaacaatatagtactattaatctctaaatttgtcttttttaaaaaaaactacaagttaaacttgaaattgatttttgctgaagtgatagatgttactatttgtctgtcctatgttataaaaaaatagatttttttgggagtagctatatttatggcgccatatttttcaccaaaaaatagtcggtatatttttacattgtaagtcattaaattacatatataattttagtgtatttacaatgtaagtctcaaaattacatatgtaagttctaaaattacatactaattacatatctaagtggtgtgtaactaccgtgtaaatttgtataaaatatgaaaagtgacatattcgttgcaagaaaactgtcggttaagatatagcaattccgtatataaaaccaaccggaagatcgggtggatacggttgccgcagcgtttgcatgcgaacgaatctaacagacttgaaaaccgactgagattagtgaaaaaaactgtcgccatctttatagcaattccgtttttttttcacaaccattagtgtcctgtcctgatggtgtgttgttgttgcaatggctctgtgcagcggggacccgttgttcctggagccgtattggaagcgccacgccgcggccagcgccgtggtgttctccgggtggcatcgcttgagctacatcaccaccgatggccacttaaagtccgttgagctcgatcgccagatccggcggctccacagggccgtcggcaacgcggtcgtcgacgacaagtacttggtcttcgggaccggctccacccacctgatcaacgcgctggtgtacgcgctctccccggaaggcaacgccgcctcgccgccggccagcgtcgtcgccaccgtgccgtatttcgcggtccgtgatcccaacaccacttcacgatgacacatcctacgagcatctatacgcgacttcactaactagttgtgttgatcgatgatatgtatgtagatgtacaagtcacagaccgtcatgttcgacggccgggagtacagatgggacgggacaaccgctgcgtgggcaaacaacaacagctcacggaaccccaccaggggtttcattgagttcgtcacctcgccgaacaaccccgacagcacgttgcacgagcccatcctcgccggctcgtcggcgatcgtcgaccacgcgtactactggcctcacctgacgcacatcccggcgcccgccgacgaggacgtcatgctcttcaccacgtccaagctctccggccacgccggcagcagattcgggtacacacgggccacagagttcccagctgcatgccatttgcaagcaagacacgtacacaacgacaccaaagctgatcgatatacgccgtgccgtgcattacgcaggtgggcgctggtaagggacgagaaggtcgcgagcagggcgatatcctacatcgaggagagcaccgtgggcacgtcccgggagacccagctccgggtgctgaagatcctcaaggtgatactggccaacctgcacggcaaggaggacatcttcgccttcggctacgacgtgatgagcagccgatggcgaaggctcaacgccgtcgtgtcgcggtccacccggatctcgctgcagaagatgccaccgcagtactgcacttacttcaaccggatcaaagaaccatcgccaggttaaaacggcacattatctctgcagatcatggcatttcaatttctctcgctacctctcaatcgaattctttaaggtgatgcgatggcgtgtttggtctaccctgatctgcagcctacgcttgggtgaaatgcgagtgggtggaagacgacgactgctacgagacgctgctggcggcggggatcaactcgcttaccggcactgttaacgaggccggcactcggtacacgcggctgagcctcatcaagacgcaggacgacttcgacatgctcctggagaggatcaccgaatttgtcgatgccgagaagcacggcagagctcccgctgcctccagctccatgtgaaaatcgtgaattgggaccgggacaaaagctttcgtctagctggcttcgatggccactgtgccggaacgatcagctgctagctgattgtaggcaataaatacaaggcaacgtggaaaatcaagactggaatgatcagctacgcgttaatcgttcattcgttcgctgtcgacctttcgacggacaggtgtaattatgtggatctacacaatcaattaggtggacactatgtgattatgtttgcagtgactaataattgagtatgtaaataaatgaagatcatacatgttactgattcagcactcgtcattcttggaatcaaaagggaaaaagggaaaatgaaagcagatagaggcacttagaactgctaaaataattttaaaaactgcgcatccggggaatcgaaccccggtcagtaccgtgggagggtactatgataccactacaccagatgcgcttacatttaaatttaccaaacatgttcttgatgttagtataaagtaataactcgtataatattgcacggtaaagcgagcaaattgttgagctaatatattcagatttggcgaattggcagccaatttccagaaaataaaatcatctcctacgacattgtcgtgctctgaaaatgtgaggagatgaaagtgatttatgttccacacaagtcaagcactagagcagagctacgagctagtactatgataatgatacttctatcagatgtaaacagcacaataggtaaactctaataatcaattttcaatccctacagattacagatatcatatgatattgcatactccgattagtagcgattctatcatgcacgagaagcaaccatttggttcggccatgacaatgttggtaagactgagcagtagtgggagtggattctaatccctcgaggggatatctccgcgtacatctttttcttctaaattcgatgcaaatagttgtgaaaaaatctgaaaaaaattgacaatgtagagtataatgatacctactagtccaccaaaatttatgttcaaattcgatctacacatcgagaaacaaaaataaacagtatgctactattcatacgctgaatttgtcttttttatatctcgacgtgtgagttgagtttggacttaagattttgtgaagttatatatatgtgttgtatgaatgttgtcaaattttttcagaatttttcataaccacttagatagtttttgagcaaacgaggaaacatcccctcgagggattataatagtttccagcagtagtagcattttcagagcttgtcgaccttgtcggcactgacgacgggattggcgcgggcgatggcatcgcgcccggcgcgcccctgtaatcgtagccacagtcgtgcctgtccgagtagcgggtgcgcgccgcagaacacggcgccgcagcggcactcgaaccccatcagccccactctcctcccgcacgcagcgcacctgctcttcgtcttcgcccgcggcggcggcggcggaggcatcgccccctcgtccacgggaatgccctccggcacggtaccgcgccgtgaagctccgtggacgacgatgacgacggcgcctgggacatcacggtctggcggaggctgtcgcggtagcacttggagcagaggccgcgggtgttggcagagccggagaagccacagccgttcgcgcacgggagcggcagccgctcgtccagcgtctcgctcccctgctccatcgctcgcccgaacgcagaggcttctcttccccggggagtcgacgatcgaggtggttggcagctgcaagaaacgtacaggataacaggaatcggacggggattcgtagggtctgtaccgaacgcgacttggtgcctcaaggcctcgggaaggtgggatgatccgaagcaagttgaatatgatgtgttttacaagggagcgcaaccgcgggcagtggaatcttcggttggtggtgccgagtgactggtgctagtggcgcagccagccgtgcaggaatgccaataaaatttctggtttttgcgggcagccgtttaatctggataggatggagattgttcttctgggtctgatggtaaaccagttaattaaatcaattttgggcttccaggtctacaaccattttttgtgtgtggtgaaggtgaacagagcaaaaagatttcattgttaagttgataggatgggcatcatgcttttatgacgatgctatgccgccgtctacttggagacgtgaatctgtcctctggccttcgctgccacctcctcctcccgatctaccctccttcggtgagtcactaaataacccacagagagggcaggttgcgtacatagcggattcacagaagacgaggaagtcctagtatagtaaaacaaaatgtcgttggcgtttcgtaaaaagaatgacgttggcaaaaaatagagatcacggatgaggttaaatgcgccaagttcatcctaaccgagcacgtgaataaactctattcatatggtgttatcttaactactgtaataaagaactaaaacacccttagagcaatgtcacccccataaaaaaggtccagggtagtgatataatttcccgtcccatatgaataaaaaagagttcataagaggcaaaagggaagggttctccatccattctctccatctccactactatcacacatgtcagatctaaagagagaatggtgtcaaactcattctcatatgcacaaaaacacatttgaatgtttttgagtaatttcgtttttgcgacgcacaaacttttcggtgagccgaccaacgacttatgtaaaaaaattgcaaccaatggtgccaaacatatttccattgatccatccatttgtcagtttgtcaccctcaccaccaagcaccaccgagctccaaggccccaccaccgcccatcaccacatgtagggatgcaagcggggtaggcaagcgggtttttttagcccgcttatctcacttctagttcattttttcttctaaatattgtactatcatataagaaatgaactagtaaacgggtttttatgcgggtagtgggactacctacttgcatccctagccacaacccaacgtcgtccgctccaccatcaagcatgcccctgccgctgagcaccatcttcccgtcgctatgtgcttccccagcccgacaccgctttgtcggttgtcactgcccttaccgccaccgagcgccgcccctcgccacctcattagcgaactccgaggggagccaccgctctcgaagtcaattggtagagagtatgatggcaaagtagcagcagggattgctctcgaagtcaattggtagataagcaaattttgattcgttgtacatgatgtaaatactttgtaatgctctcgtagagggtgcagatggctcccgagtcgggacagtggggacgcagaggcgcccgatggcgagtgcataggcgcgcaacggcaggggcagtaacgcacggtgttgggggcgcaggtgcttggcggtaggtggcgacactcggtgttgggacggcaacgcatgggccaaacaatggatggatcgatcgaccctatctcctctctcttctctctctttggatctgatatgtggggctagctaggggcaaaaatgtctccaaaactgagaaaaataatgaaatggaaaagaaaaccaagaactagagaaaaggaggagaaagtgggtgcttctaatactgtaatacatggtcgatcgctgaacgcgaccagctcgcccccctcgctggcctgtagcacgcgggcccacgtgcagtaaaaatataccaaaaaagaaaggaaattattttaaaccagaaatataatatttctgttttccactgacgcattttcaggtgaacatccacgtgcttatttttctttttagttttagatatactttgtttgtattggtttatgtcagtctgttacccaacatatccctaataagcacatctagttgcttcatattttttttattggttttgggtgacttcaaatcctattgtaagtaggaacttttaacgtacaaacttcacatgtataaactttatacgtagaaattttgtacacatgaactttggcctataaattttatgtatataaaatttagatataaaaagtttctatacatgaatttcaaacgaattaaaaaaatcaaaaagggccaaaaacatgttggcaatagcaaaaaaaactccgatcaaacaccttgctggcagactgttcacgcccggcacggcaagaactgcagcggcaacaacgaacagagcagcaaacagagcagaggagaagtttcagagaaagaattcttgcgagaatgtatggggcaattttttctgggtttttctcattcaactgaatgtaaaccttacaaaaagaataaagagctaagagaactacttatactcaacgcaaaaaaaataggaatccgaggcaaaatcgcgccatcccacgatccgcttttctctgaactccatgcacacacccacgccactgccagcgctagactcggtcacgattaactgattcgcgacttatttgcatctctaacaaactcctgctagactaattcatcctcccgttcagctccgagagaatcggcttgcattgggccacagctgaaattaatcaacaatctcccccttaattctgccgtggccctagtgaacgaacaccaagaaggtgtctcgccgtcgccagcttcgccgccggcaatcctttcgtcagtgcatccgcccgctgctcctcagtccggacgaactccacaacannnnnnnnnnnnnnnnnnnnnnnnnnnnnnnnnnnnnnnnnnnnnnnnnnnnnnnnnnnnnnnnnn

SEQ ID NO: 6009 - DNA, 15403 bp, Oryza sativa
  unsure (1)..(15403): unsure at all n locations
caactgaatgtaaaccttacaaaaagaataaagagctaagagaactacttatactcaacgcaaaaaaaataggaatccgaggcaaaatcgcgccatcccacgatccgcttttctctgaactccatgcacacacccacgccactgccagcgctagactcggtcacgattaactgattcgcgacttatttgcatctctaacaaactcctgctagactaattcatcctcccgttcagctccgagagaatcggcttgcattgggccacagctgaaattaatcaacaatctcccccttaattctgccgtggccctagtgaacgaacaccaagaaggtgtctcgccgtcgccagcttcgccgccggcaatcctttcgtcagtgcatccgcccgctgctcctcagtccggacgaactccacaacaatttgcccgccatccacacactcccgtatgaagtgataacgggtgtcaatatgcttacttctcccatgaaacaccgggttcttcatcaatgcaattgctgacctattgtcgacgaagagcttcactgctttctcctccactcccgccacttctgctagcaacactcttaaccagagcgcttgacaggccgccgtcgtggctgccatgaactcggcttcacacgacgatagtgccacagttttctgcttttgcgagctccacgccaccagactctgattgatgtagaacgccattccaccagtgctgcgccgatcatccaagtccccggcgaggtcactgtcagtataccctgtaatcttcagtgccctagtgcctgcagcatacacgagaccataatccatcgttcccttgatgtatctgagaatttgcttcacagccttgaaatgcatcacggttggcctctccatgaacctgcttgccaccccgacaacatatgacagatccggcctcgtgtgaagcaaataccgaagactaccgatgatccgccgatactcagttgcatccaccgggtgaccttctggatccttgctcagctgcgatctcggatcgattggaattgaaactgagttgcactccatcatcccaaactgagacagtaatttcttggcatatgcagtctgtttcaatgtggtagcactctcatcttgatcaacctctatcccgagataatatgtgagcaaaccgagatcactcatctcaaactcccccatcatttgttccttgaaaaccttcaattcagagggattttctccggtgacaatgagatcatcaacgtaaacgccgacaattatgccatcacttcctctgcctcgggtgtatactgcctgctcctgcgtacaccgatcaaagccgagctccctcaagcttctgtccaggcgtatattccaggctcgcagtgcctgccggagtccatacaatgccttatgcagcttgagcacaagatgctcttttcctgatctagcaaacccttccggttgtgcaacatacacctcttcttcaagttcaccattaaggaatgccgatttgacatcaagatgatgaacctgccagcggcgatcagccgccactgcaagcacaacacgaacggtatcaagcctcgctaccggagcaaacacctcttcaaaatcgaccccttgtttctgcacatatccttttgcaaccaaccgtgccttgtgcttgattatctcccctgtcgtgttcttcttgagcttatacacccatttcagcccaatcgctcggtgcccggctggcaacatggccaactcccatgttttgttcttctcgattgcctccatctccctctgcattgcttcttcccacgcaggttggccggcagcttctcgatagcttgatggctcttctgactcagctaggagcgcctctccatcacattcgtcctccaccaaatccacacgcggggcctcacgtaggacatctgccagcgatctataccgcctaggcccatcatctgtatcgatgttgtcatctgtgcccggtgacggcaccaccccggcagagtttgtcgatggagaaccgggcgtgggcgttccaggcagagtcggtgatgctgccaccgggcttgccggtgacggtacttcttctgccgccaccactgcttccttcccggcgcgcctgccaggagacggtgcctggtacgacggtaccacgccggccgctgttgccgggctcggcagctgctcaccaggctcctcctccatcgtgaaatccgttggctcctgtcctgcaactgatgtccactcccaaggtacattttcctcaaatacaacgtcacgacttacatgtatgcgcccacgacgcggatcgaacagacgatgagccttgctcccttcctccacaccgagatacacgtacggtgcactcctgtcgtccagcttcttgaggtgcggctgcgtgtttttcgcgtgtgccgtgcagccgaacaccttgagatgtcccagctgtggcttcctccccgtccatgcctcgaacggagtacgatcacccattgccttcgtcgggagccggttaaggagatgcaccgcgtgacgcaccgcctccccccaaaacctgcccggtacgcgcatccccttcagtagtgagcgtgccatggccatcaccgtgcggttgcgcctctccaccgccccgttttgctggggcgagtacggcgctgtcaggtgacgttgaatccccgcctcctcgcacacctgtgcaaactcgcctgacaggaattcaccaccccggtctgaccgcaacgtcttcacgcgccgcccagccgtgttctcggccagtggcttgaactttacgaaagcatcgagcgattgatccttcgtcttgagtacgaacacccacatccaccgggaataatcatcaactataagaaaaaaatagcgattaccagacatcgtactcggtgtaatcgggccgcacagatctatgtgcagcagctcgagcggctcctccgccctgaagtgcgccgccgccgggaacggcgccctggcctgtttcgccaccaggcaagattggcacagctgattcgggtggacgattgccggaacaccccccgccatctccttgtccaccagcagtttcattgcttgaaaatttacgtgtcccagccgcgcatgccacagccaagccgggtcgtcgaggctggacagcagggacacgggatgcgccagcttcaactcaattcggtaaagacgatttacagtgcgcctcaccttcatcaccagccgccatggacttttgtcgaacacttcgagtacatcctcatccatgaccacgcgatgcccggtctctgttagttggcccaaactcaccatgttacattgcagactggggatgtagtagacgtcctgtagcagccattgatcaccgttcttgcatgaaaaaagaatcgaccccttccccttgatctgcactgtggaagcgtcgccgaacttcacccgtccggtgatcgactcgtccagctcccggaatttgcttcgatcgccggtcatgtggttgctggccccattgtccaggaaccagacatcgccagcatgtccaccagcgtctaccagtagcagcttgggccacacgcgctgctcgcgtacgaccaatccgcacgacgcgcgctctggcacatcctccgtcatcgcaagcaacagggcaggcccggcgtcctccgtctgtgcaagatgtgcttctcccttcttcttcttcggatgtgggcattggttagagtagtgcccgtactcctcgcaattgaagcacttgatgtgactcttgtcacggccaccgccgccagagcctgcacctgagtcgccccgcggcgtcccaccgcgtccgcctgcgccacggcctctgccgcgaccgcgaccgccctggccgcgcccagcaccttcacctgaaggtttgttcttctgtggtggcgaggattccccgccgttcttcttgaagtgagcttcccactccgcttgagtgaggagcacctgcccatcggtggtgaccccgccagcggcagccttcttcttccgcatgcgctcctcgtaggccttcggtcgacccactgcctcctcaaatggcatagtatcaatgtcataaaattgctcaatacctgcgacgaggctgacgaatttttccggcaccgtgtcgaacagcttcttcaccatcgcggaatcacccagcgtcgagcccaacgccgagtgacgcacgctcatcgcggtgatgcggcccgcgtactgatccagagtttcccctggctccatcaccatggcaccaaattcacccttcaacgtctgcaagcgcgcttcgcgaacgcggtccgcgcccacgaaccttgtcttcaagcaatcccacacttccttcgccgatctcttctttgccacctgcatcagcaagtcctccggcagggactgcaacagatgggacctcgccttcttgtcccttcttgggtcgacggccaccccggccgccggctcgatggcgtcccagacaccctggtcctccatcatcgcctgaacccgaatgcaccagctggtgtagttcgttgccgtgagttgtgggtaggagaaagcactccccgagctctccctcgccggatccgctcccgctcccgccggaaccaacgccatggtgtcagatcagccctcaacctgagtgctctgataccacttgttggcaatagcaaaaaaactccgatcaaacaccttgctggcagactgttcacgcccggcacggcaagaactgcagcggcaacaacgaacagagcagcaaacagagcagaggaaaagtttcagagaaagaattcttgcaagaatgtatggggcaattttttctgggtttttctcattcaactgaatgtaaaccttacaaaaagaataaagagctaagagaactacttatactcaacgcaaaaaaaaaataggaatccgaggcaaaatcgcgccatcccacgatccgcttttctctgaactccatgcacacacccgcgccactgccagcgctagactcggtcacgattaactgattcgcgacttatttgcatctctaacaaactcctgctagactaattcatcctcccgttcagctccgagagaatcggcttgcattgggccacagctgaaattaatcaacaaaacaggccaagaaggtagctgcatagaaaagtttaggaaaaagtacggattacgcccctaaactatcgcggtcgaacgaattaccccatgaacaacaaaactggacattattcacccccaactatgcaaaccggacgaattaccccctcaacccaatccgcggtggttttggtctacgtggcatacgcgtggcagtccagtcagtgaggcccacctgtcattttctcaccctttctcttctctctctttccctaatccccctctctccctcctctctcccctcacctccattaccaaccgacgacgacgagctgaggactgcggcgcgcgggggcggagccaactggtggcgcgaagggggggccgaggacggcggcgagccacgcgacggcgggtcttcgtcgtgggagcagaggagcagcagccgacgcggcctcaccttccatcgatgcgcgggagggcggcgcgacagcagggggacacggacgtagccccctcctgctaatgcggtggctggcggctgcccgagcagcgtcgtcgccgctgccgtcttgctccatgtcccgacgccgccgccgctgccactggagccggccgagctcgtcgacccgctggctcatgaaataccaagatctggcagtcctctgctggggcctgttcctgttggtgggaagcatctggagcaccagtagcagcaggaacacaccaaatcccttcacagagagaatcaaaattcctcagagacaagaacactagagatgattcctcctgctcaccgccggccacctacagcggcatcgaggaagaaaaggtcgtcaaaaccagcgagaggacaacacacaccacacgcgaccacgcaggaccagcggatccaacaaccacgcaaaaaaaaaaagcagcaacggtggtggcatggatggagcgatgaaattgcagcgaacacgccgctgctaccggagccggccgagctcatcgacccgccgccgccgcccaccacctgcacccgcgcggcgccgtgcgctgacctgcgcccgacggcccgagagcccgagagagagggaaagagagagagagacaggtggaccccaccaacaaaaacaaaaaaagaaaacgctgactggattgccccgtgtacgccacgtaggacaaaatcgatctggattgggtcgagggggtaatttgtccggtattaaaagttcagggtaaacgatgtccgattttcaggtttagggggtaattcgaccaaccgcgatagttcaagacggtaattcgtactttttccaaaagtttaatatgtagttatgcagtacatgcacgtctttgtcagcaacaaaagaaaaaaaagagagatatgcactaacttgcttccatcaaaaccgataacaataaaaaagagaaaacaacaaaattcgaagcaatttctaacagcaaaacggtgaaagtaaagaaagaggaaatggttgcggtgcgcgagcctaggctagaaaagaaaagaaaaaaaacccatcgttccaccaggatcacagcaaacgcccattagcaatttttgagaaaatgctaccaaatactaatgttaaattatactccctccctctctaaatttgacgccgttgacttttttaaatatatatgaccgtttgttttattaaaaaatctaaatttgacgccgttgacttttttaaatatatatgaccgtttgtcttattaaaaaatttaagtaattattaattctttttctatcatttgattcattgataaatatatttttatgtatacgtatagttttacatatttcataaaagtttttgaataagacgaatggtcaaacatatttaaaaaagttaacggcgtcaaacatttagggaaggaaggagtacaatgcattgattagttggtaaaacctaaaaggcgcgctaattgagtggtatattctcaaaattattgtcttgtgagataatatatagaagactattttaatcttattattgttatacgaaattcactgtaagaattcgcttgaatatatatttttctgaaaaaatcatgagctgcaattaggagttcgatcatctcaagttagcatatgaggtttttttaagaaatttcttatataactcatgtattttttaaaagcgaacaaatttaaaacccgacttaaatacggatatgtatcttaaaagcgaacgtacttaacaactgactcaacactgatgacataaaaaaccgttaaaaatatttttatcttttataatagtagaaagagatagagatagagatagagactagtcaagggcggcttcacggccattcggatcggaaagcaacaagcctgcagctttacgtacaatttcctcacgtcacgatgagagacaaggaatcatcaactacgctgtccccgcatagcaactggggaatcagtccatcaaaaaatctcggggaatcagggttataattttctcatcgcaatagactagtgaatataagaatctagtggaatctctctctcttccctctagcagtatttttgtggtgactggtggctcgacttcgatggttcgtggaataagagcagattttagctgacttttccgcgcgtatataggaaacaacaagaagtagaaaaccgttagaacggaccaacaatgaaattgtagcatagatttttttttatataacactgcaaaaaaataaccgtgcgttgcaacgggtaaactaaaattttaccaaatataaaatattatattattagggttgagtttttcatgatatgggcctttaagaaaatatatttctagagaaataatgaaagttcaaaaaaaaaagaagaaaaggcctctttagaggttagacccgccggcctgctagggcattcgcacgcgcggcccagcatcccagcagtgttgcaacccaggaagggaggccggcccgacgcggatcaacctgagctgttcattttcattgacggctcagatcgattctgaatccatcaaaaccgctaaccctaaccctcattcactatctcctttccttccccaccgcgagtccgcgagccgcctctctctctctctcttggtgccgcctctccccctccaccgctcctcctccccttccccagcggcgccgctccccctccacccaccggcggcgccgcttcatctccctctcttcctcccaaccgtcattcccctcgccctctctcacgcctctcgcgtgatgggtccggcgacggcgaccgcaggtggatccggccgcaatggtggcggctgaggacggatcaggcggtggcggctccatccgacccctttcgcctccctcctgtggcggatctgacggcagtggcggtgtcggccccattcctagtgtggcgacgcggccaggagcggcggtgggctcgggagctggtcgcggtggaaggcggtgatgcggacaacggcaatggcaacgacgacggcgatgacgaccacagcggcagacgacgacggcggcggcggcggcgaccacggggaggactgctgtgggaggtggctagggttagggtttggttttttttttatttgggatgttgattttgtaggggattcttgattttgatttgggattgcaattgagtgattttgtgattttgggcaaaggggttgggagcaattggttgatctgctcgtggatttttttttatggtgtatttgagttctcttgtggatctctcttctgattttatttggttggattagagttcgattcttttagttttttgttagaaaaatcgcaaaaaagtgcatgggagggaatcggactgaaaaataaggcaaaaaattgcaaaaaaagaaatgcacggggagggtatcggactgcacatcgcattatactcggacgacgtaccaaaattcttgccaaaaacatcttaaacttttataatactagaaaaatgcccgtgtgttgcaacgggtgaaggatattttaatcttattgttgttgtacggtttagctaaagtgaaattaaccgtaagaattcgcttagatatattttttacaaaatcatgagccgcaattaggggtccgatcgtctcaaattagcatgtaagttttttaaagagatttgtatatgactccttctgtatttctaaaaacgaacacaattaaaaaccgactcaaacacggatatgtatttccaaaagcgattgaacttaaaaaccgattcaaacacaaatggcgtaccaaaagtaccaacaaaaacatctttatttttttataatagtagaggtagagatttcttatacaactccatccatatttccaaaagctaacgaacttaaaacccgactcaaatactgatctatatttccaaaagcgaacgaacttaaaaaccgactcatacacggatgacgtatcaaagtacagacaaaaacatcttcaatttttatattttataatatgtaaagataaagatataatacagtgatatacctgtgcatttcaacggcagatttttcatgggatttaaagtaattttgaccggttaaacagcctgctgcaggtttttctggtctaattgaggagcactgtactaataaagcaatgtgtcagctatctagaggagaaaagaaattgaaaaaaactgagaaaaacggtgagggtaggagggttattaactgatgatacggggtagaggtgggccggttcagtttacaggattttctcgtgctacgcacgctagggaagagagcaggattgtacttttaaagtagttgtagacaaggtaataaatagcgatagtagcggactacatatagcgtattggaacttagcagccgctatagcgtttcgcgaccgctatacagtctgttattgactttgttggatctctataatgctaaaatgatgttctttacatatggatagaataacttagtacaatgtgccttctttatcttatatattaatatgttattccataatttttatgttatgaaatgtagaagtaattaagcatgcagtttaaattttaatttttaagtgaaacttgatgttaatcttgatataaaatctaaatttatggttatttttcttaattttgctattgaaacttagcgtccgcaatagcgcccgctatccgcaatccgctacccagtcactaatccgctaccaatttactatacgctatttattatcttggttgtagataaaacaaatatacatatttaagttgtaatattacgatatgatagttttagcaatcgtgcttattaaaaaccatatgtttggtatttgctactggattttaaatgccttaaaatttattaaaaaaaatacaaattacatattactaagcctaaaatcgtagcgctagactgtgtagttttcgtttattttagttgggattttgttattttatatggttttatttttacgtttatatgcttgagtatttttgcatgttttttttcatgaacagaaaatttattttctattagtctaaagaagggactttgtttaaataaaggatgagaaaggtatgttttttttaaaaaaaaaacatacaagcacctacacttccaatatacttataccttatcatcgtaatatttagcactaattttgtcacaaggctatctttttttaaaaaagagcaaaagctttgccacatatatattgatacagaagagtcacaaggctatcatgagttttatacctcacaatatatcatttcatcaacttttgtttggtcagaatttacttctataacatgatctgtttgcaaataacaaggatatccatctcaagcaaatatatgtttagttctaatttacatcagaatggtcaattttcaattcattctatgtatttcgttatgaccaacaatggttatgtagagataaacaaggtttcgtggaaataatgttgccattaaacatcaatattttcataaggtatttgtaaaaaaattaatggaaaaaaataatgcattgtgggtctagattaaccgtgtagttgtgtacaacatgcaattgtgcctatagaaatactatatattaaagagttatatattaaatcgaactctccttataaaactcatatatgaaatggaagctaaaagtttgtcatgtaaagtgtaacacagcacaaaattacgtgagacaatccactgcctttgttatatctatcctatagaatattattgattaaatatgatatttcacaacaaatgaatagtttcataattttataaagtattattttagttttacgaaatttactccttcccttatacgtactctcgctactttgtgaatggtctgcttgcattaatttcttaaccatcggactgtgatgatgtgtcatgtagtactattttatttagagcgaattataatttgggtcatcttttattattaaagtttcactttagatatatttaaattaattcttttactttggatcgggtaactttgctattttttttgtttggatcaccctaaataacttcttcagcacttattaacaacctcaaacaaatatgttttaatataccagtgagcttccctatccatgtaacgccttatcttcactgtaataaagggtttatatgaatagtaaagagagttgcgtgaagggtggtccaatattaaaaatgataaagttacctgattcacagtgaaaagattggtttaagaatgttttaaagttttattttagcaataaaaagtgatccaaccggtgatttttttaattcatcaatttatatagtgctgcaaatgtagtaattgtttgcatttagtatcgaacattatttgatgtacctgagatcaggggacagcaaataattaagtagttggagtgttcttatcatatggctgctagagggcccgctttaatataatatcatttcacttttcagattaaatcagtatataccgggaagaaaaccaccacggtgattctcccacagcattagtgattagtgtttaatccggcccaataattccatgaatgaggtcagagagtttgatcaactaccctgtcctggtctttttagtataatggtgtgtgtcagtgtgtgcgtacgtatataccgcgtaattagaaaaataaaactacgtcccatccttatagtcaggcgtactatatacatatatatatatatatatatatatatatatatatatatatatatatatatatatatatatatataatcattgttgatttgtcaaaaaacgcatctcaaacttctcagaaaaacatataattgacggggactgttcaaatcgaaaatattgtactttgtatgaaagaattacctgcacgcgatcacaactccgatttggacaaaatattttataagcacagattttataatcgaaccaaagctggggccacacgcgctgtgctagaaaccgattaataaaccggtaggctcacaggctcacagtgcagtggcccagtggccgacggtgaggtcattggagacaccccgagacaggaaagcaatggagacgggacggcataggtcacagagcctgggatctgcagggctcgcgttccacgcactcctctgctcgtcgttgctgctcaacgccgtcttcttcgcgcaccacctcctcaggtcctcgccgacggcaacgccggagcggctcggcgacgggctgagctgggcgctgcaggcggccagggaggccgaggccgtggccgccgccgactgctccggccacggcaacgtgttcctggatggcgtcaccggcgaggatgggcggcccgggtgcgagtgcaaccgctgcttctccgggccggactgctccgtccggacgcccaactgcaccgccgacgccgacaggtaactaatttggctctcgtgttcttcagatcttcttggccggtgccttggcttggctactgcacacgtacgttggcacatggcgatggctgccgaataggattaattatcaatcatcttgctccgagcctccgagtgttcagggcttcaggcgccatggcaaggggcgcatccgcggccggcggatattcttgtccatgcggaaccggttattttatccctttggcatcccacgatttgttattaaatctcaaatatcatcaataagatagttcaatatatagatgaaatagttgtaaaaaaaaatctgaaaatctttatacgctagccgcctattataccataaaattgtaattccaaacttggtttacatattgaaaagggaaaaaaaaaaccatccttacaaacagaaattgtatgtagtgtctgcgctatttatagtcataattgttcctcatttcaacttgaatctaagctccaaccccagctgcagtaaccactaccagtgcacctctgtttgatagttccactatttattgcatactagttctataaaaaaataggtactcccaaagtttaagttaatgttattgcccaaattaatgtccttgcaagaggtgtttcttgccccaacaatttcacatgaaacatatctaaccatcctgtcaccacaataattaatactacagtctttacctattataataattaaagagttttctgtactcatgcctcttcatccgtcgctccttgagtcctgatctattttatttgtttcttccgttttggtacataatcctgtttatgattcctctaatcaccccgtatcctgattcctagcgactactgattccaatactgttcgcatctctgcatacatgatcccgcttctaaaactgacggtgagtggaagccaatactgttcgcaacaaaagcaatcaacagaatcatgtattttgtggccctgtgttaccgaaccaaactccaaagaaaaatattagaaacagaacgtcagcttatcaaggccacaaagtacacgaggagaagacgagcacaagaaattaagtcataacaacccaataaaatcaactagaaaaaatgtttccaactaaaaagaaccatcggaaattttaactagatatttttcatgatatggtatcagttttgaaccaaagtgggttataatttcgtgtcattattttccctattataagtgatgtgacaatttaggattttttttttatcatgaagcttaaactaacaatttccgtgatcgggtgatggatgtacacaagtcggcgtcacaatcagttgtgaccgaatattaattattcatgcatggtggcataatttcaaattagtatattttctgttgcaacgtacaaatattttttaagtaatagtttaaattaatcttccagcccaaattaatcttcttccatgactacttctagttctagaagtaggattttacgtcatcgctggaaaatatcgagagatcaggttaattttttttttgtttgtctctgcggtctagcattatacaggtcgagtcaaaacaatcgttgcccacacatgtggctgggccgtatctaaacaaggactaaatgtcaatatttgggccgtacaaacctggctcaagtaaaatctgttttaacctgggtcttaccggaaatactgacagaccagcccaatatatcagttttaactggcgcgtgtgagattaagaacatccacaatatataatttacttaaggatcctaaactctaccacatatgcatactaatggaacacacattgaaacatattgctatcacgtatgaaacactaaattttaacaggttgaaatatatatttttttattagaatatacataatcatgtgatatcttgttgtaaaaatttaattacgaagaatacaactcggattatagatcagataagtagtttaaaataaaaattatttaagatgggaacgagggaggaagatgtagcagtagcagcgccgcatttttatttttcttgtctaaccgggcgcgtgtactagtattctcctggtatttgactcgagatcatttcccctctctcctttaggtgtatctatgcaaaaggtccatacaatgtgtagagtcggtcttttattcttctctctggtttggggcccccacattgcaaatgctcaaatgagctatcattccgtacagaatgtgtagcacagccgctggtacgtagcacggcacgtactccctaacactaatcctgcaatggttttgtgcagcgggaacccgttgttcctggagccgtactggagacggcacgcggcagccagcgccgtggtgttctccgggtggcaccgcttgagctacatcaccaccggcggccgcttccattccgtcgagctnnnnnnnnnnnnnnnnnnnnnnnnnnnnnnnnnnnnnnnnnnnnnnnnnnnnnnnnnnnnnnnnnnnnnnnnnn

SEQ ID NO: 6010 - DNA, 1717 bp, Oryza sativa
  unsure (1)..(1717): unsure at all n locations
cgtggtgttctccgggtggcaccgcttgagctacatcaccaccggcggccgcttccattccgtcgagctcgatcgccacatccggctgctgcacagggccgtcggcaacgcggtcgttgacgacaagtacttggtcttcggggccggctccatgcagctcatcaacgcgttggtgtacgcgctctcccccgacggcaacgccgactcgccgccggcaagcgtcgtcgccaccgtgccgtattacccggtccgtgattccaaacaccaccacacgctgacaacctgcatgcgaaccatgccattgacgatgatctcagttaattaagtcgtgctgaagtgaactgctttgatcgatgatatgtgtaggcgtacaagtcacaaaccgacatgtttgacggccgggagtacagatgggacggcaccaccgctacgtggtcaaacaacggctcgcgaaactccaccaaaggcttcatcgagttcgtcacctcgccgaacaaccccgacaccgcgttgcgcaagcccgtcctcgccggctcgtcggcgatcgtcgaccacgcgtactactggcctcacctgacgcacatcccggcgcccgccgacgaggacgtcatgctcttcaccgcttccaagctctccggccacgccggcagcagattcgggtacacgccctcaaattaagcctgacattgcaagcgacacgtgaacacaacgacgcaaaaacttgtacactacatatacgtcataccgtgctgtgcgttgcgcagatgggcgctgataagggacgagaaggtggcgaaaagagcactttcgtacgtagagcagagcatcatgggcgcgtcccgggacacccagctccggatgctgaagatcctaaaggtgatactggccaacctgcacggcaaggaggacatcttcgccttcggctatgacgtgatgaggagccgatggcgaaggctcaacgccgtcgtgtcgcggtccacccggatctcgctgcagaagataccgccccagtactgcacttacttcaaccggatcaaagagccatcgccaggtgatcagtttgtctcgctcgctaacactcaaaatcaatttctgtcaaccaaaatctttgtgctcatgtgttggcttgtttggtctccccctgatgggcagcctacgcgtgggtgaaatgcgagtgggaggaagacgtcgactgctacgagacgctgctggcggcggggatcatctcgcggtccggcactttatccgaggccgaagctcggtacacgcggatgagcctcctcaaggcgcaggacgacttcgacgtgctcctggagaggatcaccgaattcgtcgatgccgaggagcacggcagagctcccggtggctccagctccatgtgagaaatcgtgaattgagagggtgccaagcttcgtctagctggcttcgatgggcgctgtgccggaacgatcagctctactatctgattgttcttgggtaagttcatgggtacaataatcaaggggaatgatcagctagacgttgattgttccccgtcaatatttggacgaacaggtagatattgatttgtgtgtattgacgaatgatgtagatatacacaagccattatgtgtttcagtgatcaacaattgaatatgtaattaaatgaatatnnnnnnnnnnnnnnnnnnnnnnnnnnnnnnnnnnnnnnnnnnnnnnnnnnnnnnnnnnnnnnnnn

SEQ ID NO: 6011 - DNA, 3313 bp, Oryza sativa
  unsure (1)..(3313): unsure at all n locations
aatacttttaatcatactctatacaattatattgatactgttatgtgccggttagtaaaagaaaagatatgcatatggcatggcagggaaaatggtaatgtgatatgcatatggcatgggtgcgagcaaaagggaaaatgtgggcagagatagcacatgcaaaaacgaaaatgcgggctaagatagtacttagttgcattgaaaaaaaatgtgcatccggaaaatagaacctgactcggtatcgtggaagggtactatggccgtgtttaattcaccccaactaccccacacttctaattttccatcacatcatatcacatcaaaaactttcctacacataaacttttaaattttttccaaactcccaacttttcctaaactttcaacttttttcagggactaaacacacctataataccataccactacaccagatgcacaggccctagtagtctctgaatatcgtcatcaagttagaatcacctactaccactgaatcagctaatagcaggatatgcggttagcattatatttttctcacgtaagagcatatatatttttcacattttatttatgaaagattaaaatgtcaacataacttagcgccactaatactaattccaatatccataaattaaacgcgatatatcctctagtgttctgttaataataccatgactactttgttatatttgtttcttttcttctctctatttatctttacctttgaactagtattagtggcatcttcttttactatctttaatgatattttttttacctactaaagatctcattgtcatattgtatggtagttccttgtcctaaaatagttgtcttttcaaagtttaaattccacagtacttgtcacttgagagtaatactagtcacatcagtcacctcaaattcaaatttctacctattctacctttatcactgttttactttcattcaaataaggggtaatatattctttgcgtgttaaatcttaatttgttctaaaaaaatagaaagataactatttttggaaggaggagtacgcccatgatagtttatagccccgtcgcaaataaaaaatggccattgtcctccaggcttcttcattaatgatctgggacaacggtgtcacgtacaccaagggagtagttggcgtgtagtatcatatcataaggctgtcaccgggtccgatttaattaaatgttcatagcatcaattaatttcgtcttaaaacgacataccagtaaaccactacgggtccatggcacttctcccgccgcatttctccttgactaatcccggagtagatagttttttttaacgactcgcacgagacggtgcgaagttctattgatagagcaggaaaaaattataagattataaccctggagggtcataaccaggaaaaaagaaaaaaatatacaaccccacacacctacagcgccaacacacacgaccaggaggatgctagcatcggaccggccgccgctaaaccaacaaaagaacacagacgagatcgccctgaggggtgagacagcacgacaacgccctcaggagggggaattaaccatcgttgtcagcccggcaaggccggactgggttttcacccgccgcacaccacctgcgaatccatggctgacgcaccgatgctccaccaccacacaacctctgcctacatgtgggacccccgcactggcgcccccgccggccagccttcgagcgccgaagatcgtgccacgcccaccggcatctcctcctcgcaccagggtcgcctcctcctctgccggccgcgccgaaccggcctcctccaccggacgcgcctctcgcgccaatccggcctccctccatcggccgcgcctctcgcgccaagccgccctccatctccgccgcccgcgcctctcgcgccgagccggcctccactgccatcggctgcgcctttctgcgccaagccggtctccgacccctcttccgtactctcccgcaccggccagatgcagccgtctgccacctcctcggctagccgaccgaggccaccatgccaactcccaccaccaccacggccgctgctgccgacggccacctcgctgccaaccagccgcagccccatcgccgtcgtccagccgctaccgcaaccgtcgccacgagttccgcgctgctgcctccgccgcgagagccccaatgccacagccaccaacagncgccaaagccgtcgaccagccaccgtgctgtcgccgccgacaagccgctgatgccaccatcgccatgaaatccacgccgttaccaccgtcgccgtcgccccgtgctcccgcaccgttgccgccgccgacgtcgccgcgagctccgcggtgccgccaccgccgcgagcttgctccgccaccgccgtgagcttgccccgcgtcgccatcctcaccggccttcgggcaaacggcctcaaccgccgttggtgacgctcacacgcgcctgaccgcgtcgcccacgacctcagctgcgccgcccgcgcaaccgtcgccgccttttccccgctgccagcacgcctgcttccctgccgcccgccgtcgcccggcgtcagccccaccaaatctggccaaaatagcgcggatctgggcgggggtttccgccgccgccggccctatacgccaccaccaggcaccgccagtcaccgccgccaccactccgccccgccgccaagcgctgccccgccggatccggccaggcgggcgcggattcggacggtttgccaccgtcgccgcccggccagctccccgggccgccgagcgcgcgctgaggcgaagccccgccgccaccgtccctgcggccgcgcgactttgccggcgcccgctcaggcggcggcgaggcagagaaggaggggaggaggaggaagaagacggtggcggcgtcacctctcgtgtcgcccgtggagagggcgatgcgagagccctttccctggagtagatagttttgcttgtctgctttgtgtccgttctgtttattcattaattagtatctaaaataagatatgtgtccatcctttcattcttataatcgggtctcctataaaatcgttgttgatttgtcaaaacacatcctcatcttttatgcttatcaaccaaaattttaatttataatcttaaatttcgagctgataaggttttttcatcgaagtttattttttagcttttgcttttagatcgctaagctaagaacacgtatatatttttttttcacaaattacttttcgtatgcaaatatgnnnnnnnnnnnnnnnnnnnnnnnnnnnnnnnnnnnnnnnnnnnnnnnnnnnnnnnnnnnnnnnnnn

SEQ ID NO: 6012 - DNA, 3119 bp, Oryza sativa
  unsure (1)..(3119): unsure at all n locations
nnnnnnnnnnnnnnnnnnnnnnnnnnnnnnnnnnnnnnnnnnnnnnnnnnnnnnnnnnnnnnnnnnnnnnnnnncacaaattacttttcgtatgcaaatatgccatttggcttattctaagcgaaacaatgggctcgctatcttcttagaatatatataattgacgggccagttcaagccgaaaatacctccctcaaccgattcttcccctccgctcgcatccgcccgtctcgcccctgcttgagctggctccgggagtgcgcgcagtggaaggacggtggtgatggggctttttcctcggctcccaggcagatgggctgaggtttgccgccgaagctgggagcacagtggtgaacggcgacggtggcggtgacaggcatctcgctggcttgcgagcggcggctaggttgcgtcggcttgtggatggcagtggcgacggagttactctccacactctattagagtttgtgtcgaatatgcgtacaaagtcggttacaatttaggacttgtagttgtactagttattggagtagagtaagagtcagactctatgctagtatccttttaattagaaggacaaacttgttgtaaccggatatgacgacttagcatagcgagaggtagcgtctgccagcggcgtccggcccagggtagttgtaactctggtatgctgtaatatactgaattgaggagtagcaccccataaactgtgccccggggatgtaggcttcggctgaacctcgttaacaaatatcgtgcctcggtgttgtcatcatgtttagatctcctatggagtttcttccgtgtttggtttctgatggtaatttcggactgattatctaataagtggtaccagaacttaggtttaaaatccgaaacaatttccaaaggtcaaatggtgggggaggccaggtaaaagtcttcggggtcacatgggttgatgtgacggggaagattgttgcttgggtttagtcccacatcaataattgatggtgggggaggacaacttaaaaggtggtggcagttctctttcatcagactagtattttgggttgtgtagactcaggatatatagttgtggtttcggttgggcctgtggtgaagttggcctaatgtgacctaggtgacctacgatacgtggccgggctgcacactcttacaagttcgtggactgcagcggagatagagtttaaatgagaagatctgagtgggctgatgaatgctgcccggctgcacactcttacaagttcgtggactgcagcggagaaagagtttaaatgagaagatctgagtgggctgatgaatgctgcgggggcggggcgtgttcaggcgactggctgggtggtggtgatgcgaggtggcgacggtgttggacggagacggggctgaagttgtgtctggtgtgtttggtctctcctgatgagcagcctacgcgtgggtgaaatgcgagtgggaggaagacgtcgactgccgcgagatcgctgctgctggcggcggggatcatctcgcggtacacgcgggtgaacctcctcaagacacaggacgacttcgacgtgctcctggagaggatcaccgattttgtctacgccgagaagcacagcagagctcccgttgcatccggctgaccggctccatgtgaaatcgtgaattaggacggtgacaactgacaagcttgttgtagctggcctcgattgccactatgccggaacgatcaggcattttggaaaatcaacactggaatgatccgctacttgctgattgatctatgtcgacgtttcgacgaacagatggtgtgcattgagcaatacatacacaagctattctgcaattggacggacattttggatttcagtgacgaaaaattgagtatgcaaataaatgaagatcgtagtaggcatttttgtaatcaaggacgagcatatgacatggtaagcaaaagtaaatgtgagaagagatagcacttggcattcgaaatggcggacaaaagcaacaggtgagcagggatatcacttggcaaatataatggctaaaaaaactgaaagaatgcgcatccagggaatcgaaccttggtcagtaccgtgggagggtactatgataccactacaccagatgcgcatgttgcttaagcatccaaaggaagttttactcattataacaactaacgtctttaatactgcaaaagaaagggagcaaatctgcaaatggttgtgctatagattcagaattggcagctacttccatgaacaataaaattgtatcctgccacggtattgtgctaactgaaagttttagaagatcgaagtgatatgtgcgcaacacaataagccacacagaatcatcaatttccaatctctacatatatcatatctccatacatagatcagtaccgagtaccgactccatctcgcacgagaagcaaatcagcaatcgaccaatcgtttggttcgggcatggcaatgttggcaagatcgagcagttgtagcttttccttttttttcagagcttctccaccttgtcgggtctcacgacggggttggcgcgggcgatggcgtcgcgcccggcgcccctgtaatcgtagccgcagtcgtgcctgtccgagtagcgatgcgcgccgcagaacacggcaccgcagcggcactcgaaccccatcagccccacgctcctcccgcacgcagcgcacctgctcttcgtcttcgccccgtgccgcggcggcggcggcggcatcgccccctcgtccacgggtacgccctccggcgccggcaacaccacctggtcgtgctccgcggactgtgctgcggccgacggcgcggaggcctgggacatcacggtctggcggtagcacttggagcagaggccacgggtgtcggcagagccgaagaagccgcagccgttcgcgcacgggagcggcggccgctcgtcctgcctctcgcttccctgctccatcgctcgcccgaacgcaggcttcccttccccggcgtcgacgaggaggttgagagctgcaagcctgcaagaagcgtacaggaatcggacggggattcgtaggcgatgagctagtgggagaggatgggggtctgtaccgaacgctacttggtgccccgaggcttagggaagatgggatg

SEQ ID NO: 6013 - DNA, 1470 bp, Oryza sativa
  unsure (1)..(1470): unsure at all n locations
atgtagcaagggcccctctcttcgtctcatcccatccactgagtagaggtggcaggaagcggcgagcttactggcctcttcccctcggtgcccacctcctcctcaaggccctaaagtttgccggtgacgggtgcggcgctttctagcaatgtagggaagctataggcggaggaggtccatgaccacaaggctgttgtagtgcaggaaccaacctaagtagccgataatgttctcggactagaggtggtgacatcattgatcctgggctcacacccacctaccccccactagcgtcaccttctttatcacggatggcgatgccaagcgagcctcattaggctccatcacgggtggaccgtcgttagcgtcatgctccttcccgtcagcggttcttcctccttccacagtgcctccactttgactatctcccatctaccacatttgctctagccaacgtcgggggtgacacatgtagccaagggcgacgaagaggaggtctcctcgacctgtggcatcctttaccctttatcctcgcgcctcggcatccttgcgctattacagcacgaggccctcgtcggcaacatctcctcccatggtgagggagctaagcgcgtgaggattctaccgacgcaacaatctggttgtcgcaagcctcctagaccacgacgcattgggggatcggacgggacattgggggtggaagacagtggatagtgtcgacgagatatattcgcaaacggcatttgtagagtatggggatcgtcggaaccaggatgtatgtgagatcggatctacggaacacgagacaaagatttataatggtccaggctctcaagatgagtaataacttttaccctgctccaatttatatgtatatatggattgaaatatcacatggattacaaatgtggaataggacgattagacttatctgccgactaaaagttgttgagaacggtccgatgagataaattcagcgaataggacgctagcttcctttggattgcttctgggtgtggatttggctatgatttgtaactcgatgtcagggtctgttatatgtactgtagatcatcttcttctctatggcttctaaggagaccttatcttccccgactaagattctggcaccttctatttcggaaagataatttccttctttctttgtcatatttcccgtatctcccatattctggtttaaggacatataacaggacacgggtttaaggagaccttatctttcccgactaagattctggcaccttctatttcggaaagataattccttctttctttgtcatatttccttaactaaaggatactttctcttataatatcaggtatatagtattatcgtatgccacgaacatgtgtataggggatgccttatccttgacactgatagatggggannnnnnnnnnnnnnnnnnnnnnnnnnnnnnnnnnnnnnnnnnnnnnnnnnnnnnnnnn

SEQ ID NO: 6014 - DNA, 8793 bp, Oryza sativa
cccccaagaaaataaatccaccaattaggacgctagcttcctttggattgcttctgggtgtggatttggctatgatttgtaactcgatgtcagggtctgttatatgtactgtagatcatcttcttctctatggcttctaaggaaaccttatcttccccgactaagattctggcaccttctatttcggaaagataatttccttctttctttgtcatatttcccgtatctcccatattctggtttaaggacatataacaggacacgggtttaaggagaccttatctttcccgactaagattctggcaccttctatttcggaaagataattccttctttctttgtcatatttccttaactaaaggatactttctcttataatatcaggtatatagtattatcgtatgccacgaacatgtgtataggaggtatgccttatccttgacactgatagatgggacaactcatcaggggaggaagacgatagacgggatggcacatcggttgaggaagacggctgacgggatagcatatcggggggaggaacatgatggatggaacggagagctcgagcttgtcacctcccttgtcaccgcccctttcccttgcctccctcctctcatcctctgccgtgaaccgccttcctcactagctgccagctcgttgaccctgcttcaactccagatgggaaggcgagaaggtgtcgagtaaatcagtggtggtggtggcggcggtcgtgatcaagtgcttgtgcaggatgggagggggtggcaacagttacatcatcgtcgtgggggcatgggatactgggatgcacgcggtgacatgagggagtgaaacaagcagcgggtgcactgcggaagccaatggtgaagagtcgcaacgacatgctctcgccgggcctccccaactctaatgttgtcgtcggcgtctcctctccccaagcttccccgaatgctcgaggggttcggctagccattgccaccaccctcccgggctccactaccactggacagtgagaaaggacaaaggaggaagatggaggaagagagaatatatgaaagaggacagctaggggatggaataccattcatctgacggtatagtttatgatcttgatcgtgcacgacatgctgctcccccccccccccccttcccggaaaggacgtggcggtagtgctcatgtaatcaagtctcctatctggattagtttggttgaactgtaaggaagcgggactggttggcctaggtgggactcaggtgggctgatactaagaaaagagttttcctattggtctaaacgctgatatggactaataatagtctagtagtatctcgttaggccatatgctgatgagattaggacaattgatattccctccatttcaaaatataaggcacaaccactcttaacctaaagaccaagaaataattattatcatcttgtagtttggatcatcctaataaatataatggcatgcatccaatagaattagataacatgagagtggaggattcaaaaaagtaataatttaatagagaaaaggtcatagttaattgtatgcttgcatacatgccttatgttatggaacatctaaaaaaagtagtcgtgccttatattatggaatggaggaagtacatatcttcacaataaatattcttgttgggtcatgtgctaattaggttagaccaataaagatacacacatctatgactaattattacaaagtatggagaaatcatgtacttatcatctatgaaatcccatgatacttggtactacatagtaccgtatatgttatgaacctacaaggtaacagacctggtactccatatgtatcatatgtggtatctaggtatcatacttatatttatatccaatatctaggtatcataatttgtagatatcgtgagtatcatatatgatacttgggtaccatatttgataattagacctggtacctaggtactagatttcgtaaatatcgtgggtatcatacatggtacctgagtatcatacttgatacttagacctgatacctagggtatcatatatggtacttgggtatcatacttgatatttagacttgatacctaggtatcagatttgtagataccgtggatatcatatatggtacctgggtattagacatgatacctatatatatatatatcagatatgatacttaaaacaagataattaagaaaaagataaacataaaacaagataattgaccatggctctttcctgcaggcccagctagcatgtgagcacctcttgcgtgtgtcctacgactaatggaagaagaagtcacgttcacactcggcaagacaatgcgataaaagcccaacaagttcatcatgtgggtcgtggggagcctatcgacatcttgcatatgaggcagacaacgattcgctctcattaatcgtcccgtgacgacgggatatcgttctgtagcttttcttggaaagagagaggaaggagaggtgaggaagaagataagatgaggacgtcactaacatgtgggatcccacctgttaacttagcgagtcaaaaccacagccaacttgccacgtcagcaaaaatcactttccaaaccatcgaaggagtcaatttacacgttttcaaagatttggagacgttatacctgattttgcaattaagggaggcgatttaatcagcactaagagatgaggaagagaatacagacttatttctttcctgctcttaagttactacatgggctttaatggcccacctaatacggctgtggcaaacggtgcagcccatcaactagccacgggggacgttttactgcggttagtagctcgatgatccgggcccgcatcgttccgctaaagtgctgaacactctctgctgtgaatatctccctacccagaacaaatttgctatgaatcaccccaaaacgaaacgattcaagtaatactgtacctcgtagtccgatcttaaaattcgctactccagaaatcgctttggagaaccgcaggagaaaaagaaaaaacgtcgagaaaggttgtcagagtacgaggcttcgtacgagaccagataggatagaagtagtacaacggatggcgcgccgcggcacctttttccctctgcagccgctacgcgtgcccctgcgccgagcgttgttccccgtctgattctgaccactttggtcactccgtgctgtacctgtaccctggaatgatgaactcgtgatgttgatgcaccagcatgcatgcgcgccgaggccgatcgagcagcgagcccgcccgcacgcacacacgttactccactgttcatggcgaccgctggtcgtagtactcctagctgcaccagttggcatcgatgcacgaggccacgagccacagaaacgaggccgtgcggtcgtccgtgcagtgcacacgctggccaatggccatgccatgcgtgcgcgacgtgatctcggatggattaatctatgatctcgaatagattaatctatgatgtagtagtacacttgatcgatcgagcccctctctctagtctctctacccaggacagggccagcttgcgtccatcgaggcagcggatgcacgcacgccacccgccgcaagattccaaagccatcagttcccgcgcgtgccaagccgcatcatgcgcccgtcgcacgtgcgaggccggggctttagctgtcgcctgcctggtcgtcctcgtcagttcactgctccgtatcacggagaggcccccccgccgcggccttttcgttggttgattagcgcttatcttgtcgcacgaactgatttaatatctccccaacttgtgttccgaggcgacaagagaagacgaaacaaaaaaaactcgagcatccagtggcagatcgatcgagaaaacgtacaagtcactcgcgttgccgtgaatattcaaatatgcagcgtgatggtgttggggttcatttcagttcccgtcctggctgtccggctccgctgctggtggttgctcgatttgaccgggcagattaaggttcggatcgaggtggcgttgcatgtgcggatgatgatttgttaaggtgggcaatagctcctaccagactccctgtactgtacgtgagtacgttactaatcctgctacatcccggaagctgcggaccagcttcggttcctgtcaattgcatgccccgatcgatcgcgatgcacgtacgggctcggatcgtaccccgtcgcgtttaagttaataatcgacacacgtgcaccagcattaatatgtcatcactaactccaacgacgtgctccacgtacgtacagactcctaaaccgggtactgtagctggcatccgccgttcgattttgctcgtcgtattcgtgtgccagactgccagggcacatattcatgttccaaaaactgatcgatgtgtgtacgagcgcgctcacgcgaacgtgtagccggctagccgctcgtgcgcacgcggcctgcgtgcaccggtcgttttcagttgtgcgcaagcgcacacgcacgcgcgcacggacgtgtcgcgcaccaaccgcgtcgccttttttgccctccccggctttccctccctcccgttttcgtcgtttcatgtcgacgtcgccttaatttgaggcgtatgggcgtatggctaccgctgagatcgacgtgcgcgttcgccggccgtcgctgcccacgagacgttcgtacgagaaatggaccgccacagcgcctgttctactttacccgttcccaaatttttggacgaaatgcagcggtggtgtcacggaaagccccaaaggataatgttaaacagatcgccgttaccgatcgcagcttatagtagagatctgatcccagcgcgtgtagttcatgcatcacgctgcacagctgggcgagctggcaacagactagtagtagtcctcgactcctgaccacacctaacgaagcgacctgttgtccggttgagaccggagagacgggcagagggtgtgaaggacaggtcatgtgatggtgaggaccgaagaggagcttgaggtgtgtcgcccggtggatcgaggcggtcggtagtcggtacggtacctagctgggctgagtattcgtctcatcttgggctttctggcctgtatcagtaggaccgcaggagtatactagtactagtacgtacgtacacaatatactagtaccactgtactacgtacggcacatggcatgttccccacttgccctgttcgttcatgggaatcggatgagcaactttaatacaactgcaagtcagtcttaaacaaatactgcaagtctactactgtcggccggagtagcttaatactggagtactccactatttacgccgtgtttagttctaaaataattcatcaaaatttcaacttttccatcacatcaaaactttcctacataaacaaactttcaactttttttatcacaccatttcaatttcaaccaaatttttaattttggtgtgaattagacacagtccgtgtcgaagtagtacttattacagtactgatctacagcattattgttgtagcaggcacctgcagatgcagccttcctgatgccgccctgatgacggatcgtcgtttggagaagggggattggaactgatcatcacaaagaaatacggagtagagtaactgcgatatgtagtgcagtctcctaacctcgagttcttttgagcagtctgaacaagacagataacatatgaccgtgttccagagtgcatcggtaatttgtgaaagttttcagaaaacagagaactctatacatactaaaaacacacaaagcctgttgataataagcacgtgaccatcagtgcctgttgctagattaattctatttacatgtgtatccatcagtgcttcacactacagatcaaattggcaagtcgatcgatgccactcacggcgcctagctcggcgcacacttgcacaggcaatagattcacccatcagccatatcagtccatcgcgcagcggcaagttgggcctctttcttgcctgcctcgtaccgtcgcgagagggacaactaaccacacgagcgcgcgcgcacgagcaaaagagagcacaggagataagcacgtagtagctaccagctagcgactgccatcccattgaaaggggccgagatcgatgcgtgcagcatccaaagcatatatgcatgcatccacctgattattcgtcttatcaacacacacatacgaaagataaatcaattaatcatgaacaggaacgcacgaacgtccatgatcgatcacgagctgatcaaaaatcatccatcactcagtagcccggttgcattcagtcgacactgatgatcgatgatccatgggcgcacgggtcgctcgccgcggtacgaacgtgtacgcgcgtgtggcagaagggtgtcgcgggtgagccgtgatatgaccgcgcgcgcgcacatgccccacgtcgaccgataaggggcggcgccggccacaccgcggcgcgacggagaccgctgcgtggcgatatggaggcagcggcgctttcccgctggggccgagtgcctctctcgtccaaccgcggtctcgatcgacggcgacgtacgcttgtagatggctccgtcggtccgtcccaacaatgcaccaccgtgatgaaatcaacttctttgccgttcataaagttcgtattctaccgtaccgtacaccatcgggattttacactacgccagctcaggttatcagtgatgggttcaaatcgtcacttttgatggatttgacccttgtcagatattagtggttaacgatgactcctctcaccttttacgagtggagactcttacgtggtgaccataatatgtgacgggccacaaaatttcacctgttacacaggagattgttctctaacgggcaatatattatcacccctgtcactgagctacttaatggggggcaaaaaagagattcaattcacatgttagcacagtgtcactgatatatattaaccgtgagaaatggttaattcttgttcatcgttgtcatattaacacaatgtcaagaaaaactacaaacctatagctgattgattgagatcctatcgatattggctggccttgctacatcgcatcagcctgttgaccaatcggctccttgatcttatatgatctatctatttatcttgttagttgcaggatcaaactaattagcacaccgtaaacccgattgataggaccagcattggaactaattaaatagtcctcctaggccttcgtgtgtgacgaatttcacgtaacaaccaacgcaagctcgagccaccattaggtcatgactagtcagatccggcgtctcccgacctcggggatactcgtgggcgacgacggcggtggcttggggattgaagttgcagcgacagacagtgctcagggatgcaggaggtgggtgcttggggacgaaggcaaagcccacgacggcgagtgctttggactcggcggctggtgcactcgatgagggtgaggaggtgtgagagagagagattgtggcctctggtctcaagttgttggtgggggatagaaaagaagagagagagagagatgagagattgtggcctctggtctcaagttgttgatgggggatagaaaagaatatggttcctctggttttgtgtgatgggacttatctttgatgggtgcatattctgtacccgtcacagatgaagagtcgcctctaacgggtctatgtttgaatctgttaaatgtgagttgtgccgagtatgtacaagaggcatgtcacagatgtctacgtgtgatgagccatgtctcatagccttatttacaacggaatttatttggatccgttagagataaaggtcgtttgggacgagacattttggacggtaagatatagatcatcagtgatgtgctattctgttgtagtgttattcagaactgtcagtttgattatattggactgatgtggaccaacgcttcaaagtgatttctattgctccagctagcataagagtagtactacactatccctctgtctcataatataagggattttaagtttttacttgcactgtttgatcactcgttttattaaaaaaaatcgtacaaatataaaaaacgaaaagttgtgcttaaagtactttggataataaagtaagtcaaaaaaaaataaataataattataattttttttaataagacgagtgatcaaacagtgcaaacaaaaactcaaaatctcttatattatagaacggagggagtatatattagtgcacaacttgaataaattagccacttaattaagcccggcccatgcctccccctcatttccataccatcgccggttctctttctagcgggcatggaataatatattgagatagcaatatagtaggacctaattatagcgttatgatagcgaaaagttccgattgcaccgaagggaaaggaaaaggtagagatttggtgcataaatattgcctgttgtcttcatgctcccatccttagcccatgtttatttgtctcatccactccacttacaaaaaaggagggctagctaatgaaatgatacgattaaaaatgatttctcgaaaagaaggagcggctatacttaaaaaatttcttgagggccactaactaatcatacgcatcgatcattatagcgggccagaatagctttttaagtacatgcatgcatgatccacggatcaattggatatttctggtcagacgcacagtattatattttgttggatcctttcagtactggcttttctcaaactaacactgcacggaaagacaatgctactaccgaacggagaaatcgttgaagatgaatgcat

SEQ ID NO: 6015 - DNA, 709 bp, Oryza sativa
cctagctaacttgataaataaatggtggccactaacagtacatgaaggtgaaatgagaacgatgcaccataatttttccccgaaaaatgttccttttcttttcacgaagatatgcaatcgtttgtgcacaatactagtactactagcactatttacctgcccggatactgcgtcactcaccatgcggcataccagtttttggacggaacggcgttgcctgccgcgcgagcgtggcgtggcgccggggtccccatggcgagttggcttggcccggccgcacggggggagcattaaacccccgttggcctcttccgccccgaaatcccgttgcccccgacggaaatccggcaaggtagagcccgcggagtgcgaccgtgacggcgaccgcgaccacgtgacccaacctcccctgccccccctagcgaagaggccgagcaaaaatcagcaaacggccggaccacgcgccgctctcacgcaccccgtgggcagtggcggatgcgtacgacgcgcggcgacgggctcgggctagctagtgggctagcggctcgatcgattggtttacagttttagcccgcgcagcacacggcgcgcgcggcggtcggtggagcgagcgcgacagcgcggtgcgggtgcgtgtgcgtgtgcgtgtgcgagttggggtgggtgggtgggtggtggtggcccgccaggcatgcccgcacggttgggt

SEQ ID NO: 6016 - DNA, 1014 bp, Oryza sativa
  unsure (1)..(1014): unsure at all n locations
cttgtgaaattgtgcttctcccatggtggccgggctaaactagtagagcttattttctgtagaatacctcctgatgatgtaaccagaaattatctatcaataaagatgggttaagcatgatttcgcacaggattgaccctctccaaccaaaacccaaccaaatccagggagtcatccaaaaaatatttaagagcaaagctaaccacacaagcagatactgcaacaagtggcctttttttgccggttgcaacaagtggttttcataagttttttttagataaagtggctttcggaagtaaatgtgaggcaatgaggcagtccagattcaaagcaaccctatcaagatcgaagctcaagtccagatgtcttaaattaggcagccgtacgataggagaaaaactggaggtagcagctctccagctggctggctaagagctggaactccatactccatccgtcaaaaaaaaaaaaaaaagacaacttctgggaatgaacctggacaagcatttatctagattcatcctcagaagttagttttttgtgggacggagggtgactttgcgagctgaatcagctgctaaaaaaatggctttgtgattggttttcctccactccttgaagccacactaaacaccagctgtgtaataaagggtgcgtgcctcctgtcacaccagggtccaattttgtcaaaagatttttctttaggccaggaggaggagattagtatggtactagaagcgatctctcgctaatctgtcaaggttcgataggctctttcaataaagggggactagtatgttgaccaggatacgtaatactactagattttagcaaagcatgtgaatgggggtctagttgggattagttattagcttatggatgatctgttagtagtaaagaattcagagttctcgagctgaatggttcagaaaagttggttgatcaatnnnnnnnnnnnnnnnnnnnnnnnnnnnnnnnnnnnnnnnnnnnnnnnnnnnnnnnnnnnnnnnnnnn

SEQ ID NO: 6017 - DNA, 385 bp, Oryza sativa
aaggctcaacgccgtcgtgtcgcggtccacccggatctcgctgcagaagatgccaccgcagtactgcacttacttcaaccggatcaaagaaccatcgccaggttaaaacggcacattatctctgcagatcatggcatttcaatttctctcgctacctctcaatcgaattctttaaggtgatgcgatggcgtgtttgtctaccctgatctgcagcctacgcttgggtgaaatgcgagtgggtggaagacgacgactgctacgagacgctgctggcggcggggatcaactcgcttaccggcactgttaacgaggccggcactcggtacacgcggctgagcctcatcaagacgcaggacgacttcgacatgctcctggagaggatcac

SEQ ID NO: 6018 - DNA, 582 bp, Oryza sativa
tccgcctcattcattgtattataaggaatatggaaaactaactgcatctctgagttcttttactgaattttatctaagctgtatttcaatattccacaggttcgtaatgacaaatgtgtgtttttggctgctgcttcaaatttgttgccaatactggagatgtaccaagcgggtgacacgctaagtgaagaactattacacaaaaaacactagttttaccctttatttgcatactcgatgccggaaactcgatagatttttacttgtacttatgttcatgaataaaaaatagcaaaacaatccttatcatatctcttcctgctcgctaattggtttatccatttttctggaaggcttcccaggtactccctccgtcccataaaaaaccaacctagatgtgacacatcctagtactacaaatctggacattctagattcattatactagaatatgtcaaatccagtactagattcgttttttttttggacggagggagtattccttatatgctggtagattcatagttcatatcctgtaccaaacatggagtttcagtttacaaaacaatgatccttgatata

SEQ ID NO: 6019 - DNA, 6673 bp, Oryza sativa
  unsure (1)..(6673): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaggagggaatttagacatctaagcgggcctttaagaggcccgcttgcgaaaatatattttcacgtacggccgcttaagaggttcgtttgtgaaaataactagatgaatctcttaaggggttacatgcgaaaatgcattatctcgcatgcggcccctgaactatttcttggtggagcgattcttcatgcgcaaatagtagtgatatataagcgtccagatggtccgcatggaacctaaaagggttctcgtacagaaaaaacgtttgctatgaatctggataaccgtgtgtccagattcatagctaaaagttgttatattttgggacggatgtagtaatcaatatggacggaaggagtacttcatccgtcccaggatatagcaacctatgattggatgaaacgtatcctaatatgatgaatctggatatagacctatctagatttgtagtaatataatacgtcttattctattatagtttgttatattatggggcgtactcactccaccaaaaaacgaatctagaacggaatgtgacacattttactataatgaatctggacgatcaattgtactggaatttgtaacatctagttttatgttcgtcttttataagatctagttttatattcgtcttttacaagacggagagaatgaggggagtaaaaaaaaaaagcattaacgggtcgggtcttgttccattagaaacaacaattcagcccagtaatcggatggaccggaactcatcccgtgccccgggattttgtcccgtgcgggtacagtcagaaaaagtataaaaacaaccttaaaaaatgtcacttccaaataaaatatttctctcagatgccagacacgccgggctacgagctaggtcctgtccagaaattagtttctttcaacgtccattcgatctaaattattttacccttccctatttttcccccatcatgttcttttctgggagtacatgtcctccatcttatggacattattgtgtttgctgaaactaccgctatcagtagtaccaccatttgatttgattaaggcccacatgtcatattcaatatatacttatcggcccatcgattcgtttattcggggaataagcgaaacgctatatttgcaaatgaaaaatagtttatgattaaaacttttatatacgtgttattagcgatctgaaaacaaaaactgaaaaataaacttcgatgaaaaaccctaaaatcaactctaaatttaaagttgaaaatttaaattttagctaataagtataagcataaacgaaaagatgataccatatgtttgacacgaagtttggtaataaaattgcaaaaaaaggcaaactctgggttttcgtgtccaactttgactgtccgtcttatatgaaatttttttataattcgtattttcattgttgttagatgataaaacatgattaatattttatgcgtgacttgtctttttaaatttttttcataatttttgcaaataagacgaacggtcaaacgttggacacagaaatcagggtttgtctttttttggacggagggagtagtttgtaacaaaataattcattatgtggttcttaccatgttaaatattgttccactagtcaataacactcttgatattcatccaagtttttcacattttgcagttttatgttttggtgactaaatattcgtaaattaagttgaattattagtttagtcaattaatcagataagtattttgcagatcattttttttcataaattagcaccaacttcacacacaaagcatcacacaagaggcaacatgatgcaagtacaaattgctgcatttttttcttttctttaacccaattccccaaacccacccacctccaccctcttggaaagctcacccagtttttttttacccccatagtctcctgtgcacaattatcactcctcttctcctttcacccctcttcacacacaccacggtaaaaaaaaaagaaaagagaaagaacagagtaaaaaaaaggaaagcacagtaaataaaaacaaaggcatccaccacagccccatgtgtgactttagaccaaattaaaccagtggtgctgtgcctgataacccatgagagagggaggggtgtattaggaaaattttaatcaccgtttaagaatcccaaaacttagaaatgggcgctttgcttgcctcccatctctctctcattaacctcttttactttaaacacactcccccatgagatgagcaggcagcagccagcagccagcagcctgcttgcttgcctagctcccaatatcatcaaatttttgcccttcccaaggaatcttacccaagatgctctggattggctacaatgccccagggcttgggtggagaggttgtgaacatgacctagggtttggagggtaaatatggtaactagtgggtatttagggatttgcaaggttgggattagcaataagcggttttaggttattggttgggggggtatgggctgtttgctgtcaatcccaacgggtatccatgggcttttgcttggtccttgggtccattaacccaaaagcccaatgccacttcgttttttctctttcatcctttaaaaagaaactggcgggtttttccacgttcagaattagattttatatacaatcgacatatttttctttttcataaatatgattgtattttctatccaatagattttaaaagtatgattagatttgatatatttctcttagcttatgttccatacctacaactgtgttttatatataatagaattttgaagtggtgttagatttgatacctctgttttaaattgcacgtcgttttaggtttatcctaaatcaaatattttagtctttgaccatcgatttgtataaactcatatagtttaacataatacaatttatattttagatttattataataataattttataatatataattgttgttaaactatacggaggtttaaaaattaattatcaaagatagatgtgtttgacataggaactaataaaacgataagtaatttcaaatggtcagagtacaattcttgccttctgttttaaatatacaattatattatatacaactacatcgattaatctatatcattaaaacatgtagttaccatgtgtaacgatcaaaatatttctctttttcttataatccaagaatttatatcccatacatatatgtgaagttggtccctccttttcgagctatcgttataatatataatagatagattataaagaaattcaattggtgtttaagtatattgttcaatcatgtgcattgcgtgagaatgatcattgtttcttgctgacaataacggcatcttttaagatcatttctccatgttatattaaataataacataattgtcttttaaactcgagagctgtaatccttacttcctacatttaattctatggggggtattttaatgcaatgtggtcttcaaaattactcccactatctaaaataagttattttctagatacaaatctaaacaagtgcgtcaagattggaaataagaaattaacttattttaggacgcgatacgtagaacatactccatccgttacaaaattagttcgttttccagttttccctattccacacatatcaataaagaaaactaacatacccctaatttatcaaatcacaatacaattattcctcactttatatacttctttcatactttcataaacttcgatgtaataattacttaaaaataaatttgttttggaataaattaagtgagcgaaaaataaacttattacaagaagtttaatagtatagccaactaccagctccaaatcatatatagtcaatccaatatctaattcatataatagttatttataaatatatattacaccattaatatttggtatacctctaagatatacaaaacatcttagaatcagtgttgtaactgactacaaatatatagcgtgcttctcttctctctcctttcttatcttctccatatgtttttatagtcggcttgtagtccactattatacttgctcttattaaatggagtagctaatttctcttgcaaatcttcgtcgaatatgcctggacaactaacaaagagtaaaccatccttccaaatatacttatactctctccgtcccaaaaaagcttaccctaagagtggatgtgaccaatgtgtccccttctagtacaatgaatctaaacacattctcttctaaggccgagtttagttccaaactttttcttcaaacttccaacttttccatcacatcaaaactttcctacacacacaaactttcaacttttccatcacatcgttcaaatttcaaccaaactttcaattttgtcgtgaactaaacacaccctaagttgagttttttttggacggagggaatatattgtctagctagtgtgcctaggttcgtactagtggtatgtcgtttatagccattggaggacacatttattactttggaggatatatcaaccgtcctaatttacaatttcgtaggataccactatgcaactccgtactctctctgttccattaagaatctaattttaaagaaaaatttggactactccctccgtcccatcaaaaaccaaccttgtactggatgtgacatatcctattactacggatttagacatattggtgtccagattcattgtaatatgatatgtcacatccagttctagatttgatttttttgggacggagggagtattctttaggattaggttttttttttggacggagagaatactccatactactgccttgggtgcatttacaattttgctagttgatcgaattttgcaaactttgatctttttatatatgatcacaccttacaaaatttggctaaccgaatatctttttagcctacaaacaaatgcagtttgtaatgataattattaaaagcaatctagagaaagcgtgctgcttaattagcagatgcaacccctattttccggggctttctcggctacaatactacccgtaaaaggtgaacgtttttttaagatgaatagagtttagaagacagtattagtaggaccccatgttttctacttttctttcatcaaacaatcgccaataatcactcattcactcgtgatatctaagcaacgtaccccagtttgacctatgctcgctagtgattggccggccatgaatagaatggggaggagtctagtatgaccaaacaagaagcttttctcttctttttattatgcgaaactgaaactttcctcaatgcctaaacagaacaggaaagacattttttttttcgattagggagattatcgtagagacgctgacttgtgggccctactgttggagaatggacaagggagtgcggctaacccccagtcacatggcacggctgacggctctcctaggtttgctcgagtaagattttatcccggatacaatcccccaatgccttttgtcagtggtgcggttttcacatgcttgtcgagttgtcgtgatgatctcactattctttcgtgtaaactacaattacaaggtctatatcatatttacgggataattctctccgatatatgtaattcattattgctagttttaggaaaggtttagtaagaagaaaggaaaaaaaatgagaatgaactagaggtatctttgatacctcttcaagcctaagtgtttatattgaaacaagatgaacatttcaaacatgcgggaaacgatacgtaggtctatcggcttgtctaggttaatagggccatccatgagacctattgagtttctgtaagacaagaagttccgtcataagcacctatcgaccttgccatatgttaacaaggctctcaataggcaccgcggatgcaagcgggccaacccgcggggtaacccgtagattgactcacgggttacctactaattcaacctgtaaatgagtttatgggtcgacccgcttgcatctctaggtgcggtaaatagggccacgacgcgaaaacccatgggttaccacttatttgacatataagaagctagatttgtaagtcagtccgtttgcatccccgcagtgatcatcctgtcgtagattggcacggctcgtcacatcattactagctagatgctctgaaatcatgcttcgttatgatggtttatcgttattgttacgatgcattgttatgaagaaaaatataagataattttgggagaatttttaaacagaagtctccattatccatctcataaatcttctcgatggtatttctcctacatacacca

SEQ ID NO: 6020 - DNA, 1195 bp, Oryza sativa
tgcttatatacataggctacccattgtgtatcaagctacagtctttttatccgtagtcaataacttgcacctttatggacttttgtctttacaaaacatattcgatgacctaaaaaacttttgtcttcacaaaacctaaggatactttaagcattacgaaaacctgaaattttgtgtaatcctcattccaagatgtatcttgtgctatattttctcataacatgaataccgcattctcccaaaaataccaaccgtggtcatattgctcgagggaaactccgtgatcaccacattttattctagcgagcatgtgacttctaaatgataaaatccactcttcgttatgaacatgaaaaaaaccctctcaactgcatgcatatcctttttcctgaatttttattacctttaaactctttttattcaaattttaaaaaaaatcgcaactgctaaggaaaaacactggcagtaaaaaaaaaaccacaaccttcatctgaagtttttcatcctcattttgctgacgcctttataaatccatccaaaccacactcacgagggtggcttggcttacttgttctcgcaagaaaagaaaagaaaactcacacagtggcagtaaaagtccaagcagcaagtgaccaagaccccaactattaaacaacaagtgaacactaaacacactcatcccatcagcagcagtagcaaattagcaatagccccccgacctagcttgagacgacctctcatatcataagttcataggctccattaaatatactcctcctccaacccccgagacgcgcagataagaccaaatcgaccgaggttttaaccctaatcaaccggggttttagccaaaaacacattaataccactactaccggagagtgagcgagtgtgtagcagcggcgacagtagcagcagcaacgcctccgctcgctcgatcgatcgatcgatccatctcctcgtctagctccatatgcgagctggggtgcggcttaagcaactccagctcaaagtaatcttctcactagcaagcaagctctctctcatgtcgtgaggtgtagattaggggggagatttgttcttcttttttggtctggttttttttgtggtttcttgatcgttttggggggtaatggcgcaccggggcgaccggttcttggtggtggtggtggtggtggtggtgttgggggtggtg

SEQ ID NO: 6021 - DNA, 11905 bp, Oryza sativa
ccggagattggcgcgctctcgagcctgagcattagccttgacctcagctcgaacaggttcaccggcgagctgccggatgagatgtccagcttgacgcagctgcagtcgctcgacctctccagcaatggcttgtatggcagcatctcagtgttgagtgggctcaccagcttgacatctctcaacatttcgtacaacaatttctccggcgcgatcccggtgacaccgttcttcaagacattgtcatcgagctcctacatcaacaatcccaacctctgcgagtcctacgacgggcacacttgtgcatcagacatggttcgcaggacggcactgaagaccgtcaagaccgtgatccttgtctgtgctgttctgggctcaatcactctgttgcttgttgtggtctggatcctgatcaacagaagcagaacactcgcgggcaagaaggcgatgagcatgtcggttgcgggtggcgatgacttctcgcacccgtggacgttcacgccgttccagaagctgaacttctgcgtcgataacatcttggagtgcctgagagatgagaatgtgatcggcaaaggttgctcaggtgttgtgtacagagctgagatgccgaatggggagatcatcgccgtgaagaagctgtggaagacatcgaaggaggagccaatcgacgcgttcgctgctgagattcagatattggggcacatcaggcaccggaacatcgtcaagctgcttggttactgctcaaacaagtatgttaagctcttgctctacaactacatccccaatggcaatctgcaacagctcctgaaggataacaggagcctggactgggatacccggtacaagatcgccgtcggcgcagcacaagggctggcctatctgcaccatgattgcgtcccggcgatactccaccgcgatgtcaagtgcaataatatactgcttgatacgaagtatgaggcatacttggctgactttgggctggccaagctgatgaactcccccaactatcatcatgctatgtcacgcatcgccggttcttatggatacattgctccaggcaagtgattcctacttcaagtatttatctgcatgctattttttcttcaaaatctagaaatatagtagtagtagaatgtagtgtacaagaccagcaacagttaatgccataggttaatgactctttgggtaatgctgttatctaagaaagaatctttgacctgcagttgcttctagtaatcttaaccttgctctgattccatgaccatgaccatgaccatgactagttgattgcttgtagcttaagcaggtgaaaccgatcagtctggctatctattaactgccattgcacaagtttctgaaatcacaagcatcaatgtccattgaagcttgttgacttatatactgtttgttgaaatgcctggcccaagattatgttgatatgcttaaaacatccaagaaatttatcctgacatacatttcctcattttcagagtatggctacaccacgaagatcaccgagaagagcgacgtgtacagctacggggtggtgctcctggagatcctgagcgggcggagcgcggtggaggcggtggtgggcgactccctccacatcgtggagtgggcgaagaagaagatggggagctacgagccagcggtgaacatcctggacccgaagctgcgcggcatgccggaccagctggtccaggagatgctgcagacgctggggatcgccatcttctgcgtgaacccggcgcccgcggagcggcccaccatgaaggaggtggtggccttcctcaaggaggtgaagtgctctcccgaggagtgggggaagatctcccagcagccgctcatcaagcccgggagccagcaaggttgacatgaacatcaagaacatggaacatgaacattgctgctggtgtagcagttgattcagtggctcagcaaggggttcaaggagtaggattttgataagatgcagcctagcttagcttgggttaggggggtggaaaaaaaatttcttgtacagctccaaatggcgttgcgttgcagctcattttggtgaactttgaatggggaaaaattccgcggttattttgtttgctcctgcaatacatcacaaaatctcaaatctatcttgggtatgatgaatatgatgcgaagaattaacatcagaatctgatcgcttcagctgaacagttgcctacagagtacaatacagattgctgtgagcctgtgactgtgagaagaacagttgcaacagtagctggaaggcggatagaggtggaaagtagagagagtacagacaaggcccatcgcccatgcatgacccggtgctccctcgacgccggcatctacggatcgagccggaagcggagacgcgtcaaacactcgccgttggctgggctgggcccctctcgtcgagcgcggttggtggcttggcatggccatactgctgtcattcgaccagtcactcgccgaattgctaggcgctgtagcggccgaagaggcgcgtgttgcatctgatctgcgggtggcggcggccacggtaagctggagttgcgtgggttggttacttggtaggttgttgactaatgggccgtatgggcctaaggccaactgtgttatgggctgtaccaagggacttgaatgggaaaagtataccggaggtccctgaacttgtcaccgagattaaaaaacgtccttgaaacgcaataccagacaccggcggtccccccaactatacaaaaccggtcacccaacgtccctcggtggttttgaccccggttttgatctacgtggcggctgagtcagcgtgggacccacgtgggccccacatgtcaggtgtccacaagaccaagtcaaattagccacgtagacgccacgtcagccaaaaccgttgtccgaaccgccgagggacctgatctgcactagttttgacagttgagggacccgttgtatctggttttgcggttaaaggatgaaaatcggatttgttgacaagttaagataccttagatgaatttattccatttacagcaccgctgacggcccctgtcgatattgagagcggccacgggctgggaagtaaggcggcaacaaatttgcattcaagcaacagttgactagtggagcaactatttttttccacgcacacacacatacttccccatccaaaagaaaacttaattacccagacgagttcaggaacagatatctatctctaattcatatataataaatataataaggtgattaaagtattaaaaaaatacatcaacagaaaaaatatacagtattacatgtgagctcgtaaaagaatgattaaccaatctttttatcatgtttgtagatggctttataatatattttcatacataatttatagattggttatatagtatcgaatgttaacgtttttggtttttatagcacttaaaggtactggttcactttaatagcacctaaagtttagcccatttcaatttttaacactttcctcaaatctcgattgtttttcatccgccttaaaaactacaatgatgcatttcgtttttaacctctctaatgacttatatcttttaaatagcatattattcttaaaaataatatgttatttaaaaacgagatcaatgttgaatatatataaaatattttattaatttaaaagtaatttataagcaacttagctatgtaatggaagtaactctctatagcatgaaaagtaattacgttataactgagttgaaataagaaattatgttgagtaaattcacaagcaaagtgtagagaagattttcaagtaaatatatttatgaaattaaattcaataaagcctaaaagtaattacataaatcataaaagtaacttagcataaaatagaagtaaattattacaacattagaattaaattcgttgtagggagaaaaatatggtctatctaaaaattaaatttaaagtccataaattatagaattgactaaaaacaataataaaaataatcaacacagagcattatgaatgtataaaaagtaatttagttaaatctaaaagcaatttatatatatgataaaagtaacttacgtatataataaaaacaatttacaaatataaatatttttttcatcgtaatataatcatgtaagatcttgttgtaaagattttaattgcaatgaacacgatggtgtaatcggattgtagatcggataagtaattcgagagaaaactttataaggggaaaaagacatgcatgtgtgcgtagtatacttctccactgctcgcacgatcgaacagctatgacacaacgtgcgcgatcgaatgaatctaagcagtgtcacgcgataagacaataacgagaggtttcgccaattagtttttgcgtaatatgattgatacacagactagagatcgatagaggagagaaaccaccgcttgtaaaaatcaagacccgtttaaaaaatggtataattcatagagcactgctgcacgtactaaatttttcttactttactaacaatcgtcaaattgtttgatttaggtagatagaagttaaaaaaacaaatctagatacactcatagcataaacatcagtgttattagcatacaagaatctagtaagaaaaagttagtccttatagccttttcctagttcaaaataacaccaatctataaagcagaacagcgtgtttcggagagaaaacaacacatggtttgtaaattatacgctcgtctgtaggggtgaaaacagggtaggtatttcccgcccacacgtccggccacattatttcgtgacaaattcgggtacgggacttttcacggatatcgggtccaaatacgggtccttttttatggatacgagatcgggttcggtaacatagtatctgacgaatacggattattcggtaaaaaattctggtatttcccggatattacccatattatgtttttgtgaagcacctttttgtactatgtattggttctactatgatgtattataccatgtttatttcctaaggtcctaatggcctaatataatcgtattacggatatatggaattgttaaatggttattgtctactccttccatcccaaaatataagcaattttatcaatgaatctggataaccatatgtccagatttatagacgaaagttgttatattttaggacggagatagtacgtgatatataagattgttggttcgacttgatatccgaataaatatccgtaaccgatagtgtacgtatccgttttggtacttattcgttccgtatttttgtcggacattatctgagtttgaatccgtattcgacactatccgtttccgacccgattccgattataaaatatggattaggatataggaggagtgagatctgaccgaacccgacccattttcaccccctactcgtctgagtcgtctcatcttgaaatctctaaaacgactccggcaaacaaacgagagcggaacacgaaataactgcaccccgcctccgcaccgcaccgcacccgaacccgtcccccgaaccatgcaatgcatgcgcccggttagccggaaaaaaaaaaaaaagaaaagaaacaaccggagtcctagtgtctcactgatacctgggccccacctgcctccgtacgcggtcgtaccggactaccgactctgacactgagccgtgggcccacctaccactccgccgccgatatatataaaccggcggcgagggctctgcaatccccagaaaaatccccacccggggtgaaaaaaaaaataaaggaaaaaaaaaacggagagaagagcgtcgtaacggaagaagtcggcgacgcgtcggcccaaaccctagacccgccgccaccgccgatccgcggttccttcgcaatggcgatccccacgccttcgccatcggtcgtagatcagccgtcccctcccgcgcctgcttccgccgccgcggcggcgtctcagccgctagccggcgatccggctcccgaggcggcggcggcggcggagggggcggggggtgatcagacggccccggcggccgccgccgccaccggcgcgtcgctgtacgtgggagacctggaggcgagcgtcggggaggaccagctcgtggcgctcttctcccaggtggcgcccgtcgcgtccgcctatgtgtgccgcgacatcgccggcggcagaaagtccttgggatacggctacgtcaacttcatgtcgcgtgaagacggttagttttttcctcctcttccttttacttctcattttgtcgggtgatcggcttcgattcgatcgtgggttcagaattctgatggtctgggtgtagtgatcggccttaacttgaagatttatttttcctgatgataaaagctttcggttaatttacgtgatcacttcgtatgggcacgggtcgatcaactgttcattatggaggtttatcgctttgtttagcttacggaggcctatctctttggttattattactagtttgtgtgtagtcgatctgctatatattgtacctattaattatctgtgtgcgagatgctgtaaattttgtttgtttaaattagttcgtttggagtagcatatacttattactgttgttatgataatattgtaagtttaattaatctgttatatttattttaattttttaatggggtgatcacttttgagtgtagggctgttggcaacgatgtattatatagtggagtacaatggttccatgttaattgtgagcattggattttttttttatgaaactatgtgttgtgataccttaatttgaatagaagggaaattctattttgtttagttttatactatgcatctttgtttgttttcgttgtattttgtatttcgagagtttgacacccgctaatatcaacttattaatttattatcaactctttaatttagtttgattgattgcagctacccgtgccatggaaaatctaaacttcaccgttgtcaatgggaagccaatcagagtcatgttttcgaatagggatccaactctgcgaaaaagtggacttgccaatgtgtttataaaaaatcttgaaccgaatattgacaacaagagtttgtatgaaatgttttcgtcttttggcacaatcctctccagtaaggttgccacagatttcaatggaaagtctaagggttatggatttatacaatttgagagcgagtcgtctgctaaggatgctatcaatggcctaaatggcatgttggctaatggacaaaaaatatttgttggattgttcatccgccggcaggagagagaacacactggagacgctaacaactttactaatgtatatgtgaaaaatttaccaaaacattttagtgataacgatttgctaaatgagttttcatcatttggtgcaattactagtgctattgtcatgagagatgcaaatggattgtcgagatgctttgggtttgtaaactttgagaaatcagaatgtgctagaaatgcagttaaaaatctcaatgggaagtccattggtgatatggtgttatatgttgcaagggctcagaaaaaatcagaaagacaagctgagttaaaagcgaaatttgagcatgacaaaaatcagaaatttgagaagcttcaaacagtcaatctatacttgaagaatttggatgatgacatcaatgatgagcatcttaggaagttgtttgaatgttttggtgaggtagcatcatgcaaggtatgttctctatttgttttactttgtttgatgttatgcttactgttagtgagttgtcatttgttttacgcttccatatataatgccaagttacaattgttgtaggtcatgcttgattcgcatggaaggagcaagggttgtggatttgtatcttttgcaactgttgaagacgctaacaatgctgtatgttaaaaaatgattcttttgtgctatcctcatactcccaattccatagttctaaatatttttcagtattatgcaattaatatttttaaaaatattatagattttaaaaatgaacgggaaaatggttgggaaaaagccattatatgttgccgtagctcaacggaaggaggagagaaaggcatttttagcggtatgtactaactctattacatttgaatttgatttttagggtaggttttgtacatcttgttatcttttcttgtgagttttgtaattcatgaaaaaaaaaactgaaagtacattttgtttcttaacattgacacttgatactaagtgtgctatgctaacattgaacttttccatgttacaaaggtcgtttgttaagcttgatattcatatcttctttgtttgccaggcacattttgctcgtgttagagccctagcaacaatggcacctacattagggccaaacattgctccccatcagttcaattttggccatggtgtgcctgccttgttcccaccaccaccacctgcaggctttgggttccaaccaaattttgttccaaacatgatgatgccatataacatgcaaaggcagcctggccagaggagtggtcctccgcatggaggaatgcctagacatctgcataatcctcaccaggtattcctgttggctaaatcattgtcatattttttttcttttttaacacaatagatccagcatctaattgtatccaattatcatatctacttatttttgctaatgttgtcaattactcgcaacttcagctactcccccgtttaaaattacttatcattctaggtgtctcttagtcaaacatgtttattttttaccattaatttttaaaaaacagtgtactttgacaagtaaattatatattatgaaggtattgaatctaaatccatgaatatcatgatgtcaaactacatgagtttagaaaaaatgattgtcaaaaactaaaatgtttgacttagaataagtctagaaagagaagtactaatttaaaatggagggagcaattaataattaactaggattcacttcacttaacatcgttgcttgttactttgtagatgtttcaccaaaatgccaaccagggcttcagacacatgccaaatcgtaggaatggtgtggccaacccagcaatgttgcatcagcaccatcgcttctctagcccaatgcagccaatgcaacaagctgtcaagcatgtggtgcccgtgggggaattgcaagctccaagcaataaccttcagacttccttggcttctgcgaacccggaacaacaacgagaggtatggatgtttatgctctgctttccgtacatgcttgaacaatttcacagattataaactatatactggtcatcaacatgtggaacagcattgcgaaataattcttatggtcaaacttcaatttttgaaaaacttatctaagtcaaatcagccatgttgtgaaacattgaatagatctggagcacgttttgttttacgttttgatgcatgttctcttacgcaattattgttacaaaagcatatgtagcgaatccgtttttcagtttagtcttttattgatgtatacagttagaaatccttgctatgaggatttttttctcaccttaaaattatactaaatttcacttctcgactatgtacagaccaagcttgattcttgccaatgtaggctatacaattattgataatgtggcaatttctagactacaatgattccttttacatcccagaactaacgtggtggtttaaagagagcattcaattagtataaaccatgacttgttatgaggttaacaaaagttttggtacacgacaaatcactattttgaattgttattaccttgctctgatttctattatagtcatgaaattcttgctctctgtaaaatccttctgagttgagatggttggacatagcatttttgttctcttattgacagttagactacaacttcaccaatgtttaatttttcccatttctgatgtacagattcttggcgacatgttgttcccgctcgtcgaacagctggtgaacgagaaagcttataaggtgactgggatgctgcttgagctggacaagactgaagttctgaacctcgtagagtctccagatactctccgggacaaggttgctgaggccatgaaggtgctggagttggaggctaccgccaccgccgccgccgccgccgccgcttcaggctccggcgacggcgacgccgccgcgccgtcctcctccagcgccgcctgagcggtgttggtggccggatgaattatcataataagatgaacttttgaagtcgtgtgttttggacttgggaactgtttagatgaatttcagtttatgactttaacaacttggggttgcagaatatttggagtatgggtaatggttgtgtactctttatgtttattttttttctttttcatgtgaaggtacactgtgtgtggatggttaattaggattttttgttgaaatggatccttatttcagactcaaaagttcggttcttttaaatgttttgctagttgttatttctcaaatatggtaatttgtgatgaaacataggtaattaggtactagtactgttttgtatgcaaaaccctgaaacttatgtgggttcctgtggaattcatgtctcctctttcgtttggtggagatgtaaatgctgtccccagatcaccataagtaatattggtccaataattttggtcttaattgctctagctggaatgttacaactttgagcaacaagaggaaaaaaacaagagaacttctatacacaaggaaaaggacgaacacacacacacctctcccacagcaaaatcgcaggaaaaggaacgaaacagcacaacaaactcacccttttacagcaaaatcgcaaccaatctgaaagtgaaattgcatctttttgcttgacccggagaagtgaaattgcccctcttttttgtgcttactcatccctgtgatctggtgctcaggctcaggctctcgctgcttgcccaaccgtcctgcacctgcatggagtactgcaggttccagaggacgtcctcaatggagggccggctgcttgtgtcactggcaatgcaattgagtgctatctcggccaccgtgctcagcgactcgacggcgaacgttccgcggatcgtcgggtccgccatgtctttcaataaatctgggtcttcagctatagcttcacttatctggttttgaggagtagtaaaaaggttaggtatttgctggtgtgaggtgtttttcactctgatgtgaaaccattctcaatttacctgagttttcagggagtccaggtcttttggggactctgttggcttgcctgtgattacttccagaagaattaggccgaactggtaaatgtcatccttgtccccttgttctgtgcttggcacgctacgagaagaaacaatcataatcattttagttcacaagttgagaaaattaatcagattgtcattcattctgaaaggtaggtcaggtggcatctctgagtttcaacaaccaatcatttaggttcagaaaaactgtcaactgttatagtttagcaagtgggagtgttattttccatctaaaaggacaccgtacctgccgagatcattgtcttcagatgtggcaaagggggattctgagaatatctgaaagataaacatggttacaacttagctatcaggttagcaagttaggagcttccccaataatttaaaattcgaacttaccttgccattcttgctagttgatatcaacgggaggttaaagttgctgattttggaagtgagtgtcttgtccagaagaatattttcgatgcttagatcattgtgtacaatgcccggagcagtcacatcatgcaaaaactggatccctctggcgacaccaatggcagcagaaacacgttggggccattttagcatctcacgcttcctccactctgcaccagccagtaaaaggataaattcacatacttgaagatatctagttatagtgcgg

SEQ ID NO: 6022 - DNA, 15356 bp, Oryza sativa
tattgatcctaaggacaatgcctcaaattaacatactttcaaatacttatcttaattaggacgttaaaagtaatcaaggcatcaaggttcttagttgcaggttaagtccaataaaaatgtattcttttatatatatttttacgagagtattcttttatattcacccagagccttttattcatcaaatttataaagtgtgacagaaaaaaatacaaaagatattgtagtccaaagtgtactctagtccattatgacttgagatgcagaggtctgcaatggattatttggaaagatggagatggatttctaaaatttacatttgagtttgctagcaggtacacatgctcaaaatatactccacacgaaaataaaggaagaaaaatgtgcatggcacatagcaatcttcttttgaaaattgaaatgcatattattcttcaaatggttaatatgagtggagtatcatttgtatgtgcatttattgctttgatttttcgcttgaagctcaaaatgacttcacttctgcataccttaacaacaggagaactcttgatcaagttggatgaaccaaagttgttggttgcttcttggagctcctcaagtgtatacacacggtaggctggtacttctagtgtattcacccttgcagcttgtgatgcatgccctatgacaatggacatcatgttacccaaccaaaaaagaataaaaatgatcatcctgcaaattgtttagtggtcactaaagccattgatcctagttgttttttcccccctttttctagtttgatgattgactttgctgcttttactttctcaaagtcttctttgaagcaaggaataaagatccagcccatgcttcagaactcatagtctaagcaagatccacactagctagctcacgcaaagcttcctaattatacttcacatttcactaaagtgagtagcctttattcacaccagaaacaatgcaatacaaaactaatcgtaattgcttctaattagtactagcacttcacttctttgtgttgcccctttctctatcactaatcatatatacctttcaatgaagcccatgcataatcttgtgtccccttttcataattaattcaactaagactaagtgcattgtaccaaattgaagtgcagaaaaacaaaataaaaacaaattaagcaaagcaaatgcatttctcctcttactcttttcagcaggagtaacaatcctctgtgtcaccttggccggcgccttgccgccgtccgccgccgccttcttcttcgccgccggcgtcgacgccagcggcgacttgggcaagacgctcacctccggattctgcctcctcgccctcctcagcacggccatcatcaccagcgcgatcagcgccgcgccggccacgacgccgccgacgatgccaagggccatccccacctggccgcccttcccgcccgacccctgctcgccgccggtcccctgcgccggcggcagcacggcggccagcgcgccggggttgcagtacgtgctcggccgctgcgacctggcgtcgcggaagcagttgcccgcgtcgagcaccgtgcgcgccgacgagttgccgcgcatgcacgccgggcgcgccccggcgagcaggttgtccgagacgtcgacgaacgccagcgcgtcggcgcacgccgtgctcgccggcagctgcccggcgagctggttgcgcgacaggtcgatgtgccgcagcgccgggagcgcgaagatggaggaagggatccacccctgcaggcggttgccggacacgtccaagaactggagctggcccagcgagctcatcgccgccggaatcctgccggtgaagttgttgtcggcgaggaccagccgcaccaccgcgttccccacctccgggaacgccgggccgagcctgttgtgtccgaggtcgagctcgtcgaggaacgcgagcccggagaggttgggcacggcgccattgagcctgttccgcgacagcacgaggctctgcagcgagtacatccgcgagaagtgctcggggacggcgccgtagaggcagttgccggtgaggttgagcacccgcagcgcctggaggcggtggagcttggcgcccgggagctcgccccagacgccgagcgacgcgagcgtgaggcgcgacagcgccgggagccgggtgagcgtggtgaagagcgcgtcggcggagaagttggccggcagcgcggcgccgggcgcgcggccgccgagcacggagagctcggtgacctgcccgcccgcgcacgccacggtgagcgacggcgttggcggcagcgcgcacgcgtcgggtgcccccgccagcgcgtcgagcgccggggggaaacccagcaggcggcgcacccagagcagcgtcttcgcctgcgacgacaccagcggctgcgcggccaccagcgtggagacgtcgacgcagaggacgacgacgacgaggacgaacaccacaccgacgcgctcgccgcgcgacgaacgggaagccatttccgccgcgacgtcggcgattaactcagcaatcgaaagcttgcagctccgttcagcaatggcgaatcaagggagagcgtgcgcttagttggccattggtgggaggaggaagaaaggcgagaggcaagtggtggccatggccatggacgacgcgcgagcgagtgcttgccagccaaactagtactactactactactccactgccgactctgctagcgtagcacacactgtgcgtcactgtcccctcccgcgatctggaccagatattgccatgacacgtaggccccaccccaggtgggccggccatgtcagtgtccccgtactggtcaatggaggctggtttcgctgacgggtggggccggaggtccgacgtgtccgggttctgcacgccaggtgtgactgaaaactgggtgcgtgtggggccagggcagggcgcgcaggccggagttaactgccctggagcgcagtagggggtggttggggtcggagaggtggtgcactctgcactggtgcatggcatgtgcgaggcgtgcgtgagcgtcgtggtgcgacggcgacgtatgcggttaagcggtgcgcgccagggcccaggtgcatcgcggaacccttttttttttctatttttaaatttttaattttaaaaataaacctacgccaatttggccaatgttagcaagaaaaattgatttctttcgcttcacaatactaaataattcgcttagcagtcagcacacaaatatttaattccatttgttcagtttgttttcctcttctttgtaagggttatttacaagatctgaatgttttcctcttctttgtaagagttatttacaagatctgaactttttaaccacgctagcccacactaatctaccgcatcggttcagctgacacgtcaccatgcttgacgtggcaggacaaggatatcacattaagagtgttgctatacgtccgactccctcgtccgacccccatctgacccaaccttaactgccaatcggtccgctccacgcagaccaacatatctctatgtgggctagtgcaattagcagttaagtgttggtcggacatgagttgtacgtaccggtcgtatgtatagcgattttcatcacattaaatacaggtgatgtttactgtgctaaatggattggcgtgctcagaagatttaaatttagaaaataagtttttagaatggtttgttttaaataaaaaataaaaaggttttaaaaaataaaagaaaattgttgcggaagatcacgtctactaatgccctctccaccttccttagattaatattttcttctctttcgcttttcttagccaacaaacaaaatcctacctccgtaacaaatacccaatatacacagatatcaagtcgagtcgcgaattgagcgtagcttagctggttaggtttcttctggtggagctagcccacacgtcgatagcgatatgtcggcctattcttgcaaagatgtttatagggatagagtgtgcgcgtgtacgtttataggggttagtaaaaaaaatatcaaagtcgagttagacaactatagggtgtgcgtgtgtgcgtccataggggtgagtaaaataagatatcaattcaagtacgtgtgattataggggtgagtaaaaaaaatatcaaatcgagtgtgtgcgtttatgaggatgagtcaaataaaacaaaatatcaagtcgagtcagacaaatacatgtcgttctaacgacgtccatcgcaagtattataatctctcatattttactacggtgatagtaatattttgtttgtcacttgtcccgtatctaatctggttcaatccgcgtgaattttttccacacgtcgaatgggatgttttttattttttctaacagtagtcaattggacgaaactgaaaaaatgggccaggttccccgatcgtggcatgatggagaaggacgctagtaataagtcatcggcttggagtgtacctaacttggatgctacgagtcaatcgagtggctttgggctttcaactttgaacaccatcatgtactacgtttcccacgaaaaaagttaggcgagtgcgcccgtcgttgcacgccgcatgcgcaatgctggggtcgtcaaaccagttgcgccgcttccgtcattttttcaggccttgggcttgttactgtccacgttcatttttactttctttctctcgaaataacttcaattttcacatacctcatacataaacagtcccatcttttcgcttatgcttatacttattagttaaaatttaaattttcaaccttaaatttaaagctgattttgagtttttttatcgaattttttttcaacatttgctttttaagtcgctaagaacatgcatataaaagttttattcacaaattacttctcgtttgcaaatatgccatttttcttattccacaaataagccaaacaatagggccgaaaatataccaatacaacacaaaacaaaaaaaaatatctactttataaaatctcaatgtaattatttttcactttatctacttccaatatatccatcccctattttcacaaattctaatgcaatgattactaaaagtaaatttattttgggataaataggaaaggcaaagataaactcattagagcacccgcaatagtaaagtaaggtgttctttataaaacatgtacatctcagcaataggctagattaatagtaaaccacctcaatagtatgtttacatgggtatctataactctctcatgcattgcctcgtttttctctatagactatccctaagttagtgatagctttgctctctctcttcatttaatatcttccatgtaggaaaatatactgacatggatctcttatagagagcctatagataaccattgtgggtgccctatgagatggaggtctcattgtcttgaaagccagtcatcctcctaccattctcttccgtccgtactatccacatgagtaactaccggatcaaatgttttatctccgaaacgtatcctatgcataccagcattctcatgtacacaccgtgcacgctaacttaaaaatatcatattttattaagaaaagattgtatatattttttgtaatattatatttatgcgtaaagtctcatctccaatcaccttgtagcacattcttaaatttgtggatctggttagttacagtatggacatgctacttaatctaagcacactcttttgaggtcagatgtagcacttgctaaaccggatcaatcaggttaattaagcagcaacatgacacattccgtttggctgtaaagagtgaaagacaagtgaattgaaagttgagtggatttggtgagatgccatcccaagcatgtgtcggttacgcatcgatcgggggatatatggaggaaaatcattagagaaacggacggattaggcttgatccgtttggctgtatctcttgtggaatgctagctagtggtatatactgccaagtgaccaatggtattaatttgtgtacataatttggtgtgaatattacggcctctggtttgaactattacgcaaccctctcgctacacgaaatagtccaaaaaaatcccgtaattttacaaaagtggagacacaagatatgagggtgtggcatcatttctcattcatccattgcattctctagtgtacaatcctcctccctactcctctatttatagacattccctcttccaccttccatgtttaatgttgggcccaattagtgggtaaccgggctgggccttcgtgggccggcggtttcctaacatgaactattcatatgcatcacccactgatttttttttccttggaaatgaagatgcacagttttattttaccaggacaaagttgtacaattccagccttgcttgttaaccaatttgtattgaatttgttctgcattaaattagcgggcaagcgtaaaaatgctctttctgaagtgtacttcacaatttcattgttggagcttcttttaagggaatggaatcaaattcattatggtactttgtgactacagttgaaattacatgtgaaagtagtcgttaccaaatgtactttgactaattactaaaagaactattgaaattaagattgagcggctgcaaacataccaatgaacatgcccctgcagtttcaggccgtactggttgcaattttaaaatgctcgatcgctgtgcgttgaagaatcaaagagtatcagaaacaaccaatccctatttaataccatcattatttattttttgaactaacactagtactcctgattgtttaatactgtacgcctgcacggtgtttggacccgtgaatctctgccttaaaaaacttctgaacccaagcataaagaacagctgactctgcctcaaccattactgctaatcagcttgataaatgcgctacaggaactttgtggtatggtgttttggactgttggtgtgtagtaatatgatcgagtctgtttggttgccattgccaatttgccatgaaggagctgattgactacacgaccatgaatgatgatgggttgtttcgttcgtgtacagcgctagcaacatatcagccgctaataacactattttcaggcaagttaagtatcaaaaggtgtggctaactggtcatgcatgtaaaacttttatccgttagggtttaaaaccgatgtctataactattacacaaatacaaataggctctcaaatttagtaaaactattgatttccccatagtcgtctctctagggatgtgtgacccgtgcgatcacaaatagccttagaattcttatggcctttaacataggctgtgtatgcaggggcggaggtagagtatgggacgggggtgtccaggaacccgatcaataaagttttttaagctaaacctcacatcttttcatcatgtgtgcacgcccatctcaatacaaaattaggcacctgcattagcttaaacttgatctaaagtagagtaaattaagcaaatggccaccctcctctatttcgtttagctccatccttgtatgtatgatcgaaattactatttagcatagttgtgttactagcgtgtactaaatttgttttagttttcataaacgtgcatatgtatgttccgttaataaaatcaagggttaattttctgttcaacaaacagtgtcatatctaataacaacaaaaaaaaaacacaaagtcaacgcattgtttttcagtattcatccgcaccatccatcattaaaatccattcatactaatggacccacgtgtcatactcctacacctctatcggtccatacccaattctccactcgagagtgcctgaggttcttatgggttgcttatgatttattataactcgtaacgtaacggtttactagcgattaaaaaaataatccatgggtaaaacttttacatatgtccttagcgacttaaaaaccaaaactgaaaaaaaaatcaattgacttagcgattttaaaagtcaaaactgaaaaaaaatactatgttgaacaaacatgaaaatcaattttaaaatttaaattttatctttgactccgagatcggggagatcgaccatcactcatggaatcgtggtccggctcaatcatcaaggcccaaaagctggagcatcttttggtgcgtgtgtcggtgctgacgtggaccgttcccttcttcggatactcgtgccgtggggcccgcatccacagtgacacggaaacatccctgactttgtgaagtttacagttatgccacttgacatgtgggccccactttggtatggcccacatatcagtggcacaactgcaaaatgcataaagtcaggggatcctcgttccagtgacacgcgcatgcatctgtagatcgatcgagatgagcatcatcaatcgtcgtggtcatggctttagctggtagggcgactggaaattcggggggatcatgtattcatgtggatgtgtacactttcttctcgtctcatgggttcaaggcttcaagtaatggtgatgttgatgtggcatgtgagtcatcctatcacatttgcttgctactatgataatgctggttttttttttttttgtctctatgatgcctatctgtacactgagctgtggtttacccatgggtaatttggactgatatctgtacattacgagtggtactaggctatgctagagaggtaacggagtactccctttatccgaatatataagtacacctaatacagaatgtgaattcatagtctaaaatatatcacatcatgtgctagatgtatttatattgagatggagggagcacgtggttcttaggtttacctgactcagattggtcggtcatctgcaactgagcaaaggccctgtttaattccaaaaaaaaaaaaatcacattgtcctatcgaatattcggacacatgcatggaatattaaatgtagaaaaaaatcaattacacagattgcatgtaaattacgagacgaatcttttaagcctaactataccatgatttgacaatgtggtgctacaataaatattttctaatgacagattaattaggcttaataaattcgtctcgcagtttccagacggttttgttattagactccgtttaatacattaacttcaaatgtatgtccgtatatttgatgtgacaactaaacctaaaaatattccccaactaaacaaggccaaattaccatggcaatgtgcatgctagtgattctcaggatccaggtgaagaatagttaaaggacagacttgaggataaccgggcaatgtggcatgtcattttccaggcttgaagcgatcggcaaaagctcccaggccagtgccatcaattggttcccccatcatgcagtgcagtactaatacgtctgccttcatgcactgcgcctgcaacatcagcatggtgggctccaagcactgacggatgcacaatctgcagctatgctgttctgcactagtgcagctgtgcagaagcagggacaaagacaaactatgaacaaaccaacggatgaatgaacaaatcacaaatgaacatactactaatctcgtttcagaaataaatgaacaaacactcttcaaggaaagataataatgaacaaataaatagagggggaaagaacaaaaagaagcagtgaagaacaccagaattccagagaaaagggtgcaggaacctaacccgttcctttcccttaatggctttttgccactgtctgaagtgatgttcttgctcctgcacctaacttgtttgttttcttgctcaacgttgcgttgttgcatctgttttttgcgcgaccaccaattatgagcaatgtcattttgtgcagcagcgaaggtacatactcccctgtctttgcctgtcttgcgcaattgtcagaatcttatacaacctgtattagtagcttctatagcggtacgcttaaaacacgtcactagtgccagctccacgctttatttagattattgagtgaattattaccgtaaattatctgcttgacagaattaacgaaagggcatgtagcctagtggttacagtgacctgagtagtacccaaggtcctgagttcaaatctcctatggagccaatttcagattgggttgtttgtggggctaagtttcctatttcaatggccgtatatatccggttggatatagaggccgggtaaaaaatatccttctctataaaaaaaataaactcaataaataacttaaaacaagcggtctaaacaatgcggtagaagaatttttttttgaagtgaattgcatcatggaccaagtattattgtctaatttctatcttggaccaggccatatgcaatattttcactttaggcaagggtttgttaccatctagttgcacattgggccaccattctgtcagtctatctgtttccatctgctagccgactgccaccactactgcactacgcaagcggcaagccgttgcttcttcgggcattcaccaactccggcaatgcatccgagagagagagagctaggaaggaggtacggtcgagtgcgaggctgcgagcacgtgcatcgggccagttcgcgtagagatagcttcagccttcagctgagctcgagttactcggccagagcaggcgaagaacggctggagctcatgtgccgaccaactctaatcttctgttgatcaattttgaggaagccacccatgctcgatggtagctcgattatacaaactgaaaggaaggggatgagtggacagaggccagcaacaatcgtgcggaagccctcacggcaccttggcatcctcacagtggtggcgcacacaccaacagtggcagcaggctgctggagttggagatggtggactggggtggtccaaagtgaaaaaaatggtaaagtcatatggtctaaagtgaaatctttgtattaggggtggtctaagctgaaactctggtaaatttatatggcctaatatgcaattcactcttttttttagagaatatatattccgatgcatagagcaaataatcaggtgaataatctaaaaggagcgggtattgagaaaggaaaaagatgacagcaaacaacgttttttcctatttagaaaccggcacgcccttttgcaaacgaagctcattctgtgtaaacacctttgaagtagtactaaattttcgtgtaggcacttcgttcccacgacagttcaagaagaaaaaaaaagagagagaagatagtatagttttagggcccttttaatcgtaggaatggaaaaacaaaggaataggaaaaaaatagaattttggtaagaattcataagtaaaacagaagattgcaaaatgcatggaaagcacaggaataactgtttgactaaaccgtggaaaaaacacaaaaatcataaatcatattagaaagatcgactcaaaaggaaattttttcaaagaggttaaagttattgttaagtttcctccaaaatctctacaagattatccattccataggatttttcaaaggataggatatgattcaatcatttttcaagtatcttcataggaatttttctacaatattaaaatcttctaaaattcgtatgttttcctgcaaatcaaaagggtccttggcacgttgttatgacaagaaacaaggataagctgtttcttgtactatttctagatatagccggtcctatttctgtgattggaatgatctcacaagtcgcaggtctattctgtagtaggtgcagtgatgttgcaactactactaattgcgatgtagatgggcgtctagccagcatcttttgttgttggaacgcattaatcacttcagaatggtaaatgaaaatgccaacaattacagataaaaactggatgcggcagataaaggaacaaatcgagtcaagcttgcaaagttgcaaaccaagatcccaggcaaaaataaatgttgcttataacctacagtttaaccaaaactgtgcatgtgctctggattctatgacagatccaataatacaagcagacccatgtgcgcatggaacgtgcgcacacatggatagaattcattccctgattgcaatttacatatatgcaatcaactcgataacacacgcaatggaagattataccatgctctgacacacggtcagtatatacgagaagacttcagacaccagcagggaatttctgcccagaagtaggagtatatcaccaaataaagaattcaattatattcagatgcatgactggacaattcagaattgcaaacttaacaaagggataataaagcaaacatccaccctgcaagccatactacacacttaaagacctctttatggttttgataataaggcaagctccagcgatatatgaacaaatgaggggaaaaaacaagcaccacacactctacttcatatccagcgataaaaagatttgaatctgaagtcggtttggttgttctagatttcttgggctatgccaagatccattggcatttcactgtccccctacaagtacaaatgaactgattagcaagacaagaaatataatgagattttccagaaaatgtattgtttatctcaattgctgttacatcattgccacccttaccatattctccttatcttcatttgtcacctccttcaccacatcaactgaaatataaattcaccacaccacgattgacaacaattcagtaattgtggagttataacaggtgtgatatactgataattacaatatctgaaatacatgatggcacttaccaggttcttgctctgtaccaactggcaaagcctcgctgcctccattgcaatcttccttctgccccttgacctgcttcttggctttcttaccagtattcttggtgatggcttcttttgcaggattccggttgtaggagcctctaacctttgcatcaggcttcttctgaatgttgtcttttttagctgcttccttactttgagctgcatcagaattcagcgatcttggcttcagattaccctttggtgacacattggtggcactatgagcagccttgtcagactttttcggctgttctgaagagttcacagtgatctttagcttctcaagatcctccacgatattgtaaacctgaagaatatccttcactggttcctccaactctgttgcaaggccatgccggacaacataagcctttagctcatctctcatacgatccagaggctgtggaaaagcacacttattataatatgatgatcaatgaaagaaactgaactgctcataaatgatcacttgatgctcacctcgcattctgattcaagtgcaagcttaaagaagcccaacgatatagagtgcttggaagcagcctctgcaagcctgatttgtgtcatccaatatgaggttgaggacagagtgctgaacttgcgccttgctgtggacatggaaacttctgatatcggggtatcaaacttcccttgactatcggacctccttgaacgaaccaatgacacaggagtgatagttcctgtaggagttggcctggggctaacacctggcttggtctgtattgagtgcctccgtggaggtttggctgaattatccttcaccgatgaaagatcaagaccacaaacgctcttgctgacatccaaagatggttttggtctgcaaggaataaaactacaaatggtatcaaagacagagctagtatccagcaaattttatagttggcatctaagtaagaggcattaagttgctagtctattttgcttgacatagcaccaaaccatgagatgcttagtttctaagtaatacacatgtgtatgctggcctattgttttcccataagcttgcagaaatattgagataatgcagccttgtgatagctaaacctcttaacctctggaacaaactagttaggactaccaaatcttatctgagatgtaaacacaaagatgatatgacctaacgaccagtattatagaacttaagaaatgaagagcagaccctgcattcaagtcaagatggtttttgtttactttgttttgaattcaaaaatattatgcccatgtccttatgaatacgctgagttttgatgtacttaggagtatttcattatttggactaatcatactccatagatggttcaacaagaagtaatacagaaactctattggttaacctttctaaatcagcttgtttacatgcactttcaatatagagcatcggtctaccagcctcttaacaaacaaaacttgcattacactatggcaagtgggttgacaagtccttagaaagtttttgtgacatttgttcttgttttgcatgttttacttctttgacagtgagtgcaactcacaaatcagatttatgtagtatccaatattgatattagtagtaaagtccttgcttgatattactaaaagtaaagaaccggagtgagctggttggtgcacaacctctgtagatggcaccaacttctttttttttcacatggcaactgatttgcaggtctgcagcatgaacagtatgacataaagtcctataagattcatgtacacagtacactccattcgatactttgttgttcttgcaataaatatgtttcgtttaccaaactattttcagatcaatcagccacttgacaacgtaaatacccatctaattgctagctgtacacgtctgtgctacatattctggaaacaaataaatcatttgcacaacacgttgatgtaggaaacaaagatttcaacgctaatccggagcagcaaaattcagtttcgcagcagatgtggtttaaattagatgagaacttctcgtgataaacgccggcatctaacatgtccttgtaactaaataagcgaaggcaaatcactgaaaattccaaccgacaaaagtatattccacaaaccaacatgccagatttcactcgcatatagaaattgcagcttcgaataggagagacagacctcctcgccacggagccgctcgtcggaggagcatcggcggcgcccttcccccggctcgccgaccggagcgggtacctcagcttcgacgccctcgccgcggaacctgcacgaccaaaaccggcacatcacacccaccgaccaaaccacacgcatctcccgcctaaaccccaatcaatcaaacaaacagaaaaaaaaaaatccaatacccgccgactgatcgccggaagccgtcgccatgagcccgatcgaacccaacgaatcagccgccgccttctcaacctcccaactcctcctcaaccttctcaaaccccaaattcgaaaactgccggcgccgatcgatgcggacgagacgggaaacgagttctgcgttttggaatggctagtgctacacgttgtatataaataaaactcccacgcggggctgggaaaccctacacgcgaggaggagatgtgtctcgccgacgtgcgggcccgggggtggtgccgttggtccgtgggcccac

SEQ ID NO: 6023 - DNA, 16364 bp, Oryza sativa
  unsure (1)..(16364): unsure at all n locations
gggggcgtaaatggcgttgttaaggggccgtgggcctgtttggttagctgttacccggggcccatgtgctctacctagtaatggaggatacagttgtgtatgtggtatacacggnaattttgctgggacagaacgaaaaccgttaggtatgagatcatgatattttgagatatcaggcgatactgcaaggtatcaaatgatttctatcacatatcaggtgatacctgttaggtattaggcgattcatatcacgtattagatgatacttgcgaggtattaggagccgggcaccaaagcatcatcaccggtggtcccaccgtccacgctacatcggagctcgtcgttggcggccgccacgtcggagctcgtcgatgccggctgcgtcctccgtcatccacgccccacgccagagagagccccttccccttctccggcgatgtgctccctgatggcgaggtgaggcgaaatagagaggcgatgtgctcctctctctctctctctccttcctccgccagcaagcccccttctttcttcgttgccacatgccgccgttgcgctgctctgctgccacgcttaagtgctatgggacgaggagcaagacgattccgtcgtgggcactgtgaacggtattccctcatttagcatttccttttaattttgttactgatttttaggatggagtcattggctccatatccatcattgcaaactatacaacttttgaactatacaagatcactcgtataattaaaaaatggagtttgggctcattctctataggaggaatcttgtataaatgaaaaattgtctggtttacaatgatggatatggcgatgacttatattaatactcaagcaacggagatggcgagctcggtgactagcggagcaaaattggcgcgcccatcgacggagcgcgtaccagacagagcaagtgaggcggcgattgcctgacgagtcagtggcggagccacgttcaactcaggtggtgcacaggaacaccacccccctcccctccaaaattcttatgcaagaacactaaaatgtgcagtgatgcattgattttttttttaggctttcaatggtagtgcaccacctctgtttggacgctagctccgcccctgtgacgagctcatacgctggcacacgccaagagcgagttgccgccatagatgatggcgaatcgggacggcggagcccgaacagccggcggcaggccgtcgcaagctcgagcggctggcaaccttggttgcttctgcttcttgcttgtttgaattggattgcttcttactcatgtcctccatagttcttgctctgcttgtgttcgtgaaaaggttctttctcgatagcatctgcttgattgcctcgatgttatcccaaggaaaacgtaaatgaggttggagtaaattgaatttttcctgtgtgttttcccatgaaatcagcagcaaaggaatcttttcttcaaatttcgtacgagtggtttgcgtgatccgaatgataggaaagaaaaaaaaaatctctgtgaacagtattttcctaaaattcctatgaaaaacatgtaatccgaagttgatatagctttagactagcatgtggttgaagcgcaaaccatatcttacctgctgcactgaaaatgttagtatttcctttgttttttaatatacgtcgttgactttttacattatatctgaacgttcattttattaaaaatatttacttattttttcttttgttgtggattgatttattactatagtaacattaagcattatttgaaatttttaagatttgcacaaaagttataacgaaagtcaacaatatcgtatattaaaaaacaaagggagtaataaacaagttcttcacagttgtgctgttgtttcagtagggaaaataaacctactgcatggtgacaagtgcaaggagttaatttaccaccaatttttttgacttcaacacgggaaacccactgcattccacgggtaaaagaaccctgtgcagatctcacctggaccagactcagacgggtcaaggagacgactgtctaccggtgaagtcaaaaggaactgattagttgtattgaagcctactgatgggctactcggttgcttcttgcttcatcacaaagcaaaatcatatccctgccctaatttaatggcagcatgatcgcagctaatctggagcacgtagtaataataataatacttagtgcgcagcgttttgacaatttggcatcttcgatcagatccaacactattaattattaattaatgtctgtaattggagaatggaagaacgatgatacttcctggaaacaatatgttaacactctgtgccacatggacgtcatactcatacctgtaggaacttgtgttaagatgtaaacgcagataattacagaactagggattgaaggtattataggccagcatttgttaggaattaccagctcatctagcggagaattctcgtacgaaggaatactcatgcattgcttgaagaaaccacactcggtcatgtcatattttgaacatccacggagccaaaaggatactcccctccctaaataagtctatttttatatatgaatatatccgtattcacgtataaaagtagacttaattatttaagtaacaaagaaaatatcaacacttattttaagtatttagcttggacaaaccatatcaaaatcctaaaacaagtaatctaaataagtagaccaattgtcgcaagagggaataatggacatttgattattaagattattttcgcggatcatctatttaattatagagataaattaaatatgttaagaaaaaaattaaagaagatagcttaaaataacacagccaaacaatatgcagtagataaacgtatattgagaaaacatatcttctgaaaattagagcatataattcgtttgaataagctaaaaagaacatggcaaaatcgaaagtgactgtgggcagcaaatatgcagctttacagcttcacagcaaagtgggtgtgtttagttcacgtcaaaattgaaagtttgattggaattagaacgatgtgacggaaaagttaaaagtttgtgtgtagaaaagttttgatgtgatagaaaagttaaaagtttgttgaaaaagttgggaactaaatcagacccaagcgtcgatcaatttccaagtaacaaatttttttgaaccttgaaaacagagacaccttataattatccaggaagtgtgtaaattaaataatatgcagtcaaatactcgaatgcagtttcatgtgggtcattgtcagtcagcacgagtatttgccaggtaagtatatatggttcggataccacacgaataagatattaattcccggtgcattcgtcctaccattttttttttaagaaaaaatcatgaactttgatttgatccatgtgtattcagagtaaacgttagagacatgatgtgcgatttttgaatgtttgacttcgcggcttgcatgaattgttttgtaccttttgtgttgaagttatttgccgaggattcatttggaaatttcctacacatctattaacgcggttaattgatttttcagacagcagagaatatacgtgcacaccgctgagcctttttcttttttcccgtttgcttattacagattgatctaccttcttcttgcaaaaacatcattgtgctgccagtagatacaaaaccacggtgacggtgcacagcaactaacaaatacttattatttttaagaaaataaaattctacatgtacctaaaatcttcctccaactatttacaaaatttcaaattcatgtacattataaaaaagcagggaaaaaaagaaagaactaatatatacttccatactctttaaactctatgtttttgtttattcttttaactgcttgaacataatgactttgaattagaattcttttttcaaatccttggaagatgtatgcatacaccgcactcgcatgctcgcgagtatgcccttttaactagggatgaaactggttcggatagtttccgtccgtccggaccatttttcggattcggatagtttcggtcggaactatccagaaattcttggattcggaaacgaattcggatttttttttctcggaaacgaaaacgaatacagtaagggtactatccgtcggaatcggaaaacggtcggaaactatccggattttttttcggatatccacagacattgataaaattttagaaaaaatacgtatatatacataactttttcatacggaatcagatgaagacaaactttatatcaacattgtagagcttgatgagatctacaacttttttattgactattttattatttgagatcatttaagggtctaaatatttattataatataccatattaatttttacaaaatctcagatctacaattcaaacgacatctgatggagatgtgttctatatcaaagttgtagagctcaacaggatctaccactttttagtttataacatttatatttgaaagcatttaaagcataaaacaaatattgcaagtttcgaaaatgtgaagtaaaataaataacatctccaatttatacaatggcaagtaagttatacatctaataaaaggtcttgagaatagaaaatgataatcatatttgcatatggatctcttagagaaacaaccatgaaaattgattttcacatacggttgtgagaccatctacaaaattgacgatataaatgttggagatgttgaactaaaataataagtgatatctcttccttgattaagaaactcaatttgaggggctttttatataccggtaaatattcgctaccgtattcgatccgtctcgtattcgctccgtatctgtattcgataatattcgatttcatttccgtatccgagttttcgattccgattccgattccgaaaaaaaatatgaaaaaaaaaatatgataaagctagtttccgtccgtttccgatccgttttcatccctacttttaacacacggtcaatacaccacatacaatataattgtgagtttacgcttttaaaatatgtgtatacacatagggaggacagataaatcactgcaccagaacgtaggtaccgagatttttactctaatgtttggagtttggaccaacacaacaaccctgtgcttctcaatatgaagtcgaatctaataaagcgctatgctacgcttcactttagcgaggataaaaaaaataggagagctgaaaaactaataaaaatactagaaaacaatataccgtttcaacagaataactgacgcttaaatactaagatatattttctataagatatcatatgatagtttctacgagatatcatgtatgatacccttggtaccaaatctaatacttacggtaccatgctgacaccatcatgatacatagataccagagtctgagacaatacctatctactaatacggtatcataggtactggatttggtacctaatatattgtgctgatataagcacaaataaactaatattttgttggaatggtatagtgctccgtaataaccctcgtatataatggtatatatgtaaaagaaaataaagaaaacatataatggcgggaaacatatctaatgtacccctcccgtttgctcctataaaatccccccacccccaggtcttaacggctaataaactctctctttcttcccttcctccaactcccaaccagtcaaccaccagaagcgagagaaagaaaaccgaaatcacgcgaaccgccgccgcgtgacgcgatggagccctcggcggccgtcgcgtcgaggccaccgagcttcaccgcgcagacgaatgccctcctccgcaagaatctcatcttccaggttcggatccccctttttccatccagccatttctttcctcttcgccttaactgctatgatctgtttggtactcggatgagtcttctttgttgttctgatgatatgccttagggaaaagaggaaactgcaagatggtcagtacaaaatttcacttgttgtttttttttcaaaaaaaaggaacagcaaaatttcggcataatttgctagttttcgttgttcttgaagtgtaggcgtcaacttgttctggtgaagtcgtgggcttgagttatgtttattcagaatattctcttgtcgtcgttgttgactttttggcatggccgtcgtcccttgatttatattgatgtcaaaatggaaagaatttgggaccaatacgcatccatcagcataggtgaatttccttgatcgtttgaattatagatgtttggaacgcgaagaggcgcactgaaatcccttttgtttttgtgcttcatatttcacttcgatggctgtttctgtagattattagtgtcaactgtcaagcgtcttttacatttcacacgattgcaattcgttttttattaattgcacaaactggtcgttgagtcaagctaattaagaagtggcatccatgtttgatcgtttcttgcagaaacgaaacaggaaaggaaccattcggctaatcatagttccgatatacctctgcctcttgctcaccattcttcagagagtcatcaacagcgttcttgacaagcccaagttcagatgtggttgcaagtgtgttgatgtcaccggcacaggctcttgccaaaatgtgtgtggaattcagtactctacactggatcaggctggcagttgccccataccgaaccccccggaatggcctgctctcttgcagttaccgcgccctgagtatcgcgccatgcaggaatcctccttgtatgcaggtttcccagatgtatcatgcagaaaatcacaatcttgcgcagctactatacccttcacaggagcaaatgagaccctatctaacagtaagtaatctgtagttctgtaccatctacttctttaaacctgcctcaaaatccacttaggacccctttagaaaaatgcttagggcttgttggatgaagaagtgaggcatgattctcttattatttttttgttttcagtaatgatgaaataatgattatatgacttatctgagagaaggaaaatctgttaagctgtagtgtgttcaccatattccataatccactaatttttgcccatttgtttggcagttgtcatgcaaaatttgttcacaagctcaccgctttcaaatctttctgataatgcgagcatatccagtcttctccttgtaagttgaaataaccatattattacttgtatggctacttttttttaagggtgaacatcaaagaacttactctattatcatgtaacttccaggggacagatgtaccgggtacttatacaggcttcattgaacccgcttttgtctcagatcgacccatatatgttcttagacctcaatgcaaagccagtgattcagttacagtccccattacgtttggtgatattaatattcggaaaggtaaaattcttattatgtatcgcttctactgtttctgagtagattaatctgaaataacaatgttggcaaactgatgaggttgtcagattattaacctgataccatgacagacttgtgattgtcattgtttgccataagaaccatcaacctctgtgcactccttcaatgacattctgcatattaccgtttatgtgcctcttgttttgttgaatgtttttggttgaaaatgacttaatatctgaacttcaaattctgttttagcagagatgttatgtattcaaggtttacccttgtggaggaatagttcagcaataataaatgaggaaaccttcaacggctacaggaaagggaaaagtcaggaagggataaatgagattccaatgggtatgcaggcatttcttacctatgccattagtttattattgcatcatatgctggcattaaaggtgcaaataactctaattacttctgttattacagcctatgatttccaagactcaaacgagaagcatttcagcgtgttagctttatataactcaacttatcagaatgtgtcttatgttccaatgccatttggacttctgcatatctcgcgctccttgaacgcggtgggtctcacttcataaaattgaccttttattagggacaaccatagactagtggtagatcatagttgagataatgggttcaagttaccactcttcttgaaatcaaatatatctgtttaatttgtaaagtggatctctcattcttatttttcttgtctgccaacccactaaaaagtttgaaacatttttatatttcattctgcaatcatttatggttcataacaaattgacaagaagatccaaggaaacatgacatctgatgtgaaccagaatattcataatactagaaaactgtaggctgtaataatccaggagggtttaaaacttatgagcacgcataatcatgtgttttcggcttgttctctagtaagtatagtagcacattatgaatttattagggacaatacctttcttgtcctttttacactatagttttgaaattttctactctgtttagaatattgaaggatcaaaactgatcccattatcattatagtcatatcatacttctgaaaaatatctctaacttggcaatactattatgcaaagcagtcaggaagctatacaactcagttctaccaataacatatgtttctgggcatctgtgtaggtctcaaatgcatatctccagtttcttcgaggatcaggtgtaaaaatgttgcttgcattcacaaaagaaatgcctaagcaagagactcgtttgagatttgatttttcttctgttatcggccctctcttttttgaatgggttgttgccttgcttttcccggtaagtggcaacaaattgatagtggtcttcccttttgatatagtagctatgaatttgacttgttaactagtccctctcagggtttcttaatagttaatagtaagtaaaatattgatcctcatattagatatattgaagtggagaaaagtagagaactgttagaacaaatcatgatcagttttataattcatgatgaaaatttgagatttaatgcaggttatgttgacataccttgtatatgagaagcaacataagctccgaacaatgatgaaaatgcatggacttggggatggcccttactggattatctactatgcatatttccttattttgtccatggtgtatttggttctatttgtcgtttttggatccgttataggtaggaagctattcccaacggttattttcaacaatcattacttgatttgacccattttatctaactcagttgtaatttgcaggtctaaactttttcaagataaatgactacagtatccaatttgttttcttttttagtttcatgaacctgcagattgtactagccttcctaactgcaaccttcttttctaaagtcaacactgctcaaggtacaacaaacctataccatttatctccatatccgtgacctattctgtactgcaaaatatatgatgtttcttgtttcttatgttctttccaccagcaattgcatacctgtacatatttggatcggggttgattgcaggatctcttattcgcaattttattgaaggtggcaagttcccaagtaagtttagcaaatattaccaaatggatgtttttaacaatcacattaccttcatttgaatattatatcacagttttcactatgccatagcaaggcagcaacagtttttaaacataagtaaactagccatatgggatgcctttcctgctgctagcaatttattttgataaatggggctgaaataattgcacaaaattttcctgttgtgttactgcagagcactggattacagttctcgagataatacctgcattttctttgtatcgaggactatatgagcttggccaatatgctattagggcttctgaagctggaagtcatggcatgagatggagtgatctaaatgaccatgcaaatggaatgagagatgcgctgattattattattctagaatggttggttttgcttcctgttgcgtactatttggaccattctgcttcagttggacacaaatctagtttcctttccctaataaaaaatctgctgaagaagaacccaacttggagaagggtatctattaacgaagtagttaacgacgctgttcatgtagaaatggtgaagcaagatattattaaagaagtaagtttcttatagttcttatattgcactcatcagtctttcagacagttcaatctcccacctcaatgcatttttttttgaggggaaacactactagacttacccagtagttataaattttataaataaaaaagtccatatttacatgaaacagaaaagaggaaaaggaaaagaaacacacagcaaagttcaataaggtctgtaaatgcattgcaattttttacattgcaatttcaggattacctataaggctgcaatatttttcaacaaactactctacataattatgtatatcatccagtactaatttactatattcatttcttgggaatcacataaatctgcatatcagatgttacctactacttgatatctagtggttgctaattttttatgattggattacagagggaaactgttgatcaagtactacaacaacagagtagcggctatgcagttgtctgtgatgatctcaagaaagtatatcatggaaaggatggtaatcctgataagtttgctgttcggggtctatcacttgctttgccttatggagagtgcctgggcattcttggtcctaatggagctggcaagagctctttcattagcatggtttgtaatttgatccctcacacgacatacttgatccaaacaattgcctagtcattttctctttcttctgcttaaacacataaattataattgtaggatttcttgtccatgacgattattttttctttatagtattctcttttatctgttaatgttttatatatttctgtagaattaattatgctttattgaccatatttctagaaccactgaatgtcctttttaaaatcccgaaatttatagcttttgcgctttagttttctaaatcctattcggtgttctgtaataatctctgtttccttccaactgttgccttacagatgattgggcttacaaggccaacatccggaaatgcattcgtacgggagttcagcatacagactgacatggaaaagatatataacagcatgggggtttgtccacagaatgagtaggatatgcaacctactattgcagatctgttgtgtgcattagcacttgttcatgtaaaaacaccttcgaattatcaccttttgtttttgctatgttgaatgcagtatgctctgggaaatgctgaccggcagagaacatctccagttttatgggcggctgaagagcctcaatggctctgatttggacactgtaagttatatcaagtataccaggtcccttatttcttcttctgatagcataatttttaaggtgaagctagcatatcttaatatcaatgtactgtctttcaatacttatgcccgtagatgtgctttattatatggatttttatactccaaagaaaccttataggatttgaattaagaacaaatgagtggatgctcgaaagcactgaaccatgtattaagaatggaagagtgtttgaagcataaagtgtcaagtgcatgggttttcatggagcaaaatacttctctgaactgaaaaaatggatataatctagatagtcttccctgattttctccatcatccttttttcattttcatttgtcttgaaatattttcagtatgtgttttttgacacagtacttctaaatttactagtataatatactgaataggacgctttcctactatttctatttagaagcctttcagagttatttactgaaatgaaaatgatttgcaggctgttaacgaatctttaagaagtgtaaatttacttcatggtggtgctcctgataagcaagtcaggaagtacagtggtggcatgaagaggcgtctcagtgtagccatctcgctgattggagatgctaaagtacacctttctagctacagcgcttaccaacatcttcttgcgttgtgactcatcgataattccctgcttatgcacattcataaaatggcctcaggttgtctacatggatgagcccagtacaggattagacccggcttcgaggaagagtctatgggacgctgtgaagcaagcgaagcgagacagagcgatcgttcttactagtaatgttcaaactacataccaattttgaatatgatacactacctaccttgtgtttggacataatttctcttccatgattgaattaacacgcttccttttgttcctgtgacacatcttttgcagcccattccatggaagaagctgaagttctctgtgacaggttgtgcatcatggtagatggcagcctccagtgcattgggacacccaaagaggtttaatcatctcacaaacctacttcataatccaataaaaataactattggaagcattgttcctcgagaaattttatagtatttaagaaagtatatctaggtatcaaaattttacactaaaaattttggtacctcaagatacaagtatctaaaagtaccaagttttacgatagaaaaagtggtactcccttctttttttaatgtatgacgccgttgactttttaattaacgtctgaccattcatcttatttaaaatttctgagcaaatataaaaatatttaaatcatcctgaaagaacatttgatgatagattaagtcataataaaataaataataattacataattcttttgaataagatgaatggtcaaacgtatctcaaaaaatcaacagcgttatacattaaaaagggaacttctcaaggatggtaaaactatctttgttccttgcttcatctaaagatttaacacaaaaattttcaatgacagctcatagcgcgatacggagggtactacgtgctgacaatgacaacatccccggagtttgagcaagaggtcgagaatctggcgcgaaagctctcaccgaacgcgaggaaagtataccatctgtctgggacacagaagtacgagctgccgaagcagcaggtgaggatcgcggatgtgttcatggccgtggagaatttcaagaggaggacggaggtccaggcgtgggggctcgcggacaccaccatggaagacgtgttcgtcaaggtcgccaaaggggcgcagtcgagcgaagaactctcatgatgatctggtgcaaaaatgatgttttgtttgtgctgttctgatgtactttgtacagaaagtaggataaatcttttgtcaggcattagtttgcttatttttctgtacataaggatcctatggcatgttgtttttgttcaatcttcttttggtcttttgtagataaggtttgtgttattgtgtatgttatagaaaaaaagatggtgtgtgtaggcgtatattggtgattgtattttatatatgtttgtcaacttgttgctgcacgtatatgtctctgcaaagaatcataaacctttgaccagaagcctttgaattgatcatattctttgtgtaatataatgggcaattatttttccgtcgtcttggtgacatcgctctcctggttgttgcaccgttgctttcatttgtacttcagtaggctgtagcgatgctttttcgttgggcctgcagcacctgaagttactggtgtatatttgttctaatcattttgagacctaaagcgttgtttcctatagatgtgttcaacattctttttctagcaaacgcacacgcgtagcacattaggattaaatttagattttctataatccccatctagtcaaatcaaacaattgataatttgttggtaagaattttataagtatgttgttaaagtgaaggtgcacataagacttgtttacgtgaatcgtaaaacactccctcgcgtcgctctcatgcgggcggcccgggggaaaaaccctagccacccaccccgacacctccctcccccctcccttctaaccgctggaagcaagcggtcggccgggaaggtggcggcggagcttctcctcagcgtgggaggtggagcggcgcgtttctgacaggaggcggcagccggagtgggcatcgggcagaaatgctccccctacggccaaattaggagagggcaagctcgcggtggcgtggtggcgcgattcgggaggcacggtccggtggaggcttgcggcagcgcgacagctgtggccaatggtcctcgctgcgaggacgtgcagctccgacacctggtggcgctggcgtatcgctgtgttccttgacgacattggcggcgaaggctagtaggcgcgcgcgtggaggcacgatcgacggcggtggaggccagctgcggcagtggccagtgtagagggaggtgaggccggtggaggcggaggcccgacgcgaccggtggggccggtggggggaaggtggggcgccgttggagcggtgcagctatggataggcaggtggtgggtgaaaacctagcctggccttggctgggccggcaataatggcgctcaagcgtcactccctctcctgagggcgttgtcgtgtcgtctcggcctctagtggggctgccgggtgaaaacctagtcgcgactatttttgagaccttgacggacggtggcggcggtctttcgtcacttctctccctagagacattgtctaggcaacccccttgccgaagcctcccaaacaactcgtgcaagctcattctagattcatgtcctcttgtgtcgacgcactagtttatgcaagttggccacgtcggagggcctatgggggagagcggttccatttttctctctcaccctctcttcctcaatcccaatgatgtagatagagcgggggttcctgtcggttgcaagggtttggtttttgggtgatcttggctatagttcctttgttggcttagcggcggccgatcacgcttagtgctagccgacgcagtgctagccttcttctgggtctgtgcgttggtgttgtcggtgtgtgggtggtggtattcttttttctttttcctggttacgaccttccggggttataatcttgtaattttttcatgctctatcaatatgaacttcgcactgtctaatgcgagtcattcaaaaatatatatataagtatgttgttgataagaattttataagtatgtgtagcattgctcgcaattttaagcgttcgctcttgaaacttcaaaaataccttatgttactccattaatgctatttcacgcatatgtgcctgcagcacatgctcttggcccataaggcttgggaagcgaagagactaccgattcctcttttctcgtccaccccctcctatttctctttccttccattctcattcgacactgtcaaagtggcttgttgtgacctgttgatctgctccaccagctcccaataatccccatctccggttgcttccatccttccccatcttactgacatccaacattccctatccgttgtctccgaccaccctctattcttccctatctgtttttctcgggccatcaagtgggcacccctaggtcctttgaccctagcaccgctaggggttgtgatgtcaaccatcaaccactgctccctgctacaaggactctatctcttcgttctctctgtcacagccagggctgcatcatgctcgtgtcggcctctccgaaataggaggcgacctttgtgatagcgcccaggaaggcaacgatggttgtggctgtaggagccgtgggattttttttatttagatggaagttttggattttttaggtgaatctttttatatggaagttttagttttaaatctttttgtatgttgtgtggaaagtttcacatcttcaattggaagttttgtgattttgatatggaagttcgggattggaagtttatgatttgagatgaaagtttcatattttagaatttctttttttgatttgaggtgaaagtttgcaacacaaatggaagcttcaaagatcagagtttgacttgatgtgcaaaggaggcgtagtgtgaagcaaaatcacttatgtatgtgatgcgaaaaggaggcgtgtgacttgttgctagcgtagttggtctagttaattctaggaaaactcctatattaccgtctcaactataacccgattttctccctaaaatcaaaaccagataatgggcctgtttgggggagtttctagcagccccaaacagtccagatttttatctaaattctgagaatccatagttgtataatggagaaaatgaactataggatataagctgagtttttttctagattttcacaagctgtttctcataatcttaatggcctgtttagtacagctccaactcctaaatataactccaggagttgagtctggagtggagttgtggagctgc

SEQ ID NO: 6024 - DNA, 11042 bp, Oryza sativa
  unsure (1)..(11042): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaaccccatcatctccgatctctctctccaccgcggcgtctctctctctctctcctcccccacccccaaccaccacttcctccatcaccaaagcgccgctccctcgccgtcgccgccacctccgccgccgccgccggtgccggtcgtcgaggcgggaggactcctccccgcgcgccgcgctcgatccgtccgctccccagtacgcccgaggtgaggcccgtccccttcgattggttccttccttcgctctcacttttcccttccccccagtctggaatcccggcgactgaccccccctgtttcgatctccgtgcgcgggggagcggtcgatccggtcggtgaatgcggccggggttagctttgggtcgccccgctgctggtggcttgtcgagagtggataggccctagggttcatgtgtgactttttgcggcgcgccaatccgtagtaagcatgaacacactgataggttctctcttttttttttgcgaagtttgttgagatttagaagagagtttaggttacaaatacgacattaatcccgcaagcagctgccccggggtaaaagattactagcatcccgtccaggacgagcctgactaccccactgataggttcaaccggcgtatggaacctcgaggataggttctctttgtgtatagaacacactgataggttctcttcgtgtatggattatccaacgggggatggattgagccttccattggacgtttggctctgtgtgatggttgctagattggatttagaatatgagagtcatgaatcgtgttgcattattatactagtgaaatggattgtttcttcactgagctatgtgtttcgtacagtgatgcatcttctataagctatcgcgattgtttctttaacagattaagcgtggtagttgctatgttatgtatcaagagagaaggaaaccttcacgcatatatgtggttttaatggttaatgtttgcaatgttcttgaggcatacagttcgtacacatggagattctttaccgattgtttagaacaaccgagttagttcaagcaatgcatatataaagcttgaaatggaccttttatgttctgctctgtagtgggaacacatgcactgtgagtgatcttggattctgggatcaggcttacatgatcatttcgtttcctcccattcttttgatttcagtgtcaggaggatatgactatgttaggtcattttggcgtgttctaatgttgttattatgcagaatagaactctgcaacttgtcgttcagcattttcttgtcccaaacatatttcacttacctgtagcatctagacaatgttctaatcttttgatgtttttatctcagaaacaaggagaaaagttaaatacctaccgttgtatggtttaccattgtactctttctgtagcttcttgatcactaaatatttacatttacagtttctgaacctgtgttatgcttgctgcaattcaacgcagactgatttaatagcagttagactctatcatacatctttcaaaaaaaatttctttctggaagttttctcaatgaactacttacatatctgtggttttttgacttggtacagggcagtgatactctgctgcttagttgggtgcagtgtgcactacaagtctacaacaatggagcttgacagtctaagagaggcgtttgatcgagttattgaaaaacgtgcttcctcttctgctaaagctcaggaagttattgatcagatagtgagtgaagttgagcaggcaatcacgaaaatgcagatgatgaatacagattccatgggtactgctgaccattcatccatcctggcagaattgaaagccaagttgaatgaattggcgccactaaatcaactagaaggttgtcaaaaggaattgaatgttgcacttagcaaatatctcaagctgctcgagaagtctttcagtccagacatatcgaaagcatatcgaaatgtggattttgaggccagtactataaacagcataatagcaaatcatttctaccgccagggcctttttgatcttggagactcatttgtccgtgagtgtggtgaatcagatggggcacacttgaaactacaattccaagagatgtattcaattcttgaagcaatgcaagttagaaacctccaacctgctctcagttgggctgccaagaaccatgatcagcttttgcagaatgggtcaatgcttgagttgaaacttcatcagcttcagtttgttgagatactaacaaaaggaagtagagatgaggctttaaagtatgcaagaactcacttagtgccctttgcatccttgcacaaggcagagatccaaaagctaatggcctgccttctctgggctgataggcttgatcagtccccttatgccgaattcatgtcatcgactcattgggagaagctagcagaggagcttacccatcaattctgcagtcttttggggcaatctagtgagagcccacttggtgtggcagtatcagctggctttcaaggacttccaaccttgctgaagctaacgacagtgatggctgccaaaaaacaggagtggcaggcgatgaaacaactgccagtacccatagatatcggaccagaattccagtaccactctgtctttgtatgtccggtgctcagagagcagtcgagtgatgaaaaccctccaatgctgatgccctgcggacacgttgtgtcgaaacaatcgataatgaagctatcaaagagcagctccagacccttcaaatgcccatactgtccctcagaggctgttgcttctcagtgcaagcagctacatttctgaatgttctttccctgctcagatatgtttatacacgtgttaatttatgttcctgtggcacccatccaataactaccttgtaatataatcctgtatgttaatgaacattctagtgctgtctctggatgttaatctgtacagttgcaaattcctgttcgttttatcaaattatatctctggcatgactgaacagaaaataagtgctactagtcactctggcagtcttagggcttatgattgtgtattggttttacagccatgtagatcggtcaaatcatgtgtaaaattggcagtgagcctttctgtttaagtttcctgctaaacatggtaatgaacatttatctggccaattgataccgaatagattgctgctattagcttatctttttataagcattttgtgttgttagtaacttagcatgtcttttgttagcaattagggttcgatccatatgcttgtctgctaatactttgtaaattcattaaaaaaataaaatactacttctgttttaaaatataaacgatgttgttgacttttagacatttgtctatttgtcttattaaaaaaatagaaaaaaatacataattatggagtatatttattttgttatgagttgttttatctcattttgttatgagttatttttatcactataaatattttaagtataatttatattttacgtatttaaaaaattaaacaatatgaatggttaaacgcgtgctcaaaagctaatggctttatttattgaaaaacgaggggcatgaagatcgaacaatcatactggttaatcgcttaacaaattcttggctccgcgccgtgtaatgtaccaattctctgttattagtaacagtacgcaggtcatccatctagaaaaatgaaaatgacacaaaaacaaaggtaaaagaaagtagtatataggatctttcaaagagaaaaaagcaaaaaaaaaggaagaaaaagctcgccgtgccccgtcaccgtcttttttacctccgtgtctacttgtgcttgattgacggttgtgattttttttaaaaaaaagaaaaaaaagctcgctgtggtccgtccatccaccgcacggccggcgacaccggcgattgccagggctcgtcggcgagcggcggtgccggccgaggtgctgggctgctagcgcgagacgaagcggaacgagctgtggcggcgaaacgcggccgccgaggcccaactgtccaagcagcggcagcacgcgggcggcgccacaaccagggcttccgcgaccatgaggtacacgctcattcactcatccgtctgtctgattgatttgtggttgggattttgggctggattaggctgcgctagctagatcgatctgaatgtgcatccatctacactctgctctacttctgattgggcgaatttcgcgcttgattcatgcccgaatcggatgtctcggtcccaatctgacacaaaatcagcctctagaacatccagttggcttcaatctgatgctagttgtgctaatcgatttagctctggttgcttgaactgcgcttgtagttattcaatttgaagagttaaaaggaatgtggcacgaatgctaatgccactaattatgttggttcaaaaaaaaaaagggaaaagaaaagctactaatatgttacattactattcttctatacatgaaattgccaaatcttaatttgcctcatctgacacccatgtttgaggctgcatgtttgattctaagaatcatggtagaaacctgccccatttctggccgctctctaggcaatgccattgaacatgagagtcctattttaaccaatggaacgaaacacctctccatcatatcggctacactgatatcatcttgtagcattgtgggatcaacaacctcgtgagtattatcgggcaatgctctatcaacaaaatcatgcagggttgtgtcaccattaaaattttcatcggtaggactgctacctgttaccatttctaagagaaggattccaaagctgtagacatcacccttggttgagatatcttcgttcataccatactctgcattcagatttatagaaatcataaaattagaaaccagacaccatgtgtaccataaatagaatgaacaacttacaaattagcttatctcacccggtggaatatatccaatagatccttttagacaagccaagcttgttgatatatctttatgtgcattcgatcttgtgtatacaaatcttgctaggccaaagtcactgacgtgtgcaaccatgtcactatccaacagaatattgcttggcttcaaatcacaatgtactaatggcaattcacactggttatgaagataatccaaagcaaatgctacatccaaggcgatattaattctctgtcttaaagtcagaacctttgtttgactactatgttcatgggattttggatgtaaccacatatctagattcccatttggaaaatatgggaacactatagccttgaagtctgccccagttgaatccacagaagaacatagagtaataattttcacgagatttcggtggcggacattttgtagggtttcacactcggcaacaaagctcttattagatccatggatatcaaggttaaaaatcttgatggcgatatgttcttcctgaagatgcagattgcccttttctttgaaaggaaaatgcagattgcccttataaactgtaccaaatgatcctgagccaagtaagttagttgaagagaatctatttgtggcctttagaacatcttcatatgttatgttcctgtgctcattcagctgttgtacatgtggctctgcttgcattctcttcatacaaataatttttgcaaggcataataaagtgaaagtgatagcaacaattggtattactatcgttaggactagaaccaatgacctactatggttccttttcttgtcaaccaattttgaacaaagaggcatacctgtcgttggagtttctgtgcacagatggtcatttccttcaattgacaccacactagcattggcaaaaataccactgcttggcaccactccatgaaaattattgaatgataagttgagaacttgcaaagaacgcaacaacgttagaaactgtggaatttctcccgataagttgttatgagatatatccatcaccttgatgcctaacatgttcacaaatgtttgcggaatgcttcctacaaagaagttgctttgcatctcaagatactctagaaccacgcattgactaagagtggatgggatatctccagacaatctgttgtatgaaatgataagcttattcagattgacaaggttgcctacttcatctgatatgcttccggacaagtaattgtatgacaagtctaacaccattgaaagtgaagaaattttaaagattgtctctggtattgttccatttagtgaattgtgagcaaggttgagtatttcgagttgagtacaataccctatactcagaggtatgcttccactcaagttgttcctatccaaatttagataattcagctgaacaagtttcccaatgttgtctgggatttgaccagagagtctgttttgagcaaaggacagaatgcctaatttgtgcaaatttccgattgttagagatatatttccagtcaattgattgtaatccatgtacaactcagtgaggctcttaagattgccgatctcttgtggtataggtccggaaattttattatttcttagccacaaccgttggagactactagatagattgccaacagaacttggcaggtttccttgaagattgttcccatccaacatcagcttagtcaatcttgtgcaatttgaaagtgacgagataaagccccagtcgcctgcttctagcatgttgtatgccacatcaaggtcctccaagtttgtcagtgatccaaaggatggcatgattccagttaacttgttttcagctaggtaaagcatttgtagatgggttgaattgagaagagaggttggaattgagcccttaaacttgtttgctaatagaatcaagccttcaatgtttgggagtgtatagccgatctctaaaggtaatcttccggtgagtgagttatttgccacagtaagaaatgtcagggatgacatattgaagaggggtggtggaattgtcccagagaaattgttcaaagtcaacatcaatgtctgtagcgttggaatatgtcctaagctctctggtatgctcccatctaaacaattctgtgaaaggcgaagataaagtagggaggaaaggttccccagagaggaaggtattgttcctgtgagacagttttctcctaaatcaagatattgaacttgtggagagacggttttaacaggtggtatagaaccggaaaaattgttctggttgaggtaaatgccgttaagtgacaacgtgttgagtagagcctttgggagttctccactgagactattgctattgagaatgagttgttggagagatgaactattcaacatgggctttgggatccctccggtaagagcattcttcccaagattgacatatgtgagtgtaaggctactgcccaaagagggtggtatgtcacctgaaagtctgttgtttgccaggaaaagtacactcagtttaggaaggtccccaaaagcagaggggatgctcccttggagcttgttgttgccaaggagaatttgttgaagatgcacacattgacttagactaggtggaatctcaccttgcagggaattgttctgcagatctaggatctgaagttgtgaacatgaagagagttctgatggtatgttaccttccagagagttcatgctgaggtcgaggttctggagttcgttcaggaagccaagctcagacggtatgccgccatggaagctattgtttgatagttgcagccttgtaagagaggtgatgttggcaatacaaggtgatattgagcctatgatgccttcggatgggagatcaatggcgataacacggcgaggagctctcctgctgcatgtgactccatgccagttgcagggtaacaaggatgcattgttccatgaggctagaactccagttggacctgagagctgcgacttgaagcaaaggagagcgtctcgatcagtctcagtttcatcactgatggctaatggctggaagaaaaggaaatgaaatataagatggcaaatgacgcctgtagagaagactctcaaagcagccattgctgttcgtttttgagagaatggtgggaacttggaggatggcatgatgcatgcttttgtagaagttggaactgaacatgcttcaattatcccagtaaaaaaagttactttttttaaggaagtctaaaaagtggcttgaattgtttgggagtaattggagtaaacgcttgtacaagtcactgtgagggtacaaagtctgagctaaattatttggaaggttaacaaaaaagggtcgataatcacttccacatccgtgatccatcgacgattcggcacaccaatacgtgtgagttgaaatttactgtaactcatctttccaaataattgttattgtacaccattaatcttcaaacttttgacaactcattttctttaaaggttttctaaatacttaattaaaattaccatattattaataaagcatattaaattctaaacatattcattaaactctactttatattattataactatttaagagctatcagtactcgaagttgaaacgaaggaagcacaaattgttcatattacgtattggatcgttgaaccagattatttgtcccatactttaaaagtacattattttaaaaataatatcttttactgttttgtctagatcactttaagttagttgttaagtttatttattaaaatatttactttatcactatacttaaatagataatccgtgacaacaatctatccaataatttatttcaaactgagccactagtcttttccttttggtcctatgatccttactgaagtggagtaggagtactactcagtatactaagtactgttagtactccctccatttaaaaaatataaagggcctcatcttttcgcttatgcttatgtttatcagccaaaatttgaattttcaaccttaaatttggttttcatcgaagtttatttttcagcctttgcttttagatcgctaagaacacatattaaaagtttattcacaatttactttttagtctgcaaatatgccgtttggcttattccacaaataaacgaaacaatggggctgaaagagttttggttggatgagatacatcagtttgtccagattcgtaatagtaggatatgtcctaaccaaaactctttatattttggcagtggcgaacccaaagggtagtccatgtaggcccaggactaccctagaatttggcctagaaaagactagatattcatttttcttggcccatcaaaaaagtatggcctaacaaaaaaaaccctaaggggctgtttgggagagctcctctacaaaaaaaatgagctcctctccaggaaatcttctccaccgggagctcctggagctagcacctgtttgggtaataatacatatggtccagctccagatttggtaggaggagtgaaaggactgttttgcccatggatcttgtatggatgttgattactaatatatagtgatgtttaatatttctcacagccataacaataataaaaaataaaatatattacaaaatagacttgttgcaagacgatacaagtagctatttcaagaacggtacaaaattagctcgaatagctaatttttttataataaaaaataaaaaaattataaaatagacttttttcaagacgatgcaagcacctatttcaatcctgctgcgagaggtaatgttgcagcaaaacgcgaaaacggccacgatcgagctacacagtagactggagagcgcacagtcacagtgcaaagcaacacgcatggcaatgctgctactgtactagggaattgcacctccgagtagctaatttttttatcgtaatatttattttacatcttaatggaacacatgcaaatctgccgcaattgagaaacgagttgggagcaaaatccgcacaaggtaccacattttaatcaaaggttcataattgaagtccaacaaagatacattatcatcttatgtcttacaaatctagcgccaagaaattgataaagcggtggctagttcatcacggaagagatccatagttcctgcacttctttcgggagttgactcatcagatgccgttcgaggaactgcgtatttgttgtaccgttctggtattgttggaataaaattagggtcacgatcaaacctagcaaaatcaggatcctcacctccatgctcacgaatgtaattatgaaggaccatagcaggcacaacaatcattttttg

SEQ ID NO: 6025 - DNA, 5894 bp, Oryza sativa
acgattaggatatcctgcgtcaacaacatagtatttgcctacaaaagatagcatagtatgattattgatacattttagtaacacatgcacagttagcacaaatagagagcataatacaagtgtggtaccttgtggaggatgagggaagaatttttcatccactcttaatgcattgtataaaacacttgtgtcatgcatagctcccggttgacccgttgcaacataagtaaaacgcatgtcaaagtcacaaacggcaagcacattttgagtgggaattccagtttttccaatatatctaacttgctcatcaggtgacaatgacacacggatatgagttccatcaagagcaccaatacaatctttgaaatggggaaaagttcttctatcatctcttatcctcttatgaaccgaacgaaaattgggatcttttggtcgaatgtaatcttttgccatggccatcaaagaatttaaaacctcatcaaattttctactaatggtttcaccagaatgtttgaacctattttgagctctcctattggactcatttccaccacatgtaaacagaaacattgcaagcatctcatgagtactcatatgcagggatggttcgagtccatacctttgcccaacaaatcatttaggtccaaaaaaagatctgtgttcatacgaagctgtgaatgacattcaccaggagtccgcaatgtctctagcaaccatcccatgccactaagaattgatgtccttggtggatttttgtgaaggtacatatcagcataaacttgagctatttgggcaccacctaaaacaagtttccagaacaaggtcaccatcagtagagtcccctgactcactctcactttcactgtcagtcacctgcaggccaaaaaaaaagagaacaacacttgttagatcacagcacttgttacaaatagtataaaaaataaacttaacatatattatatctgtagacgccatcacagcacttgttaaattatactaattaacttaacacaatcacagaaaaaaaaaaacttcatccaagtgacatcaatctgtagatgccatttcttttcccagccttcatccaaatccattcaatcagacaaacaagcatgagtctaacagtactattattacaccaaatccattacaaatatttcaaatgggagaaattatgaaataacaagaaggcctgcataacagcaagtatggatcatgctccatacttggcattgtactttctcctaagccaattaaacctaaactctttatttggtagggtcataaacatgtccctttggtcctttttgacaaataactctatagcaataaaatgctcatcactaccataatctgccccacaatccaaaactagatccatgatttgttgcacggttacttcatttgacttttttgatgtgaaagaggaggctgactcagcaatcttggtgatttgttcttgaataacaagtgctgtccctatctttgatttcttgcctttgtcaagaacagcccgagatcttctctttccaataccaatggaaggagaaacctcatggcactcctgggcctcgtcattcatttcctccatgggggtctcttggacctcttcatcatcaactacaagattatcttcctggacctcctcagtcatgtgctcaggtatgatggggttctcactcataggattccaatgatcggatgcatcattaataatgtcagaaaacataatgttaaggtcatctacattctgcaagggtttcttcctaaacttgccgcatccaggaatatcctattcaatttcaaccatgaaacaatgtgttagaagcaagctaattctagttaataattaaggggcaggtataaagctaattcaccttttttgcctttctccaccactcatcatccattacaatcacacctcttgagtgatcccatcctgttccagtttgctgcctcattaatttttgccatgccacaaaatcaggcttcatcttatcccacttattcctgagctgtcgcttactcaactcaattccagttatttggcgaaacaactggatcacttcgtcatagcctacggagttcaaatgggtatttggcctatttcctttcaccacttgttgggcaaacaattgacaaacaatggtagtatgctcatcaatccattccattgaatcaccctgtcaagtcaaattaaagattttatagttttcaagatgcaaataaatggacgattttagctttctgaaataaaaaatatatcacataacagaaggtaatacttcatccatatgcttatggttttgactacaacccaaattagctagcttcttcatatcatacacgaagcacatgaggttataccattggatgtcatccaaatatcagacaagtaattacctggttcgtcgctccagtacgcgggggacgagcttgctgctgggcagcgccggtcggctgggacccgcgccccagtgcgacgccggcgggtgagcagccgcgccccacggcggctccggcggcagggctgccgtgccccaggatggctccgacagcgggaggcgggcagccgcgccccagggctgctccggcagcaggaggcgggtgcagggcggctccggcagcgggaggcgggcagccgcgcccctggccgcgccactggccggcagcaggaggcgggcagccgcgcccctggccggttgcgggaggagggaagccgcgcccgtggccatgctccagtccggcgcccatggtcatctcggcggccgggacttcctcctctaggccggatccatcttggacagaggcggatccagccatctcggtggcggcggctctagggttggcggcggcggcgatctgcctgcagactcggcggcgctctggtggaatcatttttttcacgaatgaggaacgggaacggggcggtactgtggaatagaagcgaatcgttttttttaaccaatggcaatggtgggtaattttttaccatctccatgaggacatatgactccaggttttggtggagtaccccttgaggagctccagaatattcctagagatggagctgcgatttaagagccagagctactccactactcgtgtttggcaaaaaaaacttggagatggagctattttcttggagaggagtcctgccaaacagcccctaactctccagtcctggcctctcattctccgtctctccctgtctcctagtccactcccgacggcaccactgcgctagcacggcagtcggcagcaacgccatcgctccggcgctcccgtgtggtcacgtcccgcgaggctacgacggtgcagtggcactccgcctctcaccggcgcgccctggcctgggcctgctcgccttccatcgtgactcgcgccgtggcgccgcgtctagccggcgacctcccacccgatgtgcgcgccccgccatggcgccgctggcttcgcgcgctcgcgccctctccgcccctcgccggcgcgccctagccttggcggctgggcctgcccaccttagcgccttcccgtcgcgactcgcgccgccgcgctgtgtcccgcatgaccgtgtccaactggcggccttccgcccgacgcgcgtgcccgccgtggcgccgccagcgcccggcgtcactccctcttcgatgagcagtgagcacttcctcagcccctccccccattctagagttctagtagtagtagacgaccagtactatccccttcaataatcaagttttagatttctagtcgtatgccatatcaatagattaccacaaaattgtgtgcaacaataaaaatcatatgacatttttacatggtttgatggttgtcaggagattgaggcatatggataagaaagcattgcgttacttttccagaagcatgaagcaaaaaaagttgcatcttgtgatctaccaatcccaccagtggatgaagggtcgtctgttcctgctgtagttgatgctccaattgatgaagacacaatttacattgtcatttaggtaagatttaaacttatttgttattttttatttgtattgaaccatttaaagttatataccgtatcgtttaccagattttatgtcgaatcatattgtattgtatttggatttttttttctaggtctaccctagattcaaattctgggtccgccaattttgggatggagggattactgaataacaaactaatctaggattgacttggcgaaatctgttagtcaatgctaatgccactcgatggagcatgcgccaaattattttgcagccatcgtccaggcctccagggcttcaaacattgataacgagatgccaatcacatttaacctgattgatttttctcccgaaaagaagactttgactgaccgtactaatgttgttctcacgatctaaacgcgtggtttctagtactccaaccaattcgttacttctcatttaatgtcgtaagtaaacttttttttatctttatccattaatttcattcgaaaagacctacacttaaatatttttaattttttatcactatttgcataggttttaagatttatttaaatatcaaggttttaaatttcaagcaaaaaatcatgaattttttttaaatattttaaaagtttgataatggtatcatgtatggcttttaaaaaaagctcaacttaaaatacgactcatgtaaagagaaataaagaagagtgatgtgtggtggggattttttttttttttttggggagggtggtgttgttaaaatgagaacatagtagtttagagcgcttaattaagtgataaaatgaaacagttcagaaggagtaaaatagatttagtatttctcatggtgaatctaaagaaacacatgataaactatataagttattgaagcatatgataaatgataaagatataaatgttttgactaagacaaataaggttgtgttcggtagctacgattggatacctttcccctgctgatgaaaaattcgcatccggctgatggtgccaaatctgcgtttacgtgaactatgtggaaacacatgaaggcctgagagatttgcttagctctagtgcaggtcctaaattttgatgagatgcgggcatgccagttagtttgatcctgtaactgacaagatatataaattgatgatcaaatagccgaccagctaacaaactgatgtaatgatgctacgcagatatcgataggggtctgagatattgattctgacacttggataaatgacgatataaatataatggaaaaacttgagcaatcaaccaatcaaccaatgataatataagagtaaattttggaagactacaactctagtgacaaaacaatcagtttgctgcaacattagcgacatgtttcagtttgctgtaataatagcgtgggaaattattacaaaactgcaacagttatatgctgctacagttgtcacctagtatatatattgatatgtggagatagattacagggaccccgaatctacatatttatacccatcggtagatattagtccttattggacaagacacgaacattcctatagataaaataaaagatacaagtcatgatcgggctctaaataatctttcctgaaaataaaaggaaataagtaactctacctaattaatagataaactgtcatgtcgcatcgtccttgaactcagtctcttttagataagtttcttttaattgattaattttctgaaccgaatccatcgagaatctaactgttggtgactgatgtttccatcgacctattccagaactctgaagcgaatattgactctaggctgatgataattttcggggcataccaacttttggcgttgacaccctcctagcatgtaaaaacggagcaaccaagggggctgctatataatggaatcctgttgggacgg

SEQ ID NO: 6026 - DNA, 337 bp, Oryza sativa
caactccatagcacgattcacggattcaccacaatattcattcacaatatccattcacatatttattcacaacatcacaaatatattcacaatattgattcacaggttcattgacaacatcgagtcacatactcactcacaacatcatagattcattcacaatatcgattcatagattcattcacagatcaaaacatccaaaccacaaattaaaaaaaataaaaaaaaaactcgactcaccggccgacctcccatcccgccgctcgggccggccacccatctcgccgcttcccctccagccggatctgggggaggggagggcgaggccaccggtgac

SEQ ID NO: 6027 - DNA, 3273 bp, Oryza sativa
gcacaaatcacaatgccaaaagtccatcacatagtccatcacatattccacacatcaaacaatgccaaaagtccatcacatattccacacatcaaacaatgccaaaagtccatcacatatcccacacatcaaacaatgccaaaagtccatcctatattccacacatgaaacaatgtcaaaagtccatcacatagtcctcacatagtccatcacattttatatcacatagtgcaccacatatgtcatactaccaaccaatagattaacttcatacaaatcacttcttccgttggcgccgaattgcttgcgagcccggagtgtacctacatttgaaaatccaatgtttaaaacattttaaaaacaaaatacgggaaatcaaataaccatttgagaatggtaagctcattttacctctttcttcgctgcccgagtggatcgcaagctgtcttgcgtgggttgcgtcccttgaggcgcgtcgggaagctgcgacatgtctatatgcgacatgtctatctcctcggcgtctggtgcgacgtagtcctcatcctcctcgtcctcatcgtcatcgtcgtcgctaggtggagccggcgccttcccctttctcctcccttgcttaatgcgtgacgaggacgagccaccaactccttcacgctcttctatcctgatggagtgtcgagcggtacttggacgcgcggatagaggtagtggtggtggtagtctccgcggctggtacacgtcgtccaatccaaccgacctgcaacctaatcttgctgcaagtttctggcacctttgacgaactttctgcatttcaaaaaaaaacaagaagtttgttaggcataactcaagtaatgcaaagtgctaaataaattttacctctaaaacattgcggagtgtgttctccgtgtcctcaccacccctcggagcttggagggcatgccccatttcattcacactcctgaggagctctctcgactgaaagcgtgagaagatatatgttagggtctagggtgcaaatggaaataactttgacaaatgcaagaaaacttacgcctctgtctctaagtggggcgtgctccatttgatatccaactctagtctggacatcatagggattccgcccctcatcggagtcgcggtcatcctctatgtcggcttccgttcaagtagggcggaggaacagtctatatgtcctatgcagccaacgaaggtactctgagaaaatatgattttggtgtatagtctcgatgtacctgtcattccttccggctgtcctccattcatcaatgtatctattatgctctagcccccagtctttcaccttctttgttctcaccctgtcatacctagacaagtagaaggtgatgaaacaatagtgagcatcgacaagggttaaatggtacaaaattgaacattgacaatgaaagcaaacaaagataagaaatatttacttgggtaattcaactccagttgagatgtcctctaccggccaatcttgtttcttcccgaactgtcgcatgacacggtgcggaaggtggtactcaactgcccagaaacaaatcaatgggcactggtacatgaaatagtcagagtttcgattgcacatcgagttcagggtcaggcttgaagcctcatttgtgtggtatggtaaccactcaatctgcaaaagttgaagagatgtcgttggttagtatctcaattaaagaagtaaatgtctaactagaagtgatattggaagtacttacatgttgaggctgtaagcagtccatctcattgacataatgcttatatgccacatcccggtgagcatgtgcagtggcagtactctcaaaaaggtaggccactgtcttctccatatctggctcattgtagggccaaggagtgaagctttgcctccacttaggccttccaaccggtagtcttaaccacatccacagctgaatcaatagcacacaaccactcatgttggatgatggtgcctgacgacaacaggcctcacagagctctctatatgtccacgccaacactgttgagccccaacggaaacggcctagatcaccaaggttggcgaccaaaggaatccatatcgccgaagcaatgtcacccccagcatcaggaaacagaacccctcccaacaagtgcaagatgtatgcacgggcataacactcaacacgccatggctcagcgtcgtagtcaagatgtgagaagttctgactcagccaagacaggggtattccattctgcttcttcttccccccttgcccctgctcaatgttcagtggaatgccaaacagctgctccacttgtgcacgccatccaggagtctctgtcctgcccgtcacggcatgccccgtaatgggagggccaagatcatagccacatcctgtagagtgatggtcatctcaccactggggaggtggaagctgtgtgtctcaggcctccatctgtccacaagtgctgtcaacgcaggagcgttgaacactggcattcctctgctcacgaccaaggccaccccgagcaacccggccgcccttaggtacgggatgtacctatcgtcgaacactggaggggcatgagctctgactcagagcggttgaagtacctgcattagcaattgtaaatcaattagttaatataatgtcaaatacacgctaccgatacatatgcacaagtgaatcaatgccgattcataccctccccgcctcgatcgcagcctcgcgatgacgggcctcatagtacgcctccaaggctgggtaagtcggcggttgtccctcctcggccatcctacatgaaaaagtaataaattcaccgttagttaccaatgtgacatacattaaaagaaaatgaatgcgagaacatgagtaggaaaacaaaatatttacctccctaacacttatattttttttggacttcttcttttttggacgcttaggacacttagttttcttgtgaccctcctggtgacacaacgagcatctattttgcaccggcgcagcatcaagttgaacgcatgaaggtggtttccttccagaaccacccagacccgagtccatttcattcttgaatcgtttcgatctcctcttccctcttgttttaatcttcaaatttgggtcagcaacaaattcttcaccatcgtacggtggccactgtgtggggtcgaggtatggctcaaagcgacttgcccatgtgttcacaacgtgtaacgccccgattttcgttcgggattaaaaatcattaataatgcattttctagaattaaataaaatttaaatcaat

SEQ ID NO: 6028 - DNA, 2016 bp, Oryza sativa
  unsure (1)..(2016): unsure at all n locations
gcctccggtcgccattcgccatcaccccggctgccgccgcgacgcgccagccgcatcgcctccctcgccgcgtcacgctcttccccggccgccgctcgaccgacaccttccaccgccgggagcccctccgtgttgtcgacccgaggagcaccgccgcctccctccgccggctgctctcgccgtcgccgtgcccctcgatgagctccgccacctccctctccctctctgcctccgcttcctcttgccgcttcccacgctgcgcgccgccgccctctgtggtcgatcgggccagccccggctgtgcccgtgctcggccatcgctctcctcagccgcccgatcggcttggccgacctgggccatccaacccgtggaccggcggtggaccgtccttgtggtcccggtccacggtggaccgcctcctcgtctcgctgacgtgtggggcccgcctatcggcgccggcctcacttgatgacgtcagcggcagcctttttcctttgtaaaaatatttaataattgcgcaataattcgtaataattctagaaattcatataaatggctcaaaacttctaaaattcatatctaattcattcgaactccgaattgagccattcaacttgcaaaattcatctaaaattgagctctacatgtttgtttactttttatgtactgtttccttggtttttattaaagtttttcctcgttttgcgtgccagcgtgtagaatccgtcgtttcggaagtccgcggtcgcgaggaaaagagtctggaagattgtttcgaagaagcaaggcaagtcacacattccccttgtgcattttgatcctaatttacaaatgttttatcgtttgcaaataaaattgcatgtcttgctaattacatgggatccgggtattacctatctgctcgcttgtgctatgtttacttgatatctgttctttgtcaaccttgggtaataaatcgactagctcatgttacttatgtgacctagctagaactctatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggcacttctatgtttccacaactggtaatcaatcactcgaacgcctattctcggtgctattccttcttgatcttatacaggtgatctttgtccgcactttcggccctacttggtctacaaataatgcagtctgactttacacaacaacattcaaccgcgatatttctaacacaaactattaacgtcttacaaatctaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6029 - DNA, 710 bp, Oryza sativa
gccctccaagccttgccatacttcaccctatactggaaaacctcaaatatatacaaagctaacacagaagcagagagtgtaggttgcagttttatggcattgcataacctatttgctatgaactttgatgtcagctgccggtggctccctgaaccttcggcagtagcacaactatgttccttacctacccgtgatatcctccacgtgccactagacctcttagttgcatggaccttctatttgcaccgtgggttttcacatttaacagtgtacctcctatttgcggcagaattgacaacacggtatggacgatggtgcacgatggcgtactcctggagccatagcttcattgcgaccatggatgggaactctaaaccctttctgagaccatccacctgaaatggttctgacaactgatctaggttgatgccgccatctagtagtgcaccatgggcatgtgttaggtccctaaactcaggaatgtccggcttcctcccaaacaccttctcaaacgcacaacattcctctaatgctaacttggcattattagtaagtggaggaaatggacggtcatcatcagagtcttcagcaaattcaacatcatattgctcaacacttgcctcctcgtcaacatcatctctattgacttctactgagacagaatcgtgaccaccacttaattcgacatcaaagtaatcatctggattcac

SEQ ID NO: 6030 - DNA, 495 bp, Oryza sativa
tatttacctttgttatgaccttattattattgttattgttattattaccttgttcaccctagaataaacaaaactccaactagtgggtactctatttatggttccactagtatgaacttaggtagatgcttcgctggttaattatgcaacattaagtggttttacaactctaaactttgggaatgttcttatcacctgcacactatggaatggttggattattgtggaattggattcacacctccccctctattcaaaatcctcaaaatggttttaggctgggctcggggtgcatggttttgatagtagcacctcggccacataaggaccggtcttcgggcctctgttgcaaagcactactgtacttccacatgtctagtgggtaagggttagtttgtggctcagtctggttataaacaaaagtacacggatggagacggacgaagtcggcggtagatggacatgtctagggcaaatgaaggcaacacgagctgc

SEQ ID NO: 6031 - DNA, 189 bp, Oryza sativa
catgacgactcctgttccaggattgccaccggttcaccaccggtggtgcatgagggacttcagtgctaatttccacaaggccggtgcggacaagcatcagacaaaagagctcctaagaatatgtcagattgacgagaagtggatatttgagagggatgttgaggcactaaggcagcgtattcccgaagg

SEQ ID NO: 6032 - DNA, 592 bp, Oryza sativa
aactttttacccattggcatggtatgacctttttactcctcacccacttggctgcagctatttcagaatcgtcctcgtcatcatccgacccatacatgtacggacaaacatgattaaccttcttagagtttttcctaacttccgcagacctatgctcatgcaaggttactttctgtatcagatgtgacaagctatcaaagtcttcatacgagaatttctccctaatcggagcaatcatatcctaaaaagccagatcggctaactgggcatcagttaaactcaaactaaagcatttgttcctcatctccctgaatctctgaatatactcgtgcacaggttcatcatgccgctgcttaatcgctgtcaagtcggataatttcatctcatgaaccccactgtagaaatagctgtggaattgattctccaaatcggcccagctattgatcgaccaatacggcaaagaggaaaaccaagtaaaagccgatccagacaaagataaccgaaataacctaaccttcagagcgtccacagccgatgcttcaccacactgagctaagaatcggctcatgtactcataagttgacacaccatc

SEQ ID NO: 6033 - DNA, 3692 bp, Oryza sativa
agattgttctgagaaagatctaactcaacaatgcctcttaaatttatgaaagaatcaggaattcgtccatcaagaaggttcccttccatacggagagagcttaagtggacacagtcgccaagagcagagggaatttgtcctgacagtcggttattggaaatatttagaatatcaagattgatcgagccaccaatctctgatggtatttctccatcgagttggttgtgagacaagtccaaccattcagaaagagaggaaagagtaacgagttcctctggtatgctactatcaaagctgttacaagacaggtttaaagcttctagattcttgcaactccctaaggagctaggaatcggtccactcaaattattttcctgtaagtagagctcacttagatgacttagattaccaaatgaagttggaatttgtcctgaaattttgttttgggataagcttaggataaacaagtttagcagatttccaagtgaatctggaagatttccagtaagtagatttttttccatataaagaagcgtaaggcttgtgagtttctctatctcttgaggtatggtaccggatatttcatttcctgttagcagcaacacctgtaagcttgttgaaagttttgcgatggaacttggtagggttcctttgaggatgtttttgtccaggcataattgaaccaactgtctactagttatcaatgaggataagaaagaccagtctccagcttctagtcgattcatcccgagattcaattccatcaagtcaggcaggttcccaaaagaaggaataataccatggaatgcattgtcacgaagattaatcacttggagattttttgcaatgcctagtgaagtggggatctgcccttggaattgatttccttgcaagatcagtgttttgatatttggaagggtattttctatggtatctggaatttctccaatgagttattagtgcccatgccaaggtatacgagattagacatgttgtacagagaagccggaactgtccctgacaagttgttatatgtcaagtccagttcttgcaagtttggtattctgcttaaactagatggaatggttccctggaagttgttctgtgaaaggtagagtatttcaagggaggagaggttttctatagaggaaggtatgctacctgagagattgttttgggataagctgagataccacagtggtgaggagatatttgagattggtgggatagacccaacaaagttattaactgcaaggcttatgagattaagtgacgagctattaaaaagagcaaaaggaatctcgccgccaagacgattattagttaaatcaagcaatatgagtgatgaactattagctaggagaggtgggatgcctccagtgaggctgttatttgtgagaatgaccacattcagaaaagagttacttccaagtgagaaaggaatattgccgcttaggttgttatttgaaagatataaaactgaaaggttggagagtgtacctaatccttctgggattactccttgaagtttattgtcaaacaagcagatagcttgaagatttgagcatttgttcatgcttgaggggatctcaccatcaatcgagttatttgagatatcaatgatctgaaggttagagcatgaagacagagcctctggtatcgtgccagtgaggccattagaggtgaggttcaggtaggtgaggcgacgcaaatgaccaatttcaggtggaatgttgccagtcaactgattaaatggaaggtggattattgtcaagaaagtaagattaccaatgcaaggtggtatttggccatggaggttggatgactctaggttcaattcagtgactcgagatgtgtggctcttgctacaagtgacaccgggccattgacagtattgcgaagaatcatttctccaggaagccatgactccggcattgtcattgagatggagcttgaggcaaagcagagcctgaaaatcggtagtatctgatgcatcatggagtggtgcagtgggaactagggagaatgcagtgatgagaaagaatgagaagcatgccaataagattgtgaccagaacagggatgctgtgggagcccaaaggcgccatcagttttgctaatgagaattacaatgtgagcaacaggtgtttcttacttgggtacgttgcaaactgaagctgtctggtgtagtggttgttgtgctaatgtacatgaatttatagaccagcagcaacaccataagcaaggcaattgtaatggccaagtggtggagattggccgtactccggcatatacggcaggacctagacttagacgctcatggctttggcccagcttaagatttgtgcttgaactttgcttcggcactttgtagctcaattgggagctgagattaacagttgccacttaaaatatgcaactcatatgtcatgttgtagtgatgttatcaagtgcatcgatccatgtatctgtctgttactgcagtctacattgctaacttagcgtatactctggggtttcactgttctctcgtcgagacaagcaaattaattggacaaagtaactaagataactgcctaactagagcattagaattgtcctgatcttgcatgagaaagcaacttttacaagtgtaagatgtttttactctatattctaaaggtttggttgcaggagttagcaataatgtcagttttttcccaaacacaaccaggctagcaagctagttagagtgtctattctattgctaatccaaactgatattcggacgaagtagtcgtcagcgtttcccttaatgaaacaagcacagtgacagtagtgtcaccgttcactgtctgactctgaaagtctaattgtaaactcagctcggcaatttttcagtcgaattgcactgaaaaatatcatcttcttcagtcagcagtcaaatgacccgaactaatacggcaatgtatatgcgtagtacatagaatagttcctttaaatctgttcacagatgtctcatcgaaaaaactgaaatctgttcacatattcaaagacttcaaacttgactctgacttcaattactctccatgctttgcttggttgccagaaatctacagttcgggtggatcatctaagtgaaattaaaacgggatagagaacagggttagaaattctggaacgaaattttagaaatttcggtcattttggatacgatattatttcgaccgaattttttattttttttaattttttcatgaattttggtaatatttgttcaaattcaactaaatgttgtttaaaatttcagaaatttcggaccgaaatttccgaatcggtgagcaccgatccaatcggctaaaccgatgggtttaaccctgatagagaaaggattatggccttccggtgatctgtgagtcgactagctaattcgtagtgacagcatgacaaattgacaatagcgtgccaccgtggtagactcgtcccatacatgtttggatgggagcggccggccggcgggcggcgacgccgtacaagactcggcagtaacaagtatgctctgctgacgaatgtagtcccaccaaatcaggagtcctccactgcacgccatgcacactagtggagaaaccgtctttggtcggtcgcccgaaatccacaatagtctcggttccactaaaaaccgggactaaagacggttggtggctacagcgggca

SEQ ID NO: 6034 - DNA, 787 bp, Oryza sativa
aaagaaaaaaggaccagctgatggactgccgctaccctctctttagtcccggttggtaagatccctatctttagtcccggttgatgtcatcaaccgggactaaagatcgatctttagtcccggttttttcacccgggactaaagatagcgatctttagtcccggattggtagtcccggtttgaaaaccgggactacagggggttacgaaccgggactaaaaagcacttctccaccagtgatggtttcaccaagcatacataaatccatatactcagccaatgccctatgatagaattgttagagatgccgatcgaacacattacatgtctaacaaactcaacgtacagtataggtatagttactcggcacacgtcgtaagtataggatgccggcgatcaccggccgacggccggtggctcgattacgcgcgataatccagctcgtgctgttggttcttgtgatcggcagtggcatcctcgtcgtgccggcggctgggggcacgggaagcagtggccatggtactctcccttcgttatgcaatttttagcatttaaaatatgtctaaaaatataacaattttctagcctacattattttctcaaccaatcatgactctctgccgtttaattttttttacctatattgttttttcgatcaataacaacccttcacaactaatttaatttcacaaacttcttaatacccgtttttaagcataaaactttttatatttcttaatattgtattcaagcctaaaaactttacagaggtagcataccattttct

SEQ ID NO: 6035 - DNA, 13102 bp, Oryza sativa
gttatagttttttgtttggtaggaagggatcgaagtgggatgggatggacaactttgcacggaccattagtgtcgtctggctcccaatggctggggtgcagcagcgaacatggggacggtggagctcgtcggcgcgagcggcacacaggtgaaagagtggcggctagagggagaggagtcgacggcgttcgtgcaggtggtggccagtcacaaaggcgaggcggcggcgggtcacggaggtggcgtccagtcgcggaggctaggcggcatccggatctaagaggagcagtgaccgctcatggaggagaggcggcggtgggtccggacgaatggcggcggtcacggaggtggaggcaggcgcggacgagcggcggtggtcgcggaggtggggcgatcgcggacgaggcggcggcgggtcacagactagcggctgcagtcacggatgtggcagcggtagcacattattcacattaccaattcacagcaatagttacattgacagaacatttacatagacagagagttctaattagtcatataaattgtccacactcacacttggatgcagaataaatattgacatacacataatttttagtcaatacaaattaaatcttcatggcttgcatgagatacaaattaaatctccatgaccaacacacggtgtctccggcacgaggaaagcagggcagcgcgcggtgaaaggcgacggagaactggtggccacggcggcgcacgcctagtgagcaaggctagggatccaatatggctgtggccgaatctggtgcctccgcgccggatttggcctaggtcaagtggccgacacggtaagatatggtcaggagggcagccgtacgtgggcttggcgcggctgaccggcaacaggcacagcaactcccatggccggccagtggtggtagaagggcagctgtgggcatagcgcggcggagggtgcagcacgagcggtgatggaaggaggcctgtcgtgtgcgtggaggccggcgatgagaactggccacccgcaccaacaatatgggttggtaccaatgttatgtcgagcatgagagctattggggtcgattcgttcaagctagctagctagccataccccccttctctccatggacctcgtccactattatggttgattcccttccggtcatggggagctcttttggagacgccagcggtggcggtaatggaagaagatgttccagtgacaaagctccgtgggagttgcgacatggtggctgtgggaggtgacgataaggccgcgttggagactggcgggtctggactggccgacaatggggcactggtacggaggaaccgcattctagcaaaggttgttcagttggtgatgcactggtgtggcgacgataggtgtgggaagggtgttgcaggaaaaagcttagcccaggtttccctgagctgacaacgatgatgtctccgagcgccatgatcaccccttgggtcatcatcgagctgccaccctgccactccttaataggactctctaggtgaaaacctagtccaaatggacggacaatgatggcatctaagatgtcatgacctccctggaggtgttgcctaggaggtctttgttcctcgcctttgtagtcttttctcaacttgtcctatgtggcttattggttgtcgttatctggttggtgcgagggatgagttggtattcttctctcttgctctctccctcatcaaccactctacttagggatgatcgggaactcatctattatttttttggtggaatctatgtcggtggggtgtttgagacccccttgcaggtctagccctgattctaggggtggccggcttggtgcaactgccttatcttggattttgtagggagctcttagcacgcggttgcgatgtgtttgttttgtttcctgattataatcttttaagattgtaattttgtacttatttttatgctacataaatatgaaattttgttctatctagcgtagatcgttccaaaaaagttcaaaaaaaaagagatttgaaatctgggggtgggacaagctactgtagcatagctgaattttgtgcagtaatccttgaatggtgaagcgttcattcaagaacatcaacttctcaatatgtggctaaacctaaattaaggagctcggaactacctggacaagagtcaagaaagacaatgaaattaaagatttatatctcttttatctgttttgaaaagaaaacaaaaagaataactagttaactacattagttttaaaatataatctgtttttgcacgtttttccaaaataaaaatctgaaaaatatacgggaatgtgcgcttctaggcacagtcgcacagattactgtacgtgtggcaccctgccggccggtatcagctgagtaattatggcgtgctcagtgaccctcgagtcacccacgcgcacggcggctcaggggcgaaccctagccgccgccgccgccacccaccctcctcctctctttgcctcgccaccgccggagtttgccgccggtcaaccggtgtcatatccagatttttttgtttcaggatttataaattatctaataaattattaatagaatttaaattaaatgttctttaatttacaagtgaagttaaatgtgggaaataaaatttcctaaatataaagcatggatggatttaatttttattaaattctccatgtttaagtcaactctctgaaattttctcggatttttcagagctcaattcctaaatgatacgaagaacagttcagtaattatttgatcaataatgatctaattataattgttaagagcttttcttgtttaaaaatccttaaattataaattgttgtttaaaaggaattattagaaatgattttaaaagcttaaaagagaagatctaattttaatttgttaaatctcaatataaaatggggccagataaaatttcattaaatactttgcttaattctataattcctagatttttctgggatttatttgagctaaggaagtatttttaataaatggaattgcatttcatgaataatttaaattgaaaaaggttttaaaagtctgttttggctttgggccgaaagccggcccaaaacctctctctttctctctccctccccggcccagtcggcccagtccgcgccgccgctctcttctctctctcagtcgctgacaagtggggcccgtctgtcggggtcgtcgtcctcctcgcgtcggccgccgcccgaaaccctagccgagccgctccgccgccgctttccaatccggtcgcccctttccttctccggccgaattgatagaggggaaacaatcttcgggatctcctctacctttcctcctttggaatcttcgcctatttcggtttggaaactcgtggattcgaggtcgaatcggatcggtctctttcctccgaaccccgatctttccttcgccgtctcagccgccgtgggccttcgccgtcgcctccgagcccctttaaaaggatccccggtgtctcctctacccgccgccaccctcgcctttgtctctcgccgtcggaagcgccctatcgccgtgagaccttgtgccgccgccgtcgccgccgctccagccgtgcgccgccgtcgctccagccgtcgccgtcgctcggggaggtcgtcatcgtggtcgccaagtcgccgccgtcctcgtccgccccttcgccgccgccgaagaccgccggagcaccgccgtcaccgtcgacccgaagaccgccgccgtttcttcctcgtcgccggcgctgtccgttgctcttccgccgcttctttggtcaccgggagttcgccgcgtcgtcctctacccgatggtgcccctccgttcgcgtcgccgcgccgtcgttcgccggcgagcatgcaagcccgagccgccgagccgccgccgccggtggtgacgtcatcgctgacgtcatcgtcgccctctcccgtgagccggtcgtggaccgttggatctcggccgtccgttttggatagggttgatctcggccgttcgttcccgtgaactgcctccgtgcgcccggtccaccgcaaaccctagccgctgacgcaataatcctccttttccttttcaaaaataattcattattgcgtcataattcaattaaaattcatataagtgttttaatccgatttaatctttaaaaattcataactaattcattgtaactcagtttaatgtggttcaagttgcaaaagttgtataaaataaagatctacatattaaaattgtccataaattgaattaaatttatttaattctttttaaatgggctttaattatatttaatcttgtaaaattcataataaattcatttgaagtcagaatgaggccgttcaagtctcataattcatctaaaattatgatctacatgtttgtttactttttatgtattgtttatttggtttttattagtcttttttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccctgggttattataacttgactagttgggctttatatattggttcagctagatattagatatgattgcttagccatgcttagaaacattagcacactattgggataacttatgactcactattatttaatgatggcttaatgatagttcacgatggtcaatcgtgattggttaaataattacttgccaactaaaatatggtaaaggtgggttgtgagcacatggttttgagagtcgtgctcatgacaattaaggaccggttcgcgagctactattgtgaaacattaaccatgccaaccacaagccagcgtgggcaacggctttaccttttgtataacatggttcattgcggggcaccagactgagaagtggcggagataagcccacgggggtcgctggggagtccatgccttgtttataagggggtgactatgatccgggaatggtgcgctgcggtggattgtgttatgcaaggggtaatgtcacagcccctttccgaggtaccatggtggtaatgaggcacatggtgacatgatgtggggctgtgtcttgtgggtacagtggtacacctctggccagagtaaaactattcgaatagccgtgcctgcggttatgggcgggttgagcaatgttttttgtgattagtctcacacctctcacaataattatagatgttatacctggtaataatttgcttagctcctggtttggagattagatctgtacagccgggtatggttgttcaggatggttgggcctgtacagcatgggtgtgctgttcagtgttgattaaaatttctgattaattactctactgttttagtactcttaactccttgctaaatgctgctttcgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggcgaagacgtttggcttataccccagttgagctgcctgtgagagtggagccgcagcttcgctagattttattttccgctgcagttttcttcatggtgagccctaagtgcctcttaagtaagtatatatcgttttagttatttgatgaatctgtatattaaattgtcagtttgtgtacctcggctgaattcctggacgaggattttatgcacaaataagttcggaaattactagtgaatttccgggcgtgccaaccgggcggggagccgagatggcggtggcggggccataccgcggcgacgcgccgtctccggcgcgagggaggcggggcagagcgcggcgaggaaggtggggcagagccgggcggagtgtggcgcgccggtgggcgagggaggccggggatccggcaccgcggtggccggatctggccgcacggcgcagggctgcggctgcagtggcgcgagggctgcgcggcggtggacggggcggtggcgcgagggccgcgcggcggcggaggaggcggcgttgcgagggccacacggcggcagaggcggcggcacgagggccacgcggcagcggaggcggcgtcagcgcgagggccacgcggcggcggcggcggcggtgacagcgccggctccagtgcaagaacgagaatgacgccgatgccgatgcctcgcggggttgtgacgacgccggtgacgtcctgctcgccgctccggcagaggcagcgcagggaacgcccgcttggcggtgtgtccttgcctctctccggcctgttgtgtgcgggaaggagccgtggaatggtggactgggctagctggttgccgaggagatgacagggtggttcggcaacgactgttgtgtggggcggtggtggcaatggatgaaatcgctggcaaaagccttgcttagcccttggctggcgtgacgacgacgatgtctttggcgtcgttcccttgttagaggcgtcgttatggcgtctttctccgtcgccatcaatctccaggtgaaaactgtgttccggtttccgaacaggcggtggcggcgtttcacgtcgtatccttcatgggggcatcgtcttggagaacactacccttgcatcgattgttgttggtgtactcctgcgtcagctcgaagcactagataccttggtttggcgaggccttctccttggctcctttcttgtattggtggcatccagcttctttgtttgtctctgtcaggtggagtcggagctgctacgtcgttggggtgcgacgatgcttggcaacgataacatttgcagtttctctctaggaatgttggtgttgccagtacaagttttggcgtctcaggggctttggctgatgtccaaagtgtgagctcggtgttgttttgctcgtttggtggtgcctccaatgatattacgatcaccgtgaagtcgaagctgcttggtcgttggacggcaagctcggcaacgatgacatgcgctttgtgatgtcaaagtcgtgtgccacttcttcagcatctcgatgtcgatgttcgtctttggattccgccgtggtagtttggctagaagttgtgtagtgctccgtgtgctgtgtggtttgtaccggccacggttgagggacttggcgagtttctactcgccaagtggttgtatttttctttttctgtaaccctgtctgggtttttactcctgcttaattgaaatataattggcagttctcttgccggtttagtttaaaaaaaaaaattatggcgtgctcaactcttcacgtacatgttctgccgattacagcagaacagcagccagcaggtgttctcctggtctgatctccagcagtagtagtaagagagtatagcaaactgcaaacacactgataatcaataggcgatgatcgatcgactgatcgagcgctggccgtgcgtgcgatgacagtagtgcggttctgctccccgcgtctccttctgctgtcgctacttgttgtaactactgtcataaagaccaacaaatagacacagtccaattttgaaatgttaaattgaattaaatatccaataattaattcgttagatctcactagccggaaacgttcaagtcgcgcgtttcgcataatctccagcgcgtttacaccttggtatctatactacttaagaaaaacagtgacggtgacaatgaatctatcaccccacatagcctcattggaaattttcaaaattatcctttgacttccaaatattaaggtgaatgttccctatagtaaaacgaggatggataatacatctcatagaaaacatattttttatttgtttcaaacaatatctatatctatactatctatattattttaaaagaaggtaggtgttgtagcagtcaatctgccaccccacctacccacattgtaaattttgcaaattactctttgaacctcttaatatcaagatgaatgtttcctatagcaaaacaaggataaatgtgtacaacatttcatgaaaatatatttttattaatttcagacaatattataatttatttttcttctatccgtggcggacccaagattggttcaaggcccgagccagcccatatggagatttaggccttatttgttgtttacatggtgaaaaaattatcatcttaatggaccttcacacctagaccttggatcacggcccaggtggcccaaggcctaggtccatcccagtcttcttccggttccaatagcaacaagcttcactatatacaaaatacaagtcacaagttgctggttggcatctataaggatctcatcggtgtctattctaaaacctcatcactgttgactaactgttactggttggaaaatccgatctttatgtgggtttttcaaccattgcctattatactttagtggcataaatcataatctcccccccccccctaaatatgtacaaaccctagcctatgtctagtttgaagatatagtcatacagacataatccatatgtaggagtaattatctagagcccgtcaccgataataactattggtggcgggcttatgtttaggtccgattgagattatctttgtaatctttgttggcccttaaacataagcatttaattttcagtgatatgtgggccgtctatctaaaactcgtagtaactgcatgacaatagcgttccaccgtggtagactcgtcccgtgcatgtttggacgggagcggccggccggcggcgacgccgtgcaagactcggcagtaacaagtatgctctgctgacgaatgtagtccaccaaatcttagtcgtccactgcacgccatggtttcacgaggcatgcataaatctatccaccgatcagccaatggctgaatacattacatgtctaacaagctcaacaatcagtaagcatttataaagatagtttttctagactgaattatactttattccatcttttattactaaaatttcactgtggattatcctttagttaatatttttattttagagtaagtaaggttatctttgcactttgcaccatattaaatcacttctctatatctatgctctcatctagcaaagaatagcctaaggagtaagattacggtgtataggtgccaacgtgttcaagatctttgatgtgtgttgttgcaagaactcaacaagtgtatgtctagtgctcctgtatccaatgtgcccaaacaagagcggtttttacatatttatacgcgagtatataagagaaaattccttcggtgcccctagccctacaaaggatcttgagtggctggccagtgggccagcccttggccttttggcaacttcacaggtggtaggaaggagacacccattaaggaagcagtgctgatttccgagggagcccgctattacccgggtaaagacatgctctgggtaatagcagactcttcgtctggtcatcatcaacagtgtcagaggtagttgggacgcatggtgcgcatttattccaacccactagcgtctgattcctgacttgagccgctgggggcatattgagactttattcgcccccggcagcgcggcaagctccagaagcctccggactccgaagtctctagccacctccggagtacctttgccgggctccagaagccctccgggttccaaagctcgagatgcctttcgaagccccgtaacccttggatactacggcctcccggatcacccctggaaccctcctggcggtctccgagccttgccaggctccggagctcttggcctccgcgggagctgtttctcctctccgggacccctccgtagcctccggagccgggggctaaagtggcatcgacccacggtcatctccccggggaggatgattctccggagtgctgtagcccttcggaggctgacccctcaatccggagccattccccaacaatgtgcttaaggaaagtttttcggatggtagtctagagtaaaacaaagaaaaaacataattcaaactgaaaagattagcttaaaatgtttgtttgaagcgaaactctgataataaaatgtgacattatattaaaggcaattcaattttctaaaagtaaaaaccggctatatttctcgaaataaatgcagggtcgtggagccacgaggacacccttcctcgtccccgataagacgacgaagagacacgattgtggtactcctactcgcctccgtgagttctatatatatatatgctgctcgcctgaacatctggcttgttagtttgtaaaccatcagtaatatatatagcagcagatagttataccatcaccagctcggcacacgtcgtacaggatgccggcgatcaccggccgacggccggtggctcgattacgcgcgataatccagctcgtgctgctggttcttgtgatcggcagtggcatcctcgtcgtgccggcggctgggagcaccggcaaaaccggcggcacgggaagcagtggcaatggtacgtacagtacttgctacatcttaaaatataaaaacatttagcattcaaaacttatattaaaatatgacaacttttcgatctatgttgttttctcaaccgatcaaaacactccctcaattattttctttacctatatcgtttccttaatcactaacaacccttcgtcattaatttaagagcaaatttcactttgggccaccttttgttaccgatatttcactttggaccaccatttaagtaatattttcactttggactagataaacctgcctttgtttcactttggaccacccgactctcttctcaagcatatgaaccatctcgattacatcgtctctctactcgttaatgaactaccacagctatatgtaagactatttcttcgacatattacaagttggatgtagattgataaaaaagtaagggtggtccaaagtgaaataaagataaaaatacccggtctaaagtgaaaacattagtcctaaggtggtccaaagcgaaacatcagtaataaaaggtagcccaaagtaaaattaactcttaatttaatttcacatatatactctttttagggagaatttgaaccatgctacacaaattttgcatgccaccctgacccatatgtcattgactcatatgggtcttacatatcattgagatatgggtggcatatctcaaattttgcaaatatagggtggcatggttccaacaaaacccatattgaagcctaaaacttcttatatttcttaatacctaataccttattcaagcataaaaacttcttatattttagtttagaacagaggtagtgtaccattttctttacctgttagccatgtatactttatttaatttggtttctcctagtttatatatggcttgcttactttttttttttttgtgtgtgcaggtcgaccaactggtacgggtggtccgtctaccgcatcaccgtacaggacatatggcagacgggttagtgcggttagtggtttcagcgtaggctagccatgacaggtctcggagggcaatggccgcaggcggcggtgacgaatgctcgtgtcttaattagcacagaagggcacacgagagcagcaggcgcgtatgtcgcatgtctggttcattcgttatatgaaaactatctgaattcaccgtcgaaaattgtgccgtcatatataccgatacgtagctcagtttgttgactagtttctgtaataagatgaatttactattcacggtgtgtagaactgtagattaactatatatatgtgactgcaggctgaaatttattttgatttcagccgaatttctcaccggacgatgctaccatgggttggaaatttcggactgaaatttccgaaatttcggtcatttcggaccactctgatatgatattatttcggccaaaatttttaatatttgttaaaatttaacaaaattttattcaaaatttcaaaaatttcaagctgaaattttggtatttcggtgatgtccaatcaaatcggctaaaccaataggtttaaccctgctaccttgtgctcattccgagcagcctcctgttcgctacacgcacttcatctgttgttttgtcatgttaatgggttgaaaatccattaagctgttttgtcatgtttaacaaaagcccagaacactgttatgttttcctaccacttgtgttttatcaatgaggacataaaattcagagggcaaaatgacgacataattttgcaaatctgaactagaaagaacccaaaacttctgaattcacgagtacaaattatactaccaatacaacagaaacttggataatatggcttgacaggggtctgcgtgctgctccaattgatccccgcaacaccgatcagccgtatcatctcccaacgatcttcttcagccatcagtgtcatgttgttcagagcataattaagtaatggtgaactcttactcagccactatgcattcttgtagacaataattagcagctcaatgcgtgaaaacaatgttatgaataattgtcaaagataagtgtttgttaaaaatacggttatgtgtttctaaacagtgaacaacgtggtggctagcattgtgaggccggtcagaccgggtggctgccaccagtcagaccggtggtgttggtgcgatctgaccgagtagcccgatggtcagaccagtagattccaagagggagtaggttttcggttgttttcatggaatttctataaagatttcttcatgtttatgacttctagatggtttctattcgtatgtgatactattctatgctaatgtgagtcaattctggtatgaacttgtacttggacatggaatttctttgttattcatgtataggtgttgcttgaggctacgggagtatagccgatgatagatcgggactagattttggagaagttgagatccagacggtcaaggatatcacatgggatgctcatgctagagagcaatgcacacggaggaaaatgtttccatatata

SEQ ID NO: 6036 - DNA, 1383 bp, Oryza sativa
gtggtgtcgctgtcgctgccgaacaccttcttcaacctgtcgtcgctgccgccgcagctcgcgtcgctgtcgtcgctccagctgctcaacctctccacctgcaacatctccggcgccatcccgccggcgtacgcgtcgctcgccgcgctccgcgtgctggacctctcgtcgaacgcgctctacggcgacatcccggcgtcgctcggcgcgctgtcggggctccagtacctgctcctcaactccaaccgcctcaccggcgccatcccgcgctccctcgccagcctcgccgcgctccaggtgctctgcgtccaggacaacctcctcaacggcaccatcccagcgtcgctcggcgcgctcaccgcgctccagcagttccgcgtcggcggcaacccggggctgtcgggccccatcccggcctcccttggcgcgctctccaacctcaccgtcttcggcgccgccgccaccgcgctgtccggcgccatcccggaggagctcggcaacctcgccaacctccagacgctggcattgtacgacaccggcgtgtccggcccgatccccgccgcgctcggcggctgcgccgagctgcgcaacctgtacctccacatgaacaagctcaccggcccgatacctccggagctcgggcggctgcaaaagctcaccagcctgctgctctggggcaacgccctgtccgggaggatcccgccggagctctccaactgctcggcgctcgtcgtgctcgacctctccggcaaccggctcgccggcgaggtgcccggggcgctcggccgcctcgccgcgctcgagcagctgcacctgtcggacaaccagctcgcggggcgcatcccggcggagctgagcaactgcagcagcctcacggcgctccagctcgacaagaacggcctgaccggcgccatcccgccgcagctcggcgagctcagggcgctgcaggtgctgttcctctggggcaacgcgctctccggcgcgataccgccgtcgctcggcaactgcaccgagctgtacgcgctcgacctgtccaggaaccgcctcgccggcggcatccccgacgaggtgttcgcgctgcagaagctcagcaagctgctcctcctcgggaacgcgctctccgggaggctcccgccgagcgtcgccgactgctcgtcgctggtgcgcctccggctcggcgagaaccagctcgccggcgagatacccagggagatcggcaagctgccgaacctggtgttcctggacctctactccaacaagttcaccggcgcgctccccggcgagctcgccaacatcacggtgctcgagctgctcgacgtccacaacaacagcttccggggtgccatcccgccgcagttcggcgagctcatgaacctggagcag

SEQ ID NO: 6037 - DNA, 538 bp, Oryza sativa
ctaatgtcaaaagccggaatgttaaccaagcatgtcctctgtaggtctggttgccagcggtcatgaagctcataaatgtagcttcaagcctttgtaatagatccttccctcacacagtaacgaacattgcaaccctttgttggtataggaatgctaagcgactgatcaacgttttgcagcttccatgcacagcaactgtgtatcatgtacaagtggattgcttgctcgaactggtggagatcccgtaaagtatggaggagaagcctgtagattgcatttctagcttaatttggaagcacatttgagcaacagccaaaaaatatggggtaaagagaaaagagataagctaaccttgctcataatgaaatcagaaagatcctgtgttaaatcatactccttatatgacctgaacagcaaaataaatcaccgatgctatgcagttaaaatcaaaatacccgaacttatctgaatatgaaaaattccagatgagaagtgagtgtgtcaatagagtcaaattgaacatgcagaacacaaacgg

SEQ ID NO: 6038 - DNA, 6254 bp, Oryza sativa
  unsure (1)..(6254): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagatgacgacccccagaaggctgctgaactagccgggccaacatacttcgcaatcgatgattgcccggaaaagtacgaacatgggaaagcattcttgccggaatgggcactgaaagaaggaccatgggagatgacaaggttacataccttctacatggaggccagcaagaaaggcttgggcaatataacagctcgatcaccggcagattgtttcgacgaagaaggttacgtatggctagatttctcagatctccacgccatatatcgtcgggataagatggacgtcaactacgtcggtgtttggtgcatgtgagtatgagttttaattaattagatgaaaaatatgtataatacaaatccatgtgattgttactaacaaacttcttctgtagaatgcaatacatggatgctaagaagaaaaaagaacacatcggcttcttggatccaactcggatctgccaaacacagcatacgatgaggctagcaccagggtctgaccagctgaagagcaagaatccaaaagagatagcagaatacaagaagggcttgcacaaggagaaattgattactgtcgcacagtacattggacgagccttcttgcactttcaaaataagagagtcgtcatggccgcttataattttaagtaagtctagtacatttatcttgtatacatatgtcttattttagctggtactaactaactatactgttgttaatatgtagcgatcattatatctgtttactcatccaccctaaagacggaaccgtggtagtcttggaccctctcgattacagtcacaagcaatataaagaatttctaataattttacagtagtaagtgattatgacttttgcatttgtatatgaatgtattataaataaatatcctccttactgtgaaacggtacgacatccatacagtgcataccaatactataagttcaagggtggagaacagacccgaataagggagaagctgctagtacgtacctattggccggtaatactccactcacttaatgtattccaattgattcactaattgcaaattttaactacttttttctatgatatgtcctgaagtgtcacaagcaaccgcgaggaacggtcctttgcggatattatgcgtgtgaattccttagggttaatggacggtacaggactaacgcggaggatgtaagtctctatactatgtactagacagcttcacatatttatgatactaatatattgattaacttcaatgcatgcagttgccaagattagaatgtcgaacaagctttgacgatacaggtatcccaaatgtccagcgtgatctgtgtcacttcatccaccatgagtgctgtcatgtgaaagaagatttcttcgacccagagggtgtcccagcgacaagtgacgaattcaaggatcttcgggagtggaacactgctatgccataatgtaactagataacgttatttgaagtgacaatgtaaaaaaatattgtaatatatatattttggcaatacttttgatttatgcaatatatatatatatttctcagtaccaaatgcttgataatcttccaatatatgtacataataatctacctgcaaaaatttctattaaataatttaaaagtaatttacgggcaaattattattaaatttcaatattttctacctatctttgcaggcggaagtttttttttcaggcggccgattcctattttcgtaggcggaccggactagccaatgtccgcctgtgaaaattatcttcacaggcggacggccgcccagcgatcttcacagtcgttggcttacaggcagacggtcgccccgcctgcgaagacccttttcgaccgcttgcgataatgcttttcctagtagtgtactctatgctcatcatttaatcctgatcccaacattttatttttcatatttatccgtaccaaactcttgacgtcacttgcaacatgtaccgtacgtgcatgcaatgtacgtacacaccaaacgttttattcgttattactttgtttattattcagtcctgatcgatgagccgcgcagcatgtgtgcatgtaactcaacagtaaaggttgccacccgggtcaacgccgaattggcggcagtagtctttgtagtagtttacccttgcgttgacggcgccggggttcttgccgttgcactcgagcgcaccgttgatggcccggatggtggcgccgaacccctgcaacatcacctggtgcacgttgttcatccagaaccagagcgccgtcttgaaggagatcgtcgggtcctgcgccaccctgtccgggtccctcagcccgtcgaacccgatgttctgccccgcaggcccgtagttgtagttccacgagatctgcagcggcccgcgcccgtagtacttcttccccggctggcacggccactgcttgttgttcttgtcgcagtagtccatgctcgccccgtttatctcgttgatgtagcacatatctgcgagtgcattatcatttatcatcctcattagttacatgcatatatgtacaaataccaggagtatgtaattaaatattttccttacgtccggtctcatgagtgacgtgggcaaagaaggcagcgatctcacgcttggagtcatcgttggtgcggtccctggcgaagcccgagtaggagtgggcagcgttaagaaacgactgtcgtgtgtaaaagttcttgccggcgcaaccgttcggggcctggttcttgatcccattgaagaacgcctcggtgaccacgctctctacagacacgccgctgcctccgcctccgcctccaccacctccgcctcctcctcctccaccgccgccgccgccgtagcacgggccagagcggcacccatctccgcagtagtccttgcccgtgccgcagtacccccatttgctgcagcacatgttcgactggcagccgcagttctgcgcgctcgcctggccggtggcggagaggaggagcgctagcccaagagccaggaacgccagcattgtcggcgtcggtgagttcgccattataggatatggtgtgaaagaggtgatggttgattagatatcatgatcaccagcccggcttttataaaacgagcgccagcgtcttctctacatacgagacatccgtcgtgtacttgtggtgtacttgtgcgacttgccaaactaatcgagaattttagcatatcccaatacttgtggagtcctaggacactagcgtgcgcgctgcggttgctgcggcagaagggaaccgcgcgtgcgccgccataatggagagaggttgaaagtctgcgacccggtaccttcctatccggtggaattccacgcgaagccgcggtttaatgccactatccgctcgctgtatattggccatatgaatcacagtgtgtcagcaagctagcatgtgaagatttatggtggccttcgtattcaacaatcgactagaacgatcagtccagaaacaagacttccacgttcaattgacaaaaaaaaaccacaagaagacgtactacgtacgtgatcgttgagaggttggtttgcggcatacaacgttccaaacttggacgaactcatgaacgtcggaaaaccagaggaatgtctggggatctctgaaaagtttgaactctgaagttcattatggatcagctccgtgaatttgggccttgagctgtcacggcatgatagggcatatcgcctctcttacccgagtctgattcacacccctgaatcacaaaactagatatagaagctccctaaactattaaaactggcttatttttgctctccgcgggatggtttgaataggttttgtcctatatggtccttacatgatattatagtcaacgttttttttttctgacgtggcatgttaacttggttaacctgtattgacgtagtgctaaaaagaattaagagaagtttgtgggggcccatatgctagtaacatggaaaaaaaaggagatgacggtagcccacatgtcagagagtaggggtcggtgagctcgagatcgagagggctgaaacttgctatcgtccgaagataagagaaagtggtcgcaatgggaggccaccacgccagatagttgctgcccatccctctgccgccgaagtgttcgtgtttatcagccaaatctgtccaaactcatgcccgtcgtccgagctctgtagttccagaggagtgtggaaaatattgaatataggagcaaccgtaataatatgctctattccattgtattatactagaaaaaatattcgtgcgttgcaacggattaaaaacaatttcaattatatatagactgtggtggataaatagttgaatatggcatttgtttctgtttttctttatccactctaaaatgtatacgtattggttatgagccttattcctatcctctccacacggtcaacctttttacctcatctatctttagtcctctctacagatctacacacggagttgtacggcggcgagcggcagcgtgaatgcaaagcaactaaggttatgttcgggaggaggggccctcctatccagtacacaaaacgaagcatacattagcgcatgattaattaagtattagttaaaaaacttttaacataaattaatattattttgttaaaacaatttcctttcatattttttttaaaaaaataccgtttagctgtttgagcgtgcgcccgaaaaataagagagataaagttatgaacaatgaatcccgaacatcgaaccttgggttcgtaactaattcctcccgcacgaaaaacaatgtggctcattagcgcatgagtaattaagtattatcctaaaaacctgaaaaaatgtattatttcgatttttttaaaaaatatatagattctttttaaaaagcatcatttaataaaatgcattattacgatttttttcttaaaaaattctatagactttctaaaaaaatacagtgtttaattgatcggggaacgtgcgcggaaaaactgaacaacataagttttgagaaaggagagtgttgaacgcaggctacggaggccaggagtgtttgagaggggagagtgtttgagaggggaggaaaagagaagattgacaagatacgtaaaatgatgtgagtcattagcacatgattagttgagtattaactattttaaagttaaaaatggattaatataattttttaaagtaacttttctatagaaaaattttgcaaacaacacaccgtttaatagtttgggaagcgtgcgtgcgaaaaacgaggtgttttctccctcaattgtgtagatcgaacgcacccgtccaacaaaaaactggacgtttcaccgccccagcactgtaaaaaaaagtgtcattttagcaatttacaaagaagtggtggggccagtttattttggtggaaccagaacataccgagtttttttcccaaccgtgatggcgtctcgtggatggatgagccacacgcgtccggtctctctctcttcttatcgcttccttctcttctctccctctccatctccactgctctgaaatttttacaatttggtcctttttgaaaacttattttacaaatagacccctggaaaaacttaaaccggaaatggtcttttttggggcgccagagtgtctggcgccgtaccccaacatggcgacgccagccacactggcgccgtgcctgtgccaccgtggcactagggctgtcgtggaggtgctgactgggcagaaagggggcgccagccacactggcgccgcccctcataccacggcgccagcatagctggcgcgcccctcctctgtgggccgacccttaaaccccgtgggccccaccacctttctcctccccactcccattttcgccattcccagcccgagcagcgagctgctgttcttctccctctctctccccctcacctctccacctcaaatccactcaatttgaagccgtttttcgcgggattttttgtggaaatcgaagagaaaggtagactctttcattcccccctcttttttttcgtttttattggttgaatttgtagatcggtgggtaaccctagaacccactttttacccaaatttgtaatttttagcatttgttcttaggattggcttgttgtagtgctacatgtttgcaatgtactcattggtgtcatgatttttttaaccatatatgtggtaatgttaattt

SEQ ID NO: 6039 - DNA, 657 bp, Oryza sativa
tgtgtggaatataggatggactttttgcattgtttgatgtgtgggatatgtgatggacttttggtattgtttgatgtgtgtaatatgtgatggactatgtgaggactatgtgatggatttttggtattgtgatttgtgaaattggaacctgttttagtgtgtaaaaatttgtgaattgtgatttgaaatgcgaactgtaaagtggtagatttgtccaatatggatcttcaatttgcagggaggcagagggcggcgccaaccacctggcaccgcggttgggaagggcggcgccagccagtgccgcgaggcagaagggtttcgggctggggggcgctagctaccctggcgccgtggtccatgagggcggcgccagccgaggcccggaggcagaagggcttcgatggggggaggaggggggcgccagccaccctggcgccgcggtcgggggggcgccagccgttgcctggaggcagaacagacttggcgaaaattttgggggaaggggagaaagttggtggggcccgcagaggaggggcgcgccagccatgctggcgccgtggtatgaggggcggcgccactttggctggcacccccttcggcctagccagcacctccacgacagccctattgccacggtggcacgggcacggcgccagt

SEQ ID NO: 6040 - DNA, 2617 bp, Oryza sativa
tcggctctctctccatctccaccgcgcagacgagcgcaacctagcggtagcgcaggtaggggctcgtcgtctcctctctttcttctcttcttctcccctcggctctctctcaccctcccctcgcctttctcgcgcgtcagtggcggcccagcggtggaggcggtggcggcggcgggaggaaaggcgacgtcccagcggtggcgccctccgcagaaggggaggcgggggcggcggcggcgcctcccctccgccagatctagccgggagcggcgacccggcaggaggggaggcgggcggtggcggagggaaggcgacggcccggcggcggcgaacgggagcggaagcaaaaatcttgtgttcatgtgtgttcctgtgttcatcttttgtgttcatgttgtgttcttgaagtgaaagtaaaattgctcgatgcatcggctcgatgcgtaatggatttgtgcgaattttattccttttctttttctgggattatcggttggtgtagttcttatatttgaaagtgatgattgcttgattgggcttttaatctatctttgattttgtgatttgcccgccgtacgcgattaggattttgaatcgatctctgattcttctgtgcattggccagcgtatgcgatgaactaatacggatacgaatacaaccagggatgacgtacggaaatttgtgacaaaaacatcttaaacttttattataggtaaagataaagataaagattgatcgtctcagagaaagatttgtagtacataataagtaaaaatagatttatctctagaattattttatctctgtgattttaattcatgcgatatattactccacaaatataaaagtttgacgtttgaccatgtccaacgtttgaccgtgtcggatactttatgcatgacttatctttttaattttttcataattttttttaaataagacggacagtcaaacgttggcacggaaatctgcggtttgtctttttttttgggacagagggagtattgaatagtatgccatagttccatatacgaatgactcttgtgtcagctagctggcatggcatgtgaggatttatgttggcccttcttattgtattactattcaacaataaaaaagattgttcggtcagaaacaatgacttacacgtccaattgacaagaaagacggagagaagacgtacgtgactacgtgcatgtggattaggttgcgacattcaacactcgacccagtgttgagagttggccgtgaaccacgcaccgagttggaagaactcatgaacggccatggattgaagtctgaactctgaagactgtcgggcactcgggctacctctgaaactggaagctgaactctcaagtccatactaggattacgtccacgatatgggtcttgggcccaaggcgaaggcccatattgagaagcctagtatccttggatgaacttggcagggatgcccttaaaagtgtgacaccccaaacggcccaatgtccaaaacaacgattgcatcaagcccacatttatgcttctggttagatatgagcatgtggcatcaaagccgatcttagttcttacatacctcactgtttgagtggcggctaatgggcgatccatcgcccagcgatcgcatccccccgcctccccaatacgcgaccccagtcctcccacttcttcccttcctcctctccttcttctcttcctagtgcagtaaaccaaaaaaatttttaaaaaaaacaaatagttagaaaaatttatgtatagaaacactatatataaaaaatttgaattcaaatttgaatttgaattcaatttgaattttcaaattcaaatttaaatttgaattcaaattcaaatttgaatcgggtatgtaaacttttaacttataaactttggatctataaaatatttgaattcaaattcaaatttgaatcgggtatataaactttagttctataaactttggatctataaactttagatgtatatagaaaatataattcaaattcaaatttgaatcggatataatttaaattcaaatttgaatcggatataatttaaattcaaatttaaatcagatataattcaaattcaaatctaaatcgggtatataaacttttgacttacaaactttagttctataaactttaggtgtataaaatttagatgtataaaatttagatgtatagaaatattatatataaaaaatatttgaaatcaaatttaaatttaaatcagatatataaacttttggtctctaaacttttgatgtgtaaacttgaggtatataaactttaggtgcataaatctataactaatataaatatttgtatttttccagtcgtcacatctttcaccccgcacctttttttttcgtccgtaaccccttttttccatccgtaacccttttcacaccgtgttttccgttttcccaccgctccagtttgcgcgtattacacacgaaaaaaaaatcccataccgattcctactcaaatttaccagattaagcccacaagcccaaattaaaaaagaacgcatctactaaaaagagcccctgcaccgattcctactccaattttatcccgattttatgttgagtcatgctattaatattacatg

SEQ ID NO: 6041 - DNA, 56201 bp, Oryza sativa
gcattcatatcatcatatgtgaccacagagtttcaaaaaatattcaatactacaaatcaaaaatgaaatcatatctgcaatccttatgttcccaaccccaggttatcattgaactcaaccctaaatgcagtttcaatttcattagatttatgagattcaaatatgttatgccatactcattgaatcagtatatataacatgaactactacttaatcaagatcaatttctgttgcattcatatgtgaccacagagtttcagaaaatattcagtactacaaatcggggatgaggggagggctgcaatccttctgttccccaaccctatgtctcacatatggagtatgtaccatgttaattgctgttaaaatcagatccatgaaggcaccaaaaacggtaggaaaaacatatttttcgttttcttcctcagcaatgcataccaatcgcatgaacttaaaataaaaccaatcatcataaaagcaggggccttggtagatttgtaagagcacgcctcatggaccaacaacaataatttccaagataagataaaacaaggagacaactcagatggaactttcagctcacctgttgatcattgcaggcacattctcagaagaaatgatcacaactggtatgtccttcaatgaagatgacacttgtacccccaaaatgaggagcaaaaggagcaaattttactccacttacagcaacaaaggacccaagatttatgaatgctcacaggataagaataaattcaatgcaaacaaaacttaccttcaccctcttcagtagatcatactgtcatgccaggcatgtagtagtcagtgattatcacgttgacatcaatctccagtacaacagttcaaaaaaccacaggattgatttcctggatagcaagcacagcataagagaattctaaaggaacacgaaacaaataaagaacaagatttcattcactgacctgatggtcaggtgaggaggaagaaggggaagaagaggagacgttgctctcatccctcgatccatgcagctccaaggccttgctcccagaatcaaaacatgcaagagcaacaaaggttcacaacaagcacaatttggtgctgaaaagtacagaatggtctacatatttgcactgtcacatggaatgcaaaaggtgagcaaatgcctaaaagatcactgtaatgcattaggagtgattagatgaattggtgtttacagtgagaattcagcaataatacacctaatactaccttaaactagacttaagtactaggttactacacctaatgatttaaaagcatgtactgaatttagtcatcaaacttttcaccaaacaagtgggttgatggtctgattaatgataggaaatgttaaataatatagctagggacctggccctgtttttcctaggccgacataatttgtgtgcacacttttaaacaccttgatcggatatgatccatttgaatggttgtactctagctttacaattaaatctgaccaaccattagagaaccctcttaagcatagcatataatcctataaataggatatttatatatgctgatcactatgtctatgcatgtccaacagctcccaacaagagactacagttcatttttacttttacaggtcgattgatgacgatcacgtcgatttaaaagaaaatccaaaagcacatatggttctccatgatgactactggtgaagcatgctatatatttggcttagattttgtcatttataggtgcgtagatgaagcttatgcacaattagcatcatcatgatctacataccatcacaatatgtaattagtactacttgccacaaagctctaaaagccaaaaagttactaaaagtacatatatagcccagtctggccaacaatatcacacagagaacaattgacagttctcatactgacatgcatccatattcttccaagaaaatgaggaagaaaaaaaataactcctgtgaataatatagcgtactccagtaagcgtatatcaacttccggacatgtttaataattgaaactatacatacacacatactactagctaaagcagtaatcaagcatattgtgtaccagcagttgcgggaggggaagaggtcgccggatctaaccctctcgtcgtcgctggcgacggatccgcgcgagaggcgggcggagagaagacgggacacgtgcgggaggggaagaggtcgccggatctgcccctaccgtcgccgccgacggtggatccacgtgagagggggccgaagagtggacggtatccgtgcgggaggggaagagtcgccggatccgcccctcccgttgccgtcgacggcggatcacgcgagcagaaacgatggcttgaaggctcggcccatcccgtcatcgccggcagcggatccgcgcgagcaggggcagagagacgacgagaggtggagagagaacggcatccggttgaggagggagagagaaagagagactgggagagaggagagagtgggggagagtaaacgagagagagagcctggaagacataggagatactactaggagataacgaggggagagaaaacgaaagagagataaggctggtctctgaacaggcaaaccgatattttctctcctgggtaatctaggtattcggattattttttaaaaaaaatacgactacaacccagttattaattgctgtcaagtttttttacattgtgctaatcctccgaactaatttacacgcacatacgagtgatattattttttaattcttgacatcataaataaaaatattgtcttacgacattaagaaatagatttttacttatgttgtaccactaagaggaagttgttttttctccatctttcgttcttcatacgcgttcaaggaaaatggaatcctcttatatgggaacatgtttgacccactcatccagtcgtgttcaccatcagagcttgtcgttgtcgttttttctctaccgggaacacattgttgtaggctccgttcttgttgtatggttttttcatcgctaacctccaccatatatggatcaatcacatctctaaccttataaaataactataatcattatcataacattagtttttttttctttgcaacacacaggctcttttttagcaataaaaactccccaaaatcaaccggaacttcactgcattttcacatacatacatagtagaacacatgtactccctccgtcctaaaaaatagttaactcattatgttaggcttatttacttaaaagtatatcaatattttcattcgtcaaacaaaattctatatgtggtttcaccatttgttcatcctatgctgcaaccatcgggcccacacgtcaaaagcatcatccacaccccgtaaatataaagcaaatgaattgtcaagaataacacgacttttggtcaccgtacacatcgccgatgcttatgatcatgctttgataaatcattaagaccaaatttcagtcaccccaccatcagccggtgcaacgcacgggcattgtgctagtttactaaaataagaaagtaatgttgtcggtgatatgggcccgggggtatcatgtttagagggaggaggctgcccccaatgccacgtggccctcccccgaggggagtgaggcctgaggtggggtgagggccactctttcccaaagactagacagaggaggctgcccccaatgccacgtggccctccccggaggggggtcgggcccgaggtggggcggcggccactccctcccaaagactagtcggaggagactgcccccaatgccacgtggccctcccctgaggggagtgaggcccgaggtggggtgtcggccactccttcctaaagactagtcggaggaggctgccccccaatgccatgtggccctcccccgaggggggtcgggcccgaggtggggcggcggccactccctcccagagattggacggaggaggatgccccccaatgccacgtggccctcccccgaggggggaacgggcccgaagtcaggcggcgaccgccccctcctgtgactaggggtcgggctcccccgatcccctctctaggtcaccacgtacggtgggttaagtgtccgcctacaggtgcccacctacccgcatttatggcgacccaagcggtcgcgccacgcccgtgcggtgtactcaaccggtctgtgaccggttgaatgaccgatgggactgggtagtgcgcctgtgcgctgctcgtgtgtcaggcggcgtgcagcctgacatgtcccatcaaataatgatggtgagaggttctcatcctcttatcccagccggagtcggtcctcccactctggtcaaagctaggctcccgtttcccagtgtaataggagcccagaagttttcacccattaaatggtgaatgacatgggcgccccccgtgtcaggtggcatggtgtggtaggccccacgaccgaggcgacgtgtatgcggcttccaagttaaggaacaagacatgcatctaatgcaaatattgtaatacttctcgacgaagttagggtgttgggcctatgtggtaaccccttgagatataaaaggaggtccaagcctagtaagaggggggaacttccgagcgaacgggcgcttgagtcttgcaaccccaaacacttgtgttctccactcaatcaatcaaacacaggagtagggtattacgcttctcagcgttccgaacctgtataaatcccttttgtcccatcgtctttgggggattgaaccccctcaagatcacacagctttgctcaccaagccctcgaatctcacccgctgcccccggccgaactctcaaaggggggcctcatggttccctggtggaggagttcattctccgacaaatgcgatgccaaaaaaggaaacaggtagaaggagggaggggaaggtgggagcgaatatgattgctaccccctccctagggcgagcgatcgccaaacagcatttccagttggcagcttggcaccaaaatttgaccagcggcatgtgcagactgaagatacactttgggcgataaaagacgttgaatgcctgatcttttttaattcctccacaaagcactaactagcagcatagaagctgacagccggcaaaccgaaactgacggactacaagtcgtagatgctgccactctagcaaatcagatccacgtgaacactaacctgatcatcgatcaagtaccccccatcaacaataaaaaaccccatctcttaataatcgcaaaaggggaaaaaaaaagcattcatgcacaaacaacatagagccgacacggcaaattaaggacgcacccacttcctgtcttcctctaaacgagaaaaaactaaacaccgacgggggcttaatcccccccgcgccgccacgtaacgccggccgagggaacaggccgaacagaggaatccttccgttgcaacggccatgcgatacggggcatgctgcacgtgatcgcatacatgagccggttgcgttctgccccggttgtttgctactcgcgtccacgcgatcgatcaaacgatcgtcagatcgaatcagggacagtacagtacagggagtcgctagcgtgcccgcacgccgacccggcgcgtcgcgcggcgcccaatctgcccgcggcgaccgaggcatgcatgcatagcccgataggcgatagcccatgggcttcggtttcgctaacgcagtacagcgtcgtcacctataaatgcaaggcaacagcagtacagcacccgtcccggttaagctccgtcccaggtaagagctagcagctcgagagagcgcaaaaaaagaaaaaagaaaaccccaaaactccagagattaatcggcagagctagctgtgaccgaggagaagacagagcagccgaatcgaagatggcgttctataatggcgcgagtgttgtcgcgctgctgttgctggtctccacggctgctcgagctgccggcgatggtgagagcgtcagataatgctgcattatgcacttttacagttttactcctgaaccatattagcttgcttcagtgcttcctatggaatttccgcaagattcctaggagtaatttgccatccactatctaggtggcaattctttgccatgaactagatagtactctgaagagtaatccctgttgttattgtcatgatgttcttacttctcggtcattcagttaagcagctagcctgttagtaaaactatcgaactgtacctgcaaaacttccttgcagataaaaccaaaatgtatgatattttaactgtcttttcgattgactaaggcagcctgaagaagaagaagagttagtaatttctagttgaattggtcccctagctatagcaatggatgataaggtcacttccgtttcattagttctagttcttaatttcaatcaggttttctcccttatctatctaaaaaaatagaacagatgagattttcctttcatttaggaaggcaatgtagggtagttcttatctgaaacattctcattttgctatgataactagaactaagtaatcatttagggaggatgaaccccagcttagaaactagacaatgtatagaaataaggacagcagcttcttattcattgaaatgatatccgtgtgcactcttcttaattagagtatcactaatcccaaaaatgccagcgctgacttgttagttaaggtgacacagaaatcaaatcaaatctctgcattgtcacgtgcgtaggtcttctgttcagacacaaagaactgcaaaatattagaatgagttagagtaatttactgatgtaaagaatctcatcacgtgagacctagatgctacttaatattccataatcctaacatgaaacaagaacgactttcaagtttcaactgccgtctcgtggatcatggtgaaaacatgggaccatgcggccgttacaacttacaagcatgggtaaagcctgaagtagtgataagccagtcatctacacttgcttgctgatgcatgttaatgttttgttaccataacatgttataacttattcgaaatcgtcatgatccactggtttatcatagtatatcagcgcgacttaactggttcagtataaccgtgccaagtactctctgaagagcaacctggcacgatccaaaaactagaatttgcttacacgagtcatgtcactcatgcacaatgcaggcctgctgctcaacggcaacttcgagtaccagccgagcaagtcacagatgaacggcacaagggtgatggcggagtacgcgatcccgtactggaagatcaccgggttcgtggagtacatctcgtccgggcagaagcagggcgacatgctgctgacggtgccagagggcgcgcacgccgtgcggctgggcaacgaggcctccatcgagcagcagatcagcgtgacccggggcatgtactactccatcacattcagcgccgcgcgcacctgcgcccagtccgagaagctgaacgtgtcagtggctcccggcccggagtccggcgagctccccatccagaccgtgtacaccagcagcggctgggactcgtacgcctgggcgttcaaggccaagcgcggcctcgtgtcgctcatcatccacaaccacggcgaggacgacgaccccgcgtgcggcccgctcatcgactccgtcgccatcaagaccctgtaccctcctcaggccacccagagtaagatgcatcgtcgaacatgcggctagctatgatgttcgatccttttgcgattactgacgacggacgaaacttgactggtcgagcagacaacatgctgagaaacggggacttcgaggaggggccgtacatgttcccgaacgcggcgtggggagtgatggtgccgccgatctcagaggacgaccactcgccgctgccggggtggatggtgatgtcggacacgaaggccgtcaagtgcgtcgactccgcgcacttcaccgtgccgcacggcgcgcgcgccgtggagctggtgtccgggctcgagacggcgctgatgcaggaggtgcgcaccgtgccggggaggtcgtacaggctggagttctcggtcggggacgccagcgacggttgcgtgggttccatgcaggtgaaagggtacgcgggtcaggggtgcacgaccgtgacgtacagctcccagggcacgggcgggcacacccgcgcgtcgctggagttcgccgccgtcgcgaacaccacgcgggtggtgttcgtcagctcgacgtacatcaccaagtgggacgggacgctgtgcgggcccgtcgtcgacgacgcctcgctcgtgtgcgtgtcccagcagcagccgcccgctcgccgcctgcttcgtctctgaaatgttgcgctacacggagcagttcgcggccggtcacatgtactcgcatggcgcgttggaatgtgactgtgctgggagtagcagtcgacctttcttcgaatttgtttcattttgtttgagagtgatgttcgaaatatctgttgaaaatttggtcataattcggcatattttaatctaaaataacaagataataaatatgatatttacaatcaacatgagcatagtggtgaatgtaatcaacatgagcatgcttaatgtagaataagcatcaacgtaataacacaatgttgacattgcgatgaacattaacagtaaaacttctaattaaaataatgtaagaaggttataccccaagaatggtcctccgctggagtttgaggctatattgcctccgttggtgttgacgggagcctccttctccttgtatccagtgttgctgttgtctccagtgttcgacatattagtgaaggtgaagtagatgttgacgaacagtgagtagtcacgccttgcgctccccaaaaaactgatcacccgcccgtccgtgcaaacgtcgcagcagcgcgtggtttcggaggcctactctcccaacgcgtgtgcacatacgtcgggatgggattaccgtagcagcaacagcgttggaaaatggatgaaagtgtgtctcacttctctcgcgggagatcaaatccattctcattttataagaggaatggaagatgaagagtaagagtcatggaataggaagaggaatagagtaactaattctcatcaattaagccatcaaccatcctccactacacaaccatcgaccaacaatcaattaggagtaattgatgtaagttaccaatggaataggaagaggaatagagcaactaattgtcatcaactagccatgaaccatcctccactacacaaccatcaaccatccatcaattagaactaattgatataagttaccaattccctaatcaaatggattaattctcaaaactcttcatcccattgatatcccataaaagaatgaatacacatgaattcctagcataatgagacttggaatttatttgatttaattgatttaaatggatcaattacccaattaaatctaacaatccccaccaaattccaaggctcatgagaatgctctttattccatagcagcttttatataccagtgtttcagtgaagactgttaagttgaactttcacctagaaaaggagctacacctgaccacaactgaacaatggactatgccttgaattgtcagtcttgtgcagttaggtttcactcaattccataactgatactaggcaaccgttagtattccctcgggttggagcttataagtcatacttcaggcctttcatgagtatctagagatcacccaaatctcatagactgtgactagcagtcgaactcatatagttgtgttccttctaagatattctgcaggtcaacatctctgcttaatgaaagccactcggaacacattgaggcatacgccatcctaccatacagaatagaagagaagtacatcatgaaaatgagcccatttaagggtctcttctctcggttacacaatagtttgtttcgccatccaaattcacgggatctccgatcacaatggataggtttccactattgtgcaactctaagtgggtctcaagcccatttccctcgatgcactatctatcacattacgtggtagccccttggtaaactgatctgctagatttttagctgtctggacatagtccagtgctatcactctggagtttttctgctttctaatagatttcagtcttctctttacatgcctaaatgacttcatattgtccttcgaactgttcaccttaataatcactgtttgattatcacagttcattaggatagttgtgtcacgcccagaaatttagcccaactttctagactattttgtgtattaaatccctgtccaggaccagccagggtacacaaaacgacaagtaatatacagttccaaacgtaaataaagcgtaaaatacttacagaagagatacttagtcctcacaccgaaacaaaagcagcagcagcggaaaaaggcgatcctagcgaggcttcagctccactccacaggcaaaactcaactggggtctaagccttggtcttctaacttcgtcttcagctcagaagcactacacttctgaaaaggaggaataatagcaaggctgagtacaaccaccgtactcagcaagccacaccaatgatgcagacgtgcaaggggatacaaggatggcttgcggctatttgcataaaggcgattgtaaaacattttattgagcaaaacggtaaaactgttgagtaattaaagtaatattaaatctccactgattaaagctacaccacgttgaacaggcccaaccaacccacctgaactacagtgcattgggtcgatttattaagtgtgagactaatcacggtgattctggtcgatcgcccataaccgcgggcatgactattcgaatagttttactctgcccagaggtgcacaactgtacccacaagacacaatccaccggcatgtcaccgtgcccggccggacacgtcaccatgccgagtgattgtgacaagacacttcatataacccgctctgaccaagcacaccacacctcaggtttcacccccgcccccagcaggtagcgggcaatcccctctcgtgcctaggtaaatccggaagtgacagaggccgtcgcagggcccgccccgctccatcacgccacccttgcctggatgcgtcagccagagaaaagctatacttcaagtcaggcagttacccattcccgcttgtggcaagcgctgtatgtcttccagtgcatcccgcgaaccggtccttacttgccatgggtgcgaccagcaaaatcatgcaaccacagcccaccattcagtcgtattttagttggataattacgaccatgaaacatggccggatgtctcgagcacgcagctcatcatgatactaacatgtctaatactgcaattatcccatctactgagctagtggtaattaagcatggctaagcatatagttctagctaggtcatcaaagtaacacaagctagtcgatttatcacccaagattgacaaaggacagatatcaaataacatggcacaagcgagcagataggtaaaccctattcccatgtaattagcaaaacgaagcatatttatttgcaaacaataaaacatttataaatttggatcaacatgctcaaggggaatgtgtgacttgccttgcttcttcaaacaatcttccgaactcttatcattgcgaccgcgatcttccgaaacgacggattctacacgctggcacacaaaacgaggaaaaactctaataaaaaccaaggaaacagtacatgaaaagtaaacaaatatgtagagctcaattttagatgaattttgcaagttgaatggctcaatttggagctcgaatgaattagatatggattttagaagttttgagagctcgaatgaattagatatggattttagaagttttgagccattttaatgaatttctagaattattatcgatttattgcgcaattaaatcctttatggcatcagccgagaggaagggatggcgccgacaagcgggccctacccgtcggtgactcaagggaggcgggtgcaccgtggaccaagtccacgcacgcgctggtccgcgggcgcaccacgtggcagacacgtggcggccacgacggacgggtgggcggaggtggcgccgacgtggcaccacgagggcacccacgcagggcggcacagggaggccacgtggacggcccagatcggctagggcggccgatcgagaggtcacgggcaggcgcggcgcggcaaaggggccgggcggccgtgggcgagcagggcggcggcgaccgaccggaaagcggcggtgctcgacccgatggtcgccggcagcgggcggcagcggcgctggaggcggcggcacacacgggaggcggcggggaagggagaggggctcaccgagacggcggagacggcgaggcgaaggcgggaaggcggccgacgacgaggattggcggcggcgcttctcgggttggggtcggggacggcgctctgacgactcccgaccgctgcggaggtacggccgagggccagcaggacctggggaaggggatggcgggattaggaaggcacgaggagactcccggcggcgtgaatcaccggccggaagaaagaaaaacagagggtgctcaccggtgtgcgatggaggtggagttccggcaggattcgggcgacagggagcggtggccgaggacctcctcgtccttgcggagccgagggaggcgacggcgtgggttggcgacgaccaaagcagcgggacgacgcagctgcagtcggcacacggaggtggtggctcgggtcgacggtggaggggtggttacggtggcgatttagggaaacgaagcggatgccggtatgtagccaggcacagcgaacctttcggcggtggcggcgcagcgcggtagcgatgggggtggcggtggcgagcgactcgaggcgacgagaggcggctgtgactcgggtgcacggtgaaaccggcgcccgggtggtttattgcggaagcggagcggtggacagggtgcggcaacgcgcggcgaggccggcggcgcaaacggcgcggcgcaggaacggcggcagcggcggcagcagccggctggagggtcgctggtgagcggcgacacttgggctcgcgtggggagagcgggagagagcgcggggagctcaggaaaaatgggaaagtggaagaggggaggccggggatgctttttatagcctcgagagtcgacggggaggccggttggtggcagatttgaaggggaaaaggggcgctggcgacgtgggtgagtgggctcggggtggcggcggttttcacggggagtgggggaagaacggcgcggacgtgggcggagaccgcgcccacgcacgcgcgggaaaaggagccgcgcgggagaggcggcgacgtgggcggcgcgggcggtaatggcggttgccggcggagtgcctggaggaaggagatgacaggtggggccgcgggtcccacctgtcagccagaggaagagaggagaccggttgggggggaatgcagactttgagagagagggccgagcgggccgaggaggaaaaggaggccggcctggccggatggggggggatggaggaaggggtggattgggccgaaaacggcccaaaaggagaggatgaaattttaatttgttttttctttatttaaattgattgaatgaactttgtattattataattatttcttgagctccgaaaattcacgggaaaatttcagagaatatttagggcacaaagaatattgcaaaatattctcggccaatgatttttaagggaaaattttaattatcccattatttcacttgattaaattgctttaatttttatttaatttctagaaaatgcattattaaatgatttttaatcccgaacaaaaatcggggcgttacagctggcacaggtttttcaatcaccggcaaatccatcaggagttcacgaaagccactcggcctcaactgtggcagtatctagtgctgtgagttctgcttccattgttgacctcgttaagatggtctgcttgcaagacttccaggaaacagcaccacctccaagtgtgaacacatatccacttgtggcttttatctcatcagcatcagatatccagtttgagtcactatacccttacagtacttttgggtaactagtatagtgaattccatagctcgttgtatcctttagatagcgcatgaccatttccagagcttgccaatgatcatctcccagattttaaacaaaccggctcagcttgctcacagcaaatgagatgtcaggcctcgttgcactagccaagtacatcaatgaaccaatgatttgggagtatctcaattgatccctttctattcttcggtttttccttaatagcacactggagttataaggagttggagctggcttgcagtcactataaccaaagcgactcaaaaccttgtccacatagtaagattgcacgagtgtaatcccaccctcatctcctctcagtagcttaatgttaagaataacatcagccactcccaaatccttcatttcaaagcttttggacaaaaagtccttaacctcctcaatcacattgaggctggttccaaaaatcaatatgtcatcgacatataaatacaagatcactccctctcccccaccatagtgatagtacaaacatttgtcagcttcgttcacaacaaagccagcagatgtaagtgttgtgtcaaacttctcatgccattgcttaggtgcttgcttaaggctatacaaggatttcaacagtttacacaccattccctcctgaccttctagtacatatccgtctggttgatccatatagatctcctcttctagctctccgtttaggaaagctgtcttaacatccatttgatggacgagaagaccatgagaggcttcaaaagcaagtagtactcgaatcgtggtcaagcgggcaactggtgagtaggtgtcgaaaaaaatcctcgccttctttttgggtataacccttggccacaagccttgccttatacttttcaattgtaccatcaggcctaagctttttcttgaaaacccatttgcatcctacaggcttgcacccatatggacgctcaacgacttcccaagtaccattagacataattgagtccatctcactgcgtaccgcttccttccaatagtcagcgtcaggagatgaatatgcttcttctatggttcttggagtgtcatccacgaggtatacaatgtagtcatctccaaaagactttgcagtcctttgtctcttactctttcgagttgctacaatgttatcctcctcaggattttcctcagccgtttgatcattgtgttctatcggtgcaaaatgctcatggggtaaaacaggttcttgactagacgtgctaagtgtatttttcatgggaaattcattctcaaaaaatgtggcatctctggactcagtaattgtaccaacacgcatgtcgggtactccagagtttactattaagaacctatagcccacgctgtggatagcataaccaaggaacacagtctacggtctttggtccaagtttacgctttttggctataggtatatttaccttggccaagcagccccatgtgcgtaggtatgagagatttaatttcttcctttcccattcttcgaatggtgttactttcttatgcttcactggaattttattcaggacatgacaaacagtcaaaattgcctcaccccaccattccttggaaagtcccgcagtgtctaacatggcattcaccatctcagttagagtgcggttctttctttcggctaccccatttgattggggtgaatagggatgcgtcctctcatgaataattccaaactttttgcaaaaggacgtaaactcattggaaaaatactctccacccctatcagacctcaaccgtttgattttcctttcaagttggttttctacctcagctttatagatcttaaagtaatgcaatgtctcatcctttgttttcaataggtacacatagcaatatctagtgcaatcatctatcagtgtcatgaaatatttctttccccctttagtcaacacaccgttcatttcgcacagatcggaatgaactagttctagtggtgccaaatttctcgcctcagatgccttgtgaggcttgcaaggttgtttcaattgaacacaagtatggcacttggaacctttgaccaaagtgaattttagaattaaactcatgttagccaaagtcacgaatgccacacattggactcatcattctcgctaatatggttcacaacattattattattattacacatgtcatccaaagaaaaacggaacagacctccgttgtcataaccttttccaataaaagttcaatatttagatatgacacatttattgaattcaaacacaagtctaaaaccatctctacacagtagagagccgctaactagattcttctttattgaagggacatgctgcacgttcttcagctatacggtctttcccgaagtaaacttcagatcgaccgtaccaacaccatgaacagccgcaagcgacccgtttcccatcaacaaggaggaacctctcccgacctgataagaagaaaacagggaaatatcagcacacacatgaatattagcaccagtatcaacccaccaatcaggtgaatgaaaaacagagagaactgtaggtaaaaaattgtcgtaccccgatgttcctccgccctcgctaataaccatgttggcagacttcttgtccttgcgatcaggacaattcttggcccaatgcctaggcttaccgcacacaaagcagtcgcccttggcctttcccttgcctttcttcttaaaattggttgtagcctttggtttgacatcagacttgactttcttgttgttgttgttgtgggatgcgtgagggttcttcttttgcaccaaattggcgctagaacctccctcgatatttttgccccggttttcctttgctctcgccttctcctcaacacccaaagagccaatgagatcaataacactgaactcttgcctcttgtgttttagagaagtagcaaagtccgaccaagaaggtggcaatttagcaataatgccacccaccacaaacttgtccggcaactcacagttgttgttctcaagttcatttgccagcatctaaatctcatgatcctgttccactacagaacggttatcgaccatcttgtagtcatagaactgctccatgacatacagctcgttgccggcgtcggaaactctgaacttggcctcaagtgcatcccacatgtccttccctgaaggcatgtgcatgtacacgtccactatattgtcagcgagtacactgatcaatgctccacggaacaagcaatccgaaacctcgaacttagcctcctcctcaggagagagaggcggttcacatcgtttgccccgtgaaacatagaagcatcgctgtcaaccacagtagtgcacgtgctttccatctcttataattagaaccatcaaaagcatgtggtttcagtgttgcagcaaagccaactaccgaaaatgacctatcaggtttttggattgttggaaatttggtcataattcggcatattttaatccaaaataacaagataataaacatgatatttacaatgggatttgatccagtgatagtggtgaatgtaatcaacatgagcatgcttaatgtagaataagccttcaccatcacctaataacaacattgttgacatggcgatgaacattaacagtaaaacttctaattgaaataatgtaagagcgttataccctaagaatggtcctccgctggagtttgaggcatattgcctctgttggtattgacgggaggctccttctccttgtatccagtgttgctgttatctccagtattcgacatattggtgaaggtgaagtagatgttgatgaatagtgagtagtcgcgccttgcgctcctcaaaaaactgatcacccacccgtccgtgcaaacgtcgcagcagcgcgtggtttcggaggcctactctcccaacgcgtgtgcacacactcgtcgggatgggattaccgtagcagcaacagcgttggaaaatggatgaaagtgtgtctcacttctctcgcgggagatcaaatccattctcattttataagaggaatggaagatgaagagtaagagtcatggaataggaagagaaatagagtaactaattctcatcaattagccatcaaccatcttccactacacaaccatcaaccaacaatcaattaggagtaattgatgtaagttaccaatggaataggaaaaggaatagagcaactaattgtcatcaactagccatgaaccatcttccactacacaaccatcaaccatccatcaattaggactaattgatataagttaccaattccctaatcaaatggattaattctcaaaacttttcatcccattgatatcccataaaagaatgaatacacatgaattcctagcataatgagacttagaatttatttgatttaattgatttaaatggatcaattacccaattaaatctaacaatatccatctgaagcagtgaaggtaattattaccatcagttgttatcgttgaaagattttggtgtatatttgtgtaactcattttgttacgttgagttcagacttcagggttcagaggggcaacttattgcagtatggattacattattcccaaactttgctaatgtttgtatcaaagaattttcgagctttagttagtaccaccctacacttcatgccattaattatcatccccaaatcatcagcgccgagaaagcaggggttcggaattttaaactccgaccccttgaacctccgtttttcattgctctttcctactccgcgtgccaattaacttcttgaacctgcacacaacacgtattcgatcccttcatctgtttgtttggtttttttccccatgctattactgttgttttccccattcgatttgatccatcattcctatacactgtatcgttgaactggctagctcggtcatttgtatgtagcctcttcttcagtccaattgtccaaagtgtttggctcttttgaaaggtatgatatgattttaggaaaaaacactagcgcataatattttacagaatatcttttttaagtctttacatgcattgaggatatagaaataaacacttattttttttaaacatagtataaacgcttgtgctcacaacatatgcgcactcacccatataaacgtgcacacgcacaccttatctttatgcataccactaaaaaactaaaccaatacatcttgttgtccacatgaacgtcgcctaccactgaaagaaaaataagtcgcaaatacgagcacccatttcgagtcttgttgacgggggatacccgtagaccggatatagagggtattggggttcgctgatacgaggatctacgtagtacggcatcaagcaaacaaaaaacagggattatactggttcaggccccttgataggtgatagccctaatccagttaatatgggattatatgatgaaaaccacagattacaaagggaatagcagaactcgatgataccgacgagaccgtagtcgagttggttcgattagatcacccggcgacttggctcctgtaggctccgacttcgtaggctgtgttggttgtgttggcggtgagattcgatgctttaggtcctcccggggggtcccttttataccgcaggcaagttaatctccaagtagaactcagagacatcggaccctacacgatacagtgacgacacagttctatccgagtaggactccttccatctgtggactccgtgatgaattttcttaacgtgtacagagaacgtccgtatacgcgcagatataccatatcgatacatgacgtatatccaagggtggagggtataccttatccgtaaccctgacaagtctaatacttgagtatggatgggttggttccaccacaaacaatctaaccagttaagatatactcacttcgcaaaataacagttatttgaatctgtacacatcattagacctaacatatagaaacaatagctattaatctttataatatttcagttaccgtggtaatttcaggaaaacaccattagtgtggtgcagagtcgtggatagcttcacatacaaagtttaatcctggttgcgtaagtgtgttttctataggaatttagtgggactaagatatgatgttggtcttcatctctctgagcttgtgttaggaagcacaatcattggagcgtgtgagtgtggtgcgtggacgtgttgtattttccatgtaatcgaaaaatgacatggtaattttgatgcgtgaacgagagttgtactaaaccaatttggtccaagaaatttatgggccttagccattacccctatgtaatttcggccctgtttttgtgtgctaagatgctacatcgctcctgcgcatatactatccttcgacagccttacgggcgggttagtcgcaccgacggtggcgcgccgcgtcggtcgccgttacgcagcttcccccttctcacaggtgctggtgcgggggacggcggagttttcaaatggcgagcagccatgcgcccatgccgcccatgcaaaagaaacagaatggcaagccaaaccaccatgtgaccccaggcaaacgcagacaacgccttccccggtcgccgcctcgccaagggaccccatttccacggcacctcagaaccgaggagagatgccctgccaacctcctcgatcgtggcggtccgcggatccggcgctcgtttcgctcggtttcctgcagaaaacacgctgtccatctggagttctggacatctggtctgaactctgaacaccgatccgttctctataattaagtgacagcatatcacaatctcctgtacagttctaaacctgtttgctgtccaatcccattgccaccttgcttacaaccaagtaataacaggagcagtacttgctcagagaggtgatgagaagaaaaacagagatgattcagactaccccctgcgtcgcgctgctcttgctcgtcggcgttgcttttgctgctcgatcggcgtcggctatcaccgatggtaagagccttccatagtacatttgccagcttaagatcgtacatgcgatttagacggttaatcagttgcacgataaatttgtgacgctcatttctgcttagatagtactgaaaatgacgaaagatcgctgatatgtcattctgcttgctgcgtgtatttttcaggcctgctgccgaatggcaacttcgaggaggcgccggacaagtcgcagatgaacggcacgagggtgacgggtcgctacgcgatacctcagtgggagatctccgggttcgtggagtacatcgggtcgggccagaagcagggagacatgctcctgccggtgccggagggcgcgtacgccgtgcggctgggcaacgaggcctccatccagcagcggcttaccctgacgcggggaatgcactactccatcacattcagcgcggcgcgcacctgcgcccagtccgagctcctcaacatcacgatcacccccgagtccggcgagatccccatccagacggtgtacaccagcagcggctgggactcctactcctgggccttcaaggccaagcacagcgtcgtgttgttcatcgtccacaaccccggtgtctctgatgacgaagcttgcggccccctcatcgactcgttcgccattaagaccctgaaccctcctcaaagaacgaaaggtaattaattaattgagccgggtgctaacctctccacaaagctgctatcagtgtgcatctctacaaaattgaatacaaggatgtgctcacagtcatgaaacaatcgaacaaaatgaaccaggtaacatgctgaagaatgggggcttcgaggagggcccgtacatcttccccaacacgtcctggggcgtgcttgtgccgcccatggacgaggacgactactcgccgctgtccccgtggacgatcctgtcgaccaccaagtccgtcaagtacatcgacgcggcgcactacgctgtgccgggcggcgcccgcgcggttgagctggtgtccggcatggagacggcgatgctgcaggaggtgagcaccgtgcccgggcggtcgtacaggctggagttctccgtcggggacgccggcgacgggtgctccgggtccctgaccgtgcaggcgtacgcgtcgcgcgggagcgtgaaggtgacgtaccagtcgcagggcacgggcggctacaagcgcgggctgctcgagttcacggccacggagaaacggacgcgggtagtgttcgtcagcatggcctacaccacgaagtccgacggcacgctgtgtggtcccgtcatcgacgacgcgtcgctcgtcagtgtccacagccaccgccggttccttctgtaatattattactatcgtcaaagtcactagaatttaaaatgacttaaagttgtcccatatgaaggaatatctcaattccttttatatgattcttatgccaaaagggtgagatgattttttttaccgaggaaaaaaatgtgagatattatggatgcaattgatagaaaaccgggggtaattacataaccgtacatgcttattcgaatattgaatatgaccaggcccatgtttggatgcaaagaaatgaagtcagtagaaaagatgattgaatttgacttgtctcaactatcaagtcacaagtgtaatgtactcatttatgttagattattggaatcatgttttaaggttgagatcaagctcttcattagtagtcccagaggtaagcttcacgtctactacatctattctaaaataaacaaacatactatatacaatactctctccgtctcataatataaaaaagtaaaataaacaaacatactatatacaatactctctccatctcataatataaaaaagttttagagttatatacggttattaaaaaaatatgtacaaatgaatggtggatggttatgattggatgagtagtaaaggtaggtgtgaaaagtgaatggtggagggttttgattggttgggaagagaatattggttgagaagttatattttgggataaatcatgagaactaaaaattgttatatttttgggacggagagggtattatgaatttagacaaactcttgtctatttgtaaactagaatacatcacatcttgtgctatatttgtatatttgtctattttagaacgaagggagtagtcaagatcattttaaattagactatggaataaacaattattccttctatttaaaaaaacatttctagccctcaaactttattaaacaaaatttcatttctaccttcctacctacttattggttcacaaaatcaagaagtttattctttgcctacaacttatctattatagtactaataactacatttttaattaacaatggacactttggttgtttacactaaccattagtttataaaccgatgattagaaatagagtttttctgggtcggaaataatagacatgttgcaaggtcctttaaaaagtcaaatatatttgtggctagtaaactttttgtcatgtgatatcttggtgcataaaaatctttaaaaatgtaaatccacaccgtttatgtttgcttaacgtaccatcactattccagaaatacaacgtatcatgttagagtataaaataggaaagtgttgttgaacatcctatatttttgcaaatactggacggtgttgcactatattatcacagaatgtttcacatattgcacaccacgatgaaaaatgtttcaacgaaaatgtttcatatgtttcattaattgaggaaaattattacatctttttaactgaaattcttgctttccgtcttgttgcttacaggtcctgcagtatcgtcatgtgtgattagtaatagcaacacaggccattagcatcaaatgaacgcattatagtgtggatctaaccagatttgggccacgacatttgtgtactacccagtgtgatagtgtgtcttaatcggtacggcagaaagtaaaatttttgggctagtgatttcggcctcatgggccagatcggcagaccagaccacgtgtacacccaacacgaggcccgttttctcagccctagtcatccccacttgcccggatcaacgacgggagtcgccgcatcgggcggcgtgcaccagtaactgcagtttgtcacctcctcgcaggtcgccgccacagatgcagggaagggcggagttttgtaatggcaggtggccatgcgaacgagaaagaagggaaaggaatggccatgtgacattgtgaccccaagccaaacaccgcaacacgcagtcgcgccttccccagtcaccaacacgccgaggaactccatttccaccgcatctcaggacggagtgatgccctgccaaccgcctcgatcgtggcggcccgtgcatccggagtgagttttgctcggcttgccgtaggaagcaaggtgcccaacttgccagcactagctccatccaggttcttccgtcaaaaaaagctccatccaggttacatcctctctgagcacgcatctcctctataactacaagtgccaacacagcactgtgatgcagcactacttgtttccattaccaaaattctgcggcaacttgtttacagctgagtatcagatattcagagtatagggagtacttcttgtcccgaaggcagctgatgagaaggaaaacagagatggtgcggagcacctgctgcgtggtgctgctcttgctcctcagcgttgctgctcgatcggcttcggccatcatggacggtgagaacctgcaacaccatgctagcttaaacaattgtttaacacagttgtggtttttcacgataaatttctcatgctcatttctggtcaataatttggcgagtgacacttgatagaaactagctggtgcacgagcgagttcgctgacatgtgtgctctacgctgcgtgttcaggcctgctgccgaatggcaatttcgaggaggcgccggacaagtcgcagctgaacggcacgagggtgatcgggcgctacgcgataccgcagtgggagatctccgggttcgtggagtacatcgggtcgggccagatgcagggtgacatgctcctgccggtgccggagggcgcgtacgccgtgcggctgggcaacgaggcctccatccagcagcggctcaccctgacgcggggaatgcactactccgtcaccttcagcgcggcgcgcacctgcgcccagtccgagctcctcaacatcacggtcaccccggagatcggcgaggtccccatccagaccgtgtacaccagcagcggctgggactcctactcctgggcgttcaaggcgagacgcagcgacgtgtcgctcatcgttcacaaccctggcgtcaccgatgacgcggcctgcggccccctcatcgactcgttcgccatcaagactctgcaatctcctccaagcaccaaaggtaactaaagatcgatgtcactattgaagtttgctctaatgctgtaattgcatccttacgtagtttaatacgttctccgtgaaacaaatcccgtcagataacttgctgaagaatgggggcttcgaggaaggcccgtacatcttccccaacacgtcgtggggcgtgcttgtgccgccgatggacgaggacgactactcgccactgtcgccatggacgatcatgggatacaccaagtccgtcaagtacgtggacgcggcgcactacgccgttccaggcggcgcacgcgcggtggagctggtggccggcatggaggcggcgctggtgcaggaggtgtgcaccgtgcccgggcggtcgtaccggctggagttctccgtcggggacgccggcgacgggtgcgtggggtccatgtccgtgcaggcgtacgtgtcgcacggcagcgtgaaggtgccgtacgagtcgcagggcaggggtgggtacaagcgcggggtgctcgagttcacggcgacggacaagcggacgcgggtggtgttcgtcagcatggcctacaccatgaagcccgacggcacgctctgtgggcccgtcgtcgacgacgcgtcggtcgtcggcgtccacagccatcgccggcttcttctgtaacataggctaacgtcaacgtggcattcattttgtactgcgcctctccggttcgtcggaaattatgtatagttcgatgatacacatatcattgaattgagtttcctgcaccggattttctcagtaggaagacgaacggatttgagattcagatgtagtccttcgcctgtcgagggttaactcagacatctgagcaccagaaaatgttttcgcctgtgctagatttcattacaaattagaagctggatgaatgcattagttttagtagagtgctactgaaaatacactatgttacaccaagatgcattgttttaacattgtactgctatactccatttcagtagtagaaaaaatattgtacttctaacttgttggaaagaaccctttttcacatatattgtaacagagaacagctagtggttgagagattgagccccgaggaccgccacatgaccacaccggccatgggccatggccctgtggaaactggagccgaatcttccattcgtggcggaatgccacgtgagtagctgcggtcactgttccttgcttacagctgcagctttgcaggtcccaagttggcaggacgtggccattcggatcgcctcgaaacagagagccgaggcccgaattcctccggtcctcctcgtgacccacgcaccggcgcgcgcgcgcgtcggtgtcacttgccatgccagtatgccatgcccggcatttaagtggacagtggtagaacggcacggcggctttggcggtctctggctcaccaagcttgtgcatcccatctagctccagagagtcggacgtcgggagcagccgagagctcgcgactcgcgagaagggagccacggtatgactgggagcgcgcgtagcgtcgtggcgctgctcttcttgctcgtcggctcggctgctcgggccgattcagccgtcaccgatggtgagatctcgcagactgctacagcgctcctctgttaaatattttttgagccttttgcatgatttgcacggtgatgatttacgcagttcccatgttctgattgacttcatttcaccatgatctatgctttatcataggcctgttgccaaatggcaacttcgaggacgggccggacaagtcccagctgaacggcacggtggtgacgggtcgatacgccatactgaactgggagatctcggggttcgtggagtacatcgagtccgggcacagggagcaggacatgatcctggcggtgccggagggcgcgcgcgccgtgcgattgggcaacgacgccaccatccggcagaggcttagcgtgacgcggcgcgcttactactccatcactttcagcgcggcgcgcacctgcgcccagaaggagaagctgaacatgtccgtcacaccggagttcggcgtgctcccgatccagacggtttacaccagcagcggctgggactcctactcctgggccttcagggccaaacacagcgtcgtgtggctctccatccacaaccccggcgaggaggaggacccggcgtgcggcccgctcattgactccattgccatcaagaacctctaccctcctccccgcaccaaaggtaacagtcacagatctgttcctactgcttcgccgaacaaaaagtaagttttttgttgagacaatgaactcactcattggcctggcatgtaggaaacatgttgagaaacggagacctggaggaggggccgtacatcttcccggacgcgacgtggggcgtgctggtgccaccgatcttcgaggacgagcactcgccgctgccggggtggatgatcatgtcggacacgaaggtcatcaagtacgtggactcgccgcaccacagggtgccgcagggcgcgcgcgccgtggagcttgtggccggcagggagaccgcgctggtgcaggaggtggcgaccgtgcccgggcggtcgtacaggctgtcgttctccgtcggggacgcgggcaacgggtgcaaggattcgctggccgtggaggcgtacgcggcgcgggccacggccaaggtgccgtacgagtcgcagggcacgggcgggcacaagcgcgcccagctcgagttcgcggcggtcgcgaacctgacgcgcgtggtgttccagagcttcaactaccacacgaagccggacgggacgctgtgcgggcctctcgtcgatgacatctccctcgtcagcgtacgcaagcgcgctgctcgcctgtaacgttaacgttgttgcactacgccgtctgctacccgcgcctccgcggtggctggtgatcgcttgaaaatcgggtgctaatttgtatgaagtgttgacactttgacttagagtcgtcgtcaaattgaagtactagtatggctacagggtctgggtgacctagcgctataatagaagaacgaccgatcccatcaacatattgcacaagcattgaagcaagataaatacgcggacggtatagagtaagagaatgagaatgcgaaatgtgagtatgcgacaaattttcaaagcataaaaccatggcattttttcattaaaaatactgtagctgattcggtaatgtgaaaaggagacaccgcataaagttacatcatataaaactacatacttattgcattattgcagttacatgcaggttacgatgtaattacattacatatttagaattatcttatgtttacgtatgttaattttttagaaaaaaaatatcgacaaatgtatagcaaaactgattgtgagaaaaaaaatatcgacaaatgtatagcaaaactgattgcgaggagaataaaatgtgataccataattatagctagacctttttttttccttttctagtcttctcgttttctcattaagccgctcatcaatcaacggagcccatgggttattgggttgaggcaaagtgcagcccgttacaaaactcatataaaattagacccgattaaaagcatatatcgtgatgcaaatccaacggtaaaaaaattcaactgacatattgaaatttttcaggcgcacgcagaccagcaaagctgataattaaacagtaacttatcccttttgggtttgtttggttcagctgggttgtagctgcacagccactgcgctgcagctcccctagcataatcttgcttgttgagtcttgtagctgtagcgctgctgctgccacagctggctcttccaaactcaccctttattacaaaattgtttaaaaatgctcttttcatcctctcatagtttgaaacataagtttggtttactgctcggttgaaagactgaccagcgattcagaattacagatgcactttgctcctacaatatttgtcctcgttggcgagggatttgaccttgaagatgctatagcgccaactttgaaataagagtaaatttcatagaagcctacattttcaggtatcggtgacacaaaacccaaaatttaaggtattacgatttattttaagtactttatatttgaagctaaaatgtttatttatataaaatacttctattctattattatgtaataaatttttaaaagaaaattcatatttgcatactcaaaatatgcatccatctcgtctactttccctaaaaatgaaatcaatttatttctacgaatatagtacaggctattattaaatatgatacatgcatgcttgtaactgggtttcacaagacattttccattaaatatgggtttctttaaacaaattgtaataccggtgttcgaaaatttgagattacatgcgaaatgagcagatctcaactagttaggtcacttgtgatggaacctatccgtttaggtttaagtcatagacttgcatggatactcgcatttatagcaatttatccttttggtggtagacgatgtactggttgataacgaggtgctcgtaatgactttgttaatattaaaatatgccgcctagtcttttcataactgcccataggaatatggcatgtatgttgtacgtgttcatagggatagtttacgtacgttgtgagcgtccatgtttgtaatttgtttaaaaaaagggagggggtttgtaaaattatttggagttgcaactcgcatttcctctcagaacaaaacaaagttgacaaattgcctccgttagggagacgcagggactgcacagggcaggccgtgagttttaaaaaggaagatgaaaaaagaacggccggcacccggcacccacgacacaggcctgcggagactttgcgcaacacgagacggtgggaatcgcggcgccgagcggccgtagtccgtactcttcgtcgcagcttcgccgaggcgccgaggcgtgcggagaagagatccacgccatctcggctgggacgcatcgttttgtcagagcaaggtgaatagtatagccaactactgctccaaaatatctatagccaatctaatagttcattcatacaatagttaactataaaaatatactacactattaatatacggtcacacctctcacacacacataacatgttggagttcgtgttgcagccagctataaatttatagcccgctttcttctctctcttcttttttcttctcgatatatagttacagctggcttatagcctactattgtacctgctctcatggcacagccccagtgccccaggccccaagctcgaacccccaacccgctgtgcgcggcgacgccgtggccccgagctgggcggcgtgcaaactggagaggaatcttctgtagcagatggtccccaagttgccgtgatgccttccgtacgatccagccggcgcgtctcgcggcgtcccggactcatcctccctgcacagatcacacaagttgtaataagcaacagctcttatatatgtgagctcgcgcactggcccctcgcgaatcggtaaaacgacctactccgattcgatttgtctgtttgcaccaagctccagcgaagttcgagtgctggaccgtgtgacgagagctcatgatcatggtcttggcgaagtgcacgcgctgcctggctcttgtggtggtggtgctcgttggcgtggctgcaccggtggtcttctctgtcaccgatggtgagcactcgtgaacaaatactatcagcttgttaatcagttgccgaaccttctattgttttgtaccacgcgaaacctgccgttgacttatatccatagatcgatcctcacaactgcatatacatgcagcagttagttgtataatcattttttttttgaacgaaagttagttgtataatagatctgtttggtgtgtgaatgtctcttttgatccttcctgcatctacagtattatcacctgagttaaatatcagatagcaatttatgaatgaacttgataaggttgacaatgcatatatagatcaggtgcacaccagagaggattgaggattcaaagctcaaatcttctgctgatcatgacagtgaatttctagaaactaacagccaaagccaatctgcagcgatctgaaccactttcatttttagtcatagtaagtagttacacctggctcgttaattctctccgaactctgaactctgtacagcgtaatactgttcttcattagttcactacttcactgcttaagaaaccactgctttgccctttaatcgctgtaatgtcgaagctcagttctgtttcgagctacataatacagcaaagttgctttgcgttcggactttttctagttcaattttcagttccctataacagagaacccctttcctctgttttcaatatcatttctcactttgtgacagctcgatcatatattgtgcgtacaggccttctaccaaacggcaacttcgagcacgggccggacaagtcccagctgaaccgaactgggagatctctgggttcgtggagtacatcgggtccgggcacaaggagcaggacatgatcctggcggtgccggagggcgcgtacgccgtgcgcctgggcaacgacgcaaccatccggcagcggatcagcgtcacccgtcacatgtactactctgtcacattcagcgccgcgcgcacctgcgcccaggccgagaagctgaacgtgtccgtcacgcttgagttcggcgtgctcccgatccagaccgtgtacaccagcaccggctgggactcctactcctgggccttcaaggccgaacacagcgccgtgtggctctccatccacaaccccggcgtcgaggaggacccggcctgcggcccactcatcgacctcgtcgccatcaagactcttcctcctccccatcacaccaggggtacgtaagctaatccgttgctcaagagaattttcgacatgtcgcaagcaaaacacgttatgacgagttcagaatctattcaactgaactggcaggtggtacaatgctgaggaacggggacttcgaggagggcccgtacatcttcgccgacacgccgtggggtgtcctggtgccgccgatggacgaggacgtgcactcgccgctgcccgggtggatggtcatgtcgaccacgaaggtcgtcaagtacgtggactcggcgcgccacgcggtgccgagcggcgcgcacgccgtggagatggtggccgggagggagtgcgcgctggtgcaggaggtggcgaccgtgcccgggcggcggtacacgctgtcgttctccgtcggggacgccggcaacgggtgcatcgggtcccttgccgtggacgcgtacgcggcgcgggcgacgctgaaggtgtcgtacgagtcgcggggcactggcgggcacgagcgcgccgagctcgtgttcgcggcggtcgccaaccggacgcgcgtggtgttccacagctccaaccaccatatgaagtcggacggcacgctgtgcggtcctgtggtcgatgacgtctccctcgtcagtgtggacaagcacacggttcgccggttgttgatgtagcatccctcgtcgtgtgccgggcggtacttgacctgtagttgcctagttgcacacactgtgttgcaccagaacgtactacctcggctcccaaaataagtgcaaccgtggatatccgtgcccaacgtttgaccgtccgtcttatttaaaaattttatgaaaaatttaaaaatatttagtcacacataaagtactattcatgttttatcatgtaatagcaataaaaatactaatcataaattttttttaaataagacgaacaatcaaatctgaacataaataatacaaaactacacttattttaggacggagggagtgatacggtttgttagtacggtagtagctgcctatgctggagacccggagtagtcgtatggacaatgccagtacaactacccttgtgctcttcaactggaaaagccggcattcgagcccaagctagggctaagttagttacaaactttttcttcaaactttcaactattttatcacatcaaaactttcctacacacataaacttctaactttttcatcacatcattctaatttcaaccaaacttttaattttagcgtgaactaaacacaccctagattgcaatcttgcaacacctcagcccaaattggattgtcctgtgagccacgagctcacaagacgttgattttcttccaaaagtgggaagtattgtatcatggacacttccttgtagtactattttttcgtttcgtaatgtaagactttctaatattgcatatatatatattaataaatctatacacatatttgtctagatttattaacatgtacataaatatggacaatgctagaaaatcttacattgtgaaacggagggaataccgatcaatgtgaaagaagaaacgcgagatgtaggcctggtttagttcccaattttttcttcaaactttcaacttttccatcacatcaaaactttcctacagataaacttttaactttttcgtcatatcgttctaattttaatcaaacttttaattttggtgtgaacaaaacacacccgtaggcatataatattgctgctgtgaaggttttgacttttctagatgcatgaatgatatatttgactccggggcagaaggatagtagtactcctacgttagtacatttgaatggataaaaaatctgaaaaatgccttcaacggtctgccgtgccggccagtgcgatcgacgaaaagttgaaaataaccaatagcaaagcactgcaggtctgcagccgtgccgtactacacgaggtgataaaaaaattaaaaatttacgtatgtagaaaagttttaatgtgatggaaaagttaaaagtttaaagaaaaacttcgatctaactcgggctgagtcggaatctctcctgctactggtagtgccaatgcgttgaacagagcgtgtgccacccaagctccacgtggctgcaggcggtcgctctgcgtctgcagcgtgccacgggcatcgacgaagatgcgtgctgtccctctagtacgtggcgtccggcccgcgagtgtcggcgtggtctcgcggccaaagctggggagctctcgtcggcgtgggagtccatcggcgatcatgacgaagggcgccacgcttttcatggcgctgttcgtgctttgtcgtcggcgcgtctgctcgaccggttgttgatgttgttgacgacgagaactaggtagtccgaacatgtggtacgtgatttgccaaatacgttttcatcttggtcttgcgcgcaatagctcatgtccgactcacaattcgtttgtgttcacgattgcggcacctgattgctttatacaactgggccgggcctactttacatgtataggcctactaccaaacggaaacttctactatgggccagaaaggtcccagtggagcacaaggggccgccatggcactaggagatttcggggttcgtggagtacattggatccggcctccgggcacaagcaaaagtaagtgatagaaacttcacaaattaaggatcactccatcctaacgaagttaatgtggatgattatgcaagaaattatggcatatcttctcgagaggtaaagaaaaccttcaatgtacccatgtgtactatttcaaaacttcagtcaaaaccaacaatattagggtacacatgatttttcaagcatatcttacagcctttaactttcaagatactaatttctgaaaacaaccataaatcatactataggtttttttaggaaacacaatacaagtgcatacatttgtatacacgcacacacactcacctctacgatctttaactgttaaaactgttaacatttcagccttcaaccagatttcgggtggtttggagtgatatggtaatgtagcccagcccaaggaataaaccttttttttagtttttaaaattactacttgaactatagaaaaaggaccacttgacattacgtaccatgtgtctattatgcaaaatgtgtgcaacctgagtaaaaaaattgtgttccatgtaaataagatggttgagttatctcatgaatagatacaatagtatttcatatattcaagagcgtgaccgatatttacttttttttcatcaatttgagaagaaggatgcaaacaactctagcaatggaatttctcttaaaaataagaggtattgcatcctcctcgtaaaaaaaaaatacagaatgatttctctgacggtaaacctacattaattattggctcttcgtttcccatatattgacatccatgcgtacatagattgtccgctagctgttaccgtataggaaactcatttaagccgaaatgttccaggtacattaatgttatatttctcccgttgttattccaacacacatatgtaatggacgagtatcataaaccagtgtacatatatatagcaaatacaggaattgaaggagcatacgtgtataacaacacatcatgcatgcatgcgctcgtgtgtaagcggcggaattatttttaagtaagctataagcgaagacaactactcatgcatatttgtcccagcacagtgtacgtagcactgtacccaacaatcagccatagctagcttagagtacgtaaggatacatcaatgcggcgcgacgtcgacactgccacgctggtgcacacacctacgtacgtacatgcacgcacgcatgagttgttggccgtgtctgtagatctggtctagtggccagggcctctcgggctcggccccgccgtgagctgtgccacccacgccatgagcagagacctcgccctctcgtgcagcgacgtcgccatcgcgtgggccgcgctgtgctgctcgcccggcagccgccgcgccgcctcgacggctgtctgcaggatagtggatgatagggccacgagtagcaagaaaacggcgaggattttgtctctctgggacgacatgatcatcgatcgatcgatcgccgagaggtgagctgcttgtgtactaccactcgatcgatcgatcgagctgtatgttatttggtacgtgatcagggtagctaacctttctcgcgtatatataggctccatttctcaccgttaagctgcacgtacgagagagaattagtttgtctgttgtgtgtcatgtgtgtggttagaagagaaggtcccctggctagctagtcagtagctagcgtgcttaattgcttgtatgcaacgaatctttgatcagtgagtttgccttaattgcggtaggaaaacgaggccgatcggtcgccttctcatgggtgggacagtggacagtttgcactatagaccaacgatcggtcgcctcatgcatagggatggcaatcgggtccgacgggcacgggtagtgcctatccatacccgtgcctataagattatttgtgcccgtggatatacccattactacatgacgggtaaggatggttgtccatgcccatcgcccgcgggcgccttgtgcccgcgggcatgcccgtttacccgccacaacaaaagtagtggaacaaaaagtctacaagcttctaagttcgaattgaacttaaaacatcaaatattctccgcctcggtgtggtgtctcttctctggcggcgatagagtaagggggagagaaataataagggaaataaaaagaaaaccgtagaaaacaaagaacgtggcctatgtattctagtggattttgatcttaacctacatgtaagttagattttacgggtaaacgggcaaagcgggcatggttaatgattacccatacccatgtccatttacccatcaggcatagtttttgacccaataagatacccatggttataaaatggagaacaaacccaactctaatagggtttttatccacggataaacggacaaacgggcacaattgccatccctactcatgcatgatgttcaacgaagttcacatgacagatccaagagcatgcatagtttcaaactgttgatgataaattcttagtataattaagcagacccgtatgtaataatgatctttttttctcataagtattgtacaaaccaccatgcgtggcgcatcctatcaacacgtacgatcaagaaatggaacctcgaaacagatcccaaaatcgtgcaaaaatcctgcttaaacacattaatgtggttacaatgtttaatttaaggatagttttgtcatctttgagaagttactgaaaaatagtatatttttatataaaatttaatatctttattaagtatcttgagctaggttagtgtaacatttagatatcttaaggtattttcttatggatcttaatttgaaccttcctgatagtcttgcataaataaattcattgttacagcaaagctattaatttttagtttattattcttctcatgcaggagtttgtccgccatgagctttatttgattattgttataaccttactctatgtatgcttttgtgtgtatccatgatgcagagaaaccagagatgtaaccatgtaatgctaatttagtttggtatcacattgtgtcctaattaattggtaattttcaatagcatttcttgatgtttcgattggtatcattttttgccaacaccatctcttacgtagcaataaatttagtaatgccaaaagttccataaaattttgcactaccgagatttaggcagggcaccaaattaaccaaactggcccatagttatcttcttttatcttaaagagttgttgaaccgttgatcagctgtaaaatacttgaaaaaggaaactatacataggctacaatacccatgaataactagatatacatttgaactttagacagagctcctggaaccacactcataggcaagatacattcgactagctagtatcactaaaaatgattcacttaattagaatcatcatctgttcacctaattactagtttacccatctaaccagtataaaacaaatgcataacctactcctgaacttcgcgacagtggtacaacgtctaaacaagctaggccacaattaatcgagttgcgtacctgcgttaatcagagctctcggaaatttaggcggtgatggaagtttcgcccggacgcttgatcgatggagcggatttgtttaccctccccaacgcccaccgtcgtgggtgcttgtggttttgacgggcagcggcaagcacaagagcccgcaatctcgcacgtcttgccgcaacgccatatgcgagtgggagctcagagctagcctgagtaccagaattaactggcctactacacggcagtacactgtacacgcctataggtgtgtagtgtatcgaacgctttagatcgcgaaaagcattgaccatacgcatttctatatcagctacatgccggtcggtgatcggtcgaaaggaacatggtgaagctaaagaaaaagatgaaggtactgtaaacagttagcgttgttctacctgcctgccaccggtaggaaacaagagtacgggtcgactagctccccgagaagagctggcaccgttcaattcaaatggaatatagttttacatgatgagtgtaatactcccaccgtcccattttaaagtccagccataattttcagcgtctaactttaatgtccgtcttattttaaaagcttttaaaaaaattaaaaaacataagtcatgagttaagtattattcatgttttattaaaagttagatataaaaatttatgattgtatttaaaatggaacggagggagtacattactaatatttaaggctgagaaaatgctacattatcgatcaatcatttatgtggtaaatgtcatgcaaaaacggccttctgtctctgtgccctttcaaagtaaaaacggtcctctgtagcgagtgtgaagcagccagctctccggccgggccaatgcataactagaggagcccaaaccaaaccatgacaatgggtttgcacttcgcaaacatgccaatatgggccgtttgctaagccgagccctacgaatacaggacgccatcagtcaaaagagttcactttaggtttctcaatttgtcgctgagtctaaaagtcatccctaaacataaataacacagtacttcgtataacctatcctccaactcacaacacccacgtgagccccacatattagcgaacaactcttatccctcctctccctctccctcttctgggaaggggttgttgtgcacgatctccaaccccggcgtgcgcttttctccccataagtgggtgtgtgagtgcggttgtgaggacatcatgtccgacgcctcctccttcacctcccttgttcttctagttgtatagccggcacagtacccaatcatccaactgcatgatcaattcatgcaaaatcatatcagaatgtgattcaattgtagatcgcctttatcgaataatctttgatcgaagcaagaataatttaacttttaaaatagtgaattgaggcttaccctgagagacctcttcttggtgcccgcgatggcgcggccaatgttggcgagctggtactcacataatccaatcggtcttgacccatcacaggcgtagaacacaagcacaagcgccttcttgatgccaagcgtgtgcctttgcggtgcgacgggctttgtcggttggggcatgatttgttggtgtgcttgcggtccggggtggggagggattgaataagtaccactccctagtgccactctgataggtcccacgagttgaaattttacagatccacctccacaatgatcgacaccaggcgcatgggacgggccccacctataaccatgaaacaggcatcgagaggtggtcctacaccgcaagctcgaagggcaacaacttggtgcaaccgaggaacacgacagtgtcgtttcccgatgccgtgggagggtcggtggtggtagggtgggaggaggtggtgatgagcggggagtagggagcaaaaccggaggagagggcagcgtgaatggagggaagaaggagaggaagagtatgaagaaaagttaggcctcgtttagttagcaaaaatttttgttttgggtgtcacatcagatatatggacacacatttgaagtattaaacgttgtctaataacaaaaaaaaatatatattccgctagaaaactacgagatgaaattattaagcctaattaatctgttattagcaaatatttactgtagtaccacattgtcaaatcatggtgcagttaggcttaaaagatttgtctcgcaatttacacacaaactgtgtaattggttttttttccacatttaatactctatacatgtgtccaaacattcgatgtaatgggtgaaaagtttttgttttgggaactaaacaaccccttagccactggcatgtggagctcacgtgagttccacttaccacatctgtcaaaaccggtcactatactgccgagtaaccaaacttgatatagtattgtgagttagagaatatgctacatatagtatttcggttcagaaatgagtttttagaatcgacgataaattaaggtaactaaaacaaagtgttcctcagtgaaatcatatcatatgtgggtaaaagaggaagaaaaatcacaccagcactgaaacccaatctacccccatccaaaacagcgactcgatcagccgtcgccgctcacccactccgacatgggcctcaacccctccaagcgcgtggacgccgcgctccggggcgcgccggcgttcgccgccgcttgcgacgacgccttcggccgctgcctcgccgacgcccagtacgccttcgccggcgtccgcccctaccagctcgccgacgcgtccgcgcacctccactcgtcgctccggggctccctcccgctcgtccgccgctgggtgccctcgccgccgccgcgcgcccgcgtcgactccgcgctgcgcgccgcggggctcgaggacgcggcggtgctctcgaggggccagttcagggagttcgccgccgagctgttcagggaggccgtgctcgccggcgcggcccaggcggctctcgtccgcgccccggcaggcgccgccgggctcgtcggtgttggcctcgcgacccgcgccggggccggggtggtagggaggttggtcgccatctacaccgccggcgttgcggctgctgtttacctcagcttgggctaggtttatcccacagcctgtaaaactaccatttgtaccatgtgattttacctggaatgtcagttccttcgtagtagcaaatatccctatcagaaaattttaatacggttgaattggttgttcttgatcctgatgctttcatcgatggaaaacctcatcaaaacggactgtaatcggtgacggatgaaattgaatcagcaatatgccactgcagaattgatgctgtcacgtaacatcctgcataggcatttccccagtgaattcagcaattagattcggtattcggcaagacagcatcttaaatcttaatgcatttctcgtttctataccaagcagcaaatctgaactctgaattctgcagaccagtgtaatgtggatccctatatgggccgtctgaagcagagacattcttagtccgatgggcctagcggcctatcctctcttcggctctttgcaagtgctaatatgcacgggtcatttttccttttttgggataatgaaatgcccgagtcttagaaaaccaatctgatttgtttggcaacttcgttttcaccaaatcaccatgtgcaacacactgcagagatcacctgaaacattaacccacacagttacagttagcgggcaggcaaaggcaacacgcaccgagccttctccctgttacgccattcgtccggtccattaccctgttgtaacacactaacacctggacgagacgagagctttgtctgggctttcctgtacctgtccgcatgtacattatctatccctatcatggtacgcgccgcgcccgcgcctgcccaaaccaaatgaggtaaggaaggcatatcgcatcgtaatattataccgccacagatgggatgatctggagttgcctgccttgccctcacgcacgtacgcgcgccgagacaaggcaggccgagttggagaatatccctacctccagcgattccgctgtagcgtagcgcggttggtgcgcgcgcgggcggggggccgcgccgtcacatggccgtcgtaacgcaacgtctcccaactcatcgcgcacacagaggcagccaggcagcgtacgttggcgttggggtctccctcctccggtcgtctgacgccaccgcggcggcacatggttaaggccatcaggcagagcctcctctccatcctccggtgatttaattagtcgtcctcggcagatatgctagcgcttgcgaacgcaatttcctcacgcttttatctgttagtggcagatgcttccgactactatcattgaatgtttcacgggtttggacagaagaataatcggctagccatctttcgatgttgtgctgtgctgttgctaattgctgccgattctgccatgctctgtcgccgcctcacgaattcgatactccatgtattccacaggtgtacatttgttcccttcatcaagcttcagctgcagaatatccaaaatttcagggcctctctaagctctcttcctgatacgggcagtaactgcggtgggcgtggcatagtgggcgcgtgtggcctccacgagcagtgcacggttgaaatggtaagaactaagaatcttcaggtagcccccgaggtaagcgaggcaggcaacgtgaaaaactgaaaaggcaacgaaatgctcttcgcttggccttttccgtcgcagttctggcggtgatcttcttttgctcaccctggtggatgtgttctgtgctctgttggctatcatcttccaggcttttctttagcttttatcttcagttcaagaattccagtccatctggacggatggatgagaacgggtgtggacgcaaacactgtcccgtaatgtagctttcccactttattaccaaacgtttcctgtgatatatgattgctgcatccttggttagagaagagaattattgaggtgtcaacttcgggagtgtgccagctaattcagaattcatatcgtttgactaacggcattgattttctctgccaagtaacacgagactatcattcatggcactgcattttaattaggattgttctaccatctttctcatgtgctgtgcgagtgccacactggcaccgtggctgtacgatcagtaatatctgcgagaatgtccatcaactgatcacaacgagaaaaatggagaaccctcttcttttttgcgtatgctgtgctcttcttacgtagtacaatcaactagtgatgaccagatttttttagatacgtaatggaataactagtgacgaccagatgacgtggccagtgaaagtagcatgctgcatctcctccatgaactacactggctcctatattttaggggaagtgacgttaaactcgttcacggaaagatcacaaggaatcaaagatgcaggttcagagaaggagagacaaaccgctcgatgaaacgggaaatggaatggtggagtcgagctgcaacagtatgctccaaagcctttcactttacgatttcatctttgtgctttccgtggcagtatgatggcctgctcgttgaatgtggcgaccaatcgggctcgcgcatgcatgatggtggcctacgcaaggaggacactcgtccatgaaaaccttttgtgaagaaaaaaaaatgtcggatcggtgtaatttgtcaccattaatttggcgtaagcatttccctcttcggagcgatcaaagtgatacgaccgtgctagttggtggagagacaatgacgcgattgagtgacagtaattttcagtacgcaatagccaacacgagtgcatgcatgattaatcgcgcacatgatcgcccatcgggccaattagacgggtggaagcggcttaagttaggtgcagccgtgcaggtctacctaatccatcttggtgctatgaaacggcaccatcacacactcacacacgtacatatcgggaacaaatggaaaccagtgcgacactcgaaattcatgcccatcaaggtaggtgggtgactccgtcagtattagctttttgaaaattttgcgtttgatatgtccaattcgaggtttaattcatacccgattactcgacaaagtactactggtagttcgaggtttaaagtatgactgaaaaagtgagaaggttaaagtatacaactatacccccaacgattagtttagagtaaagtttttaccataattttttccctttctttctggcacctgctctttcggggcagcaagtagagcagtccaacatcgagggtaaaaaagccccgaccgaatcaatgacgcgaagatcctgccaaagtgagctaaagattcaggccagcttccatgttgtctcacagcgtggtagtacgtagtcctacactactactgcaaaccccgcaacgtactgtaccagcacgcaagattacggccgcgcggtctgacggactcgctcgttcgagaccaaaggcaaaaaccaaatcaaaccgagccaagccaaaccaatcgaccgacctacggcaagcggcatgtgcaacctggcatctccctttaaatcccatgagctgtttctccgggccgcaataatcatccaccggggccaagccaacccagacagccatcgcttttccgccttcctccctccccgccggtggacggtggtgctcgcgcgcgcggccggcttttttttcccccacctcctcgatgtggcagctcaggcggcgttggatgtcgtagacgtacgtacgtattctcgccttgttggctttttgtctcgctcatgcgtggcggtgtacgtagaggacaagggacatgttggggggacgttgcccgttgatgggttggggtgtgcaggagaggggggtttcataatggtgtgcactcacaagcaacggccaacgggtcccccccaatctgcttgattggggtttgggtttgggtttggattggaacgtgtaagtattggctgtgcactggtttaccactgtacatacggacacatgtaacaggttgacagagtgcggacctaaagactactagagttttgggcatgcgaatgcacaagtccagtgttaatctttgaaaaccagaagttggaaaaattgtcccgcttcatgaaacggatcacataaatttcgttccttcccattcgtattgttttaagagttaaaactccctaaaactagtaatcaaatgactgatgatagaggtctccaagaaaatatggcaagaaggtgagtgtttggtggccttgcaactcctaatagcaggtacaatagcagctataagccagctgcaaatatattttaaatagataaatgaggagagagaaaggcagcgggctacagatttgtagccagttgcagcacggactccaagacgcagtgtgtgtatgacaggtgggaccagatactaatagtgtagtatgtaactattatataaatgagctattagattggttatagatgaattgaagttagtagttggctatactattaaatttgctctaattggctatctgtacatctgtttgttattctaatcaacaagtggaacgccactgcaaattgcgcctacacggattgctgccatgcatgtgcggcatccctaggtaaaccaccaccagcaccaccatggctctaactacgcacaccaaggacgctgtccacttgacgagatatatacacgctgggacagtactcgatcgggagtgattcgatcagagggaggggagagaggcaagcaacactagcatcctctgacctgccaaactgtcccccgcggctcacatttcttggccatttcttaccttccaagcaccaccaatcttgtccgaggcgagcaagcttagccggtgcttctcagagctaagccaaatcgcgtgccaaatccaagaaaggcacgggaggaagaggaagaagaaggaggggaagaagagcagtcagggcagggggatcagtggcaggctgacacgccaatgggggcagcttcttgttcttcttcttcggcgaagcatctgttcctgctctgcctcctcctcggcttctgcttcgcgttcgcggcgagccagcaggagcagcagcagtcggactcgtgcagtagcgccggcgtcgcggtcgctcatctcgtccccttcaactcctccgccttccgctgcctgaccgtctggaagcaggaggacttcgtcctgcgggtatgtatgctgctgaattttgcagtcctatcaattcttggagttttactgcatactgtaccaattttcatctcggtgatttgtttagtttagatgccattgccaatgcacgcgtgcagtgtgcaaactagccagatatggctggaaaatggaagcttggtagttaaattgattagagtggagtaaatactgcaattagttaaacgagtgttgcttggatgatctggtttggtcctataatgatgaactagcactgtggcagtgtactaattaagcactgatgcttcatgcttggagtatgttcttgcgatagtttgggaggaacaaaatttggtagcatcaatgcaagtagtgtgcatcatagataaaccatcacattttgcatcaaggagtaattaaccgtaagctgaagtgatctgattcaaactgctcgtgtcaccgcagtacaagaacaccggagagagccaatggagcttcatcctctcggcgccggacaagggctcgtacgtggcggtggggttctccggcaaggggctgatggtcggtagcagcgccgtcgtcgcgtggtcgtcgggcgggaagggcacggtgaagcagtactacctcaccggcaagagccccgacgagtgctacccggacaagggccgcctcacgctggtcaagaacaaggccgtcgccgtgtcgcgctccggccggctctacctcgccttccagctcagcaccgacctcccgcagccgcacctgatctacgccgtcggccccgagggcaacctgccgccctccgacgccaccctcccgatgcaccggagcatgcactcccacgccttcaactacacctccggtacaaaatgcttgcacgcatttcgacaaacagatggagcagagggattttgtttttgacctgtttcgtttttttttcagggatggcgtcgagctccggtggctcgggcggcggggggttcccgccggagaggaagcacgggctgctggcgatgatggcgtggggcgtgctgatgccgctcggcatgatggcggcgcgctacttccggcgggtggacccgtactggttctacgcccacatggccatccaggccgtcgcgttcaccgtcggcatcgcgtcggtcgtcctcggcttccgcctcaacgaggacgggctcaagaacgtcgacgtgcaccgggcgctcggcatcgccatcctggccatggcctcgctgcaggtaaattaacttggtctctgaacatgggggagaactagaataattgcagctgagttgaaaaaaaaatgctcaatgatttgcacatgcgccgcaaggccatcatcgatttttctagccatgagtgagtaagttgactgtgaatgatagaattgctaaccaagctacgggaagctcagaatcactctagagaatctgagtactagtaaacgaagactgcaacgtcagctgcatgttctttgagccaactagttccatttctccatgtatccgtcatagccgaattgtttgataaccttatgggaaactattctaaacagttattcaaatactcaaatagctattgtaaacagtttatatgtcactcaaatagttatgaaaacaacgaggacatgttcccttgaaaacaacgaggccgagctcagcagcgcgagcttgtaacccgagcgggggcattaaggtggtgtggacgttgccgtatggctgcgcgcctgggttggcagtgccatagatggcccgcccgttccaagttgcgtagttgggccggcggggcttgggcgaaagctctgggcctcacggttcctagagtggcaggcattgcgtgaggctggcttcataaaatccactctctacccttattcgtggtttgattgatgaattacatgggcaacgcaggtgatggcgttcctggcgcggccggacaagacgtccaaggtgaggcggttctggaactggtaccaccactacatcgggcgggcggcgatcctggtggccatcggcaacatcttcctcggcctgcacatcgcgcaggaggtcagcgcctacatcgtctcctacggcgtcttcgtcgccgtctgggtcatcgccgtcgccgcgttcgagatgaaccgctgctactccgacgacgactgacccgtccctccgtccgtccgtccatctccgatccattctcgatcgatcacggcgatgatgcgtcgtcctcagtctacagaggaacagggactaatgggcacaccgcgttcacgacaagtgatgacacggcatacagcaaaacacagcgattattattcttttttcctagctctcacacggttgttgggttggacagcgcattttgagaggagtgtgtttaattggttgattattattgaattcttttgtcttttggggtataggaggatacgaggccggggctggactgctgtttctttgcctagctggacgctccggtctggttcgtgtttgtacattggtgcatggtgtcgttggcgtggttgttgtaccgttgtggttggtagttcgttcacgtttcccttcccctgtgtattgatcaattaatggcatcatttgctgattcagctacaaagcttctcccgcctagcttcatgtgtgttggacgattttcttcgcggtttggaagttgaaacaacagcagcatgtatcagtgaaggcgacttctatatcattctattcctgcagcagaagcagcagcaatgcagtagtgagccacaggttcccaaaactggcgttaactggcctaaaagcccatgaattcaaagctaaaattaaaattctgaacctttccccgggttaccggatatcaccaggactaaataattccaggtaaaaccggtaccaaaaacaattgtagctagggaagcaggaagagggacttgtcgacatacctgatgtccacaagagaacaaggtcagatattgagacaggcgcgattgcatatgacgtgaacatactccatggcaccggtgaattactcagttttgcctcatcagttctacaacttacaactgaatgggatctacattctacaggctgcaggcatctaagtgcttcatagatagtctgaaattttacctagatactgcgctagcctatgcatgagtcactcagatacaacatgttattattactgacaaccgccatgagcctatgccaactcacggctcactcctcagagcgtggctttcagatgcgccggcgttctgtgcatgggatgccgccacaattcctttcatcttcagatcccctggcaagggcaacccctcctgcagaagctgctgttggaccgtgctaagatgatgatgctgctgcagatgcatctgttgctgctggtgctgggagtggatctgtagctgctgcagctgctgggctgccagaagagattgtatgtgactgcgctggtaaccttgtggattggcgcctccaaatgaggagaggccaaagtttcccactttgccgcagttggcattaacctgacctgttgcaacctttagctgctgaatctcatctcttagcctgtcatttagtgctacatgcaaacaaggaacagttacaatcctaaagatgattggaaaaacactgtaggagagtttttgtgacacctacaaaatagtaataaatgatctgaagcctatcaaagatgatatcctaagtcataatttgcattaactaatgcttactttcttcatacaacttatatcttgttttatgattttttgttacgtctctaccatagacaaaaggttaataactcagcaaaaggggtagagaaaacaataatatcacttcgatcactaggtgatgaaaaagaaaatatcaggagaaaattgaagataatatcacactatattattccaacgaagacgcaagagaataaagagaaaagaaaacaatacttaataggctcaagtaatttccagttatatatactataaattagtgtgtcatgaagacacttcatttttttttctcaaaatatatggcaattcgattagaattactgcgatgatatgaaaaccttaccatcctgcagcctgacttgttgctccattgtttgcacccgtattttcaaatcactattttcacttgttaaaccagtggtatctctctgtattattcaggtagagataatcaaggatagactcgtggaaaactgaaaagtaagttccttcaaaaactacataatctgcaatatgttaacagtatcaacctgtaggatacaaaaggtgtatttgcagctggaaaaaataaatcagatgttaacatcctaactaccataaatggttactgctcagatagaggaaacagggtcggggtggcctgtgggtcctttcacaacccatctcaacccttaaatatttttagcacaaaaaaattctaaatttcagcccaaacctttttggacccaaccctcacattttgtaggtcaaaatgatgggcccattaccacccctaggtatgggttgtcggaatttccagaacaagcagcagtgcagcactttgtcaaatagcttcacttgatatacaaccagcatgaaatttagaataacctacaagtttagtaaccttatactaacacagataataggaagcctgccaggtaaaaaatgccaagttaaaagcataggcatgtacctaaataaacattttcatggggctgaggcatttgtctagtagagtagaaccaactgctaaacattggtgtagagtgtctaaatcatggatgcacaaagtatgagataaggtaaagccaaaataaagtacctgtaacatggacaactgtgctgatagtgtagttgcttctgtctggagagtctgtacttttctctcaagctctgcaatgtagcgcatctttctttcttttgacctagcagctgactggcggtttgccaagatcctaaaatgtttcaaaggagtaaaagaattaactgaagtcaaaacccaaaaggcacacaaaaccaatttgtaagtgagacaaaataatcggtaaaaccaaataacctcagtcaaacacagtctagatagctgtggaaaattggacttatgaattatttgaaaacacaaactgacatacagttaaaaaaaagttgagctaaattactgctgataaaaggggctaaattacagttaaatccatataatatatagggcccctctaagtaggggaacgcagactaaaacaaatatataattgtcaacatcacatattccaactgaagatattctccaatgtgctagtgaattaagaaccatctataaggggcaagggctattcggttatatgatgagcacaccaacatcaccataagcacttatttgcatatcacaccttagatgtgagattaacaacacaaatgacggtccttttcagctttgttaaatattaactactactgtacactataccaaacctgctcagaaccaaatttcccttcatcaatgatagatagagacaggcttagtagttagtgctatactctgttttatcaatagttcaaatgtagcagtatagcatgatttccaatgtatgattcccccacgttaaaaatcataaaatcacggattccacaactttcttactgttcacacacttaatcttgtgacttcgtaggtttgctttcgtcagaatcacgaacacgctaagtcagttaatctgtccctatcaaacgccgcaatgataccctattccccaattcttaccgtccaaaaataccacaaaggtgacaagcattcaagcaagcgaaactaaggggttctcacttctcaggccagtctctctcacctcttggcgcgcttggggtcaacgagggcgagctccgcgagcttggcgtcagagatggccttcttagcgtccgcgcccatcctccccgccacacccgcggcggacgacgccagggacgtggacccgtccatcgacatgctgtgctggtgacgcggccgagcgggcggcggcggcagcggcgccgcgggctccggggtctcgagcttgcccccggcctcgaggaacatctcgaacatccggctgccgcccgccccctccatctcctcctcctcgtcatcctcctcctcctcctcgtagtcgtccccgccgccgccgccgacctccccgaccacgccgaggtcggcgtcgaaggcgatgtcgtccgggagcgccgccccgaggaggatctccgactgcgcgcgccggtgcctcgccgcccgccgcggcggcgagtccggcatcgcggcgacgtcgcgcgacgacagcgacgacgactccgcggcggaggcggccgggtccattggggggacgggagatctgccaccggggagggtaatgcgggagcggaggcgggcgggggcggaggcggaggcggcggaggaggcgaggcgagggtaggcggggctagcggcggatggggcggggagacacggagaacggagaggaggaagacatgctctcgttgagctttgaccgagccattgactctccggagaaaaggagaagaggatgcgacgtggggcatgagtggccgcgccgttgggtggtgggcctctgatagtagggcccagtaacctggacttggtgggcttgagacctccgaatattctggactctgccatggagctctccctagcttatcatggggaaccgggaactgggccagggatgaacatttcacagaatttgcgattaattgttgtgcatactatatggaagaataagttcactttgactcccttcaaagttacccgaatctaatccgtgaccctcaaccgtaaaaccggataggacgactccccgaaatattaaaactggtgtaatttgactctctcggtggttttgaagggcagtttcgctgacgtgacgcatacgtggcggtattgacctagtcttctttccgcgtggcgttgacatggcagttatgtagcactcgaattaaaaaatatgtcactcattttttcattaaaaaataatatgacacccacgtgtcatcctccctcttccatcattcctcctccctttctccgttctctctctctctcctcacgccggcgtcatggagcccgactccccgtcgtcggcacctccacctcgccaccgtcggctgccgccaccaccggtcgcggcgtccacctccctgccccccatgtgggggcacctttgcccctcgccgctgcagtagctcggaggcagcgccgcttgggagaagaaggtgcgggcctctgcgggcgtcaggcgctataccccgcgcgtagaagtcgcggcggtgatgaagtccgcttttgctgctcgggatctgctgctatttgcttattgcttgatgaagccttgataagggcgaacgagcttctggttgctagctcaacccgacaacaagctgctgctgcttgtttgcttgagcatgaactgaacaaaaagaaggtttgctgtgctgttgcttctaccacttggcgtaggaataaccgaagaagagtagaaggtccacctcgccaccgccggcgccctcccggcgtcgtccttcccaacctctccttcacggatccacgccggggacctcctccgcccccagtcctctcggcgcggtggccgaacgggcggcgccgcacttggccatcttctgctcgagctagagcagctcggcggccagattctccgccgagggctcgccgaacccctcgtccaacgcagcggtggcggtggcggtcggcctccaccaccgcatccgttcgcaccgcgcgcacggccaactccatgcctggggcctggccacacccctcgacgccggtcatgagacgcgcgcacggtcgttcggggaggacgacgctgggagagcgctgacggtggcgaggtggaggcgccgacgacggggagtcgaggagacggggatccatgacataggcatgaggagagagagagaagggagagagggacgaggaaggagggaagagagaggatgacacgtgggccccatataccggtgggtcccacatttttttaatgaaaaaatgggtgacatattttttttaattcgagtgacacgtaaccgccatgtcagcgccacttggaaggaagaccaggtccataccgccacgtatgcgtcacgtcagcgaaaccatactccaaaaccgctgagggagtcaaattgtaccggttttaatagttcagggagtcgtcctatccggttttacggttgagggtcacggattagattcaggtcacttttaagggagtcaaagtggacttattccttatatggaggctttgggcacccacattactattttttcccctcgatgtcttgtttggattgtagccactctcaaccttatcaaaatattggcaggcaaaaaattggtataagttggttgttttgtttgatgtaaaaattttggtaaagttagttcaaaggttttctatccttaacaaaatactggcatcccatatttttcggtaacaaaccaaatagcctatgggtactttgctattactaacattttttttgtatgattgagatttgagaatagcgttgaaccaaaacataccccgtaatgtcaacaatgaatttggtatggataagatttaagaatagcattgaacgaaacacacccgtactgtaggctactttcgtacgacaagggtgtagcgatagccatttaattcaaaaagatacgcatccaataaaattacctgatctcaatagaggccgagtttaggtccaaactttttcttcaaactttcaacttttccatcacatcaaaattttcctacacacataaactttcgacttttccgtcacatcgttccaatttcaaccaaacttccaattttgacgtgaactaaacacacccagaactatggtaggaaagcaccaaacacaaacaaaaacaaagggggcaaaacaatgcatacactgtgcctcatttaagagaaccgcagagggtaaatcttggcttcccattccaatattccatcatattaggctaaacagctatagattacaaaacatgccagagtttgaaggtgacactgctgtagaaggaaaccatgtcccatggcagtatggtacatgttccaaccggctgatttggagaacggttggaaggtcaacaatctagagtactagacggaacatgctgaaaggaacagattagatcaaggaccagaggagctacacaatgaacgaacagaacaaggctggcatttttattttagctgtctattctaaagagctcttgagactactgaggatatatgttcattcactatcactagttcactactgcataggtacagttggcctggggagcattgagttgactagctcctcgtttatcttcactggtagcggtggcatctgcttcatgatatctggagcatcatttatcctgcaagatcaacgttgcatgagaagcagaactaaattttttagagctgtcaaacgttgcataatatccggagcatcatttatctgtgtatgcttcccataagtaagatcttaatagatttgactgtcctgtaacatggattaccagaaaaatctacagaaaatatccaagatccatctactgataaattttcagtcagaaaatgaatgaaagaatgcctgatgggaactgcaaagaggatcatcgttccaaattttgatg

SEQ ID NO: 6042 - DNA, 6097 bp, Oryza sativa
aaaaagataaactaccaagtgatgagtaaaactggaaagatatggtagatgtaatgataaaatgaaagaaaaatagcatgatcctgaaatatattgatgaggcagtatcaccaggggtcatcttgaaataaacacacaatacctgcatagtgctgaggttggttgaatttgactcaaaacttgggcattagtttcaaggatttctcctgttggacctccaattgctgcaaaaagggggaaaaaaagaagtaatgaattcagcaacctgtcgacagtcccggacataaaatttggtgcacttgacttcagcagtcaaatcatggtccatacaagtcccaaatgatacacgagaaagaactttgcataacacgcgcatttcttcattgcacatgtaactggaccaatgaaaaggttcaataaaacatatgaaactaactgcgaattagttcagtcaatatcaattgtgatttacctttggaagaaatttcatcatcgtcaatgggcagagctggaagggggtacggaggaacattaggccttccagctatatgaacaggtggtttcaacgaagaatctgaaaccttctcctgcagcaataaatgtctgtcagtgtaaaacttgtgaatatagcatgcattagctacacacacatcaaggaactttttctcttggtgaatcgtcacaacgcatgagtaaaataagttgaaaacaagtgctttcacataaatataataaaaaaacatgttcatttcctgccagctgcagaaaaataaaaagtaacagaaaacggttccactttaaagtgcataaatgtaaaatctcaaaaataaagtgcgacacaattataagtatcaagtgcaggcattaatatgaaattttaaattctctcatgcatacaaaataaatgccacatttattggattttttttggggggggggggggggtatagatcaatatagcaaggtccaagctggagctacagaatagcgatatacacttgaaatacgatggctcttgcaaatgccatcttgaagcttaaatacatggcataacttacagctcgaacgatgaaaccatattgcgaattttacattagtacatatgaatgccctacctcttactctacacagttgccaaagcaaagtaataaagttgcaccggaagaaaccattcattaaaaaaaaaaaatcgaccagtgggggaaagaccgctcccacggcattgcactaagaagaagctcttccttgcccggtcgagaaaagaccccaaaggccggttgcctggatgcgccacagggtgctcagggcatattggcctcatacatttcactgaaggcaaccacaatggttacgggtggaacacggaaaagctgacgagggctcttttttttttgtgcaaatcctgggttcgagcccaggaccagcggcttctcaagtggaagcactaccgccaagctaacagcttgtttgcaaaagaacccatttatattacggacaatatggttgaaacagattaaattcacagatgcttttgtggtgcatagtaagtgctgacaatcaataagtattaaaaaaactaattgatctaatatgcttgtttttttttttttggaagagatggttctgacatcttccattaagaaatatcattacaaaatgccagataatctggaggattttcattcagtgacttttcggactatgtctaaccaggttctgttataaatgaacttattgtagcaagtcaggatcaattttcccataatgcattccaacagtcatgagaatggaggggatgggagatattagtaaaaacctttttatctttgcttttcttcgaggagctgtggtcctctttctttctctttccactttcctttttctgcacatcaaatgcataatctcaaatcattgcttggaaaaagggtaacaagaccaggcaccatgataacagagttgaaggcgcatatgctacatttattactcacattcatccatctacaacgcaaggccacgtctcgaactgttttgtctggcaacttcatggctatctttgcataacgaattacaggagcatcagatgcatacctgagagcaagcaccagagtaacatcagagcaaaaacaaaggccctcaaagctaaacaatccatgacgccccctcacaatgttgttttcggtgctactgtcattttgatggcaacaagacgtgtcggtgccatgtggattctacccattatgcaacgaccgagcattcacataatataccgtacaacaaaatagagcaagtcacataatatgctgggaatagaggacgaaaaaaaatagtctctcaacattgctacattatccacttgtctaaacaaatgctactggtagcttttacagggcagaaaaaaatgacatgcaaaattaagaaatattacataattgaaaccctaaatggagccgtcgtacagttacaatcttaattacccgacataatccaagcaattgtatccaaaactcggaaaatcagtacccatacgcaccccctaatccgaattgccaaacccccaaatctgcatgacgcagcgaagcacgcgacttacttgacgagcaactcgtcgagggtggactgctcttccggcgaccactcccgcgccaggccggggtcgtgccggagcgccgccaccgtgccgccggggctagggtttgctccccctcctccaccatctcctcctccgccgccgccactggaatgggacccgttctgcgcggcggcgctcgccggcggcgggtggccgttcgcgcccatgccgaccaaactgggcgcgaattttcttgctcccttcgggaagcggctcgctgcttctgcgctccgagcgccgggagagcccctctcttctctttcccgctacgagtggatggggaataaaaaagaagttttttttctttttctttttggggatcttttcgatcgatttggggatttttgttacacttgttcgcaagccgaggcgggtttctctctctctctctttaggggatttttattagtttgctctgaattgacctttttttttctccctgtggatgcttaatttgtgttttatttttaaccttcttttcatattatctaaacaacaaaccataatatctatcttgaaaataaacttcgaatgtcacttcctatgacggttgatactagtgtgaccgtgtagagctttttttttttaaggcaaggcaccacagacctacgatctagatagattctataattcagttacaccttcgaagttgcacagaggttcctacaaagaaatagtattacacattaacccctgaaagtagcaaaaaggatctcgtaaaaatatagaggaaagattgattatcatatcaaggactatagtgtatctagatttctatatatttttctcaagctatatggttagagttctattaagattgagggaaacattttattactatcaacaaatgttggaaagaaaatattcaaattacaatgatttatatggcttcccgctcttcattgcattatcctggtcctgaggacctcggctacgacaatatataggtgaaccagtgtcaaaattgaacaaatccaccatgatcgagtttttttttgccattcattcgtgatgacattgatcagctcctccaccatttgagcgttggattggagatattggcattgcgtttctgccaaattaaccacgagactatgcatgattactcatgcatagaaacgacgttggtctcgcttcgccactatacgtggcatacttgtaaccacacagtccttgaaatcctcgctagtgggagcgagttgccatggcaagtatgggtcctcgccgccggtcaaaccttcgttgagaaggagcatgatatgggcatatgttcacaaaattttatttcaacggagcaagtagccacaccggattgtgttaccaaccccttgtttacatgttattgccgttagacgggttcatcttattgctaaaaatatcaaaaactgacatcggcctgactgtgttaacccctattttatcgtatgttttttttaccgtgtattaatatgttcaaatctttcagatttaaaaacatagacaagaaggcttatttgaaaagggaaaaaaatgggttgaaaataaaatttatgaacagcgaacgatgttaagggaaaagggtctacaaagtggtgtctaggctagagtaaagaaatatggtaaatatggagtaaagatatatggtaaagaggatccaaacttcggttagaagtgagcctaaaccgatattcacctaattaatagttttattatcacttttacctagaattgtctaggctagttctttcctttttattggagcggctgaagcgttacacatggaaaatattaggaaattcaggctaaaccgatacacagcagcaaggtgaagaaaacataacgaacatgatagattagtaagcgtacgtgagatgacatccaagattaactcccaaaagctcaaatgctaatttagactatgcattggtttaaccgcacgttatactataagcactagtaatatgtccttacagcgttgtaacatttttaataagatattaaaatttgatggcagtgaaaataattttcctaaaatccgtccatttaagctttcattccattcatgtcatatataaaaaataatatgatatggccttaaaaatatttattcaagacaatcaacaattacatctaatcaattcaatatacactatacaaggacaatttatatccatgcaacaaagaatggttgagttattcctcgagaagtcaatatagacaaatatgaaacttttttggtaggtatgcaccattaacgattcaactggttactgcaaaaaccattttaaaactattgacttctggtaaattatggttgaattttgttaaaaatttaaagtcagtttgaaatttacaaatttgacacaaaaaacaaaaccatttgaatacaggacagtttgaaatttacaaatttaaagtcaatttgaaattttacaaatttaaagccatttgagtacaagacggaatggatcgatggtcccttccctgttttttctagaagcggataataatcatattttacatttgatcgatgacgtaaacactatttctggctagtaagttgatgctgcggattcgatcacacccaacaattcggttcgatctttcaaaatttttcatcatctaaatctacacatcaagtagctaggcgacacattgccctgtgagagcggtatgtacgcttcaagcccctgcatatatgacaacatataagtagacctacgtggccatgtcagaacagacgcatgaagcgatgaagatgcataccgtcggcgcccgatacgcccgggtcaaaccgcagctagctaagctagctggagtagctcgctcggagaggaggctgggtcggcaagaaactccaagcactggtggagaagtgctttttagtcccggttcgtaaccccctatagtcccggtttttaaaccgggactaccaatccgggactaaagatcgctatctttagtcccgggtgaaaaaaccgggactaaagatcgatctttagtcccggttgaaaaaaccgggactaaagatttagtcccggttggtgtcatcaaccgggactaaagagagggtagcggcagtccatcagctagtcattttttcttttttattttctcccgaatcgagtggtatgcatatcatcaaatcaaaccccaaatccacatcacaactccacagcacgattcacagattcaccacaaattcattcacaatatccattcacatattcattcacaacatcacaaatatattcacaatattgattcaaaggttcattgacaacatcgagtcacatactcattcacaacatcacagattcattcacaatatcgatttatagattcattcacagatcaaaacatccaaaccacaaattaaaaaaaatcaaaaaaaaatcgactcactggccggcctcccatcccgccgtcggccggccacccatctcgccgcttcccctccggccggatctgggggaggggagggcgagg

SEQ ID NO: 6043 - DNA, 9393 bp, Oryza sativa
atctttagtcccggttgataatatcaaccgggactaaagatcctatctttagtcccggttggtgttatcaaccgggactaaagatatcggggggcctgacaaggcctgacagatttagaaccgggactaaagatcatttttagtcccggttggtaacaccaaccgagactaaagatcaaatatgcccgctgtagccaccaaccgggactaaagatcatctttagtcccggtttttagtggaaccgagactattgtggatttcgggcgaccgaccaaagatggtttctccaccagtgaagagtccattgcatatggctctcgactcgtgtcgagcacacatggctgatggctcccacgtacgcacccgcgactctcgtcgttccggcgtgccggcgatagctagcttccagtacctgctactgctacaccgatcgatatgatcctcaaccatgaaaacacttgacacgcttcactccgcaatgcgcgcgcagggatgtaaaaaaagctcgaggctcgcaaacagctcgagtttggcttgtcctaggctcgattcaagctcggctcgagctccaaacgagccaaactcgagcctgagcaaaagctcgcgagctttaccgagtctggacgagcttgactgtgtatagtttgtattgcatgttcatcttattaatatatatatatatatatattactatctatttacaaaataaattatcatgtgttagcacaatatatttattttaatcattttatactcttttattagtgtgattaactagaaaataattatacttatcaagagattattattatatatatattatactatttatagccgagctcggtaccgagctcgagctcgaacgagctcgagccgagcttgcctaaaaactcgaaggtgcaataggcttgacttgagctcggctcgagcttgtgtcgagctcgagcttgggcagtcgagctcgctcgagctcagctcgttgacagccctacgcgcgcgtcacatgtcctatcaatccacgcgcgcgcgaccgggcgatgagattgacactaggcactatctactccagccaagtacgcagcagatgtcacagccacgtgggcgacgcatggacacgggataacccatcgcgtgcgtcaagactcgagagtgcaaagcccagacgaccgtcactgagcggctgtggatgtggactggacgcgcgacggcacgacgaaagagctggatcgcaccatgcgacgccccccgtgcgggtgcggcatgaacgaatgccaagcgatccatagcctcgaaacgccggccagaaaccctgcgcaccgcggagcgtcttgtcgtttatttccacactagttcgggagacaaggtttctaactttacctcctgatacataaacaaaacaaaaaaaatactcgttctattccaaaatataagacactgtttttttaaatgtttcacaatataagacatgctgctctgctgaaaagtttggtgtgaaagaaatagacagatcttcaaaagcaaagaactttcaatactttagttagtggtaaaaatactggatgaagtgaaacttggtctgtacgtggagctaaggacattgcgagaataataccttagcaagctctgatgtagcaagatgtgttcatttttcatgttactttcctgtcacccttggtgattatgtcaagattctctcctacttaaataaaaccagctttgactggtttaggtttaaaaaaagacatacatgtaattaactagcccatctaatctactaaattattaatatttttaacttttttactctcaaaatctctaataagcatgtgtacacaacatgcggtgtgatgtcccatcccatcctgattttccgagaatgagataattccattctataaccgttattgttctttttttcttttaggaaaatggatggcacgcattcggtcacaaataattcagttcaatcttttacattaactagccaaacgcacgtgcattgtaacataatactccctccgtttcacaatgtaagactttctaacattgtccacatacatatagatgttaatgaatctaaacacatacatgtgctagaaagttttacattgtgaaacggaggaagtattaaacatagcaaaattaagtccttattgaaatatatattataattgactggttgattgaaacaaatactttttatattaaaaacaaacaaaatgtcatattgagaaaatcaaagagttacagtctagagtacatagtgactcacctaaattctaatatcatgttccacatgtcaatgatggtaatggtgaccattatctttttaattacagtgtaaaaaaaaaccaaaatcgtacccatctacctttgttctaaaatattgctatttatagcataataccgtgtcccaaaaataaagttatttctccacttattctatcatccaatcacgaccattccctttcatctatttatcttcttaactaatcacacatattctttagtcattaacatctactttgttaatgcacgtgccaactaaaaaatatctatattttagcacggagaaagtagcgtgtcattgagttgaatcacttcattaggcgacacactgctctgtgaatctggtttacgcttcgagcctgcaatggcagcagaaatagacacacgttagaaaagaccgatgagagaagacgaagggagatgcatactgtactggctatattcggcgcccgatattctactaccgtcgatcgttcggtttatagcaaaggcacaagcacaaccagctgacgctatagcacgctgcacgcccggcgggccaaaccgcagctagctggctagctagcgcgaaaaggagaggctggtcggcaagaaactccaagagtccatgcatggcttcgactcgtgtcgagcacactgcacacatggctcccatgcaggcgcggctctcgttccggcgcttcgaccaattgatcctcagccatgcaacactcgacacttcactacgcctgccttggcatgcgcgcgcatcctgtcaatgttagagcaagtttaatagttgtgctcactacttactataagtgaatgttggagctaacttatataatagattagctataaagttaactttattttttccattctctttctttctcaccctatgaatttaatgcatatttcttgtggcttgtgtgaagctgactcttgcatgagagacaacactatccacttttttttatctctctcttccacataagcatatagcttgcttatagtctattattatccttgctcttagagcatgtacaggctataagccagctgcaaacatattttaagaagataaatgaggagagaggagaggagcgggctacatatttgtagccagctatagtacggactccaagacgcagtgtatgcatgacaggtgggaccagttattaattgtgtagtatataactattgtataaatgagctattagttggctatagatgaattagagttagtagttggctatgctattaaacttgctcttacgccgcgagcggcgatgagatcgacactgtgggcgaacgcacaccaactaccgtattccgtcccgtccgtactttgcgtttgctatctccatcgcactagaactagcttctccagccaagtagtactgcctccgtcccaaaataagtaaaataagtgtagccgtacatatccgtgcccaatgtttgaccgttcgtcttattttaaaaaattatgaaaaatttaaaaatatttattcacacataaaatattattcatgttttatcatctaatagcaataaaatactaatcataaaaaaattcaaataagacgaacgttaacgttgaatgtgaatagtgtaaatctgcacttattttggttcggagggagtacgacgcagcggatgtgacgggcgcgcgtgcgcgaggcgactcagccgagcgagcgagcgagacggcgacggcggcgagagcgcgcgcggacacgggagcaatcttcgcggggccctgtagaatctagcgtacgtgtttcttcccttccccatctcgctcacgcgcgcggtcaagagtgcgaagcacgaatttttttgagaattaatattatttttatggaaaatcgcaaaagtagtggtcaaccggggaaaatcgcgaaaataggtccctgtcgaacgggtgcagttcgatagggcgcctatcgaacggccagagcgcgactggcgacgagatcggaaggctgccgttcgacaggacctgtcgaacggcccccgttcgacaggcagggctgtcgaacagcccccgttcgacaggctgggctgtcgaactgccgcagttcaacaggatgtccgtcgaactgccgcagttcgacagggtcgcgttctccatttatttgtaataagttattttttttaataatatgtaatttattttagtgtgtaagaaaggaaaatatttttgtaatgttatatgtatgtgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacataaatgactaaaagtttaatataaatagataagtcaaggacgatcagtgcccttcgcacgcttgctaggtcctcccttcttcctacgcctaatctgctcagtgggatatgtcaaattatcagggggtgcctatctctagctgcctgctgtggtgtcacgtctggcccctgaccggcctccgtctcctgcgtcggcattgtgacctgaggtgctgcgtgccagtaatccatccctacttccccctggggaggatcagtggaaaagaagtcctcaatgaatgctgtgcgaggggagtaagcaggcactccgtgatgcgtcgacgccgaaccgtactcatcgtctgtttgtacaagagggagaaaccaaaaaatatggcgtagttagtaacaatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagggaagtgtgccgacccagatgctccctgcgaggggtgaacataaggcggagtttggaatacctgcggacgtggtggtgtcgtgctcgacgtgggtacccctgatccggctgaccccctggtgtactccggtgctggggtgtgctgaaaggaaggacgaccgtgagatgtgtgggccgcttcgtacccgcgacgtgaagaggatggaccactccgatccacgctggaacgtcggggtagtggtggtgatggccgtcggcccgacgtctgcaccacatctgccgcgctccgacaggagacacgacgtagtagtgcggcagcacgtgcacggaagttgcgaaggacactcgccacgtcgtcagacctgacgactggaggtctcgcctctagtctttgcagcagggtgtcggactccacgtgaacgtgctcaacaaattccgcctgttccacaaataatcaaggcaattaaaattatttaaccagttgcacatttattaagagtatttaacaagatacacatttgttagaaataatgaaccagttgcacatcatttataaatactgaactagttccacatttatgtaagaaaaggaactaggtgaaccaattgcacatttattagacatactgaactacttgctaactttttaaaaatattgaactagttgctcaaattccacaaataaacacgtaccattgagttataagctgatctaggctgatgggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagtgccaagttatcagctgcgtgctcccactcttgtaccgtcggctgaaccgtggtcacaataactagctcgtaggaaagcccgagcccctttctggagtacctgcacaacaacaaattcacacatcagaaaaaatgttgtgcagtgatttattttaaaaaatgtaggattaaacaactgtgatgtgaactaacctatgaagactatcagccaaaggacgaccatctctcggagggaagtcctgatacatgcccaactgtttgagaaccctgtggacattgtgtggctcgacgtgcacgtccaccacgaggtgacaagtcgtcctccagagttgcatatctcgcgtgcaaagatccgcgagaccgtgcggtgcacgatcattgacatcgtgctgagtgtagggagtccaccgaacacggtcaggcgtaagctgatcaaagtcagctacaaactgagtgtagacacgacgtgtcgtcccgctaacccactgcggctgtaacaagtagtagttttcattagtcatataaggaaagtttgtgaactagtattcataatgataacataaacgaatttaacaaaaattacctcacggtgtgtccacaaggatcccatagtgggacgatcgtcgatgtcatcaacaccagacctgtacatctctcgcaaaccgtagtttgcgtacgagtcaagctgaggcctcccaatgtcgaagcgctcgtgcgcccacaacataagtagcaacgggcatccagggagtgaactttgcttgctgttcctcacgcaagcatcacacagtccggcatatgtcgccgcaagtaccgccgacccccaactgtactgtggaatctccgcgataggtaactctgcaatctgctccgcaaagtggatgaattgcttgtccacggagtcagcgtgagttcccgtgaacatcacccatccaaacaaccacaacaggtaagcgactaagtgccgctgcacgatccactcctcctggtcatcagggaagacatcctgtcgaaactgattcaaccaacttttcgtaggcccgtgcccatctgtgagatcctccagtgcaacaggcagcacaccaccaaaactggccagaaggtcatccgcccatccagcattcaccattgttgggccaactgctggcccagttatcggcagccccaacaaataagacacatcctgcagagtgggcaccatctctccaactgtgaggtggaaagtgtgggtctcaggcctccatctatcgacaagagcactcataagcgccgcgtcaatgtggattcgttcggaccttgcacgtgaaggctcgaccaaccgtgcaaacgtcaacaacccagctgctctcagcctacaacatgacagagcgcaagttattaatacatgaaaatataaacaccttgtattagtaaaaacaatatattttcacacaccttggaacccaacgaggatcaatacgccaatattgatccggtcctcgcatctttagcacattgcagaaagttcctgtactaagacgtcgcgatcgatggttcctatcgatctccttgtctatcagctgcccatcattttgatcagccatacctgcagatcgaaaaccacattagtacaatgcacgtatggtaacagtacaataaatgtatgcaacataattcaattaacaaatttgcatgccatttcaatttaaaattacagtaccagcacacatagatacagataagaatagttcagtacatttcaatttaaaattacaagcccacgacacatatattacgatattacaagtgcagtgcagttcgaaatttaaattacaattccaatacaaatacatgacgatattaaaagtgcagtgcagttcaaaatgaaaattacaaggccattacaaatagattcgggtaataaaagtgcaagaaagttcaaattaaaattacagacgcactaaacataaattgaacaataacgatcttcaaagtagggagtccaccaaggataatagcgaactaaggattatttttcttcttcgacttcccctttggaacgcgacgaacatcagcgcctgtggcatcttgccctacattgtacatgctgcaatctttacgggaatggttctccccgcaaagaatgcaagctttcttacgacgagaacgatctttcacttcagcttcatccataaggttcttgatcctgcgtgactggcgacgacccttagtatcaactaataaatttgagtcaggaacccaattggcttgccctggaggaggacgagtgaaatcacacacggcacgccaaccacgcaattcaccacgccaagttgcctcccacgattcttttctaaagtagggagaaacaaaaatgtttccatcaacacccccttttgcggaagcagcaagaacatgggaacatggccgatgtaacaggtaaggcttgttgcaattgcatttgcaagcgtgatactctggccacaacgtgcattccaatgtgatgtcagtagtcccaatgccgacaccactcttgtcacgaagtcgtatctcaaataacaactctctattcccagcaggccacactctgtggattcctcccttcttacttttctcatccatgtactgtgtaatagcggggctatacttaacactgggtttgctgaggttcagactagccatggaataccttttacagagatacttctgtgtacccctcgtgatgccctccaggatagcaacaagtggtagaggtcgtgtattcttcataacccaattatacacttcagcaagatttgttgtcatcacaccatacctcgatccatctgtatcgtacaacaacgaccatttctcccttggctcaaattctacccactccgtgaagcacttcgtggcccttccacgcttcctgcgccgagtaatacttggtgcttcattaggaatgggttcaagtccctccggctcctcctatctggcaactatgggttttttcctaacctcttccatgtgtgtagtggtcaaacgatccagttgctcccatatggcatcaaactttctttgttgattctgcttgcataacttcttgaacaggtccatcaatctcttactcctgaattgtctataaaaattagccccaaaatgtcgcatgcaccatctgctatgtaaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccata

SEQ ID NO: 6044 - DNA, 10313 bp, Oryza sativa
  unsure (1)..(10313): unsure at all n locations
ctgtacttgcgtgtcatgaaagtgccatcaacacagagcaaaggaatgcaatttttaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccctcgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggcatctaaaccatcgtttaccttcatacgactcattgatatggtcgtccaattatcgggtatgtaagtttcgttgtcccacaatgttgtatcttctccttccactacaagcgcaatgtattcctcgttttccacttccatctgatccactaccgcctcattgtcctccgctgcatcaacagcataggcgaatccggttttcatcgtccgagtcgttggcctcacgattagtaccacgaacaatgacctctccttgtgtattaccctctactacttcttcccctcgaccttgctcagtccgccaaacattttcagcttgtccaccttccaacggagtttcttccaccacggcatgacttgactcccccgatcgatcaacacattttgtcttctgcaccactattgccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactacattgccgtgtactaatttacaactattagtaacaaacaactagtttaataatccaaataaaatataacacctttgtacatattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctctccggcctgctatcccctcccctcgctccctccggcgctcacggcgacgatgtggcgactctcgacggcggctggcgatgtggtcctcaaataaatcgaacaagcatcgcgagctggggagacggggctttaaaccggcctgtcgaacgcccattgttcgacagggtcggtggagggacctgtcgaacgcccccggttcgacaggcctggcggcgcggggtggtgggccctgtcgaactccctccgttcgacaggccagcgtgtcgaacgccagccgttcgacagggctctgtcgactgcccgtcgttcgataggtgccctatcgaattgcacccgttcgacagggacctactttcgcgattttccccggttggccactacttttgcgattttccataaaaataatattaatcctaaaaaaattcgcgaagcacaggcggccgtcaccgagcggccgtcgatgtggactggacgcgcggcggcacgaaataactggatcgcacggcacaaacgaatgccaagcgaatcatgcacagccgcagaaccgcgcactggatcgcaggagctagcgaatttttttcttcttcgaaacacaatttgacaaacctctaatttattaatccagtatacataagttcagtgggaagaggatgcgcggcgactccgatttgtcaaacatgtggcattaggtgcgtagacaggtgatacaatcaaaagcttttatcgcaaaaaagaaatctgaaaaaaaagaaatcaacgcatcaacgcatccctctcgcaaccatccacgactgacctaccaagttgcatcaaatttaaacactcatcaagattcacgcactaaccccacaaattttaatcactcacgatacggtcgcgtcaacttattatttccgctcctctcttgcggtgagttcacgccatccccctccattttccccaaagcaaacgagattagagaaaaaaaagagaggattaatcggtgacaagaggttttcaaaccaaaaaaatcggtgacaagaaaaacgaagaatctgctgctgcgccgcctggaataaaaggcgcacagggctttgggagtttgggaatttctgagccaaggaatctcctcctcttctctctccttcgtgcttctccagtctccacctccctgggcgctgttgccccttccaaatctgcgccaactgcgccaccgtatcccggttttttttcccccgcttcttgtcgctgcgcccaatcaggaggcgaggctgctggcctcgtttcctccgcgcgagggttggggctttccgcgccgcgaccaagaaacggttcccggagcaggagcttggaggcttccgcgtggtctggtgattgagctcgggacgacgggaggtgtagttctgcgcgtcattgccgggctcaaggttggatacttggatttggtgcggatgttcctgtttgctactggttttggggacttttgaggtgggtggtggcgtcagatttgatcgcctttggtgcgtttctctggatcatttgttttgaaattcgctcttgatgctttaagccgctacctttcctgacctttcactccaaaggtttgaccttttgagttcctgtgctgattgttcaacaggtgatcgatccaccagtcctggggagtaggcctaatccctctatgaacaatacgatcggaaaagcagtctcctgttcagatgctgcccattaaactagtcccagtgttgtacaaagattctgtcttttggcagaatacagtgatcccctctgcttcttgtccagggcagaatacagttgctccaactcgatgttggtattgtaggagtggataagtcgtaaggatctttaaactgcacgagtggagcaaagccatggatatgcctacgccatccaaccgtgctggctgcaatggcaacaccggcggtactatgggcccttcagatgatccttatggtgcagcagccatgaaccttgattgttactcggagatttacagcccttcggtggccgaccaactattctcgctgctaaatgatccagctgcacaccggatgtttgctatgtggccatccatgggatcatcgccgtgtgctgctggtacgagtgaagatatgccgctcgatgcatattctggcctaggggaggcagtggaagaaccttctcaaataatgtcagtgaatccaactgaagcagagaaaacgggcaagagttcaggcgagcttggttcggacgatggtgcccatcaagggagtagcatggttccaaggtctgttgtgggcagttcacttgctgacaggatgctcatggctttgtccttgttcagggaatcattgggcagcggtgctcttgcccaagtctggatgcctgttgagcaggagggtcatgttgtgctgagtacatgtgagcaaccttttctactcgaccaggttcttgcagggtatcgagaagtatccaggcactttgtgttttcagcgaaggaggagcctggtctacagccagggcttccagggagggtcttcatctctggggtgccagaatggacctcaagtgtcctctactataataggccagagtatttgaggatggagcatgctctccatcacgagatacgtgggtcacttgcaatgccaatttatgaccccagcaaggattcttgctgtgcagtgtttgagcttgttacaagaaaggagaagcctgatttcagtgcagagatggacaacgtttgcaatgccttgcangcaagttctaacttgatgatgttataccatgaaattatcactttcaaaacttaaataggcgaattttgagtacaagtgatggatactattgctaatgctatcccatctatacttatggctggattctgtagtgcgtcatatgtccatcatttgttagcaacttctataaacactgtggtaaagtacatatactagatatgcatccgattctttgtttcatttgtggatgccatgaagaaaagagtacactgaaagttagatgcaagttttccaattcctatggaaccatacagagtgttcttttagcaaacatatccagtatgtagttctaagcagcgtattgcatactaacgaattccttgaaatcaattattggcattctcaaaacgttttgaggacctttttttatacatatattggtactaaatctttaggattttaactaccacaaaaattccccaaatccaaataagcaaatacccccttgtgtagtttccaccacagtagtttcagtaccctttatataacactgatttaaatatagtgtaattcaccatttggtaatatgaagtagtttcattatcctttattagattgatttattctagcaatcactatccatttgctaatatatcatccggtgttgtcagaaaaaaaatcctatccttcccttaattcctttgcgtactacataataattcactgagttgataataataatgtgaagttgtgggttcatttccgttcttatcaatggtaaactctggatattattttgttttatggtctaatatttcacttggtactttcatttgatactaaacacattacttttctgcaggcagtgaacttgaaggctacaaaaggttctagcaatcagaaggtaccatcttcaccttttgagttctgaacggttatattgtgataatttctcttgcaccccatggaaaaatgtaagttctcattttattgtgttatctattgacgtttgatgaatgtaccatttgtttgtttgcagttttatacagagaaccagaaatttgccttcactgagattttagatgttctcagagctatttgccatgcacatatgcttccactggcccttacatgggttcctacatcaaatggtattgatggtggttatgttgttggaaaggatggtgccagtttttcacaatcagggaaaacaataatacgcatccatgaatctgcatgttatgttaacgatggaaagatgcaaggttttcttcaagcatgtgccagacgtcatcttgagaaagggcaaggcattgcaggacgagcactcaaatctaatttgccatttttctcgcctgatataagagagtacagtattgaggattaccctcttgcacaccatgcacgtaagtttagtctgcatgctgctgttgccattcgtctaaggagcacatacactggcaatgatgactacatactagaattctttctcccggtcagctgcaaaggcagtggagaacaacagatgttgctgaataacctctccagtacaatgcaaagaatatgcaaaagtctgcgaacagtttatgaagcagaagttgataatgttaatgctggtactgcagctgtgttcaggaaaaacaatgagagttgcttgccaactggacacacagaaagttcttcacatggtgatcaatcaatcacaggagcttcattcgaggatacatctttagctaacaagccaggagtcatggaacctgagttggctgagcaggtgctctactaactttaactaaatatgtcatgctatgcacctgatttagtaagaagctgagtgacataactggaatataaactcctttttagtgtgttcgggtcaaaattttcagcagtaaacatgagcaatcaaaatgaacttgaccaaactgaacctttttaaaagtttcttctgtagagatatgtagttctgtaaatatctagaataattgtgtcttagtagtcatagccattgctgaaaattcaattggattatgtatctttgactcttgcctattgaataatgtcatcaaaatcacctttattaatgagatgtgagatttttatatatacctttcagttttattagaggaaaaggtgtccaatggtagtaagctagtagcaaagttcatttgaacatgctagtagcaacccaccatagtcatactgggatgggttaaatccacaaaatccatactcaacattaatacataaatgtaatcaagttgataataaaaagtctagagtaactttcacaaaatcccaggttttgaagtacccataacataaaaccccaggtattacgatttgtttcgaagaacccgaagttttggggcaaaatgtttcaagaaaccccatgttaaagcttatatcattgtttttgctaatatatttatgcataataattgaaaaattataatatgagatattcctgagtatatatacatgttagcctcattttaacaagcattggttattggtagtatgattatttaaatgtataggtatctgattaatgtgtcagtattaatgagataattttgtgtttttttaatcatgcaatgtaagagtaaggaagaagataaaatacatgcgagggatatgtattttgagcctactaatgtgaacatataccaaaaatatgatatataataatgaaattatgagtatttgccataaacatggggttttgctttacatgtgcctcaaaacctggggttttgtgaaatttactctagaatctagaatgtgtgtatccacttgttgactgatctccttctgcgctgcaggtacagcctattccataggacatgcagagaaaagcgcagtacagctgagaagaatattagcttggatgttcttcgtaagtacttctctgggagcctaaaggatgctgcaaagagccttggtggtgagcctctagtgtctttttgtaaaatgaacttaacaaacctttactgtgttatttgatctactttatgtaaatagggtataattaaatggttgactttctgctgatgccttcttttaatattgggtgcagtttgtccaacaactttgaaacggatatgccggcatcatggaatttcacgatggccatctcgcaagataaacaaggttaatcgttcattaaagaagattcaaactgtcataaactctgttcatggtgtggacagatccttgcaatatgatcctgctactggatctcttgttccagtagtttctctgccagaaaagttgacattcccttcttgcgatggtttgccaactccatcagtcggaaaaactgtggaagagaattctgacctaaaatctgaagaagggtgttctttgcctgatggatcgcaaagacaaagttgccagttgcagatctctgatgtgaagaaaagtaacgaggatgaatttcacattggcagtggtaacagtgatttttatggtgcaaatgccacagcaaaatctaattctgaggtcacacaaggtccattatgtcccactggtgcttttagtgctttgcatctcaagggaacagattgcaccaatccttctagctctctccgcccaagttccgaaagcaccagaaatcaaatagttggaagaaactcaccatctatacaacaagaagatcttgatatgcttgacaatcatgagccgaggacaaggaccacatgcacccttctacctctggtatgactgactcttctagcggcagcgcatcaagccaccctaccttcaaacagaacacaagaagtgctcttaaagatgcagccagtcctgcactgacagttaaggcaacctacaacggagacactgtgcggttcaagttcttgccatctatgggttggtatcacctattggaagaaatagcaaagagatttaagctgccaaccggagcataccagctcaagtacaaggacgacgaggatgaatgggtcatcttggcaaacgattcagatctccaggagtgcgtcgatgttctcgactccatagggtcgcgaatcgtgaaactccaggtacgagatctcccttgcatcgtcagcagctcgggaagcagcacctgcttgcagttggcggcacatagctcataacatggtagggaatcctgggctcctgtcacccaaccctcaactgtaccatattacagtaggctagtctttgttgtagcaacagccaatagggtttgtattatgtatgcagtagggtatattatgcagtttagctagcatcaacggtggagtcatcatcccacacagatcagatcatattctcgcaagaaacaatgccattaaggtcttaagtttgttgaacacgagtacatgacaataacctgttgtcatgatggtgtacagtgcttgtgaatcgtggtcctggctctctgttgtactccctccggtttcattttaattaatgttttagacaaagacacggtctacaaaatatatcttttaccttatttttctattataatatatataataaataaatgcatgtttagttttattatagtgctttaaaagacaaatctatatatgttgttctagttcttttaaaccaaatatttttaaagttagtgatggtcaaagttataaaagtttgaccttaaccttgttttttctaaaacgtcaatttatatggaaccggagggagtacatgctcacgaatgtttctgcacatattggtccaactgtaaatctgcttctttcagctctctgaattattgtatattacgacccgtgtgctgtgtacttactactgtatatatctttgtgggcatgaagcgactgagtctattatggcatcttttctgcacactcaatctactaaaaagtgacgctcgacaggaccgattgcttgtcattttaggcatttattggctgaaatgtagccggagcaggttataccgtgtagcagctggtgatttcttgatgatacgaaagctaacacctgtggtcggttagagctaaaaagtccagctgacatgaacaggtcgctgccctcttggttgaaactggacatcatcacttcgacaacaaacggaaccgcacgacagcgtcgcaattcgcgtgtacgacgccttcgccgcaaagcggcatggtggctagccgtagccggtcagtcagacccctctctctaagtccagaactactcgctctgttcacaaatataaacatttctagttcatttcacagagattgagatcgagaagaaaagactttgatgatctttatgaaatttgagatgagtgagggtgtgaaaaagatgtttgacggtaaaatacgaaaaaaaaaggagataattgatgagacaaatactagtactctaaaatacctaaacccttcatcttaaaaaaaacatatgacatgataggacgttttctagtacatgcccagattcattatactaagaaacgtcacatcttgttttaggatgttttttttaatatgatagagagagtatggccgtgtttagtttccctctattcccaactttcaatcacatcatatcacataaaaaactttcctacacacataaacttacaactttttttttcaaactcctaacattcttcaaacttccaactttttttcaggaactaaacacacccatatttgtaaacagatgttaaacgattgagatgcttatatttgtcaagaggagtagcaggggaaactgttttaaacactcgggtggacgtccacccgtttcttgcatgtcatctaaatggttatgaaaaaatttcaaaaaaattgacatgataggttaatatc

SEQ ID NO: 6045 - DNA, 22186 bp, Oryza sativa
  unsure (1)..(22186): unsure at all n locations
catattaacctatcttgtgaatttttttgaaattttttcataatcatctacctggagcgcagggaccaacgaccggcgaggctgatgaagaagatcggagagagggcacggcaggggaggcccatgtcatcatgcgcgtgtgccgccggtccgggagactgacgcggccgcggtggcctggttggtcgccgaccgatcttttgaccggaacttgccttaccggccggccggccaaaagctctctccaattcgtgcaccgtctcgctggacaccggacagatcgacgagcccggcctctggtccagactccagacatcgaaaagacaggaagtggctcgggctggcccgctagccccggtggtccatcgctatggcaatgggacgcgagatggcgagggatcattaggctagtggctaccatcagtcgagcagaacaatcatgccgtgacgacaacaacaacggaagcagttcaggcattagccaggcaccttcctgagtcgccgttcccgttttaatacgatcgagacgcaggaaatatgatttgggtccatctatctatctatagcctggtactgtcaatttccgcccccatggacaagatcccaagcagtatatacatagcagtagcatttatgctcactagaacaaacttaaaaaagagctttcaagtttcaactgctaagccgtcgtctagctgtagcctggagagaataaaatcgccgatcagtctctgcagtggtcctgcctatcgacggattcaggaaccgaagtactctgatccagcggcatcaattccacgctgtgccgcctgcttttgcgacatccatgtgtaccaagtcttaagctagagagactagagcgtgatcaagctgagtgatcgatcggctcagcacacaatagtataccattaccgtgtaatttaaagctaaagctcagctacatgatcacggcgatcttctttagcggcctagctaagctaaagcatcgcatcaacacaggctagcttaggcccaagcgatcatggccgctttcctttgccttttcgccctccccgttttttcttacacatccgatccaacatggccatcatcatggcttccctctccctagcttagctcaattcgccgaaacttaacgaaattttaggatagtttcgattgatctgcacttccgaagcatgtcaccaacaccatgagtgacatttttcttgtgtaggattaatcaatgcaacgcgtacgtgtggcaagtgttgcttcaaattaaacattttttcctgttcaaggaaaggagtactttagatttcagaaggctggcacaggcagatatatatatatatatatatatatatatatatatatatatatatatatatatatatgagctagtttatacttatcggtacaagggggcaaaaggaaaaacaaatgatcagtggtagttataaacctttattagcttttctgaagatgagaggagacatgacctcaatatatataaaagaaaatgttagtgttgtgaattggtaggtttggtagctccagattttgattaatcaatttcttcacttctcagcattctgaaccgcacgtatccatcatgtatatatacaggcgtacgtacatacgccacgaccgcaacaaggcgtgtcttttctattcctgccctgtctctgttctcaaccacctagtagctactatcaatcaccaacttggttgattatatgcataaacccatagaactttctgcccattgtcgatcaatcttttccgctctattagttgaccgatcctaaggaaaagaaaaaacaaaaactattctcggtgatcgatgtcgcacacccaaccctttttctagtactaccactgtaacataacaacatggtagtaccatgaattgaaaattcgaaatgtcttgaaattcactcttcatttcgttattaattcttcacgcgagtactagaagagatgcaggataaaaatgcagagacatcagtatcgtggccggccgtgtatgtactacgtacttagtacctaacctgatcgatttggccgacataagaaactataataaggctctgttttgtgatcttagccttaactacctccctatgtgcagcctggtagccatgtactttagtgcccgttggtggtttatactagtacatgcaaaagcgtcgcaccgcctttttgcctattgggagatttaaatgttggatcaattagcttgagaggaatgatggccaaagagaaagcatatgcgtgctgctaacatgcaaggatcaaagagaaaaggaagccatcaagcagtggaggaaacttgtcaaaagctaaggctggatggtttcctttccttatcttttcctttgagatgtagcgctggaattccgcagcatgtgttaagtctcccctgaaattaggggtgtagattatatagtatgtgtacaacattgtatatactatactggtaggaaatgaagtaatcctaaaactagcagaacattctatagcagtagctatctacaattaattaattaaacctctccattgcaagggttagtatcaagtatcacaagtatgtttgtcacccatgagtcatgactagcgtcatgttgtgttaccattaagcccattttgaacaagggattttaccgaaagctgtaaaattccaagggaaatgtatatatgcaataatgcaagtaggagtatgcaacacacatgcagagtgtacttcatatgcttcagtgttggaagggtcccaaaaaagcattccttgttgggtcatggacgcagccttattccctccagagaactttgacattgatcctagtatcctacggcccaaaaagcgacatgaccaaactgcccctcacccgccgcactgatgaccgacccccttaactaactccccagtgtacctccacgccatgggagctgagctgatctgaatgatcccttctcacttccaagtactccacgaatgtaacaacttgatgtgacctcagttcttctcccatctcctcttctccccaccacgcgcgcgccgccctgcccagatgtttctccactccctcttgatgcaaaacatggccaagaacacaacaacgcagcagcagcagcagacgaggtacgcacactttgcatgtgggatgatgatgattgcttcggttcgttctacgtgtttggctgacgtgatggttccatgcgcaggtcgtcgaaagaggcgggcggcggcggcgcggcgaggtcgagaggggtgtcgtcgaagaagtcgccgtggtaccagcgggcggttgaggtgttgctgctgatatggaagcagccgacgggggcggggacggggacgacgacgaaggccgcggcggcgtcggggatgggggctcggctgcggaagtcgtcgtcgctgaacgtggcggcgtcgttcacgcgggtctgcctgtgcgcgcctatctcgtcgtacaatgagcaggcgctctacttccaggcgggcgacgtggcgccgcgccggagctacagctacccgcgggcgtcgtcggcgtcggcgtccgggtgcagcggaggcggaaacagcaacccgctggtggcgccgccgcccgcggccgagcagagggcgctgatgaggacgcctggccccggcggggagagcgcgaggcggccggtgttccgcggcaagtcgctgacggacgacatcctgatgcggcggttcgtcgtcgacgaggaggccacgcggcggcgcaacgagatggaggtgatccggcgccgccacgcggccgccgccaagcggcggcgcctcggccccagcccgctccgccggatggccctggcggaatcggagtcggaggccgacgacgaggaggagacgacgacgacggaagcagccgagccgacgtcacggaggaaaccccaagccgtacccatcgcagcgtaacagcgaagcctccctgcttgtccctgtctcccctctcaattttttttccctcccttacacttcttctcccgttccttgtgctcttgtcgttgtctcgcaatgatgcaagaagaaaactccgagcaacacgcgcgttctcttcgactcttccatatcgaccgatgcggacgtcccgcccagcccagcgcccgccccgcacgccaaagtacgcgcgcgtcgtggagaaacccggcgaaaccgacgtgtttcccccgcgcggcgcggcgcggcgcgggggcgatcgaaacgcgacgccggaacgagcaaacgcggggcagagttaatgggcgggcagccgacgcaacggctaggcaaggcgcgcgcgcgggaccagcagcgggaagcggtggcactcgcggcgtcgcgcggggcacgcattcattgggcttttttctggggttcgtggttaaatgcgtgatcggtatgaagtccctgccggccgttggggtgattacattgattttaacccgcccgcgctttggcgaagcgaacggacgaacctgtactgccgaagcccagattaatgggcgcatcaacgtacggaaccaaacagcgccggtggtggtacgtcgcgtccgcgtccggcgatatctctggatttctcgccacagttcgtagatcgcggacggtgcggctagaatactagcgtgcagaaatgaccctactcaaaagcaacaggtgctactactaaggctgtgtttgagggtgaggggaccggaaagattgggaagatagacaaaacgaggtgagccattagcgcataattaattgagtattaactattttaaattttaaaaatgaactaatatgaatttttaaagcaacttttatatagaaattttttacaaaaaatacaccgtttagtagtttgggaagtgtgcgcgcggaaaacaagtgacaatcttcctaatctctccccaatctctttgaaaggacgcagcctaactcgatcgcggataacataatccctgctcgctaatactaaaaggtttggagtgccaagtaagggctccatgattgatgttccccttgctttcgggctggaaaagcaaaaggcaatgcaggcttgcaggttgcagctcaggccttcgttcgcagtagacttgtactggtacagacgtgtactacttgtactgtagcaaccctgtgccggtgaacatttgcatcgccggcacggggcccacaaggcttttggcgtcctgcagcctcacctatctcgcctcgagtaatcgggtggggggcttttgggattcgttggtacggctctttggtcttttattcgtgggccctcccgaagcgcccgtgggcttgttttgagcccggaatcggggcactctgcacccgctgctggacaaatcttgcttggcgccaatagccacgggccaacagcttaaattgggagtatgcctgtgattgatggatttgaaaaattatcccggttgatgaatagttgtcggtccaaattttgcctgattaggttctgaccagcaatgcttttaaaaccgtacaagccgtcctattgtgtttctaatcaatataaaaatgaatcattattctacatctagagctattcattcacctttgttgcataaaaaataaccgccagaattataagggctcctttgcaacaaaggttttattaaggatgtcttcgctacaacaagtttccatcggaacagtgatcacggaaaatgtagcggtccattagcacatgattaattaagtatttgctattttttaaaaaaaggattaatttgatttttttaagcaacttttgtatagaaacgttttgcaaaaaacacaccgtttagcagtttgaaaagcgtgcgcgcggaaaacgagagagatgggttgagaaaaggggcatccgaacacaacctaagtgtttttgtaggatgtgaatcttttggaacatttttctatatgctcctttgaatcaaaggaatggatctttcaaatttctatggaatgaccaaatccataggaatcttgaagtaaatctaacatgagctccaggctcttgaaaattttcgtgcgggtcattctctctccaattttatgtaccgtttcctgtgaagcattcaaacaacacaattgagcaattcatttttttttcatattccctagggttacattgtcactccaattcttatgtttttcctggttctgtgttttaaaattcctatgttccaaaggagccctagttgacaaatctaaaaccaagaccaacaaatattggtgaatagagtgagttcccctttgtcgcttaatataagcatgtcgcaagtttttcacgtagggggtgaaattaaatgagaaatgattgttgttggttgaaataagaaaaattgtgaagaaattaaatacgagatagcagtgattggttgagatgagaaaatagatggaaaagtagctatactccctccgtcggacggtgtattttataacaaaatttaaaagtcataagtagttatatttagggtggagggaatattgattatccaaaaactccgatttatcatctagcgaccattttcaccggcagtataaattctacacatggttagcatccaacttgaaaaaaagtgctcgtctggatcttctgggctttcaagagtactattcgtttcttccctgttgcaccaactgtttagttcgttaaaagaaaatttttgaatgtcacatcagatgtttgattggatgtcggaaggttttttttgacacgaatgaaaaaaataatttcataactcgcctggaaaccgcgagacgaatcttttgagcctaattaatccgtcattagcatatgtgggttactgtagcatttatggctaatcatggactatttaggctcagaagatttgtctcgtgatttcccttctaaccgtgcaattagttttttcatttatctatatttaatatttcatgcatatatctaaagattcgatgtgatatttttaggaaaaaaaattgggggactaaacggggcatactgtcctgactcctctgcactgaacatccatggcgccaaaaaaggagaaaagaagaacgaactcgttccttctctcgctaaacgttaacggtggaacgcacaacttcagaattcagacaagataggtaaggatagaataaagcggccgcgctaccgatttcgctctgctaatgttggatctgattctgaacatatattcagctggacggtcacacacctactaagtatacacagtaattgagctcgttgctgagaccgcgcggcacaggacggcgagggcgcgaggcgcttgtccgcacaattacaaaccgcaccgcactacacggatgcctcgcggctcgcgcggcgcggcggccgtcagagcttggagtagagctgcggcgtgcaccacttgaagaaggtgcccgtggggagctcgccgggcgggagcagggcgaggcgcgccccgatctcggcagcctcctccgcggtgcgcttcccccagccgcgggtcatgtccgtccgcgtgaacccggggcagaagcagttgacgctcacccggtcgccgcgcgcctgcagccgccgcgccagcacccgcgcgtacgcgttcagggccagcttggacaccgagtagtccgtccacaccttgggccacccctgcccgcgccacgtcccgtccttcacctgcgccaggaaccgcgacgccatcccctccacctccgcctccgtcagcctctcctcgtcctggagcagccgcttcagctccgggtcgctcaccttctgcagcacaaacacgcagccaatccatcatcacaacgagaaaaacatatctcgaatctcactttttgttttttttttgtgtgtgtgtgtgggtgcgcgcgaggatatctgctgcagatagagaaacttcgatgccgaaattccctttcaaaggcaggttagattcgtttgcaaaattagtcgtcgtgtacacattctgcgtttaatgatgccgttgcactacagatgctgacttgctgatgcactacagatgctgacttgctgatgccctgctgtaagtttaaccaactttcgtcgctgtaaaatactccctctgtttctcgtcgctgtaaactactccctctgtttcatattataaattattttattttttttctagtcaaactcatttaagtttgatcaagtttataaaaaaaatataatagcattttcaacatgaaacaaacacactatcaaaatatattaaatattagtttcgataaaaactaatttagtgttatagacgttgctaaatttttctatcaatttgatcagatttttaaaaaattgactaggaaaaaaaaatcaaaacgatttataatatgaaatggagggaatactgagaaaataagagtcagaaaataagagtcaatagattcctcgctcttttcccgttgctttcaaacctcttatcctcgtcccctttcgtgttttttaactttatggcccatgtatacagatcttttgtgagagaagatctctccagctttagttatatactaatagcatatgcatgtgacgacgaaagcgacgcaagcttagttttacaacctatacaaccatttataactggaaaattttaagggttcgtctctgtgcaagaaacataaattgcgcatgatagtacgtgattttcaaacttgcatataaagatcatctttcaacttctgctcaacactccaaatgtagttgggagtaaattagacggaagaacttctgtaaacttggagtttagctagaaaacaaacaagttgcggattctagtttatgctgtgtcagtgataatgaaagaaaagacttcaaaatgacatgtatttggccgtgtatttgtacagaccatagacaacgtattagccagcacattcatgatgagatatgcattatgccttaagataagcttcaaattataatttgtccaccactggtctcgtgcattcacacttcataatctcaagtctttatctactagctatttgtgtgctactacttgtcaagcttgcctcttgatatgtcaaaactactgttgttttaaaacatagtttgatttaatccaaaaacggttaggtcagtgacactatacttaaagagaattagttaattacaggctcaaagtttcaacgcacatacacttaacgtgactcatgatgtacaaggagaccactatggaattttttttcctaacaatttgagctacaaccagctattctttattaaaaacaaattagaggctagtctttattaaaaagaaaaaaaatctttcaatacgacaagcaacaaatattattttcctcatgaaaatatcatcatttattttccttgtcttgttatcgatcgatgatctatgaggtacacaacaatgaaggtaaaatagttgcgtgttccatcttagatttttttttttcaggagagtttcaaacaagttcatccactagttctataattttgggtgtgacgagatatatggacagggaagcaatactagattaacatgaattataaatatccatttgagcacttacattgagtagtccaagttgggagctgatattcagtattcggctggtggctggtgatcgccggaaaagtggcaggagtgcttcagtcagcatcttggccccatagaagttcgttctaaggaccgtctcggcgtgctccactgagttagtgtcaatttcattgaatgaaactgctgcattgttcacctacatcaacaaaatgtgcagatacaattcatttcatcatcgcagaaaaaagcaagtcatcatggattagagtggagctactgaacgaactggtttcagatagtaacaactcccttttattgcagctataatgttaggaggctggaaatgtactccactaaaccgcacttggtcactatatgtagatcatcttattgacataagttaagggtttgtcgtatcacgcttttttttttaatttcttttctgtttacttcagagactttttggttgtgtgcccacgggcagagaccggagatgtaatccattttcattatctaaaaaatgtggtgtactatgcctatcactccacaaagtctcaggcctcatcgtactctacaaaagctaccctcttaatgtcagttagattacttgatggtatggatgtgccaacaaacagatggagatcgattagatcaaacttaacacccgttatctgaaagtgccagctcaacatgaataaaccacgccatcattgtattcaggtaaggagtatggatcaccattttggtagattacaggtcacctagcttgaccatggcccaatgccccaatctgcctagctcggtttgcacagcctgaagatcatgtgtttgtttttgttcttctgttctggcagctgtcgttaagactggccgtaagcagtaacatactccagttcagtaaattacgcattacacaggagcagctccaagcatatataaacacaggccgggagctatggcttccaacgcctctgcaagtatgggtttgaactttgaacgaatgaaagggagagatatccgacttgtaacaaagtggcaatacggattaaccaatggacggatttgacttgaagaaaattaaacagcttgcagaattaagaacaagaccagccaacaagattgtaagttgttactccacctagatagtcaaaagtgctgcagccagagccaatcagcgggcagcggcacgttatcatgagctttttaatactccctatatttcatactctatccttccacaaaaattacactactccgtattacttttctcaccaagaccaaacacaaattaactatctaacatataacaaagatcaagtagtgtaagcactcatgcaaccaatgagtattaagatggctcattagtttctggttaaacatttaatttacctattcatttaagtctttgaatgcatagagacaaaatagaaacaacttatttggaaaaactaagatataaaataggtctaactctcgtggatggagtattataagacgggtttctaataaggatcaagtttatagaaaaataatagcatgtacaacaccaaattagtttcattaaatcgaacattgaatatatgttgatagtatatttgttttgtgttgaaaatgttactgtctttttagaaaaaacttacagaaatttaactttaaaaatatcaaaatcgtgagtgtataacatgacttttatatgtacatttaattattcatattattcatttttgaaaaaaaatgaaacaacataaaacatacttatttaaaataaaacaaaccacaacaaaataaatagtgataactttttttttcatatgacgaatgatcaaacgtgtgtctaaaaattaacgccatcatatatacttaagagagatgctctagtgctctatactagtagtattatactaccattattattaaggataaattagtaagttactaattcaatgaatatgagttactttgttatttattttttttctagctaaatcgatctatgatcatccatcacattggcatcgctcatatttcatcgacaaagccaaaaaagaagaaaaaaagttgtcactactaaatgatgattataccctccgcacttatttttttctgacaataatgcccctccaccttatagtataaatagatatgaaccatttgatcaaatgagatcaatgatttagatagatttctactgtcagtagagagcaccgtagcaagtctcgtatacttcttaaagaaacgcagcaagtatttgcgagctatcagaaccctgacttctttgagcgctcgagttggctccgggcgcaagcgaaacgaaacgcaacacgttggacgttaggaccaggttgcgggccgacgggccgtgtcgctgtccggcagcatgcacgagcacgactcagcctcggcgccgggagggagagggaagggagcccggaattccggatgcgacgccgaccgtctgctacgtgtcagtgacagagggggcccagccaaagcgaccgctcgcccagccatcgcccgcatgaggcggtggcggcggcggcttcggatttgccctttccttttccccacacgcgacaattttattcggttggtcgcccgccgcgcgcgcccctcgcccccttggggcctagcagggctagcactcatggcgggaggagcaataatgcagcctcgcaagaaccgatcttgacgggcgctccacttccgcctaaatacgcaatttgcccaatcgggcgtcgcatgcatacgaaaatcgttactgttctataccgatcgcgagcgcttactgtgcaggattaaagtggcagagcgtggcctaaactgttggcgataagatacgttgccatcatctggactgtggagaagacgtaataatgacgggcgagcggaaacctcggagaaggggaagggggtttgatttgacgtgatggctgactgactcaccaggatgtcgaggccgccgatggcgtcgcggagccaggcggcgaaggcctgcacggaggcagggtcggcgacgtcgaggcggtggaagacgacgtggaggccccgggcacggagcgccgcggcggcggcctcccctcgctcggcgtcccgcgcggtgagcaccacggtgatgccgtgctccccgagccgcgccgccagcgcgagcccgatgcccctgttcgcgccggtcaccacggccaccgtctccctcgtccaccacgccctgtattacgaacggaacgaaaaaaaacccagtcagatcgaacgacgcaaggacaggacaggaagccgagcgcgagcgggcgatggtggtggtcaccttgccgaggacggctccttggagctcgagtagtccatcaatggacggagcgagagatcgatcgatcgatctcctctcgttgagagctctgcttggggctagcttggcgcttggtaagggaaggaaagaaaggttgaggtgttcgtgccgggccacgcgcgggtggtggggagtggggggcactggatcgctgggcgtccggcagtgggcgaggtaggggagatatgtatacaggcggacagacaggccaggccacgccccgctttgggtggtcaaacggacgggacgtatcgcgtactggagtcctatgcaccagggagctgtcaagctcaagccgctgaaggggtgaggggaaccctgtggagagttccaacttccaagtaggggcatgtttaggcccctttgaatcatataggaataaaaaaacaaaggattaggaaaaatataggattctgacataaatacaattgtaaaatagaggattgcaaaacacagaaaaaatacaggaatggccgtttgatcggaccacaagaaaaacgcaggaatcagattagagagatagactcagaggaaatgttccaagaggttagacctcttgctaactttcctctaaaatatgcataggattacccattccataggaattttaaaggattggataggatgcaatcctttgtttcaaaggccttcataggatttttttttccatatgattgaaatcctccaaaatttctacatttttcctacaaatcaaaggggcccttagttcgcgaaataaaaatttttgggtgtcacatcggacgtttgaccggatgtcggaaggggttttcggacacgaatgaaaaaactaatttcataactcgcttgaaaaccgcgagacgaatcttctgagcctaattaatccgccattagcacatgtggattactgtagcttatggctaatcatgaactaattagactcaaaagatttgtctcgcgattttctccctaactgtgcaattagtttttcttttaatctttattaatgctctatgcatgtatccaaagattcgatgtgatgtttttgggaaaaactttttgggaactaaacggggctaggcgtcctactatgccgtgggccgtgcaatcgaccaatcgacggtcgcaccctatggtggtgtttggatagggactaaaaatttagtcccgtcatatcggatatttgatactaattataagtattaaatatagtctaataataaaattaattgtataagtgagagctaattcacgagataaattttttaaacctaattaatccataattagcacatgttcactgtagcatcacataggctaatcatagattaattaggcttaatagattcgtctcacgaattagtccagacttatggaatgagttttgtcattagtctacatttaatacttctaattagtgtcaaacatttgatgtgacagggactaatattttagtccctaatccaaacaggcctatatatttaggtgtggtaagggcattagcaatgtgtcgggtttatttcgtgtgactatatgctccacctagacaagaaaattgaatgaagccacacatatgacaaattctaatctcccacagtgcgctggcctccctttcttccccaggttgtgcccttcatctcctcaggctggcctgcctccttgccttcccccaccagcaccggcacagctccacttcccctgactgccagcgtagctctccctcctctccgctgttccccttccccatcggcgcctctcaatctcggatgctgctcgagcccaactcaatagctagcggcggctgtcgcctccgacctctccctccgtcatcccctccccgcctccaacctctccctccgccgtctcttccccgcctccagcctctccttccatcgaactctctagatctggcccgtggctcatggactcgggcggcggcaatggggaaggtggcggcggctcgacggcaatgctgacggaggctccatggaaggcccgtgtaacgctccgcttttcgtgagacgttaaaaactaattcagtaaaatcctaattgcgaaaatttccgttctttgagtgctgagtctaaagttgtgccaatatctcaatttaaatccgtcctcgatccctctcatcaccatcaaaatcatcctcctcaaaattccttttccaattcaagactccaaatcaaatcccgaaattcaaatcctctcttgaaatccttgcgaaatacctgttcccgattcccatttgagttccttccttgactccaccttgtgtccctaagaccaagcatccaattcgaaatccaaatccaaacccccaactcgaattctctccaaatatgtcttctctgtaaaagtctattttgcgtcctcataattttggatgggctggatcccctcccctcggcccatctccccctctcaacccgcacccctcgcacgtgcattgcatgcagccgagccgagaaggagggccgctctctccctctctgtctctctctcttctctcccggtgtcaacctcccgtcgccgccattcgattttcgccgccgcccgccggttcccgctaccgcggttttgtaacaccccgattttcgttcgggattaaaaatcaattaataatacatttctagaaattatattaaaggttaaatcaatttaatcaagtgaaattatagaggaaattaaaatttcctttaaaaaaatcattggccgggaatattttgcaatattctttgtgccccaaaaatactctccggatttttccgcaaattttcggagctcaagaaataattttaaagtcacaaagttcatttaaccaattagaataaaaagaaaagaaaataatcttcccctttcccccttttgggcttggcccaagccttcccctccactcccgtgggccgcgcgcctcctccctctctcggccggcccgcgccttgcgaaagtctactttacgtcccccggttttcctcccctccttcctaggccggcctcctccctcggcccgctcggctctctctccctcaagtctgctttacctccctctcccgttttcccctctctctctccccgacaggtgggacccgaggccccacctgtcatcttcatcccttacctcccgtcgccctaaccgccgccatggccgccaaatcctcccacgtcgccgcctctcccgcgcgactccctctcccgcgcgtgcgtggacgcggtcgtcgcccacgtcggcgccgttttcccccactctccccgcgaaaatcggcgccggttaacccctccaccaccccacgtcggcgcccacttcgccagccgattccgccacgtccggcctcgatcccgccttcccgagcccataaaaagcacccccgtgctcccctcgtccatttccccttgtttcccgggcccggcactctctccctcgctctccccacgtcgttcccgcgcgccgccacactccggcgaactccggccgccgtttcccgtcgctagggtcgccgccgcactactccgccgccaccgctggctttgccacctcaagggcacgctcggccgccgtttcttcctccccttccaccacgcgaaccacctctccaccgtgctcccgctctccatcggtccccggcgagctccggccacctctagccgccgccctagccactgccgcgccgcgccgtttgcaccaccggcttctccgtgcctcgccgcaccccggcctccgctccgtttccccatttaatcgccgcaaccacccttccaccgtgcatcccaagccacctccaccctacgccgccgggccgccgttccgccttcgtcccgaggagcgccgacgccgagctcccccgcctttccccgcccctcgtcgtcgcgtccttggtgagctcctcctctccctccttgcctccctcctctgtctcccatgcgtgctgccacgccggtggccgccgccggcgaccaccgggccatgtgccgccgccgttaggtcggccggccagcttgtcgccgccccgctcgcctaggccgcccggatccccttgccgcgccgcaccaccgctttcccgcgtgcgtcggcgtcgtcgcaggaggccgcgccgccgtgagccgtcgctcggccgggccggcctgagctgtgcccgtgctcagccgcgccaccccgtggccgcccgatcagctcgggctgatatgggccatcggttcccgtggaccagcggtggactaccccgtggtcccggtccacggtggaccggcgcccttgtgccgctgaccggtggggcccgcttgccggcgccgccctcccctttgatgacgtcagcaaccgtcttttcctttggaaaaataaataataattgcgtcataattcgttaataattctagaaattcatttaaatggctcaaaacttctaaaattcatatctaattcattcgaactccgaattgagccattcaacttgcaaaattcatctaaaattgagctctacatgtttgtttactttttatgtactgtttccttggtttttattagagtttttcctcattttgcgtgccagcgtgtagttcccgtcatttcggaagatcgcggtcgcaaggataagagttcggaagattgtttgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctgttctttgtcaaccttgggtaataaatcgactagctcatgttacttatgtgacctagctagaactatatgcttagccatgcttaattaccactagctcagttgatggggtaattacagttttagaccttttagtatcaggatgagctgcgtgctcgagacatctggccatgcttcatggtcgtaattatccaactaaaatgcgactgaatggtgggctgtgggtgcatggttttgctagtcgcacccatggcaattaaggaccggttcgcgggatgccctggaagaacttatcgtacttaccacaagccagcgtaggcaacggctgggcttgtagtgtagctttcctctagccgacgcatccaggcaagggtgggcgtgatggagtttggatgggccctgcgacggcctatgcggcttccggattcacctaggcatgagaggggactgcccgttgcccgctggggacgggggtgaaacctgaggtgtggtgtgcttggctagagggggttatgcgaagggtcctgtcacggcctctttccggtatatcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccatcttaataaatcgacccaatgcactgtagtccaggtgggttggttgggcctgttcaacgtggtgtagcattgatcagtggagatttaatgttactctaattactcaaccgttttactgttttgctcaataaaatgttttacaactgcctttatgcaaatagccacaaacccctccttgtatccccttgcacgtctgcatcgttggtgtggcttgctgagtacggtggttgtactcagtcttgctattattcccccttttcagaagtgtagtgcttctgagctgaagatggagttagaggaccaaggctcagaccccagttgagttttgcctgtggagtggagctgaagccccgctaggatcgcctttttccgctgctgtcgttctgtttcggtgcgaggactaagtgcctcttccataagtattttacgcttaatttacgtttggaactgtatattacttgtcgtcttgtgtaccctggctggtcctggacagggaattaatacgcaaaatagtctggaaatttgggttaaatttctgggcgtgacaggtttgaaccctcccaccaccgctgttcgattttggccctctcccgcgcgtcgtggtggctgaccgcccggtcaccgtccgccctggccatgcctgcgcccgctctgccgccctgccactcgctccaccttcgcgcgcgtgcgtccaagacgtggaggcagagcctcggctcccctctctcacgcgctctccctcctccctctgctcgcccaaatcggcaagaagccgagctcctttcccctcccctttttgctttttccctctcagcccggccgcccgtgaccacctcctgccgctccttgaccgcaagcgccgcgccacccgagcacccttgaccacctaagtcggtttcctcccccaaaaccgacttcccgtgcctataaaaccgcagccgagcccctcctctcaacccctcccgcttcactctccacgttgtcgcgccattgtcgcccctaccctgcagtcgccctcgccgtccgtcgccgaagcaccagggagaccggtgcgtgcggggacgcgagacaaggactccgggcacctcttcttccccttccccggcccaaggccggagagctcgccccgcgccatcggttaccgtcctgcgcccgccacagcacggtagtgcatctccccgttttcctccctcgctccacctccctccttagatttgggtagtagcttgagtagtgcccctgtagcaagctggcgccgccccaagcctcgccgccgctcgctgtaggctcgccgccgttgccgcccactcccggaggccgccgctcctcgtcggccctcctcggtgctcttccaccccatccaacgccagaaacgagtcccctgagtcctagatatgctcccactccgctgaatcgaactcccattgctccggtggattttccccttttgctcgccgccggccgccgccgtagcaatccgccaccgtcgatcttcctccggcgaatccaagccactggctcgcctcctatcgtgcccctcttcactccggtgtgctctcccttggccgaagaccgtcgcgccgtgctccggtgagacctccgccgctcaccgtccatcttggccggcctccttcttcttcctcccaccagcccgcgtggcaaccacgaaggcgccacgtcggcgccagctcggccgcaaccgggtcaaaagaccggtcagccgcctccctccgtcccatctttcgtgcgcctggtccacggagagccctagcggctgcgcgtgggcccgccatctcttggtccacccggtgctcaagccgtgagccgcgtccgccaaaccctcgcgccgccttgcgtgcgcccatccctccgtgagccgcgtcaccgacaagcggcccccacccgggaccctgcgaggtgcactcggtccaacggaccgccccctctctcttccgcgcgccctaatgggccgcctcaccatggccgcgcccggcccaatagccggccgagccatataaacccctcgggccgcgccctagccgccccgaggaagtctgatatctctccctcctccaatttcaaaaagggtttaataaattattaaatccttttttcctttagatagaaattccttaatccttagaaaatccatatcttctcaaccgttcatccgattgactccgttccatatccagtaattccgtaaaattgagatatatctaatggcactattatttagtctaaataggatctttattttgggtcttgtgtaggtttttaattgtttgcgtatagttgcggttaccggatttccgtcaatcgcgggttttctcgaagattcgtgaagcttcgtgaagaccttgagcaaggcaagtcacactttgatcaattgctcctataattagaaaatcattattattttgtttgcaactttcattattagaatcacacacttaacttgcttggcctcggtttgcgtgccaaaccgacggacctacccagtagttgcactaattcctgtaggctgtactaccctgattccttatcgctccacccttgtggtacttcggtatccgtgctctttgagcgcgcataccaaatatcccacatacaccgttgattgtcgaaaacttggaaaatgggtttgtgaagccttgaaaacccgacatgtggtgtcggtgtgtttgaaaataaaatgaattgcgaaaactcgcgatgcgggagccgtgcctacatggcgttgtcccgtattcgcatataaggaccgattcctgtgggaaactcatcgagcataatcaaagtgcaaccacaaggtggaatgggacaccctggctaagtaactagtcggttcagggaaacctcgcatgccaatagttgggaacaccggggcggggtcggacaaaccaggttcctggtaaggcaaggacaagaagtttgctcacttaccgatcaaggtggttggaattgatttgtgaatgcctaaaatggcctatacttacgtgaggatttgatccttctatgtggcatgaggtaaccctgggtcggcttgggaaaggctttgtcgcgaacctctgacaccggccagtgtctggagtaagttcgtgtcttgtgggtaaagtgtacccctctgtagaggttaactaactgttcgaacagccgtgcccacggtcatgggcggatgtgaggtggttcccgttgcgtagatttgtttgcgtgtgctttgtgaaaagttgttgtggtttgggaatcgtaactagaatcagcctacgtggcagatggatgacctgagtggtcagaaacgaatctgtgtgattcgggatgtctacgggcatcataaattaggcttcccgagtggaaacagattgttatgctgctgggcagctggactctgggagtccgagaaaatgaaaaaggctctgagagccgcctaatcaagtgaaatggctctgggagccgataagtaatgatctgaccccgggggtcggtacattaccatttgagttgttgaaaagcatctcttaagtcgaatcgagacgcaagtcaccttttcaacccaaacttaaaaagaaataaatcacttagtgatttcaaaaatgatttcaaacaaaggatttgcaaaacaatcttgcctctcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6046 - DNA, 690 bp, Oryza sativa
gagcaatctgatgttgaatttgctgaagactctgatgatgaccgtccattccctccacttactaataatgacaagttagcattagaggaatgtcgtgcatttgagaaggtgtttgggaggaagccggacattcctgagtttagggacctaacacatgcccatggtgcactactagatggcggcatcaacctagatcagttgccagaaccattccaggtggatggtctcagaaagggtttagagttcccatccatggtcgcattgaagctatggctccaggagtacgccatcgtgcaccatcgtccataccgtgttgtcaattctgccgcaaataggaggtacactgttaaatgtgaaaacccacggtgcaaatggaaggtccatgcaactaagaggtctagtggcacgtggaggatatcacgggtaggtaaggaacatagttgtgctactgccgaaggttcagggagccaccggcaactgacatcaaagttcatagcaaataggttatgcaatgccataaaactgcaacctacactctctgcttctgcgttagctttgtatatatttgaggttttccagtatagggtgaagtatggcaaggcttggagggcacgagaggaggcaattaaactcatttacggtgaatggggtgaagcgtatgtccgtttgcccactttgctgcaagccatt

SEQ ID NO: 6047 - DNA, 12910 bp, Oryza sativa
  unsure (1)..(12910): unsure at all n locations
nnnnnnnnnnnnnnnnnnnnnnnnnnnnnnnnnnnnnnnnnnnnnnnnnnnnnnnnnnnnnnnnnnnnnnnnnaattaattgcatgaaacatggctagctattagatgatgtgtggataatgctctttacatgatacaaaatgttatgttaattagtgtgtgagagtgcatgcatgcatgggagaggaaggaggctagctttgcttgaggatgaggccatgagggcatgttctcctaactcaaggccacatgccaccacatgatcatatcatatataccttaacacagccaacaacacaacacctgtctctctctctcatgtatccaagcacaccaccaaaccaaccaaccatgaattagcatgcatgtaagtgcatgcactagctagctaagctaagctcccttttgatttgcctcctcatcacaacaccctggctatacccttgcatcatcaactctctaatatctctatgcatgtgttgtgtgtcatgtggactgctgccacctcagcaaaagttcatgcatgcatagagagaaaaagtctcctctcctctcctgcatcatgtgcaacatgcatttttttaaaaaaaagatgatatacatgtatatacttatgtagctagtgcatggtatataaatgtaccttgtgtgtagttaagtgtgtttagaggatgctattataatatagaatcatagattatactcacattgtgtgccaccatgttcccctatggggagctgatcatgatagccacccaatgtgccatgcaatcagggcaaatggagatattaatttgcaatatattgcattgcacatgtagattaatctccctgatttggggcttgattttgccatgttctcttctcatgctctcccacaatgacaaatattctcctcttggccaccactacaataatatgtacatgcaatgtacctcatgatctctgatcctgcatatatatatctgacgagccgacgacacgtgtcactcgcgccagccgtcgatctgtctatcaacagcgcgatttgcggaacaagattaactatagttggtggtgctgcccatgagcaagcatatgtattgaagatatatgtgcaacttctaggaagattccatggagaagattatgcaattgatcatataattaatgatgatcatctagttagttaattatgttcttttagtgaaattagttaattatgttgatgcatccatatgtggctgcagttgagcaacagccagcaggtttggttggttggttagttaaggttaattaagaatgcaattagattaattggaccgtacaaggggataagtctaccttagaaacaaaggtcaatgtgatttgagttattagtatatagttttggtgtgaaatactactgaaatggacgtcaatttccaggtcttagtttgctttctccaatacgcgttttgttaatcaatcaattagtttattatccctcattctgctgcaaatgaactgcacatgcatgctcgattaatttttcccttttgttcttgataccttaagctagcagctgattcacaaagattgaaatgatttgaataaacaaatgaaaatcgtgaaagttctctgtagaatttcaaaagattctgcctctttcggcagaaatctgttgtagcaaaggagcaaaccgaagcagataataatacactttattgacaaactactaactgtcacaaacttgagcgcgtcaggtaagtttcagatcctaaatttgtgtaaaatattgccattatcacctagtgtcagatcagattattatctcgatgaatcaagcgaggtaagaataatcttcgattaattttccccttttctcttctgataccttaagctagctgggtcacaaagattgaaatgatttgaataaacaaatgagaatcatgaaagttctttgtagaatttcaaaagattctgcctctttcggcaaaaaactgttgtaacaaaggaagcagataatgcactttattgacaactactagctgtcacaaacttgagcgtcaggtaagtttcagatcctaaatttgtgtaaaatattgccattatcagttactgtcagatcagatcattatctcgatgaatcaagcgtggtaagaataatctttgagaaatatttgcactaactaattcctactcgtctcattggaagaaaaaaaaaaaggaacattattctgaattttacaaatgagcccctgacgacctgacgttggcctgaattttacaaatacgtgtttctgcgtttgtttcgatcgggaatttcacacaagtccctgtttatttcagagaatcctacatttttgcaaatgagaccttataaaatagtattattccatgtcagcccttttcgtatctcctactattatacgcgatcagatcaagccgttgattccaagatcgacggatggagatgcttctccggtctccaagatatttccgccgccgatgaggctatcgcgattggctcagtgaagctgcagccaccggagaagccatggcgccgccgacggcgaggtctctgctcgcctcccacgccgccgtccgagccgcggcctccgctcgcaggggccgcctcgccggcgaccaccacccgccgcaggtcgcggccctccggcgcggggactgggtcaagctcatctgcggcgccagcttcgaggtagtagcacacttccgcttccttccctgcaagcgactgagttgcgagttgtagaagtggggatggaggagcagcgctgcgaacggagtagatatgatgagaaatgagagagagagagagagagatttttttttttttgctcttgtcattttgttaattttgcaaagggaaacccagctcaattgacctgtcaaggaacgatttctgatgaagttggtgcaaatccctcgtctcggggacatcgattttgaatttatattgagtaatgaaactagcaatggtgatagtgtgaatggaaattgtgaaatgcttgggatgtgattttcttgttcttgtgtaggatgctgccgatgtcaggaatctctcccttgtatacacgcttgccggaggtatgcttgttgctctaattataaacatttttgtggagcatatatgtagcatttcagaattcagactggcatcataacataatgggtggtgtttgaaaaatatcatgtcaacttggtaaaatagctgttttcaggaggtggttttcctagcgacctccttttgtttcgacagcttcttgtcggaattcgaagtttgtaaatttgtgcatacccttgatcttaatgaaatttggtccgcctctccttcggcagacctggcaaaaacttggtaaaatagctgtatattcagtgattccattgtgctaggttaatctactcttgataatcatggactgattttgtgtatgcagtggattgcattgattgtgcagcagacgcatctgtggtgggtgcagtgaatgaaggtattgatgtagcagcctcaattgtgccagcagttcaaaggccatgggtgatggttagtgttaatgacgattgcagagatcttcatttccgtaaagctggtaaatgatgtgctctttacaaaagttgtactctatattttgagtttatttttggatatttgttaatgccactttgaaataacagtctcgtttttattatcctcatttgagtatggaaaatttgaaattaaaagaaagttctgctgtatcatgttaaatgaacttggtttcctgctttcactagcaagacctgttgcatgtttatggatttctgaatacctttgttctttgcttctaaaggtttccacttcctttctcttttctctagaatttgatcctgaggattgcccaccagattgctcaaagccatgtgagaaagtctgtcctgctgatgcaatattgttagagagggttatgattgaggaagagcactctcagtctgatccttcatgtggaaaacttgaggtatcaattggtttgtttactttattctgcttttgtttattctcttcatttcattttatgacctgacctctgatgtcttgtgtagggtggtgtaattacggagcggtgctacggctgtggacgatgcttgtcggtttgcccttatgacagaataagtgagcactgagtaatgcattccttcgtttttcctttatggcatcatgacaatagtttacatgacctttgttcccacagtgttctttacatgtatatgtagcatccctatgtttttaagcataatctgatacttccacgcctttgtgtatcttatagaagctacaagccttgcttgaaaacatttcaggagctatgtcgtatgttcgagatcctgctatgactgctgaactgttgaaaaggaatgatgttgatgcaatagagatacataccactggaaagtacgtaagtttttctttgatgatttttataccaagtaacatttaccttttctccattactcagaccacttaatctgaactttttttgctactgtaggggaactgatatgttcaataccctctggagcaacttgggtgagtcaatcaataatgtgaagctgattgcagtaagtttgcactttgtttcatgatggatatgtttcctattgcatttaccatcataatgaataaaaaaaaaactcatacctttcaggtcagcctgcctgatgttggcgattcaacagttaatttaatgaatgcaatatacacaacaatgcagtcccatcttcaaggctataatctttggcaggtttgctatgaagagaacaaatgtatcaactgcagattctaatttgtctgtacatgatcatactgttcataactatacttttagcaatttgaaattctattaggacaattattttcttggtgttggctagttgattctacattctgtttttctgtaaatgctttgctggtccacttcatgtcataatctgaaccttatccatatccatatccatatccatatgctcaaaatctgaggttattcaagttaccttatttatacaagcagttagatggccggccgatgagtggcgacataggccgaggtgcaacgagggaaacagtatcctttgctgttcatttgtcttcaatgtcaaataggcctcctggtaaacaaagtcaatctttagaaaaaaaaaaactcgttatggctttgttatcatccacatttctaagtattttctaataatatggttttgaaggcttctatcagttggctggtggcaccaactcatacaccatagaatccctaaagaaagctggtcttttccaatctacaacttttcctggtattttgtttacttttttttaacatgtcaccggattttgtttactttgttccttttcttgttcaacttatgaggtcaaagaatactttaggcaaaatcacattttaagcccttgaactattaaactgtgtgcaattaaacctatgccttttgaaactgagcaatcaaactaatgttttatattctggtaatatgtttatttaatccatgaactatccaactttatttatcttactgaaacttaggggcagcaacctctggagtgactgattgtcagcaagcctttattggagggatagcttatggcggctatgctcgcaaggtttgctcttgatattacatttacagtgttttttattggaatgatactaaagtattcagcaaatacctgctagaatagaaaggctaaagcatagatactgtcagtggacgcaccaacacctagcaactagttaaatgaatgttgatctctatttttcttatttatgagttgcatttctcatccgataggattctaagtgaaatcattgctagaatagtcttgtatgtcatgttttgctcattttgttttttcttatgagttgcagattgttggaagagttctacgcaaaataccggcacaatttggccatgcacgcattgaggaccacccagattatctcctggaagcattacaagaagctctatcactagtcgggcctgtgaaaggttacccaaccttgccaagtctctgaaactagtaaatggcatctccaagttctcatccagatataggataactttgatccagttagttagtatggaagttgcattgtgaaggtaagccaaggtgagaaggtattctgccaactgattgcccaatgaacagtttgggagttgggaccaaccatttctggctaagtggcaaaaatcagtaatccaacagtcagcagatcaatcactaacttactcttaagcttggtaagtaggagatattccatctgagattggatgtcacaacatgctttccataaagtccatgtaaaactccataagaaaggtgtaaaaatccatttgttgtttgcatgtacaccttgaatattctatatagttcagtggacaacgaaggttttgacgtggacatgtactatagaataaaataattcaactttgttgcattttaaatggtccagaactccagattctagatgccaaaatacttctagaaaagatatattgcattttttttcttaatatcaggtcaattggatgtggatgatctttggataaggaatcttataccatgagcggtcgctctcgcaataggcacatgacgttttggactgatggtgcacgcatatattattatgtatggtgtttttactttcttgttttgtaaatacaaattgaacaacttgcacacatgttttgcttttttttcaagggacccaattggttgtcttattgttgattgagaaagaacatgtgcaagttgctaaattttgacattttatcttggagcaattaaatttaaagttctacaatttgggtggcattactatattattgatggattataaataattgaaaaggtctcttattatgcgtttggttgaaaatatggaccataattaaaactttgttgcttgttttatcaccatttttcctcttcagaaaggaagtgcacggtcaactcatcattctgcaaaactagctgcgccttttctttttgaaaaaaaaaatcttagatagaagaaatacaggttcatgactattttgaagaacaggaacagacaaattaacacttgaatactgattgacaacaagctaacaagataagaggaaccaaacaaaaaaaataaatggagaaacacatgcatggctgactgcttgtcaacgtggatcatcatcatacagatgctggccagctgtcatgcagaaagagcacaactctagacaatttctctcctttttcctcacatgaaagtaaaggccctgtggctcaacaaataatgtgaagatctctcattttcattttccttcttttccctagagaaagtagtagactgcaccaataaatatcctaacagttactcttcaattatatgttaattatatattgtttgactcttttttaattaaatttctataagtttaatcaagtttgtagaaaatataccgctattttcaatacaaagtaaacatattgccaaggtatatttaatattaaatttaatgaaactaatttggtgttacagatgttgctttttttcccaaagaactttcataagcaaaatatcaaacgacttataattttatgggggcgaagagagtatttattaagaaagcataacagctttgattataagccgtaacctttttagcaattaaaagtaatttatgtgtaatatatttacatatgtgtttttataaaatcaaaaatcataaaaataaaatataaatttaaaatttaaactttgactacgattgataagccaaagagcaaacactataacttttttaacacatatttgcatcaacaaatatcctcttattgaagaaaaataaaagtttaataagaaaaatagattaaaaaaccatccctggcatcaagataggcatgtctaaaactctggatcaaacaaatatgcttatgaatttcttgtttgagaataaaatagtgaaaagagaataaagggagaacaagcaggcgagtatttctaccttgcttccccatcccttccagcacagtgacctccacaagccaagaagctgcaagagcaagccaagccaagccaagaacgaagcagcagcgagagcgaggtgagcagcgagcatggcgggcgaggcggcggcggcggaacggtgggtgggggcggcggtggacttctcggaggggaaccgcgcggcgctgcggtgggcggcggacaacctgctccgcgccggcgaccacctcatcctcctccagtcctcaaggaccccgactacgagcagggcgagaccctcctctgggaggccaccggctcccgtacgctcctcctctcccttctcttccacttctacctcccatggcgctcgcgtagtcgcgttactgttcttgttggttgatccatccatcccatccgaatcgaagtcggatatgatctgcatgatgatggattccacgcgtaggctctgttcgatgaccagatcgagaggattaatcagtgatgcttttcagcttcttttgctgagtgattcagtgatttactcttctcagtcactgtggactgcttcttggatttttgcttatttggcgcgtagtagatgatgtttcttgattggttacttaagtttgggtgatttctttgtgtgaggttgggttagtttgcccattaccataatggaatcgaccgttgatttaccagacaccattttgtgcaacccagaaacgatgattgactagtggattggccgataatttgttgctaattgtgtactgccagctcctgggatcattcaccttgatatccttcaggcaaaccatagtgcatcatctttgtctcatcaaacatttttgcaagaacaggttacttggctagttggctagtggcagaatcacggcctagtgtacttaccattaatgggtgactgtgtatcttcagaatctttacccacatcctgctatatctccagtttaagattcggtgaacagtttaggaaaaatggtagatagttcatctttcatatgcagttgcgcacaatgtccatgtttcgcattataaagatagatgtcacaagctgtccaaacttttggagtttgctcctggtcaaaaaaaaacttttggagtttgcagctagagtatttacctacactgcacttaataatactgtgagtattgaaacactcatcagtgaaatattttgtcatgtacataaatggtaagtattggccatgtatttgtgctttgcgtcgccagcgcacgctagttgcatgtgagggattatgttatgctgatctcttattaaggtgtgtgtttgcatgatgcatttccaattcagactacttgcaagtgaaggattctgttttgttgatatgttattaaggttattctgcaattaattattattcactcagtgctgattattctagtctgcaaacaaggactgcttaacatcttgatttcgttgggtttttttaatatacagcattgattcccctctcggatttctctgaacctacaattgcaaagaaatatggagcaaagcctgatgccgaaacattggacatgcttaatactgtggccaggcagaaggaggtgatcactctctcaataccatatggttcaattaattggcactcccttgcaatattataaggtttttggttcttttatacaggttgtggtggttttcaaagtcctttggggagatccccgtgagaagctatgccaagccatcaacgaaatccccatgagctgcttggttattggaagcaggggtcttggcaaactcaagaggttgtaaccaaagcttttccccccattgttattgatgcacattgttcacatcattgccagttctaacctttgcattcctcttcctggttccttcagggtgctgttaggtagcgtcagcgactacgtcgtgaacaacgccacttgcccagtcacagttgtcaagacagccgatggttgatcctattgtcataaatatccatgtgttatatagtctgcttaaatctttgtccatctatctgaaacatattgaaccaccatgcagtgtaattgtaataataaacgaagtcaactgaagacgctcagttgtactttgtgcttgcactctctgagcctgactatgaaatggatcctgctgtttttcttagcaatctgtgctgaacttgagcaattttttttcctgttttttcacactgaatgtcttatcagagcacggttcatgcaagatcattcagcatggatcctgctgtttcccatagcagtctgtgttgcctgtctagcaattctgatatgcaatgtgacgcaagcaacttgagcatgttcttttttctgttttttttttcacactgaatgtcttatcagggcatgtgcttcatgcaatatcattcttcagcaagggcctcaattttcagaggctcctttgcacgtttttgaatcttgatctatctttgagatgagatgatagcatgggctgcaatacgtgttccaacctgtattccaatcacgaacagacatttttgttttcgattgtttgtgatggaaatcttggaattggcaggactaattttctgttgaacctcatgatcttgggagtattatgctacttgtcacaatgagctgattgtgacagggaagtaattgcatagagaaataatgcaaattctacactggaaaggcaatatctcagaaaggaaggcagcaaatatatgcatggtagaacggtgagcagccataggaaatagaggttcatcagccatgacaattctcatcatgctgaaatgctaaacatatggcctaatgccatttacatcaacaaccagcatcacagatacgatacaggtatgatcagtcatcacgacaccaaactacagacagcaggttaaggctaacacatttcaaatccattcatcaaggtagcaaaatgtgcagcagagccaccattagaagcagttcatagtggtccaagatagtcaccagccagggtagcaaggagctggaactggcgatcggcttccatccagcggaaccccatgaccttgaagcgcacgacggtgtccttctccagcttcgagtgttcattcatgaacaccgcgttctccccaccaatgtacttgaagtcgctcatcgtcttctccgacagaaagatgctttctatcggtccagatttgaggaaaatgccatgcttgaggatcttgtccacggagccaactaagacctcgcccttcataggcttctgcgtgatgcaggtgaacgtcaccgggaaaagaacgtctccggtcagctcacgcactttcccttctgatatcgccttcagctcactcacagcaatgtagtaaccatgatccttggaggccttccggtttgctatatcctccagaaggcggacaatgacagccttgcggagcaagagaccctgggggctcagctggctaggtgagatcaacacattcaaagacatctccaccttaaggaaaaccatggttgattgcctgtcaaaaagacccaatattcaagatgtcagcctatgcccatgcaacagtctttcaataaaagtaacatcaacaaatgtttaagagattgcggcacagagctaggaattgcatccccttctgctaacaaggatgaattgcacacttgcaatgttgataaaaggaatataaaatttcaaacatattttcaaggacatgacacatcaacagaaattcctcatgtctgcatgaacaaattcagtatatacacaactaggagcatcagattaaacggcaaagaaaaaaaatggataatgattccacttgatggaaaagactgggtatatttggctttggccttgtaacgccaatacgccatcatgtaaaaccatgatccaaccttttaggtgtatacacttaaaaaatttcaatttaatggtattcttaattcaatgctgcactttttcaggaatgtaacatctatgatatgcatatcacacacaacaagtgtagagaaggaaccagatctaccaaaagagttgtgctataatgtcctcctacataaacttttcacaaatctagctataatgtcctcctacataaacttttcacatatctccaagaaaaatatagtcaagggaaatgagaaaaccgcaaaacatttgcgcagcttgcaccatcagcatacatctatttgttttagcatcatcagatctgtaccagccccatggtctgaccagagataccagatccagtgcctaagttgagccggtccaccgcagagatcctagttggcccatacagttttcaagttgccaaggcaactcagcccacagttagtcctaaatgctagaaagagcccacagctggctttgaaacccagcaactacaagagtgagaacaaaccatttgagctaacagttgcatgtttcctgttgtgaaatgagcctacataagacagaagctccctgaattcatacaacattactacaatataagatagcagctccatagtttcgtattgcgaatgcacctacataatacaagacgttatcatcatacagaagctccacaaatccatacacttggataatacaacaagcatgtgattcaactggtgacctaattagggtacagccactgaacaacactggtttgttcccgctagtgcatttgcctactctcaagtgcacaccaggaagaactatcaagatttcctataacttaatatactagatagatttctcccatcattaacatccaatgctacacacaataagaatataacctcggataatgaacaaaaaagactccaccgatttatgaaagtcgccttgagtttgtgcagagcattttaggcgcaaatcaaagcactccgaacttgggacatggggggctcagttgaacccccaaattttttggggaacaaaaagaaaaaaa

SEQ ID NO: 6048 - DNA, 29819 bp, Oryza sativa
  unsure (1)..(29819): unsure at all n locations
ttttttttacttacttaaaagtgcacatttntgcgaagtttgagatggacaatctctcttctatgctaatatttcgaaatttttggccaaattttagaaatttttgtcccagagttattaatgtcattaggataattatacagtactaatcgaatctaactagtcggcgatggtatgttattggtatattgtagatcttgacaaacttaatggcatattatagaatatgaataaattcagtgacacacagcggattctctcttaaaaataatatagtaaaagcgtttctttatttcattcaaaacaaaacattttctacctaatgttaggagaacttcaagagaaggtaagaaaaagaggaggttggttactagcccaaatagacagaaactcatggttatgcttaaaatggaaatgagggagtccttgttagtgaacaaaccaaagtgtgttgaaagcatggcaacacgaaaatataaccatgacaccatcacaagctcacaaagatggaaatgttgttgtatttatcattggcatattgctctaggcccacatatcattctcgacatgcaaaatgttactttccggttcattacaaattaatctttatttctctacggttaaatttcagttcaaacatttaaagtgataattacttgtcgttcaaaccatcaaaatgttgaaagcgagaaaggttcattaccaaagaaatgttgtcttgaggccaaacggggcctaagggcacgtttggatcctgggcaaggctcatcctaacctcgcttagtaaagctacacgtttggaactggtaaaataatctggcttttggttttggggacgagctagctttgcagggcaagaaaattcttgctagccagtgagaaccgatttagctctccttcgacggcaaactccgttcgcgtgaaaatattggaacaagggcgatgcagacttctatgaaattggcgccgtaaaattagcgatgtttttcaatgactcacccaatcttgtcggcctcttcttccagatcttgttgtgaactctcgctcgctcaaattttgttgtaaattgccctctccaccaacccataaatacaacgaacaatcagtctggatctaaaaggaaaaattgatttatggaagaactcagcaacaagaggaactcatctgtagcagctagccattaatccttgccacaagaagcaaaaccatccaaacagaggagctacaacaaggctagcaagttggcaaatagatggtttagtgctgctaggctagctgggcgagcgaaccgaacgcgtcctaagttaatttgtcctattatatctaacctcgacacttgtactgcacaagacactagtgcgctcccttgaacagctttttttatggctttttcactagaagctgtaacaactttggtttcttttggccatctttcctccaattagaacaggattgcatacatcttaacagcaaagagagatgcaaactattaaagtttatcatcacaggaaaacttatgacatttacaactttgaaattgaaatatagcaagataaatcaagtagcctttccaagtttcttttgaccaaagaagagaaaagtgccaaagatctacatgacccagagttgttttattcaaaaaccaccattcgaaatgaaggtagctagatgcatgatgagggaaattttgttgcatatgggtgaaccccaaagcttacctaatggcattgtccgtcagcatttccagtgcgtccaaacctcaatgagacgcaccgtagataacttatgctcatgcgtcagatacacctaatttgaaccgacggtaaaggattctagacggtgccgtttgtagcggctttttcgctacttttcttggtgagatagaagacagtgacaaaataagttgcaaaaacaacaaaaatgtttatacacatgtacagcatgagctctacggtgtccctggagagcacaagctgtcaccaagccataacaaacggtcgaactgatcttgaacactggatccaatgcatggtttgttcagtgctcaaagagaacaccagcaaactttccatttagaccctcacaagccacaaatatgcggaaaaaaatgtcatattcaccctccaaaaagcttatacaaggacttgtttgtaattatcttaaaatacaggtgggtaattgcaaagtgagacatcttcccttctataaagagcaagcttagcttggtgatcaccaccactccacatctcttctccatcaagaatcaatcactcgctcgtcttctcctccattggagctctcgatcgagcttagctttgcgcttcgttcatccatggcgctcatcggcacggtggcggccgaggtgctcatcccgctcgcggcggtgatcggcatcctcttcgccgtgctccagtggtacatggtgtccagggtggccgtcccgccgcacgacggcgtcggcggcgccgggaaggtggagagggagagcgacggcggcgacggcgacggcgacggcgtcgacgacgaggaggacggcgtggactaccggggcgtggaggcgaggtgcgcggagatccagcacgccatctccgtgggcgcgacgtcgttcctgatgacggagtacaagtacctgggcgcgttcatggcggcgttcgcggcggtcatcttcgtctcgctgggctccgtggggcggttctccacgtcgacggagccgtgcccgtacgacgcggcgaggcggtgccgcccggcgctggcgaacgcggcgttcaccgcggcggcgttcctcctcggcgccaccacctcggtggtctccggctacctcgggatgcgggtggcgacgttcgcgaacgcgaggacggcgctggaggctcgccgcgggatcgggcgggcgttcgcggtggcgttcaggtcgggcgccgccatggggttcctgctggcgtcgagcgcgctgctggtgctgttcgccgccgtgaacgcgttcgggctctactacggcgacgactggggcgggctgtacgaggcgatcaccgggtacgggctcggggggtcgtccatggcgctgttcggccgcgtcggcggcgggatctacaccaaggcggccgacgtcggcgccgacctcgtcggcaaggtggagcgcaacatccccgaggatgacccccgcaaccccgcggtaagccacgccacgtcactctcctcgtcctcactctgttaaagattaagttaacacacataaaaattaagttaacgcacatgaaacgagaaagctattagcatataattaacttttctttaagataaaggatttaaataaaacccggcttctacatcccgaagaatgtacacagccaaccaaatccatacaaaaacactaaggctagtaaacatgattaactaagttttaattattgctaactgataaattgatatatctgatagtttaaagcaacttctgtataaaaagtttctgtaacgtatcgtttagttgtttaaaaagcacgctaatacgaacagaggtaatatctgaattttaatcagaaaagaacatgaccgaaccaattcgatctcatattttaaaacaactcaaagctgcttgcatgttgcatgcgagctcggttcgatctgagccactgcactaatctgaaagcaagtccagttggcctttttttgttgccttccttaaacattactaggaagcatgaaactcacgtgttcagtgttctctgctagctggcacaggcgtaacgcatgatttttaccggatttattcatagaaatataggagagagattgaaaatttattgtcttgtttggagaaaaggaattatttaaaaagtctcgctaggaaatatttaaattgtggacaaatttaaactgaatttgacttagaaatttaagtgaattcaattcaaaccaactttctttttaaaaagatcgattgaaacaaatctattttggcagttgatttgtgtatgcatccactttggattgttcttttgactgaatagctcaatatctgaatatttgtaatgattatttgaggttacaaacgaatgaactaaatattgttttcttttcgtttcgtattataagatattttgggtataatttgaatagatttatgcatgaattcagatacgtacaatatgtatatgtgcgcaaatttatatagatattagtgaatttagatgatgtatgaagaggccaaaacgttgtataacatataacggagaaaatatagagttgagatcgattttggtttgaaatagttttctcgaaagaaattatatatacaagaagattttataaaatgcttttatataattgtatcgtttaaaaaaccgtttaaaagtttgggaagcttacaaattcacccccatcgttcccttccttcaaagagaagtgatacatcatatatggttttgtacgtgcgtgtggatatgatgtgcgcaggtgatcgccgacaacgtgggcgacaacgtgggcgacatcgccgggatggggtccgacctgttcgggtcgtacgcggagtcgtcgtgcgcggcgctgttcgtggcgtccatctcctccttcggcgccgaccacgacttcgcggcgatgatgtacccgctgctggtgagcgccgccggcatcgtggcctgcgccgccaccacgctcgtcgccaccgacgccggcgagctcggcgccgccgacgaggtcgcgcccgcgctcaagcgccagatcctcatctccaccgtgctcatgaccgccgccgtcgccgccgtcaccttcctctccctcccccgctccttcaccctcttcgacttcggcgaacgcaagctcgtcaaaaattggtaaaagaaaaaaaaaccttacatagtgtgtaatttatttttttttggtttttttaaaaaattataattacacggcagacatacgcacacaaacaagaccacactcacatccctgtatacaatacattttttttaaaagttttacaattacacgggagacacacgtgcacagataataccacactcacatccctgtctatgtgcattcaacaacacattcttgatttcggagaaatcatgttaaaaacctagttacagtgcgtaatatttataagcaccaagatttgaatcttgttgggtggagccatgcacctatgactctagcagttgtacttgcaccaaatttgattaaattatggaataataatagttttgtctgaatttttgttgaataattcaggcacctgttcatctgcgtctcagctggtctgtgggcgggattggtgataggctacgtcaccgagtacttcacgagcaatgcttacgggtgaaaacgaattctacccacccaaattcgcgatgattctacattttgtaaaatttcaaattttgatgaaatttgcgttcaaatttcaaattgataggccggtgcagacggtggcgcagtcgtgccggacgggggcggcgacgaacgtgatcttcggcctcgccgtggggtacaagtcggtgatcgtgccgatcttcgccatcgccggcgccatctacgccagcttccggctcgccgccatgtacggcatcgcgctggctgcgctggggatgctgagcaccatcgccacggggctcaccatcgacgcctatggccccatcagcgacaacgccggcggcatcgcggagatggccggcatgccgcggcgcgtgcgcgagcgcacggacgcgctcgacgccgccgggaacacgacggcggcgatcgggaaggggttcgcgatcgggtcggcggcgctggtgtcgctggcgctgttcggcgcgtacgtgagccgggcggggatccggacggtgaacgtggtgagccccagggtgttcgtcgggctcctcgccggcgccatgctcccctactggttctcggcgatgacgatgcggagcgtggggagcgcggcgctgcggatggtggaggaggtgcggcgccagttcgacgagatcccggggctcgccgaggggctcgccgcgccggactacgccacctgcgtgaggatctccaccgacgcgtcgctgcgggagatggtggcgccgggggcgctggtgatggcgagcccgctcgtcgccgggacgctgttcggggtggaggcgctggcggggctgctcgccggcgcgctggtgtccggggtgcaggtggcgatctcggcgtcgaacagcggcggcgcgtgggacaacgccaagaagtacatcgaggccggggcgacggaggaggcgaggtcgctggggcccaagggctccgaggcgcacaaggcggcggtgatcggggacaccatcggcgacccgctcaaggacacctcggggccatcgctcaacatcctcgtcaagctcatggccgtcgaggcgctcgtcttcgcccccttcttcgccgcgcatggcggcatcgtcttcaaccacctctgatgaagctgagctccattgctaataaattaagctgcatgcatgctctcgccatgatcgatcagctgcacctgcatgcacgcatggataaacaagaagaagacgatgagcattagggttccttaaccagttgaaaccgataagagtaataattgtagctcgggataatgcagtgtcagatgtaatccaaagtgtcttgttgcttgggatatgtaatgcggtttgagacttaggatgtaatccaatgttgttttagacttaggctgcgttcgtgtggagaacaaagggagtttgtttgtttcgtttttcgcgtgcacgcttttctaaactactaaacggtgtgttttttaaaaaaaatttctatatgaaagttgctttaaaaaaatcatattaatctatttttaaagtttaaaatagttaatactcaattaattatacgctaatggctcatttcgttttgcgtatcttcccaattttctcaatcccctctcccccaaacacagcctcttaatcccatgtgtagtagtgtcgtcttaaattaccaaattattacctgttgataacacagcctcttaatcccatgtgtagtagtgtcgtcttaaattaccaaattattacctgttgatggttaagtttggggtcggcgttgtttttccaacgaaagcctgatttgagaacgtgcaaatgagcggtaaactgaacacccacacaatctttgatttgacacaacaacgttttgcatgaggaccaacagaacagagcaactttttgcctcgacacaattttgcaaacattggattgggatggtacaataaatcaagttgaaacgtgctttataagttcattaacataggtaaaaccttcctacaagtttgacgacgagtgcaatttgctctgtttttcccctaaatacgtagacgtatctgctggaaaccaatggacaatggtgcaagaagcagcagcttcatcttaaagtgatctcaaatcagcaatgggcaattcacagtggacagatatttgccatcaaaatcgtttgaatttcatatgttccaagctgtttccatcaaaatcatgtgaaatttaggcattccaaacagcccgacaatggtccacgttagtatatacaggataccaagaatttgttaccgtgtaaatggggggttttgagcaagatacttcaagctgttgtaaaatggttctgttacatgagtgacagcttagtggatcatcccataggctgattaaaaataagagatgtaaatagtccaatcgaagggcacattctgtgcccgtgagagagctcacattgatctttaggcggaagctaaaacagcaagaccctctcctttttgtctatagtgcagcaccaaatggcatgttggttctcagcttggtattcttctctttgagtgtcaatttacatgttcagctgagccgaaatcgcggttgagatatacaactttgaccaaaactatctcacctccgaccatgcttgctggctcgagggtcagaatgctatggattcaacgaccttcttcggagccaaatgtgaagcaattccttttcgtcgcaaggaaaagcaatcgacttgaagccaatagaggaaaaaaaatatttattgtcatctcactgaataaggctctgaatcagttgcttttgatgtatttacagtcatctcggaaggcgagttccctgcatctttggtacagtcatctccattttgatgagtggaatccaagcttcctgggtcatgttgtagattctgagaacctgggccttcctcccctacatcaccattgccttcagaagttttcgtgcttgaggaaggtggatggggaccctgtttatctgccaaattcgagcgtctgcctgccacactagccgcagcgacaatctttgagcagataaatctgggttccatctttggttttttgggagacctcccatcagcttgtttgtcatccactggattacgctttatgactaaggcctcatcatcctcatcagctttaacagcccttttgggaggtgggttgtaaccctcatcatcgtcgtcataatccacaagcccaccagatttagacctgaaaaaacaaaagatctgctaaacactggaactgaagtatgttttagagtccagaaattgcataatgtgcgcacagaatgtaaaacgtaacaagttattatgaatataaagaagaagaagccagtaaataaatcttcaatatgagttggcaggaagttatcgcaagttatagaagatgagataatgtaccttgcagggatatgacggatgtcacttcccttgggtaacttatccaaagattccttctgtgcatatgatgtctgtttatcagaatcttcctcatcactaaggtattaaaataaaaaattccatgtcagttaaggacgccatctatgaactcaattggactctttaacacaaacaagcagcaaaactgaagtggacaaacctgcccttgttgaaatagtcctcctcttctttgtcgagacctctttcttctggcttctttctcatgtcaactagactaatactttgtgttgtttcaccactctccattaactagcaagaagacatggagaagcattcaaatgaggcaacagtaacaacaggatgcaagaatacacagaactataagtttcaacctgttgatacttgagtttaaaggcctgaatgctccctagtttttcgaacctcacaagttggtcccaaaaggatttggtaacatgtatcacaagtgaattgagattttcctgtacaaataatgcatcaactgacagcacattatgtagcattataacaattggcaaataactcccgctaggttacctttcgtatgtattccaacagttcaaggacaacagaatgtagcatgttgtacctatccccattttcaacaaatacctcgataattggtttcaatgagttgaacttgataacatggctaagaagaagctcatcctgcagagcacatacaacactttatctcgagttccccaatgatgtcaatgaacctacaattagaattcaaactgggaaaaaaagtaaatgtcatacatttctagcaataacagtcctcatgaatcggacggctgccacgaccaaaaccttctctctcctatgggttaaagtaaggattttctccacggaattgcttcttaaaaagttgaccctacaagattagacctgccttttagcaaaacagcaagacatgagatgtccaaaggaaatattgaattaagaaaaaggaaagggaagcatttgcattgagtattacttgatcttgtaggggtgatgaactacacaaaagcataaaagctcgcagatgttagacagtatttcagtcttcacagaatggttttcaactcttgtacccacaccaactggactagatgttgattgggtaatgtccataggggaggaagccaatgctattacatcaatcaacttatcaagatgcttttcatgaaaaacatcaataactcctctctgcgacagaaagagataacaaaatttccatagtaactcaatacaaattacacgttaacagtcatgcttcaatattttgaagtgagcagaaaatcatgttggttcaagaaatatcaaaagtttcacaatttaggctagttcatcttacatagtttgtaggcatatttgtagcaaatccatccatcagaatcttcaaaatttccagaaattgacagtgcattccctcaccaaagtcagttaccatgccttgaacctgaaatttcagtaatagcgagcagtatttgtaaatacgctagctgaggcacaaacagcagatttgaagcttagcaaaaatgtattccaacattcctggacataacagagaaatggaggcacctgagaaaaatacctcaatcactagtaacttaatggttcaactacaaataaatgataggtcctcagattataaaataaccatcgctaccatttgcacacagaactttcccaagatttctgagttcattaatcagctgtacatcacattgtcaacggtcaagcatgcagctgttggtagtgtcgacaacaaacaggaaagagaagcatttgcatagatttgaagattaaaaaatgagaagagacatgattcgaactccaaaggctccacaacaaatccaggagtcgcaaagtgcagagaatatagctaaaatagcagaaggtacaaaagttgcagaacatgaaggccattaagaaatgtaattcactgcttggaccatgtataggacaggggaacataaatccaaaaccaggacccagaaaaggggtgcaacttacttaccagaagaccaagaagtgaatttccttcttgagaattttcttgacgagcaatatatgatctcagtaagttaggatcttgattaagaaaatatacaaggatgtctgtcctgcatttgccaaaaaagaaacagtgtgattagaaatagtatatgcaaggaaaagtcaaaaatataatttgctcattgctctagattgcataagttacccagctgagacgagcactttatcctgactctgcaacacatcagacatgatgtcaaacacaccttcactagcaagatccctgaacagggaaaagaaatgattaacctgctagaattgtctctccaattatccaatttacaaaactgcacttaaatgctatttatttgaacagttggttgcattattaatacaggtatatctgcatagcacgaaagaagacagggtaacaatcatgattcatagtggtgaacaatgtccttataaacacaaggagactgcgcttaagcaaatttgcattgtagaagacagagaacatgattcatagaatcatagtgttggcttgtcatgaggtgaatgagggtgcacaacacacataggccacaggagtaacatgacaaatggaaggggttttccctgaaacttatggaagtttatcatatcccatttcccatgtgatttgccaatgaaagtgaaacaaaaaaaatgaagctgtttacttttctctatcttctgaataagctaggaacaaacttcaaactaaaatgagctggattcacattactttttgtagagtatagatatatctaaaataattgtctaattttatctatcctccttctatcttatgaataaatgtgtgcattatatttgttgccagtaattgcctcgtatttgaagaaatatgttttctcatcaaaattaaatatatggttccattgtacacataagcaaactgaaataataagaaaaatagatgaaatactaaaccaggtacatcatcctgttctggggccataacctatcatcatcatgtttgtttgggcatcacacatacaacttcattactccctccatcccagaataagttaatctagtacatgatgtggcacatcctagtactacgaatctagacaggagtgtccagattaatttattctgggacggagtaagtactaaattaatttattctgtatgtactagattaatttattctgtactagaataatttatcctgtactagattaatttattctgggacggaggaagtactaaagagagaaggttctcaaaacaccaacctagatagacgtaattgctgaacagcctgcaaacttttagtgagagtacaaaactcaagcaaaaacaggacctgaaaaaacaaaatgttgtcaatccaaacagcatacacaagaataatctccccagctcccacccccaaacacaacacacaatcagtaacattatatcaatgttaaagaactgtgtgaaatgacatactccctccatcccaaaacataacaacttttgcatggatgggacatatcctagtactatgaagattcatagtattaggatatgtcatatgtctcatccacccaaaaattgttatagtactaggatgtcccatccacgcaaaagttgttatattttgggatggggggagtagaaggcaacaatgtgcataatacagaagtacaaactacaaaatatcaagaaaattgatgtctccaaaaactcacagcccacatcatataagcactcaaatgatgaagcaaatgttcagcatgcataagatattttggctcaactgcaaaagaagcatcccaatagtacaagatgatccaataaaactctttgaccagtaactggcttcagtaaagccaacacagtatctagttcacacaaactcaaccttggtttgtcttgttccctccaagcgcgcacaaaatcacaactcacagaacaccatgaaaacactttaattcatgaaagaaactagcaagcattgacccttctttttcttttccagcagctcagcgattggaaggggtagttctgttgaagatttgacagaacatactataaccttactaagattatgactagaaagaaaatttcccaggttctcatagggaagggtgtgtctaaatatgttagaaaaaaaaaaaccaacagtctcaccagttcgcgttttgattcagcagaaatattcgaagatctcatcttagcaaacagttcttttacaaaagaagcatcgtccttgagtaaacaaacaacctacaggagaatcacataatctgaaatagcgaaattacagaagaaagttgattcaaaacatgtacaaaatctatagtgttgaaatactaacagcagcattgttcgcatgaatgattgcagcaatgcttgccatggtagaatcatcaagtactcttggtaatataacatcctgtaaataccaagcaatccagaccaaaacagtcaagcacaaaaatggcaacagaatcaaaactactaaaaactccatgtagcaagggggcagagaacagagggcactgacctttatatagcctattctgtatgtttgatgaatctttgaaaccacagaagcatttttaatgggtatagcctatgcaaaagaaatcttgacatgaaaatcactccatcttaaccaggatatgatgcataaaactcggtttacctccttgaaaactacatgctccttcaggaaagtgcgatgattttgcacagtgcgagcctctggatcatctgctcagatcagatcactgtatcccattagtaacaaacagcgtatgcaattatacaggtatgttactatgtagaatttcccgttaaaatgacaaagcaagactttatcattactgatgtagacacttatagaggtcaagggtaattgcttacattcaagtgcgcctattatctcaagaataaaatcatcagagaaaatcttgtcatatatcgcagaactgttcaacaatactgcagaaggacaaacaaaataagcagcaatcaaacataacctatgacaaagcttaaattgccatgtacttactgattccctttactaatctaaagatcatgtggagtgcatccatgtttcctgaactctcacacgttctaaaaagattcactagctgggggaagaaatcatgctgcaacatattggggaaaattgaaaagtttagagcatcataatactcatataaatatccatcaatgttctagatttcaaaacttcacagttcaccctatgtaagaatataccaaagttgacaaaacggtgtgtggtttgttttatctgcaaacgaatttttatagtgcttatcaactgttcaagcaaaaacgaaccagaaccaagtgcgacaaaccagtgacctgaagcttatcttgcaaaatcatctactgcaaccaagcatgctcttgtgattaaattactgacttagagcacctacaacacccacagtccaacaagatattacattggtttaacagcagatccaaatttgtggagcaatgaagctcataactgagggccagtgtgtggttgttatcctatgctgtggaatctagtcaattacttggatcttcactattttattagataatacaattatggcacaataaaataggattatttccaactagaaaatataagttataccaaaaatccgctgcaatgccaaatggagcctaggcatcaattgtgaaatgaaataaagaaaatgaatagaggcatcttcctatgcctaacagcatggagctggggaatggcctattgtccaaaaataaatgggcagcctgcactagtttagccttaacgtttgtaacactcatgtacacttttatgcctgcaggaagaggcaagctacatgaccaacatgttgacatagaatagttcatgacttacatattgtaatattaactctgcaacagaaacacgcatccgctctgtcatgctgcactccaatatagtctgcatatttggtcaacagcatttcaacatcaatatgttagtataattcaataggaaacgtgtgtatctgcttccaggcatattgaccaaattaactcaggtctctaataccctacatataatgtttctaatgtggcaaccaaaaatatgcatcaaaaatcagatgatgagagcggtatataagtaaatggcactggaaagaaaataaaggtagcccaccacacctttaagatggaagatagactggacaaatcaagagggggaagtttctttaattctctgctggtagaacttaaggactcatctgcaggtaaagaaacaagtcactatcacatttttagcaaaaccatacacagcagacagctacaagcataaggcaataagaaatggtacactcaaattacattacattgtataaatataagaattcaattttctgaaccttaaatactttatttaggtatcctttcaaaaaaatactttatttaggtatcaggtggcaggagattaataagaaccttcagcattgcctctcaggcatggtaccaattagcagtcgttgcggccgttattgcggtagcagcctactgccactacgagcccgcaattcaaatagcggtgtagggcatcaggctgcagcatgcaccaacgtggtctgaagacaggctacactagaagagaacaaatatgccactgctagcttgttgtatgtgtgagtttcctcctgtgcaatgaccagaagctggaatatactggtttgttacatgtgtagctatgtatatgtgctatattgcctttcagttctacctttggttgatgtcctccatttagtgaacttccagaacatatcatattgtactaaaagttaccatgtctgcatgattagattaacttaaaattgtgagtactttttaattccactatagaaatatagcgtctgcaatccgctatgtcaataccaatctgctatttagtacctagctctcacgtgagcaaatagataaaatcggaacataacatttcatgtccgaacctgacagcgtatgtgatgagattaagcaagcccatcaaatagtttactcaagaattaaaccgagttattgggattttaaagttgaaatggggaaaaattaaatcctagccatgcaaaagagagatcatacaatcaaccttcaaatgttgcacaaccctccgtgacataactctcaagagggcacatcatgcatatgtacacagttccatgaagaagggaatgtgtagttacctaccatgaaaaggtggatttctagaggcttctaaagattcaaatgctgcgggtggagcggcttcttgaactgtaggatatagaaaaagtaaatgctgtaaaaagcaactcacaagaataacaggctaaaactacacaggttagaaaaaataccatcaaggacattaaattgtaaatttcgttgtatggtacacacactctccctgcataaaaccatcagaatttaagcagacatgaataagaaacttgaaatatgatagtaaaacaatccatttatagttgaatcaccatatgtatgaacatccagcagcttcttgaaaactcaatgctaactctagtgccttttcaggatccctccatgagatgattgtttcttccaacaaaaatggtaaagatagtacattaagacttaggagaatgagtatggccaatcttaaaagaaggacattgcaccacttcaccttcttgtttcctgtatatatcatcagatgtaatgtgatgaagcagtagcgtgtcactatcctcttcatccacaacagtcagagcaatttctcttgatccctaagtcaaataaaggttgaaaaggtgaaccttaaatggcaagtccgagattaagactgaaaatttaactgcaatcttggtgtcacactctacaagtagttcagccattctaacacgctgcttcctgtgttacttttatctgtgataagaatattatctctgttttgttcttaaatgcgaacatgaagatcagtgtttccataaaaacagattatccaatttcatgagaagcattttgaaaaagcacactcatgtgtaacagtataagcttaaatgccaaaaatatattgtcccacaaataactggaaacataattaacttcaacatattaatgatgaaaacagcacgatcgatattcaataaaaactttatacaaatttataaatatcagtccaatagagaaactaagatttgaagataaaaagagggtatcatcagagaaaccatatttagtgaaaatcactgcagcataggaaaggatataaggtttcaactcaatattcagacaaaattatacctcaatgtagtcgatggtaacatgccctgttccctgatcatcccacttcccatcatcagtcaatcggtacactttgactcgctggaacatttttcttcaaatgttaatagtagtgcttatgctgtatatcacaaaataaaaatacacacagaaaaggtacaattcttggaattgattttgtggcatgggccttgtatcattggcttgttcacaagtatctctgtatggtgtaattgacaacactaaatagattaacagttgcaagcaaagcatcttttcgggctattgtctggaaagatggcatggtgtaataatattatttttaagtcttttggatcttaaccaagaattacctccctgttaaccgaaatatgataagctgatatcttaatatagacgtaagatagcataatagataaacattgcttcagcaagtttttagtttaagatcatacagtaggacagtaaacaaataactgagatagtcttcctgaagtaggatggaccaaaaaatccttattctaaatggctactggtaaaacataacataatatagcatataattacaaaaaactggaattccatgcaatataggcaagttatacatggtatggtctaaacatcaattagctcaaggcattttgttataggacggagtaatgaatgtacacatgccattttgttactatcaagtaactatccaagatctaatatgaggaaaccaaattttttttactaacatttcctatggggtttgtgtaaatcatttgtcggggaatagtgaaaattaactggcgctcaaaatggaactgaaggttttctgagtgaaaactgaaaacccaagtagtcatgggatttgtgtaaatccttgttcgcataatagtcaagaagttttctgaagttcgaacaggaactaaaatgttctgagtgaaacacaattcgaggttattaactaaaagctgatgactcctcttgaacccaaccaaaacgtgataccttgtttctgttgcattctgtcttatcatgtcagttctgttctgtgattccgctttgacaaaaagaaagagcatactcgatttcaatagttttatgtccgctatcccgatctgtttctaccctatggagaaagtaaaggccaaaacagttcaccagacctgccttccaccgttctccacgcaagtggaaaagtgcatctacatttatgaggcggagcaggtggaaaagctctactccctgttagaatggagttgctaaccgtgatctacgagtgatgattagaaagggatcaggtgatcggcacctgaaatagtaagctccacagcacacaacgagacattcccctcacaattcaaccagaaatccccccccccaaaaaaaaaaaaaaaacccaatgaatcacactcttccccaaatcctgcacatggtcaggatatcgaatcaaccactaccagagcgagcaaccttgtcgaattcccgaaactcccaagcgaagtttccaccaaaggcgctaaacgaaagcctacataccgccgcgagtgggatctaccggccctgcatcgcccatcatcggcgaaccttctagatccttctaacaggggggagagatatgcggggactgggagggggagggagaagctcacctgcatgctgatctgcaccgcgtcgtccggccccgcctgcttcctccggggcccctgctcctcctcccccatcgtcgcccgccctaggcctgcctcaccgccggggaaggatggaaatcggggcggactcggggatcggggggcggcggcggcgagggcgagggcgagggcgagggcgaggtctagcagcgggaggaggaggagggcagcggcgaaaccctacccgccattgacgagcacgagcgagcgagcgagcgagctctcctcccttctctctctcttctcgcttcgcggctttctcctctgcgtctatttttttttctcgtttggccccctcgagtttttcttttcttttcttttgttgtgtgtgtgtgttttgttcgcttgcggaatggaggggggaaaaaaggaattgcggggggtgggagaaggaaaacgatggacacggcagtttggatattttacgtggtgtggtctttttgctacgcgtacaccatcaaaagttcgtctgggcccacttgtttgtttctcttttgagggggtacaatttagaactcacacaaacacacaccacaacacgcgtgtgtgcatcctaatatacgatagggttgagattggaggtactaggtcccattgcacgggaaacgtatagtcccattgaatgcacatgcgtgtgtgaaccatattccctagtagaaccacctaaacgtgatccctgggagccgggaaaaacctcggtgaggcaacgtgaaaatgtgggagtcaaactcgcgccgaccggttcgaaccacggtgaaccaaccagatgcgctagtgcaactccttggtctcatttgtttattgatgttcgagttggagggagattttccgcgcacacgaaacgaaaaatatcattagcatatgattaattaaatattaatggttataaaattaataaattgatttatctaaggtttaagtttaatgctcttcaatcaacttttcaaccttctaatatttaatctattcgcttgtaatatcccaactaattgtcaagagttctgttgaatccatatgcgctttaaaaccttggcatacgatgaagttcaccggcttgataacatagctattttatttttatggttagtgttttttatgcatgactttttttttggacatgtcaacttgattttgtggtatcagcattttttatcctttgatgagagtaatgactttttgtaattaaatcatgtcgtagcattgagtctttccacaattaaatgatagatttttatctataatgtaaacagattgaccgtaatgaaatatgagcactcaagcacctttaaggaaaaaaacaaggagtgcgtgagaatatttaggttgtactactcggtgcattataaatcatgcatatctatgatattttttccgtatgcgcatagtaaaatagtgagactttcaaattataaaaaactatagaaaaaaggtttctataattttttttatctatagtcgaaatataagatatattggacttgtcgaaataagagattggacttcatttagatgagtgattatcagtagaatcatttgatgttagtcaatgaaaggatatttggttagagagtagacttcgtgggatgcaaagctggttcccattgcaagatttcatctgtagaattatttagctgcagtaaacaaactgatcttacttttctcgaaaaggtaaagagaagtggatttctttagtcactagcctatcataaacaaaagcatgaacattaggtagaattcatagttgactaggctagtcctacttactagtcagcgatcaaccgatctagatttttataatactaattttcttccctttttcttacactaaatcattttatggcgcactttattaatttgcaaataaaatttcatcacctgagagcaaactaataataaatttgagaggttcctctacccaaccgttgattgggatccccgatttacaagccaaaatgtaaacaaagattatatttagaatcctcctattacgaaccattactttccctaagacaatggtttcatgttagcaacccacacaccctattatattcttgctagagaggatcacgactgcaataaatgtcgatgtaatatttaatgttgtttacggtaaattggacaattagctgctaataggttcagttttgatgtttagcaaaattcttgtgtgttagcactacaagtttaattgaacattcgatgtataattgctttaaaagttaacgtaagttaggtatttaccatataaaaatagagaatactaccttcatcccataatataaaaaaatttagagttggacatagttactaagaaaatatatgaaatcaaatagggataagttgtgattcgtagggaagtggatgtatgtgagaaaagtgaatagcgaggagttatgattggttgggaagacaatattagtgaaaaagttgttatattataggataaattttaagtgctataagttattatattatggaacgaagagagtaaagcgtagtatacatgttatgccttttcatccatattaaataaacacagacaaagtatcctccacattctcttaaattgaagttcaaacatacataagaactatcgtcatatgtgttatgaagacacatatttgtttattgagtatttttattaaaaaataatggtattatgtccaaattgccaaaaaccacgaggcttggcttgttgcacgtaaccacgagtattatgacctaatagtttcataaaattacatcattaacccatttttctttcatctactacaagcataggaaaaacacatatatgagttttccaaggctgtgttctgtatagcaccagttggattttttagcacacaaaatgagaaaagtcattaggtatgattaatcaagtattaatgattaataaatatatttgtgtaattttttaaagaaacttttatacatatatatattttaaaagagcaccctttagcactttaagttgtgtgctaactaacaacggggaatttgtaatttagagttgtagtttagaacatgatgtaattcatcgtataaatgttgttgcaatatagtataagttatacttctaggtactccctcgttttctaaatatataacaccattgactttttagcacatgtttgaccgttcgtcttattaaaaacttttgtgaaatatgtaaaactatatatatacatataagtatatcaaatgataggaaaagaattaataattacttaaattttttgaataagacgaacggtcaaacatatttaaaaaaatcaacaacatcaaatatttagaacggagggagtattattttttataatttagacaaaattcgtcaaaacccactcaaacccatgcccgcatccccccccctaaatgacaggtggcccccacccgcactcccctcgttccctccgcccccgcntaggcgccacagcttcgaattctccgccccctcgctcccataaaccccccgcccgccgcctcgctctccttatgccccccacctcgcctcgcgtcatccgccgccgcctcccattcccctcgcgactccggcttctcttctcccctcctcttgcgttcgtcgtgagggcgatgaactccgcggcggcggcggcggcgtgcgcctcggccccggcgtgggtggtcggcggcggcgccggcgggggagccagatccgcgcgggggccatgcgggatcagggtgtgcgggctcgggggcgaggcggtggcgctccgctcgctgcggatctcgcagggggcggcggtgaggcgggcggcggtggcggcgagggcggccgcggagaacggcgtggcggggagcggcgggttcgactacgacctcgtcatcatcggcgccggcgttggtgggcacggcgcggcgctccacgctgtcgaggaggtaagtgcggaccatgtttactgttcggtgtagagctctagccgtttctcgtcggcggcgctgtacccgtgatctattgacatttgaactgatgactgtatagaatgatctatgggatttccggtattatggagctgcgaacttaagtacttagctgaattcaaaatttcaaatgaactacttcgctagagctcatgctttgttgaaatttacactgcgaaatggtaactggaggtttttgttagtaagtaatttggtgctagcacaggtaaactgtttaaattgagtgctatcttgagctttgctttgggacttcagtggttagtccattgcagtgcgctgatagtctattaaatttatgctgagactatcactatgaaactagaaaatcttcctttctagttgaaatatttttttttgtcttgatggattgatgatcgtagaggtaaagaatatataatgtgcaactcaacgcatttgtaaaccaactctatcttgaatgcagcaccagcaaaatagtgacaactcggttgttctggtggttatctatttacaaatttcaatgttggcacactttggccctgttggagcctgccaagtgccaagcagtagcagtttagttggattattggcttacttgatatgttacttctttgttgatatatccgacaggccaacatacaaaaatgcacacacttttttgtttacaatccaaggcttttctgtagcatataacgcaaataagattgcagagttataaatgtaataacctgttcgttattactagtccactactgctgtctcaatgtgttaagtgttaactggcccaaatttgtgcagggtttgaaaactgcaattattgagggagatgttgtaggtgggacttgtgtaaacagaggttgtgtcccatcaaaagcacttcttgctgtcagcggtcgcatgagggagcttcatgatgaacatcacatgaagtcattgggtctacaggtattttgtttggatgaattactgcattagcctctttgtttgatgtgttgaaacttgaaaatagttcacataacaattgacaaatgagtggacttttaaaagatttgtgttctacagtattttttagtcaatttcttttaggtacgaccagtccattaaagctggttcacaaaataggtactgacacagggagtgtaaagcgtgcgaggttcctgttttcatgtttatcatttgtgtcctgaaattgatgtctatgtcaactctatggagcttaccttgtttcttactcacaatgcatcaggtttgctatatgtctatgagtctgtatctctgtgttttgtgagattgtccaaaatttaatgtcaccagttactaggcctattacctgtggcctttgggcatcggctgttttctcattcttgtgtgttgcattgtgtcctgcataaatcattaagcccattctctgtacaacaggtttcatcccctggatatgacagacaagctgttgctgatcatgcaaacaatctcgcctctaaaatccgaagcaacttgactaattcaatgaaagctctgggagtggatatattgagtggttttggtgcaattgttgtaagtcatccataagaccataacttcactgtcatgtacaatcatgagttatgcacatgagtgttacattctcatttttgggcaagaacagatgttaatatttctcttgacttatatacatgttatatgtaaaccactgagttaaatccttacggatagcactttgttgaattgtagatgcttagcttttggttgcatatcaatgtcggtgtgtcctacaatcaagtctattcaaatgttaccaagttatagctggaagtgcatttatgtgccccatgttttgttatggttcaagaattgacatatatactaaattagcagtaatttcttgtggaaagcagcaagtttattggttctcttagttatgagccattaaaatgtacatacatcactactagatgtatcatgttactatttgatgtggccaattcagtcgctgatggaataagctgacctattctttgaacttgacaacaatcatatcttgtggtagaaaatgcatacaggaatatctcatctgcgaaatatgacataatagaggattgccgacattaatctattcctatcatgatttgatcagggaaaacaaaaggtacggtatggaaaagttggttttccagacaaagaaatcactgcaaggaatatcatcattgctactggatcagttccttttgttcccaagggcatagaggttgatggtaagtactaccttttcttctcttgatggatcatgcatctcatttagttagctctagtttccagactgaacattgaagcaagtgatcaaatgctgaaagaagcatgtacttctagctcagttgtagtgaccatagtcttagctgtgtgccatgtgattactgaattgttttgtatatacaagctttgtggtagcttattctgaaacaagttttccttattacaatttacatacttaaatgtttttctaattgtccatgactgttggtatttattttggttaataaaacccattttgttgcaacttgcggcatgtgccataactagcataataaagccacacatgttttattagttttagacttctagaatcactagtggcaatagataaaacataatttactatttgttatgcctgaataaccttaaatgtgtgtctgtatttggatatcttagagatcccgatagaaagcattcgatcttggaagccacatgatctttgtgcccttctgctactgcttccatcttttgatgttataatctcagcatagaggagacacattaccattattacattatgtcctacagctgaatgacatggaagattagcacaattgggtttgcagacccaaatgtgttgcctaccatttcttgttatacctattgttcttacagaagcctgctgggcaacttttgtgcagggaaaactgtttttaccagtgatcatgcactaaaacttgagtctgtcccggactggatagcaatcgttggaagtggatacattgggcttgaattcagtgatgtatatacagctcttggaagtgaggtacatgaaagttcttgctgtgaataaattcaaggatatggcttagagaatcatacagtgagcatggaatcatgcaattattgcagaaacatggttctacaatgggtataactggaaaaattgcatctgtagttatctggatatgttatcctttttgctttgcatatagtgaccagtgaggtccaccctgttatttgattggatgcaaatttgactacactgttttcaacttacacaaatgattctattacagtagtattgtatcactgcatgctgatttttgttttcacatgccccctgaattgacagttttcattcttcaggttacttttgttgaagctcttgaccagctaatgcctggttttgatcctgaaattgcaaaattagcccagagagtccttatcaaccctcggaatatagactatcacactggtgtttttgcaagcaaggttaactagaccttctaccttagctttcttcataccgcagacacatttcatcatctctatgttaaaattgttgatgattttttctagattactccagcaaaggatggaaaacctgtgcagattgagctcattgatgcaaaaacaaaggaacacaaagaaaccctcgaggtaaaaactacatttaaacaatctttcagtccttgtacatagtatctccaattgcagttttactagccaactttttgttaagatacttcactcttcatatactcctatagctatatgacttactgattatcaaatgtatggacagttgtctcttttctatgtaacttattgttgtttagttcatctgtagtaagttgatactataaacatagtttttatttctccataatggcttatgtggaagatctaaaatgtggctctaggtggatgcagcccttatagccacaggacgggcaccattcacaaaaggacttggcttggaaaatgtaagtacctgaaggttgaaactgtttgctgtcagaacatttcctacagttaagtttcaagcatagtgaatcggaccctttttttcttcagatcaatgttgttacacagcgtggttttattcctgttgatgagcgaatgcgagtcatggatgcagatggcaatgtggtatgttgaaacaaatgaattaccatgctttgttcagaataatcctcttcctggcttgtatgggatctaacatgccatgcatttttatttgtaggttccgaacttatattgcattggagatgccaatggtaaactcatgcttgctcatgctgccagtgcacagggaatctctggtacattgcaaatctgtttagatttcatcttcttctatcgctcctatgttgcttatcgtatagttgcctgataagtaattcctatgaaaatgtagttgtcgaacaaatctctgggagggaccacatcctaaatcatttaagcatccccgctgcttgcttcactcatccagagattagtatggttgggcttacagaggtaagtcgggtgtaatcccatatagctttctttagtctgccctgtttatgcgttacttcttcatctacttctgttatattttctgtcttgatatttagtcttatattttctgtcttgatattttgtcttttccttgacgtaaccaattcgttatccttttactgtatttggtatgtatccattgcttcttgaaggggatctaaaccatgcaatctttatgatttccttgaccaagtgttatcaataaatattgcagccacaagccagagaaaaagctgataaagaaggatttgagataagtgttgttaagaccagctttaaggctaatacaaaagcattggcagaaaatgaaggagatggacttgctaaggtatacatgtttttagtttgtgccacttatttctatcagttttttttccttgcagggttatttctatcagttgtgttgtcttgtctccaaattggcacctgggtattgctgtcttgcatggcttcattcagtgacatactttgggcttgacaattgtatgttcctttctgcagttgatttaccggcctgacactggagaaattcttggtgtgcacattttgggtttgcacgctgctgacctcatccacgaggcatcaaatgccattgccctaggaactcggttgcaagtgagtataatgatattatttttcttcacttggttcgtctttgttagcctttcagcagtataacttgaatttgacatgatcactcccaccacgcaggacatcaagtttgctgttcatgcacacccaacattgtccgaggtgctggacgaactctttaaagcagccaaggtacacttcagcgctccatttttctcttgtgtttagaatccttgaccacatttctgaacagctgcaagctattcttttttttttccttcccaacaggttaattcgggtgtttctcattctgtaaatgaaccagttgcagcctagagaagggccggagcgcaagccaaagcatccaccacaaccactcctgaaggtccttagtttcgtcacgcgcctgctcacttcccagaaacgaaatcggcaaccatagttaagtgaggagcctctgacgaactcgaggcaaaaaggttcatagcgccgatctttctgtagcttccatctgtgtatgaacatttccagatttttgtagtttttcgtttggtttaattatacgaggggcttaattatacgaactcgaggcaaaaaggttgattgtcatgtaatatgtagccctggtgtagacttgatcgaaataatcagttctgctgctggtcctgtgtatcataaaaataatttatctgctcagcttaaatatgttatataggacggaatttcagaattcggaagaagagtttgtactgtactttgtagagtaaagagtttttggtacaattatgaccatggaaagttccttaattttgcagtaagttggggaaaccatgaaagagctgtcattaattaattactagtagctgttgttcatgtacagtttggttgttcattggttggttcgtgtatctgacgaacaaaaggagaaacctattgacatagacccaatttgaaacgcgataatttcatacatacaattttatggtatgaagactgaagtttcctaggcacttataagtatattttttagttaactattatataaataggctattagattatctatagataatttagagtcagtagatggttatattattaaacttgctctaaactcgtaatttgtcccgctaaaattcactttgctaggtagttatgcgggagacgtggaacacattaattttcgtgtttcgtgtggaacactcgaaaattttcgtgtttggaatcaaacggcatttcataaaatttgcaaacagtcacggttcgaggcggagaagttttgcacgtcccttcatcccaaaataaattcatttatcatccatcataaatattccaatacaaaagaggtgactagaatactcttactttatcaaatcccattataactatttatcactttatctaattctaatataattattctttacttttatagactccgttacaataaatactttagtttattttgagataaatgagggagctaaaaaaaatgatagacggatgaactagtattacctcaaaatttcgaaaattgcgcccgtcttccttcccttcccctcaatcctctccccattttccccgtcgctcacaaatctccgcttcgtcccccacccacccaccactccactccccgcagttggtggcccgcggcggcgcaagccctagcgtccacgcgaagcaaaccccccaaaaccctagctccgccgccgtcggcggcgcccgagctgcaacccccgccacgacgccatccgggtggctagcctaagcccctaaccaaaccctagcgaccggcgccgcagtcggggggagagatgccgcgggagatcatcacgatacaggtggggcaatgcgggaaccagatcgggatggagttctggaagcagctctgcctcgagcacggcatcggcaaggacggcctcctcgaggacttcgccacccaggttg

SEQ ID NO: 6049 - DNA, 41770 bp, Oryza sativa
  unsure (1)..(41770): unsure at all n locations
tgatccgtgtgggttacaagatttctccatgttccgcatcagaaatgggcgcgcttctctttttgtttaggtctaagggtttagtggagtgaagtgtgtgtgggttttgggcttgcagatgcttggagcgctatgtctagtgtttttttttacaagtaatttagtagtacacttgaacaccggcacgtttgaactggcaccagcattttgttggcattggggattgctcatttccaagtgtaagaatgaggcgtgattggggcatacttgcaacataggaatttcatgggaaacaattcatttccataggaactagagggaattcaactgttccgcgcaggtcctgttgtttaagagttcagtgtttcaacttttaaatgccttttgatactggaagcaggggaataaatagatcccagttaactgaattacgacttaaagtgccaaattcgatgaatggttcaatctcaatctgactccttgttgctctgagaagtgcagctacgatctaaatgcacagcctaaatacaatagcatccaaatattatgtttcttttcgtatcatctagaacggttacaatgtctatcattcatttcaatgcatattttcctttgttggtagctatgttaaccaaagagtgctaaagactcaagtttctctgcagggaggagataggaaggatgttttcttctaccaggctgatgaccagcattacataccgagggctcttcttgtggatctagagccgagagtgatcaacggaatacagaacagtgagtacaggaatctatacaatcatgagaatatatttgtggctgagcatggaggtggtgctgggaacaactgggctagtggatatcaccaggtatactttgatctgtcttatccatatttcatctgctacactgctaatcaattctgtaggtttgtcagccgatcaccaatgctataggttttgttatattctgtcattagatcaattgtgcctgtgtttcttcagtcagagtttaatatatctttcacattaatgttttttttcctatttacacactatagggtgagcaagttgttgatgatatcatggatatgatagacagagaagcagatggaagtgatagccttgagggttttgtgttatgccactcaattgctggtggaactggttcaggtcatttatctcgatctcctttcttggtttcattcatttgtcttagttttctgtaaatcaccatctattgtaactggagcgtatattggtgttttaacatgtggcttagtgtgtatatgggatgctgtagttgcaatatggaaaagtagtatttccacatgtcagttttcttacaatagttatctaattttgttcactcttccctcatttaggtatgggttcttacctgttggagactctgaatgaccgatacagcaaaaagcttgtccagacatacagtgttttcccaaatcagatggaaacaagtgatgttgttgtccagccatataattcgcttttaactctgaagcggctgacactgaatgctgactgtgtggttgttcttgacaatacggcccttaataggattgctgtggaacgtcttcatttagcaaatcctacttttgcacaaacaaactctttggtctcaacagttatgtctgcaagcacaactactctgaggtatcctggatatatgaacaatgacctggttggccttcttgcctctttgatccctactccaaggtgtcattttctgatgacaggttacactccattgactgttgaacgacaggtgatttgatcatatttgttgcattggttcatgtaacatttgatttcacattttatctgtttagtaactacttttcttgagtttagtttgggggttggtagactagtatatactatgtcaaatacatattactttccctgccttcttttgtgacaaatggggaaaaattcagttcatgatataatgatatgctcaattgcaggttaacatgatacgcaagacaacagtattagatgttatgaggcgacttctgcaggtattctttgcttccttaggaataggatgcttgccactttatgatctttatgaaatttaaattttggacctttatttgttgtcttgcagaccaaaaatataatggtgtcatcatatgctcgaaataaggaagctagtcaggctaaatacatctccatacttaacatcattcagggagaggtggatcctacacaggtaaagttctgttaaatgggtttattagtttagctttatccatagcagctggaatattgaaatgaaatttgcctagttctgaagcagaatgaagatctcgttcttctgatcctttggaattgcttgttcattccattcttatcttttggtattctcatgcatttaggtccatgagagcctacaaaggatacgtgaaaggaagcttgttaacttcattgagtggggacctgcaagcattcaggtcattatacaactagaataattttaggttaaacctttttgacatattgatttattgttatttcaactgccacaggttgccttatcaagaaaatctccatatgtacaaaccacgcatagggtacctttctctcactctctcactatctttttttttgtcaattcaagtgcaatgtttgaatcactaatgtttgtctacaggttagtggattgatgctggcgaatcatactagtatccgtcacttattcagcaaatgcctgggacagtatgaaaagctaaggaaaaagcaagcttttcttgacaactacagaaagttcccaatgtttgaggtaagaaactctattccttcaatttcatccattttcattacctgagtaatttccaaatttgaagtttctggttaaactaggtatgtttgaagtgctacaatgtaattccctgttcaaaacctgtttgacaccaacaattttgaacattccactagcaattttacattaaagtataaaacaaacatgaactgtagcactataagtttcttgtttttcttgaagtgaaatgctttcagtactatatatgatcttgtgaggaaacctgtccattattctgtccaaaatactcaacgttttggcctctctatacaggacaatgatctctctgaatttgatgaatctcgagaaataatagagagcttagttgatgagtacaaggcttgcgaatcaccagactacatcaaatgggggatggaggtacgtctttgctccatttcagtatatttgttatttactttatgtgaaatgctgagcaatctgttggaaaataggatgctggagaggcaaacgttgcggccgcacttgattcgaagttagtggtgtaaatatgaaggtaacgcattggactccattcctgatatagcttgctgtacgggtacctggaacctttgttgaactttttggagaaatattttgtacatggccttgatgagcacattattctcctaaagaagtgcatttattttatcagcagtccttgtgttgtggagagttggagatattatggtgttaaattaggtgtatcgacagtgacactactaaattcgttactcctttgattttcactctgttagctactcccccgtcccaatatagttgtccttttatgttgtttagcatagattaagtttaagaataaaagacagtaatgtcccttattaaatgatgtatgcttgtgagtagaattttgaaacctggaatttaggacgaaggggttataatattgtcttttaaacctcttgtcatgagctatgacttgtacatgcaggtcctacaagaatgcaactctaattgcctgatggtcatcagttcgatggcagctgctcgactcgttcccactctagtgctagatgcgtttcctcagcattcttcaagtttgcttctcgtgttagtgttacagcctgtgcgacatgagtgtatatcttgacccacttcgaactggccgtagtttgtgctgttccgttttgggttgcaatcccttctgggatgctttgtatgtgtggatgcgtgtgatgtactgatactgatgggttttgtgccagaatagcatgcagagctctaattgttggtgcagacaaatggtttgacagatctggctgattactgtaatgtactagagtgtaaaaacagctcgcgtctttggctgcgcctatggttttgcatccagccagccagtttgttcactttggtaattccataactttctactctcaaaacttctattaaaatttggtaaggtctcaaagtaaaaaccatcggtctatacaataccttaccaaaattaggcaacgaagtaaataagccctgaaaagtgagttatgattaatttgatgtgataaattactagctggaattctttcgtattggtctgatcattcaccagatgagccctagacgtactcgagtatagttcaccagcaggacaacgaatgaccctgacttaaattccatttaattttactgctgactgttgtacaaccagtaaatacatttttgggaagtgtaagctacaattctaccatcaatatattcttccagcaatacaaatattttggtacagctcatgatcatccaacttcctaaatgctacacccggttgttaatgacatgagaaacaaaataaggtaaaagagaaattaaactgctgaactgctaacaattaccaacgcaaaatcacacccacagaaaaggcagctgctggtgcttgtaagctgggaaaatttccttttttgaggcagttttccttcccacctcaaatgagaacgaactagctgcagcataaaagcgaaaacctgggccttcggttatgtgagaatgctcttcagcttggacttctggtcgtcggttagggttttcgggaataaaacctcgaaagttacatataggtcgcctttcttgttgctctggtacaatggcattccttcccctttgaacttcctaacctccttgggtttggtgatcccctaaatattcacgacgaaattgtgatgatcagttgcagtattgcaggtgatgaatgagaatgactacagtgtacaagaattcttgatggtgtggggggtggattaaaccttggtgccaatttccaccatatgattgtccagatgcttaatggtcttctcgaagccgaccagagcttggagctgcaggaccaaaggatggtcaggaaatacaggctaaagtgatgaacaaactaaaagaacagcccaagctctacagttagttacaatgattagtagtaagggatttcatggtttccactgctagattggcactccaagatttgggttttgccagatcttggattttatcaagttactgaggtggctggacatggaactcctcccatccacagtggctgaaaagccggaaacatatttggatttttttttatccatataagatgataaacttctttgtcatcttgggactttggtccttataatgtgaccaagtttttcacgcaaggttgtcatcaggctaattttcacaggataactacacctttaaagagagttaattagaacatgcataacagacgggggtgagcagtaccagggagattgtaacagttgtgtgcaggtcattgccttctcttctgaatcgctcatgtggtgctgttcggatcctaaactgctcatgaagcattcatttgatgataaatattagtaaaacagatcaccccctcacaataaactttaaccaaccagaaaaaggtgctaagcaaaccttcaaatctccaggttcaccatcaatcttaggctctccttcctcaaagaatgaaacttcctgcaaatataaaatggtgcggccaaatcaacatccaaactgtaaagtagaacttatagtgatgaatagaatataatgttcatgacaaacaactgtctctgatcatgttagtagcctgaggaaattaaaggccaccacataaattcaatagttcacatgaaagatcaagatctctttcctgtatcaggccaaattccaaaagctgctagtaatttgccaattaccaggtaaaaagaagcattgattggctttaacataaaaaaagcaaacaataccaattaacaagccactgattagtgttgtgatccatgaatcagccagtttgactgaaggtttcaaattctaatagtaaacaatgaagtgctgatcataaatgacagcttattagtttagcagtttagcatctagaagtagcaatagcatgtggtacacttacaaccatagtacatataatcttatctaatgttgacaaaataatggaggaaggcacacactaaatcacagcgcatcgcacaaatgtctagaaagtgaacagaacagttgctctgtacctgcccatcttgcattcctttctcaatatcaacagtcaaaaaatcaccttctcgcacatacttcacatttgcacactggtcacagacctaaaaagacaaatgcaacctattattatggagtgaaaaaaacaataaaagaataaaaataaagatatttatgttaaatcatgccaaactgtggaataacacagcaaggggcaatcaatacctgctcggtcatttgttgatacattcctggaccaatttgtctatggtaaacttcgtttctgcaattgcatcgcctctttcctggtgctggctttatgacgtttttctcccgccaaacctatcatataaacaaaaataacaaagtaaatttggagcggtaatttccatgtcagtgcagccttcacggacactcaagcatgctactgaatagagcggcaaggtaatgtaatcacttgatttacatattgtttatgtaatttatataacttatctacactacatctttcttgtcctcattcctcagctagtcaaacttggttacctttagtgagccgcccatgtacaagtcctccaatgaagcatccagttcaacgatcacatcatcaccttttataatctgctcttcctcctcttccatcccaccaccaccaccaccgaagaagctacagagttcaggaacaaaacagtaaagcgatgattaagaacaaaatgatacaataaaagtaaatgccaattaggttgaattgcatctagctaagatactactgtctaatgtgtttacatgcagactgttgacattagatttcctgatcttaaactttatatattcagttagttcctggtgagcacatcaccaacacatttagaattttgttccacaatggaggggtttgtgttattgtcgaacaaagagctagatatttacatgaaaagacctcttaaatcagatatatattgatatatggaggcgtacaggcatttatcttcagactcaatttgttactaccacctataaaagtagctcacatgtacagttatagctcagagaaggctaaaacaataaatgctaccccctccattccaaaatgtaagttgttttagttttgtcccaagtcaaagactttaatcaagtatatagaaacctaattaatatctacaataccaaataattaccccctccgtttcatattataagactttctagcattacccatattcttatanatnttaatgaatctanacatagcattacccacattcatatagattttaatgaatttaaacacatatatgtctagattcattaagatctatatgaatatgggtaatgctagaaagtcttataatatgaaacggaggaagtacactactgagacatatttcatggtggattttaatgaaactaatttgatgttggcacaattttccataaacctagtcaaagtcaggatttggaacaccatacttatgacaaaaccaaaacaccatccattttggaacggatggagtagatagcacattggcctcacctgctaaagatgtcctgaatgttcatcccgccgccgccacctctcccaccctgggcctggaactgcttcagcccctcctcgccataccggtcatagatcttcctcttctcctgatccgtcaagatctcataagctgcaacaatacaacacctttacccattaattccccctcatgtgcaccaaattttcagtcttaaaaatgagcaccaatttttcagtccaacaatgggctccaatttttcagtccaacaacgagcaccaatttttcagtccagcaatgggctccaatttttcagtccagcaatgggctccaatttttcagtccaacaatgggcaccaactttgcagtcttaacaaaggggggtggattcgttaccattgttgatctcggcgaatcgcttgttggcctcctcgttgttgggattcttgtcggggtggtacttgagcgcgagcttgcggtaggaacgcttgatctgatcctcggacgcgcccttgggcacttgcagcacgtcgtagtagctcttcctgattcacaaacacccaaaaaggaaaaaaaaatccaccaaaatttcagttgaatccaatccagtataatcctcaacagaatgcgcaccaacatgatacatacagatctcaagctgatttaataataaaaagttaaaaaaggagagcccattgcgattgggagataaactggatcagatcatgaggagggataaaaaagaagagaagttcacacgaagcgggagagggagagctgagctgatcggaaaccctaccccgcgacggccgccacgaagtgcagcagcagaagaagcagcggccctatccaccgcggcgccgccatcgccgtcccctcccgcgccgccctctcaccgagcggccaagggcgcctagggtctccccgcgggtgggtcgcggatctagggtcaggcgagagggtgtgcctcctcctcctcctccttccgcgcgctcgccggcgatgcctcgcctccgcgtcgccgccgccgtcgagtcggagtcgtctcgtcttttctccctctctctctctctcactcgcggtttaaaagcttctagaagaaacccgagggcgttgtggtggggttgggggggagacgtggaaggtgatgacgtggaccaatcggggacggggaacgggtggcggtagcgaatggggtggcgccacgtgggaagtcctttttgccttttgagtcaggcgatgcaccggaggattgtacacgtcagcaaacggtgggttgacctgtcgtgtgcgtcgttggtaaacccaacttgccccgcatggcacgctgatgagtacaatattattttttttccattaattttgggttgtattcttttacaataaataaaatacgtgctattagagcagtacaatagcagactataagtcagctgcaaacatattttaagaagataaatgagaagatagaagagcagcggctacagatttgtaaccagctgtagcacggacttcaagatatagtgtgtgtatgacaggtgggccaagtatcaatagtgtagtatgtaactattgtatgaatgagctattagattggctatagatgaattggagctagtagttgcctatactattaaacttgctctactactccctccgtttcaggttaagtcaaactgctttaagtttgactaagtttgtagaaaaaataataaaatttttaactcagcacaaaattattataaagatatattcaattattgatttaatgatactaatttggtattataaatattattatatttgtgcataaacttagtcatatttaaagtagtttgactttgatcaaagtcaaaacgtcttataacctgaaacggaaggagtagtaaactctaaaccgtctacaaacacctatggaggaaagagaataaataatgagaagggtcggctctcatacaaaagttaattaagaaagatatgagagaaaaaaaaatagagccaccgttatactcctcatatcctaaatataaggctcaatcactcctaacatagaaaccaagaaataatttaatcaccttctcgttgatcatattcatacatgtaggcaatgtgattggggagcttaatgttagaggatttaaaataaaccaaatttaaagggccaagaggcgatagttatgtatgcatacatgcacgtcttatattatgacttaggaaaattggttttgccatatattttgatacggagtgagtaggctatatttttctcatcccattttaattatcgtatttgcaaaatggtatcgaaatcaagacaagaaaacatcattctttatgtaattaaacctcgtcgattgaggtgttggaatgcctcacataagtgcatgcagatcttttgtacacgcggatgattattataaatcattcagttatttagccagtgtcatttatctctatctctactattataaaaaccgaagatgttttcgctgaaatttaggtatgacagccgtgtttgaattggtttttgagtcgttacgtcatccatgtttgaataggttttatgtcgctcgtatccaattcgatgtgagtctaaaataactattatatttatacactctccatctcaacctaacccaacccatccccctcccagcccaacccaaccggcccacatcatctcgccatcctctcccgctcgtcccttccctgatcgccgtcatttttctctcttttttttcctcatgatcatcttgaatcctctccctctccttccaatctcctctcttctttttctcccttttctcttttttcatcctcttatttttctcttatcgtaaatatctttcttttgaaattgtcattgcttgagttgtatctacagtaaaaagaaacttccgctaattgaatagtcaaaattttaaactttggttaatgaggtgtatcaaaatacacacacgtcaatttatggaagagccacccaatcgatttgtgagtttatgaaaatgtgtacatacggggttttttaccccctcccatccgttcctcactcgatcaccatcttctctctcttcctcctgatcctctccctccccttccaatctcctctccttttttctcttttttcatcctcttattttctcttctcataaatatttgtcttttgaaattgtcattgtttaacttgtatctacaataaaaaaaacttccactaactgaatattcaaaatttcaaacttcggtcgatgaagtgtatctaaatacaaatacatcaacttatggaagagccacccaatcgatttgtgaggttatgtaaatgtgtacatgtggtgtttttcatgtgacgacgtatgaagcaagcgcaacttggctcaatgctatatgatttctaattttgttttgtcttgtttcagtttatcgtttaaattaacagggtttttattaattatgaaaattttctttcatatgttgcaacgtacaagcatttttgctagtccataaaacagaaaaaactatgcatagctcgttgaaagatagattctgttatattttcaggaaactgtatcctctcgccgaagcagtgacattctctttctctataagctgataggtagcatttgaaacagattattcattaattaaattaatttcacaatctatctacttaattatagagataatttgaatattttaaaaagtaaagttaacaaataactaagtggtataagaaacataagaagcatgagaaagtttttctttgaaaaagaaaatcatatttattaaatcgtggaacaaacaatctacgacaataatttgataaaaatatgtaaaaataacatagattaaaccaaacacgctacatcctttgcacaagcgaactgctaatacaggactgatgcaatacttgtttttagaacttttggagacatactaatcagtagctggaatagctcagtggttagagcgtgtggctgttaaccacaaggtcggaggttcaagccctccttctagcgttattttttttctattatttcttttcatttttttaaaaaattacaaacatagccttccaaattgcaatattcactaaattcatttttctaaaaatcctattatttattttcattttttaaaaaattacaaacatagccttccaaattgcaatattcactaaattcattttctaaaaattgcaaacatagccttacaaattgcaatattcactaagttctcactctttttttcttttcagtttttttaaaattgcaaacatagccttccaaattatttttttaaattacaaacatagccttccaaattgcaatattcattaaattcatttttctaaaaattacaaacatagccttacaaattgcaatattcactaaattctcattctttttttattttcatttttttaaaaaaattgcaaacatagccttccaaattgaaatattcactaaattctcactatatttttttgttaattttttcttttcaattttttaattgcaaacatagcattccaaattgcaataatcactaaattatcactctattttttatttattttttaaaaattgcaaacatagccttccaaattgcaatatttactaaattctcactccaattttttcttaactttttatttttaatttttctaaaaattgcaaacatagccttccaaattgcaatattcactaaattctcactctaattttttttataatttgcaaacatagccttccaattcttccattttttttcttttctttctccccactaaattttcattttttttataaactgcaatattcagtaaattctcactctagcagacaaatttttacaaagttacaaatatagccttccaaaaggaccatttctcactctagtagataactttttacaaaattacaatcatagccttctttttttttctctttacgtagcataattctcactctaagctaattttttttaacaaaattgcaaccatagcctttcatttttttttcttaagtctaattttttccttttctttcttccctacacaattctcactctagtagatttttttttacaaaattgcaaatatagcctttcaaatggaccagtctcactatggtagatattttttggcaaaattctatataattctcaccctagcactctccaaatgagtagtcccactctagtaattaaatttgtacaaaattctatgtatttcctgcgttattcttattgtagtagatatttttttacaaaatcctgcatagttctcttctcactctagtaaatacatttttacaaaattgcaaaacctatgcttcaaaaaggagccatggttttttcttactaggggaggaggggttacctccgtgatggatggtaagcttagtttctgtggtaaaccataaaaaagcggatacaatttattaaaaaataatcaaaattccattttaattccgttgaacttggtgaggttgccaagctcttaccgttactgaaccccggcgatgaacaataaacctggttactacggtaaccatcgcatgtgaaaccctaaaacgtggatgccttcttcaatgcataaaaaactttttcttaacataatctttctactacctccgtttcaggttataagattttctagtattgcctacattcatatagatattaatgaatctaggcatacatatatgcctagattgattaacatatatatgaatatgggcaatgctagaaaatcttataatataaaacagaggaagtagtaaataagctctctacgaagtgcagaggtaaaaaaaataatgccattgacagtcttaccaggcactcagtatatgaaaattaaacaattgaacaacttgataactgaatactactattagactatagcaatatctatatctatactcctttaaaacacccaatggtgatggtggatggtgaatggtgaatccaccacaagccatcactactgccatatgggtcttcaaatagtgggtaggtggacttttgtcccttccccaacctcaaaccatcaaacagagagaatatttttttaatatttttgagggctttaaagtgttgagggttctctttttaaattcccgttgcaacgcaccggtatttaggtagaaaaaaaatcaccaaacgtgcgggtcctattcgcaaaactccccgttccgtttgatttaacggccggagatttttcccacaaactcgttaacctccatcttctcttctcctctcacgagctcgcagctcaagcgcacccagccatggcgactcctcagatctcgcgcaaagccctcgcctccctcctcctcctcgtcgccgccgccgccgcggtctccaccgcgtccgccgacgacgtgctcgccctcaccgagtccaccttcgagaaggaggtcggccaggaccgcgccgccctcgtcgagttctacgcgccatggtaataagcgatgatggtgtgcgtgcatctttgggtttttcttcttccttttctttttcggatccgcgcggggcgtgtgtgtgttctggatctctgtgatgatgaaatgggctcgggatcgcggctggatcggtggcggcgtagctctcattctcggaatttcgtagcggattcttgagatcggtgaggttttgggtggcttgtgtggagtggatcgagttgatgttaggctggaaaaatattcggatctttggctgaagtatcgatcttggccgcggagtgttgcgtggatctttcttgacatcacagattcgtttacttttccggtcccttattttgtagtatcgatcagatgtgtgagattttgcaaggtttttagggcttttatgttatatcttgcggtggttggtgttgggggagggtttatgtatagagaaattcgatattttttaaatgtttgtgattgattttgttttcaggtgtggtcactgcaagaagcttgcccctgaatacgaaaaactcggtgcaagtttcaagaaagccaaatcagtcctaattgcgaaggtaaatctcatgttttttaggtgtttggaaatttaatgtcaaggccgttttgtgtcatatcttcgctgtttgcatgccagtagttctctatcgtttgcattccatatggaaagaaaataaaaatggcattcctgtttagtggatatatgttattaggatctaataattttatgtgtttgttgatgaattgactccattttgtctatccaggttgactgtgatgagcacaagagtgtgtgcagcaagtatggagtttctgggtaccccacaatccaatggttccccaaaggttccttggagcccaagaagtgagaatacatgcttctttgttgattactcaatcactacattttctgtcgtaaagaacaatgaccctaatgttaaacttactgtttaggtatgaaggtcaacgtaccgcggaagcccttgcagaatatgttaactctgaagcaggtagacgaacgcactttccaaccaagctatcggtctccttgtttggaaaattaactgcattttttattaccatgaaacatattatgtatgatatttcagttttcaccagtcagaggattatttcataagcaataagtactgaaatatcaatgctacttggctacttcctgctattatggagcccaaaagctgttgcagctaattacatatcactgctttctcattacatgttgtcatgtctcattttcattatttgttgaacagttggctattggcaaaccaacatgctatattagctttcaaagtcccaacactgttgtaaatctttctgccttgtctttcagccaccaatgtaaagatagctgcagttccttctagtgtcgtggttcttaccccagagaccttcgactctgttgtccttgatgaaaccaaagatgtccttgtagagttctatgccccatggtatgctattatgatcagcctgttgttcatcaaacctttttatcatgctgtatcaatgaatttaattttgttggatgctgctttgttttgcaggtgtggtcactgcaagcatcttgctccggttagtagtacacctcagtattttgcaaagttgcaaaataatgcattgtcatttttctattttgtctaaactcaaacttgcacttgttttagatttatgagaagctagcttctgtttataagcaagatgagggtgttgttattgccaatcttgatgctgacaaacacactgccttggcagagaagtatgctttctgaactttgttctaatagttcttgtctacattgattaccctcgacatttcgatgtaacggcatagcttatgttggaatggtatttgctttcctgaagaaaattttctactgttattgtacttctcctaactgttagatctaacatacacatacctgtttttataggatgtgtggttggtcatgtatgtttttcttccccataagagaatttttaatcatgcatgccacttcaggtatggagtttctggtttccccacattgaaattcttcccaaagggaaacaaagctggtgaagattatgatggcggtcgcgagttggatgacttcgtcaagtttattaatgagaaatgtggaaccagccgtgattcaaagggtcagcttacttcagaggtagtgcttttatatagaaggtacttaaatacttaaatttacataatccaattccaatataatctattggttgcttctgtaggctggcattgtcgaaagcttggctcctcttgtgaaggagttccttggtgcagcaaatgataagcggaaagaagccctctccaaaatggaagaggatgttgcgaagctcactggccctgctgccaagtactaaattttcatctctgtttttaaattttgttatgtaggtttggcatcgtcactgtgtgaatttaaccattttgctaaagcaggtacggaaagatctatgtgaactctgcaaagaagatcatggagaagggctctgaatacactaagaaggaatctgagaggcttcaacgcatgttggagaaggtgagcaacaaaagtttctattcctcaattcactttggacatcatattacttaatctagaatctgatttccatgcttcatcatatgacagtcgatcagtccttccaaagccgatgaattcgtcatcaagaagaacatcctttcgactttctcctcttaaagggtgtcccacgtaccccgacgagcaattggggtatagtcagtagcgcaatgcctgtctccaagaatggaaaacagaaagaaatgaaaagaaaaggcaatatcgatatcagcaagagatggcaatggaagttcgttagttgggtattctgttgaacaaacatgtatcccactgcccggcatgatcttttttttttctttctgctatttgcttttgtggttacagggattgacatagcaatcagctagtttactcaagaacacaagaggttttgtaaccatcccgtgatgagtgatgacaccgttctacgtttgtcaatccaataatttgataattcagtttacattatttctgtttaccctggtgaaagagagcatatgttgcttttgcttttgggtttgaagaatgtggagttgctcctattttgttttgttcagtgtatgtgtaggggatgggcatcaagctagttctgccttcttcgagcttggttcgaaattaaaatattttaattatatcagcgttttatatatagttagaaagcaactgtagaaaccagtttcagctgagatagactacaaaacgtttattcaaaccaaccataataagtttaatcttgtagatgcagaaaaacaactgtaattggaacgattttgaacgacaactgtaattccgttcgttcagattatcaactgaatattataagttgcggagtgtctttgcagacatccggtagagctggaacaaatcaacaatacatataagataagaggaaaaaaaaataatggccctgcccaaaaatgatacgcacaaatccagaaaatttaaaagttctgcagcagtaaatactgtcaagtactaataacctgagagttaaataagaacgatatgcacaaatccagaaaataaagaagttctgcagcagtaaatactgtcaagtactaataacctgaggtgatatgcacaaatccagaaaataaagttctgcagcagtaactgctaaggttaaatttcatccaggaacatttagttccatttgtacatgatcccaaccggcgaagctatagcacagaatgatgtatcagttcataccattttgaggttgtgtagacaatcaaatggcgctaaaataccgcatttcaggggttaattttactcaaaggttacaatttcaggatctcgaaaagcacatgttcatactaggggttacagtggattgaacatcaatcagaattatcataagcatatgagccataatctcccacaaaaataatttccaggaaaatggcatatggtgtgatctctctgctacctattcttatccatgctggttagtttactacagtccttgtcctcttgcttaaacttgaggtcactcagacaaccatgcggggtgcaatcctcaatgtaatctatatcatgctctggtcgcccatagctgttttccggcatctggtaactgactccatcactgattgtttctctatgtgatgacgatctttctgccccttccaaaccctctagatgttcatgctgatgttcatcctcatggtcgtgtgcatgttcttgttcttgtctgccacagaacgacagttcatatgcatgtggtccctgaaccctcatttgcactgacctcagtagtgctgttttcctcaggtcacctccatggcacatgtcatttggagaagatgggaaccggccttcattttcagagccacgacgaggattagagcagacgaccgacgagagtgagcagctgggcagagggtacgggtttgcggataaaagaccagattgtggtttctggaatcggtgtggggatgacattggactagttgaagggctaaccattgcatcggtttgacttccattgggtaattgagtgtcgtagcaccggtagtcatctgaatcttcagacattggtgagtattgggatattatttcatccctgcaaggagacatataacaagactcatggtgaaacacagacctgaactagaccatgatatgtgctgagaagtataagagctaaatttgattgaacaaaactagcaatgcattctatcgaatatattagctaattagaaaattatattctggatgatatttaattatcttactgtaaagtacttgtgtcatcagcatgtgtatctaagtgtgtattcatcggcatgttgaaaaatgttacttgtgccagagtttctgtcatcaaacaaagtgctccttccacatggcctgtgccatggatatgtaagtttgtgggcatcttgtttgcttagcatgtgcaggaacatgccaaagacctatgtttcatgagtttcaatgtcaacatgccggtgcaagtgttcaagcaatcattgaggagatcaaatcacgctctccagaacaaccagttcacccagaaagcatacagacaacagattgctgtccagattatccatgagcaaacagtgcacatgcaaaactactagaaccaactaaaaaaaaatctagaaatttcatacatccatcatggtatgagaaattaacatgaagtttgcaacaataagaaattgaaatattcaccctacaaaatgtcatgttgtgaggtgccttaagctacctataaatatggctttcggttaaagtagagatatcgaggataactattgattttaatttgaagaacccataggaggtctgtatgtcgttcaattaagacgaaaaggacagccaatcccgattacttcccattgatcatgggttacaacccctcaatcataaagcatgcttacaacttactaacttgctaaacattctgatccaggaaaaaaaacatagataaatttctaaattttgatcacacctatccatttaaccatttttttgggggcaaaagatggatcacgttacaactgaagtctgaagttgacatagaactttatttgcctctacaagttagactaactattaacttcggcaagtaaatgaataatgcacacataataatgaggccttcaccatcatcttcttaccttcaatattgaatactccgatttcttacaccacaaaattgagcatgtatacatgaacaagcacagacgaagttcatcaactttgtaagaaaaatgtagataaaatctgagcacacatacctgaaataagaggtattctccgacctcgcaggggactccatgatattgtcaaccagtgaatctccgacagacaatccattcaaactggatgccattatctgcaatagccaatatccaatctaacatataagtaaaacactggaattttggtctcacagtaataatataaatgaattgcattctagagtgggatatgaactagtacaccaagaactgaagcaaggcagcaccgtttcacagagcgagaggaaagaaagaaacagaagaacatagtacaattcagcatccaaaacgacgaaatcgcccaagaatcagagtcaaatgaacacggatcgagacaaacaagaataggtaattaattaattaatagaatgaagggaacgtgcaaagcaccaaaaaaaagcccctaaacctgaaaaagactagtgatataaccagtaataaatcaaagtaaattacccgaatccctgagtcccatttcgcttcaattccaataatcacagagtaaaaaaaggccacacaaatcgacggaacaacggagaaaatcctctctctctaccgacacccaaattaaccaagaaacgaaaccgccccgaatccgagccgcggcggccaccccccaagaacaccgagccacgaaaattccccggacgcagagggcgggcgctgccatggcccatggggagagggagagagagagagacctcgctgaggtagcgcttgtgggagtggaggttgtccacgtacacgtcctcctccggatccctcccgcgcttcccgccgcccgaaggcggcgacattgccgcctccccgccgccgccgccgcccaccatccgtggccaggtcgggatcgcaagcggggattggctcgcaacttcttcttcttggagagtttgcgagtggaaggaagaacagaaaagggaaagccggaggaggaggagaagctttggtctttttttcgtttgtttcctttttttttttactccagaaaaaagaaagtatcatttgcaattgggccggccgattaacggcccggaaagcaaaatggggccccattaatgcataatacttgagccaatgataatattctgttctgtttttcttcactcgtatgactatttttctcctacctttaagttgtactccttctgtccctttttttttaaggtaaatgatgttacatgacatcgtgacttcgcagttttagcagtaggatatcgcgcaaagtgatttttaggtgaagacactctcaagagttaggccatgcccaacgctccacgctagagtgtggtctcacccctcttgacgcgaatatttgtgccagctcgactgggaccgtgccctcgcagagctccgcgaccccctgcagagtgtcgtatggtttcgtcagcttttggcgaggaaaatgtgaggaatgggcgaggaaccgaattgggggagaggtgtcgctctgtcccgtagccccaggacgttgaggccaactacctcctgcgccaaggtcgaagatggcgaggaagtaggcaggggagaagaagatggggcgccgccgcctccatccggcgccaacgtgcctcgatccgcccctgccgcctccatccggcgttgccgcgcctcaatctgccactaccgcgcctcgatccgccgctcgatccggcgacaccgcctcgattcgccgccgccgccttcatccgttgctgttgcgcctcaatccagtgtcggggagagaggcgcaccgccagggaggggagcgccggggagagattgggaggggagatggtcatgagaggactgatggtggtatttatatatgtttgtgatttttagggggtatattgcaaatattgtatgtatatgcaaataaaaataatccaagggttaaaatgcaaaatgtgaccgactgacaggtactgaaacgtaaaaataagataggggtatggcttgcactgtgtgagggatatcaccggtgtggtttcatcccacttggcatcacctttttttatggggctataccctgtgttgggcatgcccttagatatttgctagtggacaccgtatctattaaaataataatttccggataaggaggagagaaaaatcgcgtgaaatatcaaaaatgtccttgggttgatccacatgtcaactctcatatgtctcttctctcgatcccctccttctagcgcagcatcgggtcggagctcgacatggcctccggaactcctcctcgacaccccactccccaggcaacgcggacgacgatgacagggaacggcggcgacggcaccacaccaattccgactggcgtagctccggcgatgccgccctggatccacatgacagtcgtcgccctcgccctcacggcgagttccttggtgcgtgccctcctcattgtgccaccgtccatcagctcggtcgcagccgtcaccacgtcggcgctagcgacctgctcgcaccaccgccactgccttgcgctggccagagcaacgccgcatcccctgcaccaaacaaaccaacacctcgttgagtcccttctgtttttcctcgcgccatcacgctcccaagacctctctaactctattccctcaaaaaatttaaagggaagttgagcggagagccgccgccgccggccgcctcgggacctcgccgctgcgcagctccaaactgcctctcaatagttccaaagccctttcctctcctttaatcgagccgccatccaccatagccacatcgccatcgccatcccaaacccactgcgccgccggccatggcgctccctgactctagccacccttggccacgtcgctgcctctagaaggtgcgggagggcccactatagccgtcccggccttcggccaagccaccccctgcgccgcccgttgccaacgggcacgtgccaagccgtcacgcacgctcacattcccaccgagatgcggcgtgatgcgatgcatcaccggaaggaggggatagagagaagagagataagggagctaacatgtgggcccaagggcatttttgatatttcacgcgatttctctcctgacctgaaaattattattttaatgagtgtggtgtccactagcaaatatccaattttttatagtgtcttccctcaaagtcatttcacgcagtgtcttacagctaaaaccgcgaagtcacggtgtcctatcacaaaatttgcccttttttttttaacatactgaaaactaaccattttctaatcctgcatcatgccgctttttatgttttcaataacttcctaaacctaggaaaatacaattagagggaccttctaaaactaacttgcataaaatctctttctggtatttaacttcttttgtgtttttcatttaaaaatatagttggttaaattaaggtgtttcttgatttggttttaatttaaaaccttcctttgactaaaattcttttattcaaatttagtttgaaaaccctttttacttttatgaattatggtccaagaaaccttcccatactgtcctagaacctaaaacaaagcaattccaattttattagaattaattgttaacccatcctttgatcttaaacctattatttgattcttgatccaaattcttccttttgatctagccactgatttaattcctgtggcttgatttcctttttggcacaagaataatattattgcaaatattgtgaataattgctcttgtgctaagaaaataccaatttatattcttcactcaactttccctattagccacaaataattcttcaaatacttctactatcaaatttaggattcaaatcctatttattttacctccaatcattctcttccaaacatatatatatatatatatatatatatatatatatatatatatatatatatatatatatatatatatatatatatatatatatatatatgtcgtaggctctccggaccttccattataattgagagatgaagtgaataattcaagtcatcaaacaagcataatgaaatatccgacgcctcgagagaggaatattggagatattgctaggcctttagcctgccagtcaacttcagcctgagacgtgcccgtcaaaccactcgaaggcggcgaccagatgtgttacacattcaggagacttgacaaaaatggctaaagttctacaacatctcaaatattcctaactcatactcatgtgaatctagttcccaggatgtgcactagattcacattttcatctcaagcatgattatacatagcaaacacaaataagatgaaagcgattataaactacatctactttagttacattggccgaccggccaaataaataatagaacagcggaaacttgtctacccaatccacaagcacaccgactaggggtttacccattatgttcaagtcctagaagaagcagtcgataacccgcatcactcaaagactaagtctaaatcctgcaagcaaaagttaattcaacagcaagagtcagtacattattagaaataatgtactggcaagcaccaagacaagcctaacaccctacttgcaaggtatataatcaaggaaggcatagtatggttctttttagcataaagcaagttttatttgcataaaacacattcaaaacggatttgctttcaaataaaatttcagcaagctagtacttagcatatgggcatcaaagtaggcattaatcatgtataaatattcacctcattgccatccatggcagcaaagagatcattctcaaatctcatcacaatttgaaggtaaatttcagcatttaggagaataaacacaagtctatactcaatacatatccacacgccgctcatgaccgcgagcacggctaatcgattagttttaactctgcagagtttgtacactttacccacatgatgcgaaataataatcatgcaagagcatggcacgcgatacataagtacccgatttattacccgcaacaaagcttttccaaaattcatgatttagccttacaccagcacgatacgtgttcctccatcctagtcatactggaaatatgacctagaaccgttaagtggcgggcccacgccttgaacttaacgccgtggtggcggacacaacgggaacccacccacgtggcacaataccgttgtattggacagacttagtcacctaaactaccacgtcggggtaaataggaagttcctctgagttatccgaactcatacacaccggcctaccagaatgtaaggctaaaccataaataatttactaagtttggactatcccatactagcacatgtggttgtactgtatacgaaatgaactgacattgagtgaagtccttaggtcggtttgggcgcactctccccctatcggtacacaactaatcaccatatgtgcaccacttgaggcccaaacctaaaatccatgctttccaccattttatttatcaaaatcacaagtattaaagttctgtccagattaattaaaaatcaattttcatgtttgaaatgagcccataatgacaaggaagaccattctaagcatggctatgctttatagtaacctagtgtcaccaaaactcatatataaagtggtatagccatattgttcctaaggttaggaatgaggaatatggatatatgtggagttaaggtgataatgcaaataataggagtttatctaacaagtttaacaaaattttaatttattagtgtacaatcgacatgcaagatttgcaaacattttcaataacctccaaaagataggttcaaagtgatcaaagagagggaggtgggacttgccttgcaactggaaaatgtcagcacctaaatcacttcttcaccgattaagcaatcatctatacaaagtacacgttatgcaattaaacaccgaaatatgcgaaaaatccaaaatgctctaaaatggatgatttgtgcacagtgaataggtaccggtctaaaattaatttaggtgaaagaatttctattttatctcattttatttgggagttatgaattttagaagtttcgtcggtatagtgtaggatttacttagttactattgtgaaatgctgttgtaaggtgattcttattaagtttatgtttgctggggtgaagatatttgttttctaagactaacaaatttggtttcataatttttagagttaatatgaattatttatgtattttacaagttttaacgtgttctaggcatatattccctatgtgtacatggctttggagatttaggtccagaacttgctctaacttgctagtgttgtataaaatgagtattttagttaactaatctaatcttagtttataaaattttagtgttcaaattactttacttcacattttataagctaggggatgttctatgttagaaacttaacatatcaatctggagattattatataagttaaggatactaagttttggtggaaggggatggatctatgccttcactggttcaacaagttttatttggatttatttggagctaccaagcatatatatactttttcatatgtattgtttaaccattactatgtgtttagtacctattctaccaaattaaggttcagagccatggtctgtaagagggtgctataattcactctactaggttgaagtatattacttgctggttctatagaaaatttggttcacttcatttagactatagatgaattttctacaaatgttactatttaaggtatgctccatgttgcttattccttacttaaatacttaggggttttcattatactgtaagtatgtctttttattttataacattgaagtgcacaaccctatgattctactgaatttgggtttactcaaaaaggatctaagatgaattttatataaacttctaaagttcagcttatgtaaaactagtcattttaaaggtaatagttttagaggcattcgatgtatagtatgtatactatttcattttgctttataggagaacataagttggtggatctgtagaaactgagtttgctccaaaatgagttgaaatgaattttgtatgcattttataaatttgtgcatgctttatgtgtgatttaacttggataaattttagaggctaaatttgtactgtgagtgcaagtttttattccataacactaaagttcacaatttggtgagttgacagaaatttgtatcatcttaaaatgagctatatttaattttatatggattttacaagttttaggtactttccttttataatttcagatttttgtttccaaggggtccactgtcagtgaatgatcaatatacaaaaagatccctgaggtttctaagaatcaacccgcagacctagcctcatatgtcagtgagttgaaaagttgcacattaaaccttatagttgtttaaattctcgaaacaaggtccctgacttcttttctcacgcacagaggcagaacagccatggctgagctcgatctcgagctcaccggcgacaaacgatggctcgtttgggggtgcaaccaaaatacaaaatgaagatcatgttattgcgattccattcttctacttttctcggtcagtggacatcggagtaacgccggcggcgagtccgaaaggaggatgttttcgggtggtgatgcatgtgcttctacaatcatgtattggttaattgggtgcatgcatgtatgttctataggctgaagggtgctcaccgagatggtagacatggctggggtagctaggtttatgacggtggctcgtgtaacggctcggcggcggcaagaacctctgggtgaacggcgatggctcaatcagctccaagaactatcatgcatgtgtgtccatgaggttagagaggccccagagatgctactgatgcatggaattgggttggtactcaccggagggggtggattcggcaacggcgacggtgaccggaggtggagaagacggtggacgatctccacactcgtagcaccatccttcgagattcttgaggggaaatggagaggaggtcgaggcgaagacgctggcgcgacagcttggcccggcttggtccagataagcgggaacggcgatgatgtcgctgcggcggtgcacagagcgcgctctagagcgaccatgacatggcggcgttcccgctgctgtagaagatgaaatggaatgggatcaaaaccaaagttgttcgtcatggtgagatgagaatggaacgagtatgagttagagatgaagagggctcgacaacggttggcgatgtccctcttcttggcggccggcgacgaaagagaggtggagagggagagctggagcttcctccctcggttggattggcactgggatggtgggtgaagaatggcgacgcagctgggtggaggtgaagcctcggttcggcgctgccacgtcgaggccacgcgtcgtacacagccggcgccaatctctctctctcggctgtctttggtccggctggaagatttgcacagggtgaggacgagccagagtggctgccaagtgggtccaggtcgtggcaaactaagctagggtgagagggttgggcagaaacgtgggtgaacaaaaggtttgaatgattttaaggattatttctctctcccactttagtatttcaattatttaatttgtgggtagaataatttagtgtggatttttctgaaggtagatgaagatacctagattccattttctttgattgcactcaaaaattatggatagattactcacagaaattagaggaatatgggttctttggaaactagttcgaatttttaggagacctaaacagagaagataaattctggaaaaattatttttattcatgataaattacctagtatttgaataaattattttacttatacacttttatgcagttaaatgcacttttagacaaagtatggttttagccgattaagaactacagttaatctagtttttattagtttgactaatttatttgaggtaccaaatttagttattaaattataccaaaattacagtgagttgtatgtgttgagtagagcctacatgaattttcccatgattttatcttgcatgaattattttagataattcgcaggacttatgtcttatatgtgtttccctttcctaaatgcatgaaaatgtttataaaagttatatttggactctcattaacatgaggtgatgttgatatgttagaattacagtttaccttacacatgtcataagctccttccctatttatgcataagtttactttagtattaaattaagagaatgcttatagagatgattaaaatagaatataccctatatgatataatttatttgttcactttcatgttcatgacatgtcttcagatggatatccaaattagttttgtgaggcttgacattagccatgttgattttttttaaggtgtatggtttctgtgtattattttccattagttagcactaggccctaatggtttagttgtttgtctagattgcaattatattcatgagacctattatgaaatgcaaatcgaaaatccaaatgcatatgaaggactcaagtcaaaatatgatttatgcaagtatgcatgctttcacttgggttgcatccaagtcctaggttaaaggtgaaaaagtttttaatttgttctcaaattttattcttgcaagagttggatcaactccacctaggtttaaaatagaaatttttggtttacaaaattgaagaacttccctttcaactagttttgatggaaattccttaatcctagaattcaggtacgttacaatatatatatatatatatatatatatatatatatatatatatatacacacacacacacacacacacacacacacacacacacacacacacacacacacacacacacattgaggaattatattgttaattcccctctcatttgagtgcattaaattccaccatattccacttccaaaaatattgcactcaaattagaaaatatctcttttggaaattagatccaaatataatttcctttcaaccttccctattcaaattatctccaaatatattttcctttcaaaatcttctattcaaattccttccaaatacaaattctcctctaaatcaaattattcagccccaggaaaaattagactttcttccttctacgtttgggccgaattctccttttcctccttttcctttcctcagtacaagtcggcccaattagcccagccggccccaccgcacagaagcagccgctccatccttctctgtggacgccaccgccgtgcgccatcggtgcgccgtcgcccacaatcctaccgccgccgccgctagcttgccgtcgacgctaagaaatcgtttccgacgtcatccgccacctcataccgtcgacgtcagtccctggaacgaatcaccgtcgtcgaccaatccagagacgaagcggcgccgtcttttcttcacgacagcgtcgccgtggccgagtcgacgaccgcctctacaaccgccttcggaaaccgcctctccgagacctataaatagccagcaacccctcccctttcctccacacaagccgagctcctcgagctctctctctcttagccatgtccggccattgccgcccccacccgatctccctttccgtagctccacaacccaaaccctcgcgccatcggccttgtctcggcgaggtgaatccgttttttccctttcccctctcctttagccaccattgccggccgaagagagctcttgttgtcgccgttccggcatcctccctctccctctctgccagctaccgccttccctggatatgcggtactcgggaacaccacccgacaccggcgtcgccgtcttccaactatcgaagagccggcgcccctcctccctctctcccctctgttacccggctggaaggaggagaaagaaagaaacgggaggaagaaggaaaagaaaaagaaaaagaaaggctgacaggtgggcccctgcacagtaactcttcgtattttctctatttaattcaaatcctaatctttagaagcccatatctcctaaaccgtagatccgattccagtcaaacttggacctaaattcatataaattcaaaatctatattttgataccaaatttgctattttaagattttatttgaatttccttaatttattcaaatactatttggataaatatttgattaaatcttataattgaatttacaacttaagtttatatttgcttttcaaatattttcttttattccaaattacccctttagccactaaaaagccgccagttggaactttacgccttccacagggacgttcgcggtttactatccccgacgtcggactgttggttgtaaagcccggcaaaaaccaaacctaaggtcgaagtgctgctcctggcaccccacgccttgatgcgtatagcggtcggagcttcactattccctcgacctccacagcacgccgcacagttagctctcgggctctgtgtgatcttagccgctccgccgccactcacggttgtcggagtaacactttcgccccaccaaacctacaccaacctcatattcctctagccgatatattgtcggtcgacaccggctagagaagacactaaatctagccgttatgctgccaactctagcaacgactagcaaacaaccaaaccctagccgataccttgctagtcaaatcccagttgtcatccaaattccataccctctacaatactacctatccaccatattctcagccacctactttctgtctaccagaacctacacataaaatatagagtctagccgatatgctacccaaaaatactaaaccctaggtatgatcctaccaaaacctaccatcagccgatactagctatataaccgttcaaccagttcaatcatccagtatacttcccatcctcctactaatcaaacccacacatgaaatataagcaacagtagttgcttaatcccctctagcctccaactctctagaacctccgcataaaatatcagcacagtaatccatataccctataaaagagatagactataccctaaaccctagccctcctaaccgtttatctctttcttgctattttatggattttattgaaattggttcttcatctttcttagtagagtctattttattttggatggcaacctgtggtatctcaaggatcgaataatcaggttgcctatctcggatttatttgtgttggagcaaggcaagttattattcctccccttgagcataattaccctatattctatatttctattctatgcattagccattcatgattttgaatgcataacctgaacatatagcaaaccagatatgctagcttttgcttagccctgcctagttagactgcataaaaatataatgaacttagattgggacagtacgtaagatttggttgatttccgggtggctagtactgtcccggtcgatataattgccaccaaatacttatgtcgaacgaacgagtacgaccgcagcttctagaatggggacagacctagatattatgttaattaacaatgtggtacctctgtacagtggttccttttgtaagtcctcgcgcaggaggcaatcttatgctgagcagggcatcttatgatatttaccgaggcgcaggtaaatatactgattttcgctcatgagctgtgtgtgtgattttatggaaacctggttgagatgacatggggtctctcatccagttctctctagaaaccccgggaacgccagaactcctcttgctgctgataacgttacgttcagagcgcatggggactagagttcatggaacatgtgccactattgttaataacctaatactgggccatgactaagctaatgaatattagcaagtcgtggactgcgggtaaagcatatatctactgcagtagaatattcatgaaactattcgaatagctgtgctcacggaattgagtaccgagactcatatggtatttggttagaaacttaattccagattttattaaatactgttgcatcaaacacattgcaggatttctccttctatattctctgctttctgcaagtaatcatagccctactcaaatactactaattcatacattcatattgaatataatagcttgctgagtacgttgtactcacccttgcttcaacccccacctttttcagagtccatttggagttcttatcgaagccgagagttcaatcacataagttagttccctttaaacctagtcttgaagtctagtattgttagatggtttaattctatagcaaaacggcagagttgagtcatcatatagcttctgctgtattagttagccacaagtttgtaaatacccatatattttgtaataacatctcctctggagtcttgatcaaacgtatgcaatgaagatccagattgttgaacctgtatcaatctactaatccagggcttgatacagtctaaacatgtcggttactgaatcattagttttgggacccgacatttttttactaactaacatcaaatattaaagggaaattttgctacaggacaccgtgacttcgcggttttagctataggacacttcacgaagtgacttttgggggaaaacactcccaaaagttagatatttgctgatggacatcgcacgtattaaagtaataatttccggttgaagaggagagagaaatctcgtgaaatgtcagaaatgcccttcggcccacatgtcagctctcctatctatcttctctctctatcccctccttcacttctctctctaatatcttctctctctatcccacttgtcagcgacagcggtgagcaggtgaggtccgacggcgggagggcgagggaagagcggacgtgaccaacggcgcacctagacagcagcaccgcccgaacagcaagcgagctgtgtatggaggagcggcggcgtggctggaccatgacggctacagtgcgcggagtaaggagggaagggctccgtcagcggccggtgccgctgtctgggcgcaccgctggccggagacgtcgccctcccgtcatcgcggccgctccacacttaccctcccgatgccaccgccacttaacctcacctgccgcccgtcatcgctgacatgtgggatagagaaagaagagatcaattagagagagaagtgaaggaggggatagagagaagagagataggagagctgacatgtgggcccaagggcgtttctgacattccacacgatttttctctcatcttcaatcggaatgcggtgtccaccagcaaatatccaactttaaagagtgttttcccccaaaagtcacttcgtgcaatgtggtacagtaaaactgcgaagtcatggtgttctgtagcaaaatttgtgatgggaccggccttaaaaaaattacgtccctgaagccacgcctacgcgtgcgcgtgcactgtggagtgaggagcttgacttctttttttgagtttctctcctatgtggacaaacttgctcctcgcttttgtgcgacgcactgctactgccctaaaatagccatgatgtccataggagtacttgattccggtatatgtatctacatggagtagcctgttcttttttccccaaaagctgctaaattacaatttatgtgggcgttcaactcaaaattgtgaaacgaaaatttctaacccacaattttttcttcataataatagcttctttcattattattgcgtgaaaattagtaaattatacatgctccaactttcttatgaacaaatacactccacacgtagaagtagctacgaatatattgtactccatcattctcaaaatataaaaactactctatccgtttcaaaatgtttgacaccgttaactttttagtacgtgtttgaccattcgtcttattcaaaaaatttaagtaattatttattcttttcatatcatttgattcattgttaaatatactttcatgtacacatatagttttacatattttatattttttttaatcagacgaacggtcaaacatgtgctaaaaagttaacagtgtcaaacattttaaaacggagggagtatatgttttagtttttatatttttttttgcgggggaaggagaataaattaatcacagtcctcgccaacaaaatgcgagataaaggtacaattttctcctagccaaaaactagagagggactcagctctagctttatttgctaaaaagtgactaataacattctgactacgctgaactttgcttatggcaatttgccgatccccagccattagtgatttagcctcctgagctatattagccagaactgagcgatctttgtctgggtgatttaagagctggatcacagaactgcaatcagtttccacttggattggaagaagagtccagtggagcgctaagtgaagaccttccacacacgcgtgcagttcggcttccaaggggccactgcaactatcaagagatctgcaggaactaaagatcacattacccaggcaatttctgagaatcattccaatacctcccttctcagaattaatgtcaaaggagccatccacatttagcttcatccacccattcctcggcctttcccaacgacggttttccgctccaggggtatgtttgattgctgtagttttcgggaaattaacactcaccacatatttacctttctccaagttcacctagggattttgtcggatcatgaacagagagtccacataactctctataaatcttttcgaaacctccattggtggggctggtttattgtgcataacttcgttcctcacaaaccagttccgccaaatgatcatgagaactagagctctctcatactctgaaagcttttctagacaatcaaagagccaaaaattaccgaactggattgatttgacgtccaaggagatactccctgatttgtgcatactcacccagagtgaatttgcatggacacaacggcacagtgcatgtcctgcatcttctttttctctgtcacaaatgccacaaacatcaaatctttccaagttcctcttcttcttgttctccatggttgctaggctgttagaagccaccctccaagcaaaaatcctgaccttttgtgggacattacatttccagattagttcccaagatttattaagtctgctcgaggacgagcttgagcaattattcatgtcggcgagctgcaaggccaacttgtaagcacttcgaacagaaaatctgccagttttgtccggatgccatgctataaaatcctcctccaagcgagcagaaatacagatcttctgaatgatgtctgcatctatttttagaaaatactgattgatcttggctgaatcccaagttccatcttctgcaattagatctgacacccatttcagtctacagtttgctttacttgataccggtcttcgtgacaaatctctcgggatccagggatcgcgccatattctgactgaattaccattcccaattctccagatgattccctttttcaataaatccaaaccatattcaatgccatgccaagtaggagaagcatttgcactaaaagttgtatcagtcagagaaccatgcggaaagtatttagccttgagcacttgggcacataggctgtttgggaattcgatcaatcgccaagcttgacgagttaacagggcctggttaaacaatttgtaatctctgaaccctaaacccccattgatttttgctttcgtcagggaatcccaggccctccaatgtgttctcctccggccattatctgcaccccaccaaaaattccttgtcatcttagtcagttcatcatagactgaatctgggaacttaaaaagccccatcacatagactggtatggcctggataacagccttgatcaagatttcttttcccccactagaaaggaaattttcaccccattgaattacccttttcgcgatttttgcttgcaaactctgaaacctccctttatgcattcttccctcaggtgtagggaagcctaggtatctgtcctcaaagttatccctctccacctgcagagtgtttcttatatcctcacttactgatgagggagaagcttcaccgaagaggatcgaacacttggcagggttaataagctgtccagttccttgagcataattggtcagaacctccttcaccacttctgcctccttcttttcagctttaaagaagagcagtgtgtcgtcagcaaacaataagtatgaaattcccggggcttggcgacaaatcttgagcggagttagggaattttgtgccactttttccttgagcaagagggacaagccatcggccacaaataaaaataggaatggcgacagaggttctccttgcctgagacctctagttggagcgaaagagcgaagtaaggttccattgaatttaaccgagtatctcaccgtggttacacacaacataatccaactaacccaacggtgagcgaaacccaacttgttcaaagccaactccaaaaatcgccagtctactctatcataggcctttgagagatccaacttatacgcacaagcagcactgttagctttcttgttcttttgaatcgagtggaaacattcaaacgctaatagggcattgtcagttatcattcgaccctgtatgaatgcgctttgctctttagaaaccagatcatcaagaattggtctcaacctgttaactagacacttagaaaccactttatacaccacgttacaaagacttatcggccgataatccttcaaatcaataggttggtctttttttgggataagaactatagctgtatcattcactcctttaggcattaacccagattggaaaaaattcctgactgccaggattatgtcactctttaaggtgccccaatttctctgataaaatctggctggaaagccatccggcctaggggatttaaggggtccaatttgaaatattgcttgagcaatttcttcctccttgaattcctgacagagcttctcattcatagcatctgtgactttctcctggaacaaccgggtgacactttctgggttaagactcggatcagccttataaactccctgaaaatactcagtagccatagtttccagcaccgatgtcgtactatgaatagcaccgttctcatctctcaacttagagatcttatttttcttagctctccaaactgcgcggctatgaaagaaacgagtgtttcggtctccttcctttagccaatttacccgagagcgttgaagccataacatttcctctctatacagcatttcattcatatggtcagttgcttggcggatagaagatctagcagcatttgacgctataagatcctccaactttttccttgccttttccaattcctttccaacatttttcacctttgttttactccaggatctcaaagcagacataactctaccgagggcaatattaatatcgccgaggtcagttttaacaccagcattaatccatgcttcctcaataacctgcacagactctggttccctttcccacacaatttcataatgaagacacttctgacggggtcgagtggtatccttcactatgaactctagcaagataggactgtgatctgaacagggggacacaagatgtgagacttgtgcttctggaaaaaggtctctccatttatcatcagccactgctctatccaacctgaccttcacatttctccatccatctcttctattgtcatatgtatgcggaacccctttgaagcctaaatcctgtaaatcacagtcatataaggcatcacgaaaattctgcatctgagtttcacaacgtgggttttttgagaagtgctcgaactgccaaagggtttcattaaaatctccaataaccatccaaggcagagcggatgactgtcgaattgtcctgagtagtgaccacatacgatgtctattctcaacccgaggttcgccatacacaaaggtgatatgccattgaggctcatcaggggataatcgcacatacgcatcaatatatcttttattaatatctttgacatcgactgaaacagactcatcccaatacaaagcaagaccaccactcttaccttcactactgacaccaacaaaacctctaaaggccaacttccttctaagacgactcatcttttccacactttgtctagtttcacataaaaagactaactgggaacctgccttttggattaaggcacgcaaatcttgaactgtcgccgtgttccccagaccgcgacagttccaggctagacaactcattgctcctggcgagacccattcttaggtcccgccagtttaccagcagccccggggctggttgcttccatatctttaccattagcattcatatccgctccctttttaaggcgcttcaacgctcttggtgtcacccctgacacggctcctgtattggtctgatcatactctaggatagcttgttttacagtccccaagcccttagcaacaggagccgtcaaagccttcctcttagtaggactaatacagtctgcactagagctttcttcaagggattcttggtgagaattcaaattgcggattgctgggatcatttccattgacggcagagaggcagactcctccacaggcccgactttgtgctcactcctcttcttcgaggaattctgctcagaaacagacagaagattagctttatccgctaactgtgcatcaaccgattcttccccttttccctctttggaatcaaacccatcaaatgcatcaactcttggtagagtatcttcgtggatattaactctctgcatctgaccagccgaagaagagcttgcgcttcctgcacctctgaaggacaacttcctctgaaccccataactctgaaaagctttcactttactcaccttcctctcaaaaggttttaaaggagaacagcgaagttcaacagaaaacatcaggggatcttcctcatttgcaagccttttttcacactccttatctgaatgcccaataaatccacagaagaaacaaaagtgtggtatcctctcatatctcagattaaatctccgaatttcctcagcccccttcaccttgattttgatagctaacatcctcttcagtggacgattgactgggagatccacacggattctgaaaaaatcatgtttattacagccgtcctcctgaacatccacctctcgaaccttgcctagtttactgccatagattacacctctttctttgttcatcataacaaggggaagatcgtagattctgacccaaataggcactgtttctaggggtaccatagaaggactcaccaacccgttaaagtctgcgactagcagtgcatcgcctctatgaagccacgaacgaacttgtgatctccttctgcactaaaggatactataaacagattatccttcaaagatttataactcatctctgctcgcaggcgccaagctcttcgcatatcctcaaacaatgctacctggttagggaacttaagggaatagaacctcgcaagaacagtccattgaccggccttcttcacttcatcctcttccaactcaatctccactgcatcatcatcttcaactgttatttcaccttgcatgaacgctgtcgggcgttggcttgatgaagtattctcatggtctcccccagtcagactcttatcccgcgctggattttgagtcttcagatcagaactttgttcctccaaattttcagattgaacaacctggatagccagatcctcatagttcctcatgttcttggacgtcgccatcgcagcaccgagtagcttcgggcgggtaactatcgcattgatagtccctttgtcgcccccaccaccagtagctgccatgggaagactcgcaaggactcggaggaagaaccctagattagaacctgatcgaggcgtgtgacgagatcgagaattttgtgtaattgcctcccttacttctgcaggtatatattgccacaggctaggaaaactaatcgtaacagatattttcctcaaaacatctaatccgaggatatcttgataaaccttcggacccaaggattcttgtttaccaagatcaaaccccgttatcccaaaccagaatatagcagatccaatcttcataccataattcataatggaccatgttggaaacctttgcagcaccgatcgtcgattcctcccatattggaaaacaaagaatccaaagggaaaggaaccaggaacaggtcggaaagtatgaataccttgataaggaaggaacgcagacgaaggctctgcagacgtcctgagtagatcggagtagaactccatccattttcttctcccattggagaaaatggctgccgcgcgccagtcgcccgggcgccgccaaaaccctaaccctaacttcatcagtttttatattttgatacggagttaccaatattatttcatcccttgcctagagccttgcagctaagcacgcttcagtatgtgcatcgacgccaccgagctctctcgccacctccaccaccatcctctccatcgccggcgccggcagccgaataggcacctcgacgccctcctcgccgtccccgctcctcctcccggcgacgtggaacgtcgccagcgtcgccgtcgccggcccgccgtacgccggcgcgccccacccgacgtccac

SEQ ID NO: 6050 - DNA, 3327 bp, Oryza sativa
tccctgccggcgtccggcaccgcctcgtactccgggtggcgtggcgcggcgacgtcgcgcggcagaggcggccggcgcgcggagaggagctccctcgcccacaccggcttcaccgtcggcgcgccgggcaccccgcgcgcgaactcccccaccgccgtcatgaactgcgcgacgccggcggcgtcggcgaggcagtggcagatctggagcccccacacgaagccgccgcaccgcatgcgcgtgacctggaagtagagcagcggccgccccacgacgccgctgtcggcgtacgcgccgtcggcggcgcacaggagctcctcgtggcgcggcacgggcgggccggtcacctccccgagctcatccatcgccaccccggactccgccgcgacgaacaccgcgccctcgccggtgcactcgacgagcagcttcctcccggggctcgcctccacgatgcggccggcgagcgggtagtagtggacgagcgcctccgcgagcgcggcgcggagcacggcggcggggtcgacgccgtccatggcggcgcgccgccggtacaggaagaggcccgagcggtagaaccggaggccctcctggtcgtcgatgtccgacagcggcttgaactcgtgcggcgtcgccctcgccggcgccaccagctccgccgcgccgcggcgcaccgacgacatcgtcctcgccatgttcacactagctggacaatctcttcgtgagctcttctgctgcttgctttgcttgcattgtgattggcgatgtgagcaatatatatacgcgtgcatgggcgttgtggtggtaggtatagactaacctatggaattcctgaccgtcatcgttttatttatgattgtattatgctttccttcgtcttataaggatttttagctgcacaactagatgtttggattcatggttgaaagctgttatattttagaccggaggtaataagccataacagcttataaaaaagtatttgcatgtaatgttttgtgagggctgctataaaacgggatcccgttgtaacgggatagacatattaactattcttttgcacaagtatcatatgtatcaggtcctaggtatcatatataataggtaatatgtatcataggtatcgggtaccatgtagctggtaccaacgagatagacatattaactattcttttgcacaagtatcacaagtatcaagttctaggtatcatatatactaggtaatatgtatcacaggtatcgggtaccatgtagctggtaccacaacagttatcacttatcaggtatcaggtactgtctcatagaaggatatcccattccaacgggataccgttgtctaggttttttgattttttatatatatttgttttaattaatttaaaattaaatgctgaaaaataaactacgacaaaaaacctataattaactacaaaatcaaattttaatattcaaattttagatgcttcttataattaagtagaagggtaaatgatggaaataatatgccttggccacctagcccctaggggcatcgatgattatccttcgaaatggtccaccaaatgtttgcaaccaatgcatcaatatgtttgattatttgatttcatatagtagtttaacccttttaaggaaaactatagatttttcgaaaaaatactgtaaaactaaatatttgaatgccaatttaattaatctcaaaactgtatacttataactctagcaaaacagtactgacatggacatctaaactttaacattcatagttttgtcgtaaatttattattaaaactgtaatttattaatctgcaatacatcgtcttaataatgtatttttatataagtttagtactaaaaccgttgttatgcgacatgtcactcaaaatctctgtacgaattttgcaatggcttggttaaagtttttatagttttgcaaaatttactcttaaagaaaaaacagccagtcatacacgctagctttgatcttactctcacctacgaaattctaacacacatgccatatactttgatcttaattaatcttcaacgttgtcacacactatacatccatcaacggccggtcagctgatgcatcctggtcaatcaatcaaaccaggaatgtgttgagcaaatgatgatcaaatcataaattaagtgatccagcatgcactactgtatagctagacgactcttcttcttaattccatcatcttttgaatttggatgaaatactcttccatctgttgaccactacaccggattttagcgtaaaaagcgatagtggcatagtgcgaattcctcaagattcgacgacgttgagatttcatgcgtgcgacgagctatagccacagcccacgatcgacgacctcttcttcgtggacagcgccggtcagctcgatcgatcagcgccgccgccttgccggaatttaattattgtgcaccggggccggaatccaatatacttatatatacttatatatagttcatcctctgtagataatactatttctctcttctctcattgagccacatcaccctgattatttctataacatttagatgatatatctatggtctaaattgtctcttctttcttctatcataaaaacatacaatcttaattatttttaggctcaaaatgatatcaaattattttagttttaataataaaattacattttatatgtacacattatttaacttaatttttcacagcaacacggcagagtattcatctagtttagtttaattattgtgcatgccggcgtataggaaacggcggtagtgggtggcagatgatcttaccggtcaccactgatttgggtgttggttggcaccattaattaattaattagctttaaggagtagcacaagattaattaattaagttttgattattacaaacttgaaaaatggattaatcttatactattttagagcactttcgtatagaaagttttcgcatgaaacgtaccatctagtagtttgaaaagcgtgtcacgagtatccaaaattttatttgttggagaaacgaacgcagcctgaataatcttccatggaaagataaaactacaggaaagataaaactacactaagatcgtatttgagaagcttaaaattctgaaaattagttgattgatatgtaggatatgtctggggtgtttaagattcttataagcatatggttggcatctagcttcaactgagtttatttttgagagaatcccttgtatgtcactgaaaattggtctgatcctttatatgccattgaaaattggttcttcccttatatgccattgatccaaatttgcacaccctctcatgccactcccg

SEQ ID NO: 6051 - DNA, 29824 bp, Oryza sativa
  unsure (1)..(29824): unsure at all n locations
ggtagtggcatcagagggtgtgtaaatttggaccaatatatggcatataagggaagagccaattttcagtggcatataagggatcagaccaattttcagtggcataagagattctctctttattttttgattaaacaactgcagcttcttaaaataaaaaaaaatagactgattgagaaaacttttacttttgattctggggaaaaactacgactatatcagaagctcctagatagagctagccaccttctcgtactctaggttgggttttccagtttttatattctattttattttttgaattatatatttgcaaattagaatcgaatctacattgtgcaaaggagaagccgcagcgagtaaaactccccaaacaaggccaccacagacttcggtcggttgactgctattaataacctttaagtcttgacaaattaaacttcactctgaatagtcttcagtaggaaagaagttgacccaaagggcttggataggcttggaccaacttttttgtttgtacgttcaaaaaaagttgaacaattttcataaaacgtgttttgattttaattagtaagttaaggttcaaatattttgaccaacaatttattaagttaacatacgagtatgtttatgtataaaaattacaccattagattcatacttcaaggtagtgggtccagaaaattggttagttgttggacgtgcttatcaatgttatagcattgctaattatacgcagatcatagtgttatacgatgtcatcgtcaaacatcatatttgcaaacgaaaaataatttgtgaataaaacttatatatacgtgttcttaacgatctaaaagcaaatactgaaaaataaactatgagaaaaaaaattctaaatcaactctaaatttaaggttaaaaattcaaattttagcttataagcataattataagcgaaatgatgaggctgataataaatgaataagtaattctgctataggttttatcaaaagtcgatggtgtcacctacctacactaacacaatagaactgctcctgcttccaagtaattccactcaatattgatttttatacaagttagaaatatattataagagagaaactaacgtcaaaatttagttataaggactttctaaaatgaaagtacgccttataaagtgaacatagagaacatagcgagtagttggtaaggtggctgcaaagcaattctgatttaattttactcgtggctatttgttggaaatgtcactctttttttataattgaagtaactatattggaagtgaaaaaaaaatttaaataaaattcttcccatctactctgaatttttatttttattttcatatcatctcttatctaaatccttggacttttgaagctagctggggtgagtcgtcgttgatggtgccaccgtcatattggacttcatagtggtggtagtggagctggctaaaaggctgtttttctattgccttttctccaactatcgtatctgtcgctgatttttaaggggtttgaggattacgataatctcgtttggtgtaatgtaatagctttttgatatttagctgtcgggcaaattacttttaatttatgttacaaaatattatattattgggcccattagtaaatgttaaaaatatgacacaattggaaaagacatgacagccagatagcatattttacccatctaatatgtgtttgatgagtttttgtgcaaaaaaaaattgggcatttaattttgtacgaaaatattatctgccacctaactttattaaatatatacgagacgtgtctatatgacatgtgagcccagaaattttaaatatcacggtgtccgaatatattcgatattggactcgttttgttgtataattcgaatagaaagtaatggttcaaatggattttaaacccgatgtacgattcaaaaagattgaagctattaaaacaaaataaataagcaagtgctattgttactatgagcatgcatggtcattggctgtggcgattaaacatatggggctcactgtcattagacatgttaatcacataattatctccagacggcagtacacgtcgatggatctgctcatctctgcgtcggcttatcgcgaagattagcacggggcgctggaaattcggaagccgtttccgccaccgctgcctatataaggagtagaccccatcaggagccggggacgctgacgacgctaaaggagacacccaaccaccattttcattcatcccattcctcttagtagattaggaaaatcaagagaggagattgaagccggccggtgatagcaaaccggcgccgctgcggagagaattaaacaccgcagccggcatccttcatcaagtcgattcatttatcgacaacatgccgccattcaggatatttgcgctggatggtgagcacattgaataaatattaattttctagattaaacacaatagatgttcggtctttattggtgatcggaacatctgcgtgttcttaatctatcttgatctttatgattaaagccagatcgatgagagccgaaacacggttatcatcaaactccatttatacaatcaatggtataaggctggtccggtcctcattggcgatcggattatccgaatactatttgatattttctacgctcaaaactagatgtccgaccctcattggagattggacaatctaagcggtgtttttacaaaatatattttgctaccatgcacacgcatgggagctattcgtgatctttggaagataaaaattatggccgagtatttacgaggccggtgtcatgatattattaacatgtccaaacagataggaacggatacacattactaggttccgacgaggcaaaagtaatgatatatccacatctaataaaggccggcatatatgactgggtaccgacgaggcaaaagtcatcccctttattatgatacctgattcatgtatggacatggtgataatatattgtgaccaggtttcggcaaaacaaagccaccaatatcacagttatcattaaatctctgcaccaacctcaaccttcggcgagcgattaattttgaagacgacgatgacaagcgcagcttaatcgaaggtattccataggctcgtcccatggatgtaattaaccggccgcctcattgctaggcactgggaatcagcggactacacgcaatctccagtcagcatacctttccattaagtattcctcgcgaaggcaaaaggcgaactcctacgggagccctcatgtatttgtaaatattcatgttaatgaatcgtgattaataaaatacagggttttcctattttcttgtgcgttcgttgttttgttttcatcaaacaatatgcaaacaagctaaaatgattataagtttttttttattttcacaataacttaaacaataagcacaaagcaacaatggcaaacaaaggcagcctttaggatgtccaataaatgtaagcccgcactgttatgtcctgcctttgcaaaatgattttgttctgcttaatttcaacaaaaatagtgtctcgaactttggttttaaaactaactttgttccttggatttttagacataggggagagaaggaccaatttacaattaaatccacgcattgaatttacaaaatgatacatcagggcgatcaattcagttgcagtgtacaaatggaggaagtgcatttacagagaattgtttcagaagatttacaaggaaggcccttgcttgggccaaaaaagaacattttctgcagaaaatgtgtttttgcagggaaatgaatggctctacagctacagtttcaagtatatgcctttcatgtggaggaaacaagcagccaggcaccagaagatgatctccaagacgacgaacgccaaggttccccagcgtttggagtggaagattgtctgaagcagagattcagtcaaatccacctgaaataaaaaggagaattttccgcgctatgaatcaagtctctagaggtagtagagctttgcaagatcattttctgttagctaacatgtaaggttattgctccaggaaaagaggaatttggtattcttgagtaaatattgcatctatgaaagaatccaccccatatatggtaggatgcacagcacagcaagttgcttaccaggttgttttcaggtgatctccaatagaacccttgcacaagtgtagggaagatctcacaagcagcaagaacatacactataagcgcgttcatgcccatccactggaataggatgaacggcttcttgatattgatgacatcaacctgcatgacaaaaagaggctctgtgaatcagaatccactaatgaggtaatattatctgccttcataacagtttgttcgaacagaaaaggtaaagcttccacaaactaacatgggtacatcaaccgtcattaagattacatatatagtgataccatactatcccacagtacggtttccagagattgttcgagcactcaaacttacaatgtagtatagcaacaacagcaggaatccagataccccaccggttagtagcatgtagctcaccgtgtacaaaggcttgctgaaaggcatgcctaatgaccaaaacatgcatgaatcagattgaggaatggaagctctgattaaaacaacaaattgctgaatgccagcagtctcacgaaacacataattacctaataactgaagtagaaatcctgagactgttaacacagtggaagctagtagccataatagcattcgaggtgaatgatcctgtggtagaagcaaaggttagagaagtctggaaatatcattgtgtttttaaattccattttgctcaaggttcaagagattctaaaagggaggtatgcagttcatgggcactaccttgcaatgaaccaaaacatgtccaaaatgcaatccaacaaagcaagtcactgcagccatcaatgtactgtaaaaaccaataagggaggttattttctggtttgcctacaggaaatgggaaggttcaattgataaacattggtcaggtcaattgaggattgaatcggttgtacaattattttaagaaccaaataataaaaataaaagatataaataaccaccttagcaaaccctcgggatcaaatggagccaggcaccagtctggtgcatttggaggaagtggtccataatcaggagagttaacactgcattcctatggagcaaataaaaggaatttaatcttgcatatttttcaaattggtatcctataagaacatggctatttgatatccaagtgaatcgggaaaagatcaatatcatgtgtttgcttaaggaaaaaaagaccttagtccttttatagactgggttcttgtacaggtgattttcaccaagtaaaactcgatctacaaatccaactgcattgcaaggtggcccaagactacctctaactccacactggatctgaaacaccaaaaacaaaaccagcaaaacaggttagtaactgcaacgatgtagatatgatgattaggaccacaaaaagctgtaaaggaacccacagccacaggtaaagactccacagcaattagctttcaaacactggatgaattgaccagttattcaacctaggtttcatatccaccagtaacttatggagttttggttccagaaatactttatgaataaggatatacaaaatccgatattttcttaggttagtaactgcaacaaggtagatatggtgattaggaccacaaaatgctgtaaaggaacccacaagtaaaaactccacgacacctagctctcaacactggataagctgacttatctgatctgaacataaggtttcatatccaccagtaacttctggagttctggttctagaagtactgtacgaatcaggatttacaaaatctgatattttcttaatatacatactaaattcaattcaattttgaattcctgaatccagggtaaccaactaggaaccttcttcaattaaaattcggttgaagttgagttttagttagcaaccgttcaggaattcttttccccagtctttgccaggaagcagtactggcctgatccagtattttttttatcaagacttgggttattcctggtaaatcaattctggataagcatctgagaacgaaacaatgggacaaatatgatggccgtgaattcatgtatcttaaaatgtcaccaaacatatcaactagttttgaaaaatataactgtgtaaatacgaaaagggtctgtcacccaatcaaaacatttttgtcaaaaggaaaatagtcagcataaatggggtcaaagtatatttactgaataaagctcagttagacatgattgaaatattgcattccagcaacttgagtaggtttcatccaaccaaatatatcactacagatacagaatcatgatgtgcttcaagtattgaaacaaaatcacatgaaaagcaaacaaatggtacatctagcaatccgattcttgagcacacaggataccatccaaatagaataaagtgtttagattaaacaggatattctcttcttaccattttcattccaatttcgttgcccggagttggaattgtaaggattgaattgctagtttgaactttaaattcccaatttgaaacataaaggccgagtagcaagccaacataaagtgctgaaatcattacggccacgatccttcaaacgataaacaaatgtcagaaatggtatggccatattagtatatcttccatgtcttgagttcagaataattctcagttataatctcatatgaagcacagccaaactacaaatattgcaatttttttaactgtacagaaaaaagttacctaaccctctagcagatgaacagatcgagcaatcaaaatgaccagaattaccaaaactcccccaaattcaggactattaatcaactaatgcagataacattctttagatggacaactaaacatgttatttcatatcatggaacgtttgtagagcaaataccactttacatgaacatagaatgtaatcagcatgtataaacaatgattggattacataattccaaatgctgaacaaaaactgaaactttccatagtaaattgttacacttattaactaaccactccatgaagtatttcttcacaaatgatatagctgaatccactgaaatattgttgacaagccaaatctctgaaattgccgctagaaagtatccaatagctatcctctaccagaagtataacaacaagttaacgtttcgaacattcagtaagccgaagaggaaatgtgataaagcttctccttttgtttttaaacactacctgcagcacacctagccatcgaatatgatccaaatcaatgccataagttaaattgtgtctgccatgaatatatcctcctacaggtaagatataattttaaaaaggaaaaactccgaccaaaagaaatggcaaaatatggagctaaatgttgctggtatagttggcaaggaaacacagggataagtataaccttgcaaaattacacccaagatgaaaagtttgatggccctgattgcagccttcttagttgccactgttttgtttggtgttttctgttgtgcatcatccacaatagtcagatgttattctataactaagcagccagtggtttaagtcacgcagtgagcaccaacatcatgagtaatcacacacattccaagtgatggagcacaatgacataggcattaaattttgttatatgcttacatcacttggcagattggaacagaagttggaaacaaaaaaaggtataccagatttaaagtagaaaaggtaaccaggataaaaagattgtggcataaaggtttgcagaatttttttggcattgcaatcaggtagcctattatattctcacaaagtttcagaagatttgcacagcagatatgctcattacctcattggcttaacaactgagtattcacaaatcctctgaaacttagtcagcaatagggtatctcaacaaattccccaaaccaaaattacctaggttcaacacacacgggccaatttttacaagtcacaggcacatcaaagttcctttgatttgcttgatactccctatgtttcagattataagtcgctttgactttggtcaaagtcaaactactccaattttaactgagtttgaaaacaaatatagtaatatttacaacaccaaattagtttcattaaatcaatagttgaatatattttcataatatatttgttttgggttgaaaatgttattacttttttctacaaacttgatcaaacctgtagcaaagtcaagacgacttataatctgaaacggatggagtactacatatcaaagctttttcttgaagtagcagaattcgggtttgggcgtcaggtaagcaggagagggcactagggttgggggtgtataccttgaagacgagggcggcggagacgccgatgatgaagaggaaggcgggcatgacgaagtcggccaccgtcaccccgagccacggcgagtggttcatccccggccacgccccgccggcgtcgtccaccagtatcatcatctgcgcccccaaccaaaaaaaccaaacccccagtcaccacgagaatgagaggatccccgaccacgccgtcgggagaaatccggtcgaggaaggaggctcacggcgacggtgaggccgcggaacacgtcgagcgaggcgacccgccgcggcttccgctcagcccccgccgggtgctgcggcgaaggggatgatgcggggtaggggcggatctcgtcgtcgtcgtcggcggaggcgaggagaggacggcggtggccggcgtcggcgtccccgtcgccggcgatggcgacgacggcggcgtccatttttgggtcgtttgctcgtgccgtgtacagagtagaccagttagtagtaaagtatgtcgcgaatttgtattatattgaaatacgtgaaatattcggtcggttagctctnnnnnnnnnnnnnnnnnnnnnnnncgtttagtaagcgggaggtcttgagttcgactctcaacgagagcaatatcttttttataaaaaaaaaattatacaactaaatttttaaacctgcgctccatttaattttattagggctaaaattttaattccggctattttaatttgtttcaaaatttggaggctgtaatatgagaacatgaacttcgcttggatcatcttacatttatttcagctaatgtattttactttagaaccttttattacatttttattttttattttggattattttacattgctgccatacccaaatcttcaaataggccgaaaacatcatgggtgcattagggtgtcttaacttggcttgttatctcgacaaagcttaactagcccatttaaaccaagctcatgataaggccatgcggttggttcggtcgatcaagaattaacagttacatctatcatgtagcaaatgaaaaagaagcaaatcttgcctttagagcatactactatgtccaaaaaaagactaatcctaacaacgaatctagacacatatgtgttttggctctcccttatcaacacgtattttcttgtgtaggtggaaattagccgcacaagctaaagaagctatctaacacttcacattgtcaaactatgctaacttttgaggaagatccaaatgcgtctattgtccttgacgcggcaagaggattgtggatagggagaagatcgtgatgacacatcaagtctaagcttgaggaaaagtataaaggatagttcatcgtgaagaaaaagaaaaggcaatcctaacttttcttgtaaaaatatgagtctaaagagtaaatttagaaatttgataaaaatattaagttttttaaaatgaattactaccagatcttacctaatagttgtacattaattaattagaagaattaacatatacaaacaaaatagaactacatggtttataaccaatcaaaaataccaaaaagatctaaaacattcgaatttagagtctcattaatctcaagacagctagcatacatcaacgataagaaacacacatttcctatttttgtttttgtccgtgtgaactaaccttatagatcgacacatctcgtccacgcttagtcatcaatatagcaatataaaattaagagataccatataaaacatcccaaagaataaccatcccacataaaactcaaaatcacctactaatcgatttgaatttagaaaaaaaaagtcatagtattaatctccaagacaagcttaataaagccttaaacacccttaaacacaaccaaaaaagcatcccaaaacaccgaagttaccatttcccacccgttcgataccgtgtgcaagccacccccctcccccacaccccaatcctcctatataaacccccaccctgcctcctctcccccacccccgccccgttccccaattcgtttcgaaatcgaattccaaatcgaaatcgaaatcgaatcgattcgtccgtgcgtgcgtgcgtgcgcgactcgctctcacacacttcgcctccaccgacctctctctctctcactcgctagggtttcgaggcgacgacgatgtcgctgcggccgagcgagcgggcggaggtgcggcggagcaggtacaaggtggcggtggacgcggacgaggggcggaggcggagggaggacaacatggtggagatccgcaagagccggcgcgaggagagcctcctgaagaagcgccgcgacggcctccccgccgccgccgcggccgccgcggcggcgtccccgctgctcgcccactcctccgcgctccagcagaaggtttgtatatgtcccgatctggcccggttttttggtttggggggcgggctctcgatctggcggttccggatctggttttctgaccccctgtgtgggtgtgtgtgcagttggaggggttgccggcgatggtgcaggcggtgcagtccgacgacagcgccgtgcagctggaggccaccacgcagttccggaagctgctctccatcggtgaggtttcgatctcctctctcgggaccgcgagatttggatggatgtttgttgtatcactcgttgacgttctattatacgggattaatattattgaggactaggccagctctagattcgtttgtggatgaccacgacatgcttgtatgataatttactttgcagattgggagagaatgagagatacaaatccatcgcggtgtttcgagattgggaactttgttagcactgtctagtacacttttgattgaacaatcatggttccaatgggatacttgtttcggtagttataaagatggtgtttgcttgttagtttacacatgatctcttcttttacttttaatcgaactgctttatttcgttttaaggtagctttttgggtaaagtccagtgaaatataactgattgcatgattctactcctataaacagactgttaaaaggtgccactttgtaatgatttgtttaaatgtttgtagagcggagtcctccaattgaggaggtgatcaacacaggggtggtgcctcgctttattgccttcctccaacgtgaggattatccccaactccaggtgtgtcaacagtcacagtgatttaatttactaatagtgttaactaggaaccatttgctaaagctaaccatcccccatgggttttcttgcgcagtttgaggctgcatgggcactcactaacattgcatcaggcacatcagataacaccaaagtggtagttgagtctggtgctgtgcccatctttgtcaaactgcttagctcccccagtgaggatgtccgtgagcaggtatgtcaacagttaacagaagaattataatttccctgagggacctgtactgcatgatgtttagattgttacatttctctctctttttttttaaatcttcgcaggctgtatgggctctgggaaatgtggctggtgactcaccaaaatgccgtgacctggtgcttgcaagtggtgggttatacccattgttgcaacagcttaatgagcacgccaagctctcaatgctcaggaatgccacatggacactgtcaaacttctgccgtgggaagcctcagcctaattttgagcaggtttaattctgggctaccttctactttgatgcactgacctaagtttttatcattaggatggttttgttgattttttgtgttcgagcaggtcaaaccagcgctttctgcactgcagcgcctcatccattctcaggacgaggaggtcctgactgatgcctgctgggctctttcttatttgtctgatggaactaatgataagatccaagctgtgatagaatcaggagtgttcccaaggcttgtggaacttctcatgtaagtgcctccttttctcttcatgtaacccttgcgctatgctgaagtctgaatttcataacaaattgttgaagtctgaactgctgttgcttaattcaggcatccttcggcttcagtgctcattccagctttgcgcacggtgggtaacatcgtcactggggatgacatgcagactcaggtaaacatattaattcatttggttcatttctatttatacattattcttttgtgaacaaacatgaaagctgtaattcctagttgctgcagcgattaaagagcaatgtctccagaaattgattttgccatctgtttgcttcatgcgcgtgttctcctttattgggatgattaactctgtagctaatagctgcagtactcttctgtaatgtcaagttatggcaaagcttctctgatcctactagatccatgagcatgctgaatggtgaaggtgtttggattgtacggggagcatgccctatagatattcttctgttttctcccctaatatttttatggctaattgattatttagtgttgagaatatttacagctcatttattatattagcttgatcatttcctctttaattctttttatgcgaagtgtggcaaaattttcaactaggatgtatcctttttagctattcacatatacataattcggctagttagaatattatgtagcatgaaaaataaagcaagaccaccatgtatgtcaaattgtgcattctttgttatataccaaattctgaatgagttggaacacagtatgtatgataatctaagttgggaggatgaaatagttctgttcacctgataactggtactgtgtcgtactgtgcaatgttattgttgaagcaggacatcattttagaaacattttaagattatctccatcgattagtgattcaaaatgaacaatacctatggtttagtgcctccatggatgctcatatttccctctttttgatatgcatatattgtaaggatggtttgttagtgcattgttgtactggcagttgctacatttctgtacattttgcatgagattgatcatggggagtatttgctaggccaacgatatcgtgttgacattattgactccattctcaagagagaactggcatttcatatttcacttgacctgatttttatgtgctatcaatgtttattgttcatctctctcaattgctgcttgactacgttctcaagaaagaattgacataagatttttatatgttatctgggttcattgttcatctctcaattgctgctgcagtgtgtcatcgatcatcaagctcttccatgtctcttgaacctcttgaccaacaatcataagaaaagcatcaagaaagaagcatgctggactatctcaaacatcactgctggcaatagggaacagattcaggttggtgtgatttgaagctagaattatcatattgatattgcttacaacattgctaaaatactattgtccgtctacaggctgtgatcaatgcaaacataattgctcctctagtacatctgctgcaaactgctgaatttgacatcaagaaagaggctgcgtgggcaatctcaaatgccacttctggtggaacacatgatcagattaagtatgccttttttttttctttgcattacttgtgtataatatttatagaatttttcattgtcattatggtttgctcacaacatatgaaatgtcgaccaggtaccttgttgcccagggttgcatcaagccactctgtgatctgcttgtttgcccagatcccaggatcgtgacagtttgcttggaaggtcttgagaacatcttgaaggttggagaggcagaaaagaaccttggggcaggggatgtcaattcctatgctcagatgattgatgatgctgagggactggagaagattgagaaccttcagagccatgacaacactgaaatatatgagaaggcagttaaaatgctcgagtcctactggttggaggaggaagatgatgccatgccctcaggtgacaacgctcaaaacggcttcaactttggaaaccagcagcccaatgttccatcgggtggattcaactttggctgaaggtatgctatctttagcagttaaactaagtaggattgtggttgatcatggggatggtgttttctgatcgatataaatattgtttatgcagatacctatctggaatgatgtaccactgttccttagctacttgcttggggctagtcagagttgggggagtcttgtcgttggagtcttggttgggtcctggcggtctggtctcaggcagtcgtaatgtcagtcccagtccttgggcttgcatcatcgccagtggtgcagcttggtcagtggtcagtcttgaaggtcatccagttggatttacttgggctctgtctcacctgtggtgggagcatgggggagagggcgtccagagccgcaggtgttgtcgggagagagttaccagttggcttttgcctcctatatagcatgaatgaattatattatcatctgttttgaggtaaaaagaaccttgaaagatagggtttattcatggttgtgtcagtttttgtcaagtctctatgtgctgtattaacatgtcagaagagtattggcacaacttataaacatcaaatagcaactgggtttttggtggagtcccatgctggtctgtctattcattggtttgttgttgtaatgtttttaatgtcatggttttgtcgcgtcaaagtttgtcggtggttgtttgcgtacttgctgttgttgttgtcgttgtcgttttgagattcatgttgttatgtctgtcttctgtctagaaaactgaaaactcaggagaaccgcctagggaaaaagaccgcctattttggcgatgagttttggttgagttcttggtgtcatgtgtggagtgtaaaagggaagatgatggttcctagttttaccccctggaacccggtttatgattgtatgattattacgttatgaaccatatgcacatgataaaaggaagagaagggagctgtcccacttcatatttccctatggagatgatttgcactggtactgtgagacttgttcttttgtttagtcatgcgattttgatcttactagatgtgcctgtgctgcttactacatgtctcgtgggttggccgccgatgattgcagctcaatcccaatgcaatcatgaaagcagaaagcaggagcagcaaggcagccactatgtcctaataattggaaaccatgtgggcaggcggctgacggtttgggcgccgtggagtagtttggaagcggtttctgctgatcttgtgctgggcgttccatgatgattgattgatgactagctgtggcttttctagtcttttttcttttattatcgtgtactgggttgcattgcagattagcgcggctgggaaggagatttggtgtgttgggttagtcatccccaggtccctggctcctggaatcttgttcctcttggatgtgatctttcaagtgttgctcttcccttatgcttcctgcacaactttcatgttcactccaaatttaactttgacctgaaaaattaagttgtatgcgtacaaaatacaatgtgttaacactagcacgacacatcgaatgtgattaccgattaacctcagtgcaatcattcctatgcagattgggtacaagagttgatgctctatgtacgagtaagtgtttaattaatagtagacacgtcatctctaatagtctacttgtacacatatacgttaatacctcacagcgtaatatttttcttcactctactcttctctacctatgttatctacagccttatcttttcagttatactcatacttatcaatttttagtcttaaatttagagttgattttggtttttttattgaactttatttttcagtgtttgtttttaatcactaataacacgtataaaaaagttttattcacaaattattttttgtttgtaaatatactatttggggccgctaatgtgttaatttttgaagcctgcttatgtcatttattgtattcgcactaaatggctgtgcttcatatcacgcaggttagtagtactttcttatttaatactccctccatttatttttgatagtcatatttcatattggcacacagatcaatgataaataattctacttatcattcatttaaacatgctactagttatttctcgtaaacaagcgattcattaatatttacatttctcgatgcccatgtagccaatcatgtgtggaagaatgaagagtcacgcattaaatcggagaaaatcattaagatgataggttgttagattgaaatatgcctatcaaaaatagatttctcagatttgaaaatatgactatcaaaagtagatagagggagtagtatttattatacttcacatgaagtgtcaagaaaacggtggtgtgaatcgcttcatcccagaggagaaaagcggacggcgcaatgcagcaaaacactccatagtggagagggagaggagatgaagggcagggagggacaaaccctagtgctctcctttccacagcatcaatgacacgagttgatgaagttgactaaagctgtgattaagccacacagatcaggagagctcatcagggaatctcatgctgggacaatgatagggagagaggccctgcctttgcattgcatttctgtgttctctgcttttgtccccatcttttcatgactgttccctctgttctgttgcaacagtgctaatgctttgcttcttttctttcttttcttttctttttttccttttcaatgttggtatttttttcatcttaactacaaaactgaaattgtattataggccttacaattgatgggggttgatgatgcatatgcctagctgttccatggagtgtacaattaaatagggatatacaaaaggattagatggctagaactttccattgtttctagttggatgtcctttcttagttttttcattgttctcttgctagtacagtaccttcttatggttgtactttgctagtaatttaaagtcagtaaaaatgattgtggactagggcaagaggttaggtgctagtatttttcttctttagggcttgtttaattatagacaatactaagccacatagttggacttttcaacaatcagtatcacctttctctaattttttttgtacagcatttctatgtatttattctctaaagcttgttagtacttgaatcattaaatttcaaataaaaatttggaaatcgtactggctttgcggttgacatgatttttgaacaagctcactttctcctcctttcctgactgtaaagaagcaacccgtttattcagctgttccttgtctccagactccaaagcgactcatctatatttggctggaccttttctttctttcatttcatttcattttcctttttctttttggtcttcctgtcctaattctctccctctcttcggctccttgtttgacacattttcctcgtttatttcaatcatctttagttcatgttgagttaggtcttctcttactactcaactatgtgttgtggatacaggtaggtgtaggttggatatgtatccatttaccatgtgcatatgtaatgtatactgttcgttttcttttttccatgataaataatgtgtttctactaaatatctagatggagcatataaatgcactatggcgaaaacttgcagagtatttgattaatagattccaaaaaaacaaattgcaataataaaattggtggtagaattaatcaggtagaatttcccacattccccactaggtctcagtgcaaaatatctcgtacattagtatcatcactttcttttctttccctttccaagtgtttcgccttaaactcttttatctgcatgattggaactagaataaaaacggtcagaaacgatgaaatctctctgaaaacaatatgctccgttggtcaagaatttatcccacaagagatttggtgattacatgactgcagctcaaatggtcacaatatatctataatcatcgtatctaaattcaagtgctaagatttactaccccaattactccatactcatataaatgttaatgaatctaaacatatatatatatatatctagattcattaacatatatattaatacggacaatgatagaaagtcttgcagtatgaaacgaatggagtattatattaggataatggataatgggatgacatataatggttaacttacacactctgcatcagtgatcctggtcccacaaggaagacactgatgcccggttttcagcagataaggcagagggcaccactactagagatagatagggctacctgcccccatcagggcccacacgtcagcctcacacccccatatccccatctctccctctcttttatacaccacgtttgctggcttggcttccttccacactcctactgctgctggatagtatagatcgtctctttttctttctttctttccttcctccacaactactccctcctcttctctcctcttctcctccctttcgctccaagaaacgcagccaagctccgcttcgcttgcctccacgccaccatctgcgcgcgccactccgatcgatcgatcgatcgatcgatgggttcttccgatcagaaggtgggtgatcggcgcagtgatcgtctctgttctctgatcagaagaagaacaagaagaagggaaggtttgatgttttcgttgctgttcttgcaggtgatcgggatcgccgcggcggcagcggcggcggcggaggaggctgggaggcggtgctgcgtcgaatgcggcgccaccaccacgcccatgtggcgcggcggcccgaccggccccagggtgcgttcttgttcttcttcttcatcatcgatgcctttctgaatttttatcagtgctgttgttgatcgtgatcatgatcatgatcatcagtgaccttctagatttgataaccttcggttcaattcttggacttaatggagtgatcttgtaaaacagtaaaaagaagagagtttgttggtggtatttagtgaccttctagatgagttttactacatgaaaattgcggttatttagtgttttttagatttgaaattctaagttttttgacttattctaagtatgagtttacttggtttagtggcacaagatgattaagttgatgatttatttggattaagctgtgagggagaaagatatggtgatgattgtcgtaatcatatattgagtagctgccctgtggaacatttcaggatctttaattcagtttgattccattttggtggttaggtgagctgttccttgcaacagtactaacctccaatccaaattccaaagtgtgaactgcttaaaaaaagggcagctttctttggttccatccaagctcctaatcccatttttaattgctcgggtcaattctctaatggcatccttatcaccatacctgtttctctgtcctggtaatagcatcaagccataatatagttcagagaactgaataaaatagattgccccaaaaaattgatatgatattgcttgtgcttattagcaccatagtttgacttgggctattattgagtggaggattgttgctgcggattatctaccattaaatatttcgacaaataaatctaataaatagcttaaaacaagtagtctaagcaatgcagtagaaaaaagctttttgagaaaaaaaaagtatagagtaaataatccatttcaataattcggtgaaaaatctgaaaagaactaagcctctggatgagcactgaactattctttttttggtttgattgcagtcgctttgcaatgcgtgcgggatccggtacaggaagaagaggaggcaagagctaggcctagacaagaagcagcaacaagaacatcatcctcatcatcatcaacaacagcagcagcagtatcagcggcagcaacagcaacagcaacaagaagatcacagtgatgcagcaagttcagtaaaagacagtagcagcagcagtagcaacaaaagcagcagcctccaagtggtgaagaaaaggagggtcctgatgggagtggaggaggctgcaatcttgctcatggccttgtcctcatcttcacccacactactacatggctagctaagaacctcacaccattgatgcacaattgtacatacagtgatacaacacaaacacacaaaacacagaccacccaatggttccaagccaatcagatgactgtcttagattatcatcaggatgagatgagataggagggggaagaggccattttcagggtgatgttgatgtcaaggggggactggatttggttcttggatccatcctgccttttgtgcaaccttagatctctgaaatcgtcatatcgcgatccaaatccgattgcgaaggcgcgatggagggaaattgtgtgcccttgaagagggtaagaagctggtccctgtccagttgtcctgtctattgttgatcatggaaggctccttgtaattagttagaggtcattttacacctctcatatcccctttttctgttcatgtcttttgtttttatgtgttttgaatgatgatgttcttttcaacttgagaaggatggtgaccaaaagaagacaccagccttcttgacttcatgtgtgcaataaggatgaagtgaataaaaatgatttgtttgtttttatttcagttagtgcaacaagtagattttctactatcatctactgggattacagaaagctgccaatgtgttgctgtttcttgtgccaatcagatgggattacagaaagctgccaatgtgttgctgtttcttgtgccaatcagagttctgacaatggaaaacaacagctgtgacattttgcatatcatcagaataataggcagaggctgtggcattgagtccaagaccagaataatagacagataaaaagactatcaaattccaactttattagcatatcactcttgcaggtgcagatgcaaagaaagcatcatatacgattatatgaagtaggaagatataagcaaaccaccaccatgaattacactcattatgctgtagtaatcactgatcagctctgcttagataagaaaggctcggcatatacaaggattagataaaagcagtgatcaactcactgtatcactttatttaagccctattgcaactgatatttgtgtaggctagttaacgctgcctctacaatctatgaaagtatgcttcttcgctgttgcatacatcaggttcaaaattacagctctctattcgtggtgaaaactttgaactagtcctgatctcaaaacaaagaaagtgactatggtttttgaaggattgattttcacaaacaacgatgcaaagtttccctcgacatgtgaagatgttgagatttggccgtaaagaaaagtcattccaactggccagtcagttcagcttcctcgtcaccatcaagttcttgctctactcctttcacctgccaaagaagtgtgaaatatcaaatttcgctagatcaaaggataaattactgctttaagcagtctgaacaaactaataggaattgcaacttctttcaacattttacttatcagataaaacaccttatataatgagccaaaaggagtggaggttttgaggaaacagaaataaagcacagaagagatacctcagggacataatgcatgagcatgttttctatcccagacttcaatgtgactgacgaacttggacatccactgcaggcaccttgcatttttagcttaactatccctgtttctctgaaaagatatcatcatagtgagaccatgcaattaaaattcttaaaatcagcactgcacatgaacatgagagagatagactaacggatcaaatcctcgatattcaatgtcaccaccatcatcttgaacagctggtcgaatgcgagtctccagcaactcttttatcattgcaactatttctgaatcatcctatggcatagaggaaaaatatgtgaaaatacttagggtgtgtttgaggaggaggggattgaggagattaggaagatacgcaaaacgaggtgagccattagctcgtgattaattgattattaactattttaaatttcaaaaatggattaatgtgattttttaaaagaactttcctatagaaaatttttgtaaaaaacgcaccatttagtagtttgggaagcgtgcacgcggaaaacgatgtgctttcttcctcaaacttactggaacgaacgctgccttaacatctcaagcagacactcttaccaacatgacaacagttttttaattgataacaatatgtgatgttacttctaccttgcataacttcttggttcaagaggaatttacagcattaacatttcaataattggtagaagtacatattcatcaacttagcagcattattcaggagcactttagaagatatcttagcgaatatctatattgtatcatcacaacaccaccacatgtaagcagtaactactagttacacgtgcaatgaacacattcaaatttaaacagataagcaattttccctagaaccaaatcaaatggtaatcagggctccatttgaatcctttttaggctacttttcgtttactgctgaatataacttatccatagagacacagattcgcaaataataaaagatagatctgcctgtcataattttggtactaatcactgacaattagaacttacctaataccagtatcctaaatacaatgcatatgctgcaatgggtctgacagatggccactttgcgcagtatcactaggaacagctaaaagttatactaatggaatgtaagatctacactaaagttgtctgggatacctcatgaattgcggtgtccatagaagctgcagtacttgagtccagaaagagtgattgcccagatgagtaaaagtccattatcacagcaaaaacctcaggcttaagatagtcccaagaagtttcctctgattttgtaacagttacaaaatcggatccaaagaatactctggtaactcctgcatgtagtcaccagtcaacataatgtcaaagtaaataaaacaaatgaacactcatgacaaatttgaagaagttgttctagaaatatttactgctacgagaatatcttctgactcttagcatgattttgctgttatggcttcaaaaaggtactttatatagttaatggaaaacatggcaggataaaattatgtgttacaggccatcatgataccactaagccttaaacacttgtggtggtgtgttattttggatgattaaacaacgaaatgttgcacgttcatagcaaatgtgaaacattatgggaattaacaaccagcagcttcagatatatcatttcatccagaattaaagatattaagattattgcttttggtttgagtttcttttgccttcagacaattccaccaatgtcatcttctcacagtatggtttgccacatctttatcatttacacagctcaatgctagcattaaacgaccaagtttgcttggctctgggctctaagcaactacatttttaaggagtctctaagcaactacgttggttacttaagcaagcattttggtaacccatgtcagtgcacattgctttgtaaggcacatttcagttgcatctcacaaaagttatctacaacagctaactttgttttaataacaaaatatcaacaagaactgaaaaaggcaaatagaacacaagttaaacagaaggaatacaatatagttaaataccaactcacagaataaagttacttatagtttgtaccaaaaatggaagatgatatagcttatttgtataaagagtgtcctaggaagactcgatacattgaaagagttggccagtaagagtggtaactaatcatatatattaagaggacaaccagaggattttacaaggaaacatataaccgagatattcaaggaagctgagatggtgaattgattaacaccaacaggtaactagcggaacaggaaagaaataccgtcgattgcaaacagcgccttggccaaaggagatgtcatcgcggtccgagcattcgggaaatcagagctcccaacctccataaccggctttccaggatagaacatgagcgactgcgggttcggggtcgactgcgtctggatgaacatgcccctcttctgccctgcccatcacatcaattccaaacaaaaccacatgagttaagcaagcattagacagagaattcaaaataaaatcccatttcagccaccaaaaccatcacatcatttcctgtcatctaaaagaagtactaaaatcctgcaggacagtaactaggctagataacctcaggtcctaaaaacatcaatcctaatccaccgcaaatatgatcaagcaagctacgcaaacaaatcgttacttcgatcaagaacacaaatcttgcgctaaactagttgggtaaaaaagatccgcatctttaatcatcccacatccctaacgaagaattccacgatagaaaaaaaaataaagaaggaagaggtagaccctgacctccgaagcggctccatggggaaagagcagggctcccgtgccgcgccgccgtgcgcgcgaagggcggcgacctgaggcggtcgagggggccagaagccgccgccgccgcggatgagaggaaccgcggcgggggtctccgcatgagcagctgcctccgcaggagctgggacgcgagcgccgcgaccctccgcctcgccatggccacctcctcctctcctcgtcgtcggcgtcggcggcggcgagaggaaggctgggtctccaatggcgagagcgaggggccgaggaggaggttgtaacttgcaaggccgtggtcggcccatggatgccagtagtaggttaattgggctaaaaagcccactatgacagattctgtattttctctctttctttttctttagagggtacaactattttctctcttctaacaagacatccactatgattgtgattaattaattattaatatttttttaaaaaaataaattaatataatttctaaaataacttccttatatatttttttatataaaaggcattgttgagtactcgaagaaaacgagagagcagtggatgggaggagtgagaaacaaatacagcttaaggatgaaaacggttagaaaagatgtatttttttattagttttatgagaatggtattgagatgttttgattttttttatttatgaaaagttttgtttagtagcaatattatgcagatagaaattagaaaaaataaatcttatggtcagaaacaattgaaaactatatcttttttttacagaagctgtatcggtactatcggaaaatatccgtaccgtttttatccctagctgtattttggattataatccgctgcagattttaattttaaaattggtctactagttttctggaaaccctattgaaaagaccctgcttagctttatatcagattataattccgcagaagattttaattttactagaatttgatttactagttttctcaaaatacctttagaaaaccactttgattatacaggttctgtatttttctagaaaaagttttctttgctactgggattgcttagctgtacatcggattataatccgcagcggatttagtttcttctttttctttttccgtctcgctctctcttttcacgattgctaactggacatataaagtggtaacataaaatattcttaaagaaatcaaacttagaacttcaatatcatcgttggattatcatccagcgtcatgccgagtatatattaacaactgaattatatcacttatttacatatggattttaaaccctacaaaacggcacggaaacaaaatgataatgggatagcgatgaaaacaaaatataataaacgagtttatttaagattttttataaacactatacgaacacaggtacatctgagattgatgaaatcatcatgtgcgcaaagctatcgaaagaataattagctctaaatactagcacccgtgtctagaactttaacccaggtgaattgattccaccaaaagaaacatataaatatatcacttcattgtttaagtattatttttgtgttatgttggtacttttgctggacgttgtagatgttgaacctctagatccacactaaaaacgttagtggttggctcaccgaggcaaataccatgtttttcacgctgtagtgtgtacacagaactgcaaacgctcatagtttgctagacggtgcctagcagcgatcatttttaatgcccttaacaatatttaatcacactttgaaaacacatacactcgccgttttagaaaagcgtcctaattttatttatttacttatacagaggaagtacttctatatgttcatgtgaagatattaaagcggtataggtctaagtgtactcttcggaaaattattagctcctcccacaaattactacaataccctaatttcttttaggtgtgattaacaagctctctagttaataatacttatcgaataaagctgaggttaaaattttaaaatatttgactatgaataatttctaaaatatttatcttaaaaggtatataggttagtcttaaaaatatacttaaaaataatattttattgatatttttatttatattataataaaaaataaatgttaaattgttttttaagaccgcgtccttgtcaagaatgataaatgttgttagcccggagagagcacggacaattttgccttctagaactgattgagtttcttcatcatttcatcactcggtttggtttacatcgctgaaaacaaatgcttaatgtcttatctaaatatcttttcccttttttcatgtatcctggcttaaaagttaccaaaaaaatgcctagccttgttcgatttgaaagattcgtataggaaatctcaatttatcttgaatacacactattcatgtatttggttcataggattcaaatgaaaattttctattaaaatcatataccaatcctccaagacctttctaaaacgtaccgattccatagaagtgaaaacatccattctcttttttttagctcatggaatgaaaaaaattcatgtccatcttttatttttgcacgtgtatttatatgttattttttgtgtttttcccatcatgtgatttggaatccggaaccgaagaggctcaaaatgagtatcattttcctgggttccatacatgttttgaatctttttaatccaaaatctttcctgtaaaataatgttggcatctcagattcaccactttctgtgccatgtgccctaaacagctaaacctaaagtttagtacttctaagtaaaattagtaagaaaaggagctggtttttaataaattcaaaaattgtaatttttttcacacaatcagagaggttctgggagacacgtggaaatcacaggcaagcaattgatgtgagaatgggtcaaaaaagcaacgacctttctctctctgtttagcctttaggtcgagtaaactccaaacgtctctctcacatgtccatgcattaagcaggtgcaatgcatccagtccccactgtcaccttcatccgagatagcctaatcctccactaaaaaaatgattctctgtcgcaccaattaacaaatctaatgataaccatccatgcattggttatagtctaatactctctccgtctatggattttgagtatttgtttattctgtttgattactcgtcttatttaaaaaatttgtgcaaatataaaaaaataaaaagttgcgcttaaagtactttggataataaagtaagtcacaaaaaagtaaataataatttcaaatttttttgaataagacgagtggtcaaacggtgcaagcaaaaacttaaaattccttatattatgagacggagggagtacagtaactatactagtgaggatgatatgatagcaagaaaaaaaaagaaaaaaattgtcatatctgaattttatgtcatcagtaattcagagccaaattgcataattttatgccatgttcttttctaattcttactagttatgattttttttcctttccaagcttagacttctaaacgattatttcgtgcagaaacttcttatatgaagttttcccaaaatatttttctaaaatatttttctttactttatataagttaatttattcatttatactcttactttatctatcacaaaatcagattatctaatcaatttcgactattttagacaggaccatatacgtagtatattctaactaacaaagtagtagtgcgcccatacgcacatgcctattcccatatgcaacttgaaacaaatcgaatttcgggccctttgaatcgtaggaataaaaaaacgtaggattttgataggaatacagatgtaaaacagataggaatacagatgtaaaacagagtaatatacatgaaaaatacagaaatgaccgtttaattagaccacatgaaaaacgtaggaatcagatgagagagataaactatgattttttacaagtggttggacctcttgctaactttcctccaaaatctctataggattagccattccataggaattttaaaggatagtatatgattcaatcctttattttaaaggttttcataggaattttttctataggattgaaattctttaaatttcttacacttttcctacgaatgaaagtggcccttctttcttgaaaaatcttacaagtgctgactcgtttgattctttttctaagctgagagagagaaaggcattagtttttctgttcctgattagcggcggagtgtgccgtcctcgctttcacatccaatcaataccaagaaaaaataagagctttttttttaacgctaataatccgaagcactccctgaatccaacccatccgcggctgctgctgctgcagcagagatgacaaatcagatcgagccgggagctctggttgttcgtctctcggttcaggtcaacacctcgggagttcttgcttcggtttgaagcgaggagctctgttcttttccccgtttcttggtactggtgattcttggcttcgccgtgctggaatcggtgcagctttagggggggatttgggggaggttttgatgcgattcagagagtaaagctacatcatttcttgcatttcgcgtggttcttgggggtggattctttgcgtggttctgtcgaggtcgagctatttcgacgcgtactccagtctgaaccttctcagagatccaggttagtgtttcttggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6052 - DNA, 278 bp, Oryza sativa
caaaaaaaaagaattttgcatttctaaacaaaatttgtcacacatttcatataatactatgcatatattaatctataggctttcttgcaaaaacctcaccattgaattataactttattttgtttcttaggtattttattgtgatagatgacatatggagtgcccaagcatggaagaccttagatattcgttgcttgagaataattgtggcagtagaatattagtgacaacaagaataggtactgttgcaaagtcatgttcctccccttgccttaatc

SEQ ID NO: 6053 - DNA, 676 bp, Oryza sativa
  unsure (1)..(676): unsure at all n locations
gccaccgtcaccccagccacggcgagtggttcatcccgggccacgccccgccggggtcgtccaccagtatcatcatttgcgcccccaacaaaaaaaaccaaccccccagtcaccacgagaatgagaggatccccgaccacgccgtcgggagaaatccggtcgaggaaggaggctcacggcgacggtgaggccgcggaacacgtcgagcgaggcgacccgccgcggcttccgctcagcccccgccgggtgctgcggcgaaggggatgatgcggggtaggggcggatctcgtcgtcgtcgtcggcggaggcgaggagaggacggcggtggccggcgtcggcgtccccgtcgccggcgatggcgacgacggcggcgtccatttttgggtcgtttgctcgtgccgtgtacagagtagaccagttagtagtaaagtatgtcgcgaatttgtattatattgaaatacgtgaaatattcggtcggttagctctgnnnnnnnnnnnnnnnnnnnnnnncgtttagtaagcgggaggtcttgagttcgactctcaacgagagcaatatcttttttataaaaaaaaaattatacaactaaatttttaaacctgcgctccatttaattttattagggctaaaattttaattccggctattttaatttgtttcaaaatttggaggctg

SEQ ID NO: 6054 - DNA, 771 bp, Oryza sativa
ctggttctggcgtcttcagtcctttgtatgtaggctcatcgttttagcatttgtttgtttagattatgtggtggcaataaacaatgtactgacaatggatgacatttttgctacattcatagcagatcatcaaacctatggaagcattgagctaaacggcaggagattacaggtgtgcactttcagtttctggcagaaaatggaaaacatactagctgtatatatttcccttgatgttgattttattttcttattataagaaatactaaagttagttggaaagttttctccagttccataatggcaatccagtacttgtacttctacataactcgtgttccttcatctatctttctcaggaaagaagactttcttctactaaccgaaagacaagggccttggaaaatgtcaggatcgatgactaccgacctgttgatccaagtccaagctccaaggcgactatcggggcaggtccaattgagcatggcactcctctacttccttacgtgccgcgaccgaagccgcctcctgatcatcctgcccaatctcctgccacctaggtgaaaactgaaattctcacaatgcactggatagtatctctagaaccactatatatatggccagaatctgatgatttgatctgctattttgctcagatttgctaaagtgccatatgccttaaactttgtttgcatgagcatttgagtactgcatgctttgtgctgtgtatcaatttcatgataagaagcaatgtttcactcttctatttta

SEQ ID NO: 6055 - DNA, 3821 bp, Oryza sativa
  unsure (1)..(3821): unsure at all n locations
cagcttataagccgcatttaaatttaaattttattaattttagagttaattttaggaattgtttttcatcgtaatttttttcactgttttcttttaaattgttaacaacatgtatatataagtttcatgcacaaatcatatttttgttgctaataaaccgttattttttagataatggaagctttatttagactcagttagttatatcaagatgatacaaacaaactgagtcatccccggcctctgcataaaatgcacacagccagaaaagaagaaagaaacaactagaacatctcccaagcataaaagtttgacagaaacatatatcttagtggctatcaatccgtaggctaggtcgccacccatgctcctgggtaaaaaaactcctgtgccacctggtccaactgtcgagataccaccgtatatcttagtggctatcaatccgtagactagaccgctacccatgcttctgggtaaaaatctcctgtgccacctggtccaaacatcgagataccactataatagtatcccgcggtcccagttggtggaggatagcccaggtacgtagccaccgggtaactaaggtgataacctgcaaaggagaagacaccattttgttatcaaaaattactccattcctgcttagccaaatggaccaacacagagctgttgcacccatcaaaagcagattcctcatttctttggggacacatgatagccaactcccaaacatatgaccaacattgcgaggaggtttcagattagaagccaaatgaattacagaccacaccaagcgagataagcggcattgaaagaataaatgttggatagttttatccttgtgacagaaacaacatgtcttgctgcctttccaatttcttttagcaaggttgttcttggtgagaattacgccccgacgtaaacaaaccgttatggcttataatcaacataagtgaaacgatgtctgtctttgttccgctatacagacatgtgctgattaaattttgcacgacaacctaccaatctaccatacccttatacgtattttatgacatcgtatttagcacatgttggattcttatattctttgtttggcttagacactacgaatgatgatttaatcagaaaacaaagtgtacacctttctaccgtcttcaggtcttttcattgagaactacttggaaaattgttgcatgtgacaatacaatacctccaagctgcatttcaatatttgatgtaactgcaacaaaacttagtttgtcaagtcaagttttgatttgactccatatattctaattccattgacgaacttgagtagtattctgacgacattgaataaaggaagaaataaagcacggttagcttctttcttaaataatcgtgtcgaaataaagcaagtggttggtaaaaagggggaacaacaagacaggccgtggacaacagttccaatagatcagtcgaaagacttgcaagacctctacctcgcaggaacgagacaagtgttgggtgatgggaagaacaccaaattttggttggcggactggttgccggtggggagcataaagtcgagattccccttgaacttcagccatgtcgagcgctcgggcttgacggtggcacgagggcttctgaaccacaggtgggtacgagacatcaagggggcatcctccaatcgcgcaattggggaatactttcagatttgggacgcggtccagggggtgcaacttcaagatggggaggaagatgagacaatctggaagtgggcaccaaatggataatacactccctgctcggcctacagcatattcttcatgacaaacacggtggcgcgatgtggtactctgatttggcaaacaagagcgccgtcaaaggtgaaattctttatgtggttggcagaaaaagggcgatgcctcacggcggataatctaagtaagcgtggctggccgcaccagcaggtttgccaactttgcttggtgggtgatgaagattttgaacacctatttgtgtcttgcacctacacgaccagggtgtggagaatgatcaagggctggattggggttggctttctgctgccatctgagtcaggcttggacttgggcgaatggtggttagcgatgcggcaaaattttcggaacaactacagggacgccattgacagccttgtgctgcttgtttgttggatggtttagaaggaaagaaatgcgcgtgtgtttcaaaaccagcggcgctcagccggtttcctgtttggttcaatcaaataggaagtggcgatttggaaggaagctggggttttcaaaaatataggagagtagtctcttagtgtaatcttttgcttttgggaagttgctccggtgacaacttccattacttcgacagctttttgttgaagttataactttgtatatttgtatatattcttcaatcttaagtaaatttggttggcctttcttggccggcctggcaaaaaaaaaaaatcgtgtatccagattatcacttgaaatattgtttagaaacaagtgttagcttatacctacctgatgtaatgtttcaatttcttagagctgttagttaggattttcatattgcttttaacttaagctcggacaggcagaacaaactaatagtgatggtttcccttgttgacaatttcctttcaagcttttattcgcactgatataaacacgagacacacgacaaacaatattagttaggagatatatatgtcgctgtttcgtctcagtactgaaatttgtcaagagcaaattaattagaccacgacttgttttgaaacgaactttgcttgtccaaagcatgtctctgttaggctggggaacatcctaaactaaaagcaagcagaacgaaacattctgaacacctgctaggtaggccgctagggcaaatcctgatcttagaaaacaccccgttttgattcacattgcatacaaaagaataaaactattatcatcaacttggataagcttgattgacatgagacctaatcaccaagcatcactggcaacaactttgattaccagtatgatgagccatggcatgtatgttccttctgtctcaagccataataaggccatcagcattctactgagaaatccacaccacaacatgcacccacttctacacaaatctttgtaagcatcatgcttacaattatgcagagaaatctgccactaatttctaatcctttattcatctactaggcagtgaggtttaattacctctccactgacaacctccatctggattaattaaagaactgaaggtaagccttcagtggccatattatgctctgtaggtgacacttgctttcaggctttcagagatgggcctattactacaaactaacaagcatcattagtagacaattgagtcagtgatgatggactaatgccggtgtaattaagactcagcaatcagctgacaccttagctaatgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6056 - DNA, 7287 bp, Oryza sativa
acgttggaatgtcaatagcatcacatctcattcacaatcttttcagagatccagcatcaaacatgaaccaagaaccaatggcagatataaccgctaaagctaaaggtacagtagctatcacttttcactcaaccaatcaagacaaagtaaaagaggacaggaaccacacgaaccaagtgagtgacaggagaaaaacacaaagagggcaagagacagagcagagagagccatcgttttctttgtgtacctgaggatgtcgtagtgcttcttcttgcatccaaagcgatccctagcaacatgtttcctcctccaagaaatgcaaagagtagcaaaaccaacagaggaagacgcttcatcttcatctcccctgcaacaccgtaacttcagatgcttctgcaccttcctcctctcgctgcttcctctttcaaaagataacgaaaggtccatgcgtgatgtgatttcatttgcattgatcgtaaggtgtcagtacatgattaaaaaaattgatgtgataagacggcagaatttatggtctcgccaacaccgaggagcagcagcagaaaaaatggccaccatgcattcctctgttgccagcacctcgcattaattgccaaccgtgcaacatgtacagtagcgcaggagtatcatatgtccaggtttttcgatgctcagggcttgttaggcagagctccagctccacccctcctggagctggagctcagccaaatagtttcagctccaccaaaactggaagtggagctgggtagagctctctcacaaaatgaactagagttgtagagctaggtttatgcaactccacaactccactccagactcaactcctggagttaaatttaggagttggagctgtaccaaacaggccctcataaacttcagatacaggggacacagaaatctgactgcaagattgacagtacagggagttgaatcaaagcatcagaacgaagtatataaatccacaaaaatgacaacctcagcaaaaatcttcagagctgaagcttgtaaataacaaaatgaaatcacatttgatacactagtattacaagggtataggaagaatgccggcacggcgttataattcttttcccatatgctcttcatgctgcccatccagtgatggtttaaactttgtcactgttccagaatttctaaacgatccctatctaatgtcatctattcgggatgatgtcgttggagccttctagatcacaagagcgttcaggacaatccagcttaccccaccgtgcatttactctctggcaaggaaatataggttttccaaggctgcaaaagacaaccacaaaacgctcagatattgtgaataatctcatcatgggagggcaggaggccatgagattcagcaaaatcatgatgttgtgaatgaaaacatctatacttcaaaacacataccccctttatggtaaaagggtgccttaattttcctctttttggctttgagaccttatttttgcagcaactctatacgaacaaattaacaatgcaataccttaagaaagttcctttcggaatggcaagtcaacagttcaaacttgacaatatggacttaccttcgattgaccacattgtgcacgtagcataaccactgagagaattcagcctgagatcctgcctgcacaggatttgctctaagcaaaaagaacataaagaagtcagttcaatattgtgccgagacagtttattgttgctacattgagcacaaacatgaaaatttaagggcagcacaagaaaaaaacagaacaacagaaattggcagctggatataactggaacataataaactatgacagcaaaaacgacattataaccataaaagtaaatgaaaaatagctataagagaaatgagcttataaatggattgttacatccaattcccacatcccattatcaccatagcttctgtaaatcatattcccaaaaggtacagatggtgtaaaataactaaaaagtttttaaacgagtttgtggatgcatagctttagaatataaaagatccagaagcacagtttcataatgcaaaagtacaaagaatttatagttcctacatgatgttatatctcgccctaaaacaatgaatggataaaggttgataatgtattacataccaacatttcaacaaaacatagtcctgtcacacagaaacacatctcgaggaatcaaactatcaaaatggatactataatttatgctagtggttggagagcatttcttactttaaaacttctttgaagtgttccgcacattctttgcaaggatagagtctagatattatagccatctgaacataaaaagcagcagaaatgtgaccttgcatgaaccaagtaaccaagcaaaaggaataatgagatgcagaaaaatgtaattcttcaggaaataataaaataattcctcttcgttaaagcgagtaaaaaaccagtgaacgaacttcccattattcatcatggattgaggctcaatttgcagttgttgtgctggcctatgcttattttttaagttttcatggaacaatttgtaaaactcagttatccaatttggtagactcatccatcaaatttcaactcagatgttttatatgatgataatgcatctgtatgcaccatgattgagaaaaaaaaataacagctagccaaacacccatatatctaaatgaggttcaatcaaatgagatagtcgattccaaacgaaaccttagcagtagtcgtaacatactgccacccattttcaacgatgcaaagtataacatttatttgtcaagcaatgtagtggtaattcataactgtgctagaccaaaagcacaaaacactttctaaaaatgtctaagctcaaagttagcggggaatgaaccaggagaacacctagaacaaagcctgcatcctgtagcaacaaaatcacgagattaccatgctggaactttactgtgcagtcttaaagtaatcttgaatatttcaaggcacataaagaataaattaaatacaagctatatcttaaacaggatccattgcaggagaatacaaggcccccaagataaacatcaagaaagtgccttttctaagattcaacaatcctgtagttagccgtgacaaattacgagtgggtagcgacagcaaggtcctcatgtttcccccaaaatcaaaacaagggactttaccatacttccacccaaactctagagagatatcactaactgtttatcctgcttaatgcttaccagctctctcgcatcgcgtctttgttgcctggttggttcgtcaggaaactgaaagacaattcacaaatacaaacacgagttaaccgtagtcaataccagactgcgtactttcaacaacttgcagcctattcacaagtatgtcaatcaatctaacaaatgagtcacggttcgttgatgtgctctaaattcacccctgatgctacagaacttactagtgcgaggtaagtacataaaaagctttcatatgctctgttgtgctactcacagaggcaaaagatcgagcacctgcgctgcgatggtgtggagcagcatccacgtggccctgccgacctcctccttggtcaggggcgccgccttcgaatccttctgccgcgcatttcacccccacaacaacacaagttcagaaaccccctccgccacaatacagcaacggagagataacgcaatgaaggcaaaaaaaaaaaaacggagggattaccttgaggacctccggtggcggcggcggcggcgacggcggggtgggcggaggggagagggagagggagaggagggggcggaagcctccttcgtcgggcgcggcgtcgggggcaatgaggaggcggcgggagaaggccgcgacggtgtggacgacgggctccagcgggttggagccccacccccacgctggaggcggcatcgcggctcgcgtggaaatcgtacgacgacggcgacggcggcggctgcggatgggtgaagccgtaagcgaggtcgacgtcgacgaggaggagaaactcgagggcgtgcggtgcggagggcgtgaccgcgtgagaggggggagacagctaggaagggaggagggaggggaaggcgaaaacggcaaaaccggtgcgtttccaggaggaaccagttgatggatttggacggtggtgttcccgtttcacgttggtccgtgggccgcccgcgggcctcgtttgtgcatgccgtgttgcgtcgaaaacgtgcggtgcggtttggcggcgattccggccccgatagaaagtttcggtgcggcccggtttcgacacttcggcacaaaacttcaaaactacgatatatttcatctaattttgttagatgaaatatatcctactacgaatctgatatgctaaaatatatctcatacaatcaaaacttcttgtattttggaacaaaaggtattttggaacaaagggagtattgtagagcagaaatattatttgctaaaatgtggtctggtagatattagctgacatagtttctcctctttccaacttttactccctaattttttgcgtacacgttttcggatctatactacctccgtttcaaaatatagctacgtctaccgtgcatagtctcaagatgaagttatttcttcacctatcatctcctctcaatcaatcataaccattctccaattgattttttttcacttttctcttctcaatcaatcacaacctttctcatttacacatatttcaatacccatagacaactcagaatcttacattttagtatggatgaaatatttttttgcaaaaaaaatctatatgaaaattactttaataaaatcatatgaatctaattttcaagttttcttagctaatacttaattaatcatgctttaacgagtcaccctattttttgcacgggaaaaataagttctcaacctcggctaacaaacacagcctaattccacataaccgtcatttttgctcattaagtgctcgtagggtcaaaagtacagccctggtactacacttccctgcgatcagctggacaagaacctcttcgttggggcaacgacaataattctgggggacgggaaaacaaccagcttctaggactcgcactggctcgagaataagagacccgaggatatcgctccagctatcttggcggcctccaaacaaataaccaggactgtgcacgaggctcttgcccttaacacctggattcgggatattgacctactgcgtactatagatgcagaccatctatgctagtacgtttgtctatgaaccatgatacaatgcgttggccctctaaccgacctaaaggacctcgtcgtatggaagctgacggcaatggaatctactcttccagcacggcgtagaggctacaactccttggagcggcgggacgatttacaaccagaccatttggaagtgttgagctccacctaaatgtaagttcttcttctggctcattatttaaaacagagtctaaacggcggataggctaaaagaggtggtgggccaatcaacatatttgccccctttgtcgcaaagtaccggatctgtccaaaagaatctggactgaaatgttgattggcccaccctccctagattgcatgtgtaaagttccaattgcatactgtccagaagaatctaggctgaaatataacggtggacaggagcagatctccgattgcaagagtcggacggatgtgcgacagttgaataacggtagtacaaaatctcacgcacgatgagctgctggtaattatggtgcgaacgaaatgccaagatttttaggcatgttgcctccactcccaccaccatcattgccaaaatcaaagaggaggcgcatacttggatcacagtgggagcgataaaaatcacagagctaatccctacaggagagtagcgccttattgtttaattttgcgtgcccgtttgtttttgtcccactctctgtaaatactttaccattttattcctgctctatcactataaaggcctggtttagttcccaaaaatgtcacatcaaatatttggacacatgcattgagcattaaatatagataaaaataaaaactaattgcacagtttgcatgggaatcgcgagacgaatcttttaaacctaactaatccatgattagccataaaatgctatagtaacccacatgtgctaatgatagcttaattaggctcaaaagattcgtctcgtggtttacaggcgagttatgaaattagttttttcattcatgtccgagaaccccttccgacatccggtcaaacattcgatgtgacacttaattttttttttcgcaaactaaacaggaccaaagtggcgaaacttttgcccttcattcagaaaaaagtacagcccatagccgtcggtccatgtctttttcacgactaagtgaggagcacgatgcatcgatcgagcgggacatggtctgagatgttctctgtaacacgccacgcatgacgaatgggtacaatattgacaattaattaggcccgacggtaacgttcacgcaggaccagaaaaaaaaaaccctcaaaaaaatagcccgtccgacggccattacgtgaccggaaccaggggcgcaaaaccgaaagcgacgccgcggccccgtccgtccaccatccaaccaaccaacggcggatccgtcgaatcgccgacgcgcgcgagaccgcgaaccgcgagacaccgatacccagcagcagtggcacctgcacggctgcacagcagcgcaggcacaggcgtgcgtatgcataagccgtacgcccaggcaacgcgccaatggacgagagagacggtggctgtgacttgctgttggggcctcaacatcagcgaggcatttcatttcagtaccagtcaggaggcagcagctgccggcctcgtgacggcgcccagtgcatactacgtgacagggcccggcagaggcaggtcgaggttgacggtgatgaacagatatttcggatgcatgcatgggtgcagccatgcgtttaagcctgctaatgggttgggataaagtgagtaaaatggattgtttttaagtttgggttgtctttggttggatagaaatgggctgaggaggctaatgggttggagcggattggtccacatgtggaaatggattggattggtttggtttttaataggttgggttgaagtgggtaaaatggattggttaatgggttggagcggattggtccacatgtggaaatggattggattggtttggtttttaataggttgggttgaagcgggtaaaatggattggttttaagtttgggttgtctttggtt

SEQ ID NO: 6057 - DNA, 20272 bp, Oryza sativa
  unsure (1)..(20272): unsure at all n locations
cattagcaggcttatcctcaactacccccaacttctaactttccatcacatcacatctaaaacttttttacacatataaacttttaacttttattttaaacttttaactttttttttcaggaactaaacacagccgtagtaaacgttacaccttcagagagctaatagtgaacacataccttgctgccgacacagacgagcatactcacatatacgcgacattggatacccaacacacacgcagagacttttgacaacgtatctggccgttgtcacgtctctgtcaaccacggcaggccgcaactcatagatgccaatggtatcaccgaatttgcacctctaatgttttggaatgttcgaattgtttgcgcgcgtcaaagaacaattaacaaaccatgaatctcagctgcttatggccccgaacacacacacacacacgaggagaggacggtcttaacgcatccgggaattcagaatcgacatggcctctctttcaagctggtcagctaataccaaccgtccgaattaacaaactcccacgcaattggtaatcaaaggggcttggttaagctaactggcttttgtaaacacttacgcttactttactgtattctccagacaaaagcttggcagactttgctttactgtttttttttctcatacgagatggctgcagcaggagcagccatccacagtactctagtatagtggtctcctatcaattattatagccttcaaaaacaaataaagcagatctaatcatgacgccgttttattggaaaaaggaacgtctgacaaatgtgcctaattaggccgcttaaacgatcatatggatgagctattgacaaatagaagatgaaaccatgcgtgttgctacggaaaataaataaacaaagcaaaatcaatactaattgggtaaatacctacagtttgataggcaagaataaacataaactgtataaattagattgattggttgagttttcttataacgtggcctaacattatactccctctgtatcaaaatataagggattttggagggatgagatactttttagtactgtctagatttgtggtactagaaagtattacgtcactcaaaaaccaaacctcttgtattataggacggatggagtaagagtaaatgttatcaatgtgttgtatttatatagaaagaaagaacgcctaaagtacaacatgccgcctttcatcacaaattaactgtagtttaacttgccacattttcagaattgaatttttaaccctgatttgttttcccaaaatttagcgtgattacgaaagtgctgttcaataatacataatagagtatcagtttgacagcaactcttgtggctgacaattttgagcccgggcagggacaacagtatcctaggctctaatagcagaatcacagagccatcggaacctgtcgttgccaatggccggataggtttagtttttagcattaaaaaccactggagtagctaggagtgacatcgacttttatcaagaggagctaaaggcgaaaagccagtccaacgaccgaaagctcagaggatttctttttcttttttaaaagatgaatacttacggcttaagttactgattttagacgttaacaagatatcagcagtgatcagtgcaattagttgaagtgtgattcaatcattcaagggagatatatacttgtaggagaaaaaggaggcaattattgatgtgtatctgacagtatgaagcatcgcgattggagtgtcctcagcaagcaccgaaaactacagaacaaaacactgtacttacatttacaataaggcgatgttttttcttaaaaaaaaaagaggcgtcaaaaccattgtaaatcattgtgtgagtggtactcagagaacataatttgattttctaggacagtattaagtggctagctttggtcggcagtcagtcaatagcctaatagtataacttggcataatcaattttaaagtagcaactagcaagtgtccatacgagatcttttaatccccaactcacttgttccaatcttgataatctttttctgaactgttgagtggcgcctctgcagactggagtctgaacaagcacgtttcaggattgaggtttaactgagtttcgatcaaatcttcttcttctctttcttttagcaaaaggaactaaattttaatcctaacccaaacgtttccggatcagagcaccatcaaaaactaaaactagataggaaattcaagatgaaattgcaaacaagaaagtagtaataatctgaaacagctctgttcattcacataccccaagtatcatctaggcggatcgatacaagaggaggaatcgattactacatctcagagcccagtagtgagacggagaaaagaaaaaaaaaggaagaaaaaaaaaatcaaagagaagtcgcgaagagaagaggacgagctaagccacagccacaagcccacaagggagaccttctagaagcccgcgcagaggcagatgctctcggtccacggccgcggctgccggaaccggctgtgcctcctcgccggcggcgccgcccgccccgcccccgcccccgccgtgctggtgcggctcagcatctcccacatcacgcgcacgtcctcgtactcgcacgtgctcacctcctgcctcagcctccacagccctgcgaccaaacaaacccaaaaaaacatcgccggagttagcccccacgtacgccgcctccgcctccgccgcccaaccaaaaaccaccccgtctcgccgccttacctgtctgccgaaccccgaatcgggcggcgacgccgagccacgccctcctcaccggaagcacgacgcggtcccaccagtaccccatcgccggcgatcgatatcctcctcctcctcgtcgtcgtcggcgaccaccgcacagcctcgcctcccctcgattggggcctggtcgtctcggcgtcccgaatttgtacacgcgggttggggggagaaaaaaaaccaacccactgtaaccacaccctcactcacacactgacgacgcgggcccaccctcggaaagcttctgcgggcccggggtgtcagtggcagaggtaggtacggtggttgtggggagtttgttacgggggtgggcggcgtgcacgtgcctgaatgcggtaggcgatggcgcacacgtaggcgcggggatgggggttgcttgctgataaagtggggcccaggtggattcatgcgcagtcgtaactgcttggtatgtggcagttgagtggtggttacggcggcgtggcagtagacagtagtagtagtgtggaagtggacggagttaggtcacccgcgctgggttggggtgacgctgcgaagctactgcaccctgccatcatgatctatccaggtttagtatccgtgcggttatcacagatatcgtatgcggtaatctttttagtttttaaaatcatactatatcttacgataatcatcaaaagagtgatgataacttcactcaaaacggtttggtaaatttagatccatctctactggttctaaagtacaaaacacggtaatcttctcagtttttaaaattatagtatatcttgcgataatcattaaaccatgagagtgacggtaacttcaccaaaaacggtttggatccatctccatcggttcaaaagtacaaagcattttttaaaattttaagtacttataatagcagtgagccgtgattttttaatgatgattctgagtttctgactactcatattattgttgccgggtcagaaatatttcatctcttgtaaaatacaagcatttatgaaaactttagtacaaataaatattaagataagtattggttaaaatgaaaagtaagtagacaaattaaatgggaaagatgaccatcggttgaaatgagaaaactgatgcttgtattatagtataaattctaaattctaaaaatatttatattctgtaacaaagtgggtagcaatcagccaatcactacggcactagtcacctctcttgccgtcttctatttcgctttgagattcgtgcacaaagttcacgtcgcatttttaattatctggtgttaactcgtaatcaactggtgatacgcaaacatcaagctgatcgttgagctgagcagaggcagggaaacatttggttaaggcccggaaattcttgacgtgcgacgagatgaacggggcggcgcttgttgcaggtgagcagtcgcatgcacggccatacctttattgctaaaatgacaacttgtgcaaattgcgactcccggatcagtgtatataattctgaagaaaaagcctacaaatcgtcacgctgcttaggcaaaaagaaaataagaaaaggaacagatatctcgttaagccatatatataaatcgatgggacattttatacaggttgatctagacatgataacaattactcctaacaaacaagaacgtgaacgtgttaacgtgagagttgagaatcgcgtgcggaacagttttggtcgtcgagctgaaaggaagatcgatatatcaatcacgcattggaagaaaactccaaactcaatggagggaacttggaaaggaacaataagattgaccgtatagaaatgcaagggctagttggtctaattctgtctactgtctactggctcccgttccatccacatgtttattttttttctagaactccatccacatgctggaaacgaagttttctacgtactcctacttcaaaaagggaaaacacatatcccatatgagtggctaaagcagtagtcagatctaccaacaagtctcggaacgtgagattagactgactttacccgttgagttcgttaattagatggttttatgggtactggttagttggtgcagttcaccaagcctatatctgcatgtgtttagttgcagagtactagtaataccagaacatcaccccatatacatgtgtggttcctggagcctcagcgaaagcaagccgaagatgcaagttggacctttcagatttcgtgctggtctctccagaccgggcacatttcttactgtcaagttggctctacaaacaaaacagtgccatatggccaattgtaaccggacacccctgccctcttgtattctatttttatacctctaaggtcctgttcttttctccaacaaacgttggattaagattaagatttttataacacgctttttaaactgctaaacgatgtgtttcatgcgaaaactttctatatgaaagttgctctaaaatatcatattaatctattttttaagtttgtgataattaaaactcaatcaatcataagttaataccatctcattttacgtaaaaaacttcatcttcagcagattcaaacagcacctaagtctgataccacatacaaacagtatgtattgtatgaccataatagtatgagtcttaaaaaacacagactggttggactcactgtaggcctgtagcctgaccatcggtcacgcgcgctcgtgaccaccgcgaggccaaccgccgccccctggctggaccactccaccgcacccactcgcgattcatcagggtatatttaaatattcaacacttttaaatatacttcttccgtttcagcttacaagacattttaactatggtcagagtcaaaatactttaaatttaactaattatataaaaaatagtaatatttacaacactggtatattttcattaaatctataattgaataaatttttataatatatttgtcttaggttaaaaatattactattttttctataaaatcagtcagtagcttgattttaaccaaagtcaaaacgtcttataaccttaaacgaagagagtaacatttaataaaatatgtctatgttacgtgagttttggcaaattgttaaacaacgcatctaaaaaattcaccactccattactcctcatttatatgctatgaacggtaaacagtgcattaaccagggcaaacctgcgcgggtacgtttttgcagtagcggtacgacgaggggaaaatcccactgacaggtgggtccaggcgaatcagaaagcgctgcccggtcggtggaggcgagctgggcccacgccgcagtggcggcgtggctcccccgaaactaccgctccgctttttgcccggccaaaaggagagcaataaaataaaataaaaaaggaaaagaaaaagaaaaaaaaacacgctctctctccctcgagggccgcggcctcgatcgcacgcacgcactagccgcacgcgtttggctgcttgctgcggttgctcgcactcctccacctccaaaggctccaacaagaacaagaacaaatccaagtgaggccctcgcccacccaccgactccgcggccaaattccggcgagatgttcgcgagcaggccggcggtgcacccggtggaggcgccgccgccgccggatccggcggagcagccgaggggggtgctgatgaaggacctgcccgggatgcccgggacggcgggggggctggggctccgcctcgcgcagttcgccttcgccgccgtcgccctcgccgtcatggcgtccaccaacgacttcccttccgtcacatcgttctggtgcgtgccgcgcgtgccccccctctcccctcccccgtctctgtttctctttccgctttatccgctccacgtcagtattgaggtttcctcttttaggatttgaggttttgaattgttgctttagaaaggggggatatagttgtatgtggtggtgtgtgaagaccacacgttttttgccttattgatgatatctgaatgaacagagacaaatatttctgaaactggatattgtagattattagctcagcgatgagatactaaatggcttggctgactgtggtgccctgtgcaaacctgtgctatataatcgtccaattttctttctgttgtatggagtagttcactagtttatgcttgtttgcttaactccaatgtaaagatggtcattatctttagagtgcaaacttttgaacttgaatatatatgcatcatttgccgatgatgaagcatatacgtgatgctaaaaaaatgtgctatattatcaccaagtcagccgccatcaattgtttgaaggtttgttaatacataagcacgggctcttatcatcacaaatttgtttttagctaattagatgtgcaaccatactatcccatttcaaatactcccttcctttgtataccacatttatattttgtactttctgaaatttggataggggtacaatagctcataccattatcagaaagaatgacacatatatcccaagaacaatatcgttttcatccatagttctgagctcttctttagcaagttgcaacacaaaaattcaatttggcaaacacttggggacaagcagcctcacttagcatcttcctcggtagaataaaaatagtattgttgtgctgcattacctcatatattcagagatatcccgcttcaaatttggtggccatctttattatgtgctagtattgtgtgtgtctactattagtactggttttgagcctacatgtaaacctgtcatcaattcaagagacacacgcatatgctaataaacaacaaggacagagacaagatgctgattcgaagagactgttgatgagtaggaacagtgtattctgtgcaactatagtaattaaaagagccatatatattgtgttcagtatgactattaattaaagcctattaatggctgcgtagggtatacttactttctgatattccctaatttaatacctaaaccttcttcttgttatgtaggtttatccactcatattactcctatgttaattatatgaccatgtttgcccttgtttctttgggtggtgggggcatatgctctttacaaatgtttggtctttcttttagtcaacctcagttctattatactcagtttaattgcatgaataacagactaatgaattaccgttttggccagctttcttgttgcggcagccattttgcaatgtctctggagcttttcactagcaattgtggacatatatgcactgcttgttaagcgttgcttacgaaatcgccgggctgtttgtctatttgcaattggtgatggggtgagtgcaagctgtctgttatcctctttctactgcttgtgaaatccattcagtcagtataccttcatttattttctgtaagtaatggatatgtgttgttgataaattcattacaagtccttctagcagtcaacttgttcatgataacactagcatactatactccctttggtcactagaaaagagtgccctttgcggctgattccaaaagttcaagaatacaagtcgttttggttaaacgagtctcctacctgctataccttcaattaaagtcctacatgcatgcacatgcacttttactacaaaccaagagaagttgagaggcaacaacggaaaaaaacatggagagagaatgatgcataaacgggttgatggaccttaataggggtacaggcacctgaaatttctctccttggttttgtgcatagtgctgaaaactacttttattcttgactggagagagtactttactgtgactattcattcttctgcaactatagggtgcattgtcattgactttggtttttttgcagatcacagcagcactgaccttcagtgccgcatgtgcgtcatctggcatcaccgtgttgattgataatgatctagacctatgctcggaaaatcactgcgcaagttttgaaagtgcgacagcaatggcgtttcttagctggtttgctctttcgccatcctttctattgaatttctggtcaatggcttctggatgaatgaaaaccaaagaggaggttagagcttgatttttgaatgtatcatgtgcccaattcaccaattgtggttagtgagaattggatagcgtgacgcagctaattgtattagagttgaaagctgatgtgcggtcttgggatcatatgtttctagtataactctgtaaaaaaagaataggggatggcctgttttgcaagtgttcaatgtggaactcagtaaaagtctcttaagcaaggtgctttccgtataagacttccagctggttgagtttttgtgtgccatcatttatgcatacaacgtgttgattgtgctgatgaatcatacagccacagcaccactacataacaagggttgtgcctaatttccatggtacatttcagttgaaagtcgttctgaaagaaccactgaaattggtggagaaccttctatcgtcggctgacattcttgtgtgcaatacccatccatggctactggccaagagttctgcactcaccagggccaactgtggtgccgtaatctaccacactgacccatccgtagatggcactcttcttttttcccattgaatgttctttcgtagtagtacctttcaattgttccctcggtttcttagttgtttttttccttaatatgtttgtactatatgcaatggacaaaagccatgtcagataatgttctagatgtcagttatcacttgttaggagctggagatgagatgcactcctagccatgaaaacatcatcgttatcgtccggggagagacaggataataccgagatttcattcgcgtcgttacttggacttggctggcacatctcatcttcttagaatgtaaaaataaaacttttttttttggaatttgtaatactgtttgagattcactttggtccatcaaaagtacctcgagataccggtacctcacagtatcaaattgtttttatcattggatctagctgggcaggaaagacattattagatctaatgatcgaaaacgatttgatatctcgaggtaccggtacatcgagatagattggagcaaatctcactgtttatacttcagtgacatatactttacactgagaacgacttcgatcaaatcaattactcatctgtagactacaccagctttgtactaggactataccaaaaccttacattgaaatgagttcaaaatttgtgttgtaagttgtaacacaaatgatacatttacaaggttacatactaaaatactacacacctgaaatagtactacctccatactatcatgcttatttatgttcattgctacatagcgatcatgaaaaatcaaaagcaccatgaagacaccagtcatgcatgatcactttgatcaaggtctggttggtcaagaaatggagtgcctccgatccttgggcggcttcgtccgcaccctgccgccgccgagcacgtccgatcgcaagaacgggttgagcctcccgagcttcttggacatgctgttcatgaatccgccgctgcttccgccgccgccgccgcccggcttcttcggcagcggcggcctaccggacggcgggactcctcctgcggagaacgccacggatgggtctctcaggcgcatcttcatccggagcagctccatcctgagctcgtcgttctcgcgctgcagccgggacacctcgtcgggaacgcccggccggtgccggccgttgaagctcggcgtcggcctgtacgacagcgccggcgactcgccgccggcgtacgacggcgcggcgctcggcggctgcgatggcgcgcggaggcgccgctgctcgtggtacagcacctgcaccaccgtctgcaccggcaggcggtcgttctgcgccgcgtgcgcgcacgcctcgcgcgacagcttctggcagtccatcgccctgcacaccttcttcctctcgccctcggccagactcggatgcgcctatcgaatcaatccacataagcatttagtggagcgattaacgaaggattcaaccatttcttttagtgatcgatgttaatggtagcttctaaccttcaagtagatgtcaatggcgcggtacatgccgtcctcgttgaacctggcgcgctccgggatgagctcggcgagggcggtgaacttgtcaacggacaggttctcgtcggaggcgatctcggcgaggtagctatccatgagcctgccgacctgggcgacgtcgctgtgcggcggcgacgccgccgagctgaagtcgtcgtcggtggtgtagtccagccgtggcggcggatccgtggtgtagtccaggtcgaggtagccggccaggatcctctgcacggcgtcgatgtcgtaggccgttgtggcggcggcggcgtcgggcgaggaggacgggatgaggaggtcgtcgagcacggcctggccgagctgcgccgccattcgcttctcgaggtcgagccggcacgccagcgtcgtgtcgaggtggatcgcggcgcggagcagcatcgacaggaagctcaccgacagagtgttcctctccctcggcagcaggctcacgatcgtctcgagcaccacccgcttctcgtgctcctgcctcgcgcccatcttcttcctgtccctcccgtgcatgtcctgcaccacgaaccacgcgccatggtcagatgatgatccaagaaacgaaacgaccgatcgcgaccattgccggcgacgcgcagagctcagaaactaaccagccgtcgaagagatttctgggcgtagagcatgatgagtgtccccatggcgatgcccttgaagcccctcgccttcatcgcgatcatgacgcgctggaacgtgtcgatccgcagcgccgtcagctcgtcggcgcaccagtcgtcgacctccctcgacgccgcggcgcccacgccattgtagccgccgccgccgccgccgccgggggtgcccagcgacatgctgaactggccgtcgccgccgcagacgatggacgcgacggcgtcgatgcacctggcgacgagccgcgccttctcctccgacgccgggaggagctcctcggccttgcggagcacggcgaccgcgccctcgaggctcgccagcgccacctcctccaggtaggcctccgtcctgccgaccaggttgcccggcctgcactcctcggtcatctcgaggtgctcgccggcgcaacgcagcatggcgacgttgtccacggtgatctcgaagttgacgccgtagcagaacttgacgacgagctcgaacgacttggagccgccgggcatgccggcgatctccaggtgcgtcgccttgttgccgccgactcctgacacctgcttcttgatgtagccgcacctggatgccaatggaagctgcagtaacaattaaacacctgtcaaaaactcagtttttctttgctagaacacgcagtgaaaactgaaaaaaaaaacaaatttgggttgatgaaaatcaccttgtgcaggttgaaggcggcatcgtcgactttgatggtaatatcgcttgggagttcttgcgaaagtatcctgtagcaatgaagtgaaatttttgttcagacttgtgttcttgcatagttcggttacagtgttgtgatttgtgactccgaactaaaagcaggatgctaccaagctgtactgtgtgttgatttagggaagtttttgtgctgctcactttgaagcagcactatcacttctaattgaaaaacaaaacagtctccaactaaatgaagagcaattgaaacttttttttgacaaaattacagttcatatcagatagaaacaccatgcaaattaaacatgcaacaaccacaagaggaacagatgaactcgtagcaggaaggtgaggaggaggacgaagggcggcaaacgtaccagtcgctggttcgcttcatcgcaggcgagacgaaccgagcctcagcctgcatccctgaccttctctctctctctctctctctctctctctctctcctcctctcgcacgcagaagtcacaattttcacacaaaatattctctttatcttggcccaaacgcgcgtcgccgtcggaggaaatcacgggtgcagtgagtgacgcaggtgcggcaccctccggattgagccgcggttgccattggacccgcgtggtggctggacgccacacaatggcaattcgtacggcggcttgtggatggaatcggtcccgaatggcttgtgcttgctgctgccccacttgccctttttccgctgttcttttctctgtcagactcaaaattgtcttcggggagagggagacgggcgggcgggcgcgcgctgcgccttggagccatgggcctggacgaggtgggccgcgtcttaggagataaggggcgcggcccactgggagatcggtttcctgatggaataagttcacttttagccccttaactagtgaccgaatctgattcttatcctcgaaccgcaataccggatatctcgatcccctcgatgcaatctgattcgtatctcgccgcatcaactgaggtggaagcggagatatccagtattacggttcgaggaaacaaatcagattcggtcctaagagagtcaaaatgaatttattcctttcctaccgggtgaaatttccggtgacctactgacctccggtccggtccggtcacggttgctgagttgccggttacggcgccgttgggttgaagtaaaccttcccggtttgtttgatttgttccgtggagaagctggctgattgtcgtggtttgtaataattgaattaagattgttgaatcgtaatattttcctgataactaaagagtcatctttttacaaggagcaaggagccaaggaaacacacacaaaaaaaagtaataaataaaacatatattttgatcatgtactctaattcttattttgaaaatagttctcttaagacctgttcactttgatgctattttcaaccatatcttttttttttggcaaagttgctaaaaaaatatctatgtttagtttgttgccaaaattgataaatacataaaaaatcctactaaaattttggcaatattgctatcttgccatgctaaaattttggcattgccaaaacttggtaaggtttattttgactacaatctgaataggtccttaaaaatgctaataatggcatgtccacatgtgtacaaagataaaagaaaataataggagaaaaatattgtgtttgttcatttctttcttatattcaggagcatacgacaggattgtgttttctactcaggccttaattaatctgcgtgtcctaaataaccagagtatatgaatggataatgtccctaatattttttttactagcacttgcaatatgtgctgataaaaaaaatagaacgtgtcaatcatagtattagcatactgtacatggctgcctgtcattttgacgtaggtccaatacaggagcataaaatagcaagaaaacaattaaattaagcgtgaaaaaggaagggacgaagaaaaaggggaggaagaagagcaaagcggagacgaccaaccaaatccttgtcccgtccgttcggtcgccgcgtcgaggaggcagggagctcgcggcctcgcaccaccgccgccaccccgccatgacgagcgcctccgagctcttcaccgcccgccgcgcccgcgccgcccgcctctccgaccccgatccggacccggatccgcctgcggacgcgctccatgacccgcacggcctcgccgatcgccgcggccggcgccggggctgccgcccgcgccgccagctcgacgccgccggggacgtccgccagcacctgcacaccggggccccgccctcccgccgccgcgcttcgtacaccgtgagaagcacatccccccgcctcatcctctctagattttttttgttcatttttttattatttttgtgtggatgtgattagatcgaaatgatttagctcatactgataaaaatttgggaggattagggctcctaatttggcttgcgcaatcccgattggggtttggatgctttagattaggttatcctcgcctagtttatggtgaaatggggacaattgttagtgtggctagcctattctcttccatttttttttctgttactgcatcaattgtcacgttgagtactaatcaatatcgtcctggcaagtactagtacttgcacaaaagactgaaaccaaacccgatcatgctgtttggtctgttcaactgaggtgttcttctgctatgcacttgtagatcattacggtccccaaaggggcagtgataatatcgtgcagtgtatctcgagaattcgttgcatcctgtaaaggcttgattttcgttataaacattaagttgaaggagacccttatcttcatttccatagaaaatataacatatcaaaatggtgtgatggtgcctcatctttcttcactcactcctgaaaattgaaatggctaggatgtatgtttagaatattggctacgcttattagaatgtcaatactcagacctgtgcatttagtattccattgccttttcttcttcttctttttgttccagttccacttgaaattcttattatgaattgttatggatgaacattaaattatgacctaggatgcatagtggaatttataactgtacagcattctgatctatttatttcaactaagaaaacgtaaatttagattgatgtttgttgtttctggtgaatcaaatgaggatattcggtctcttttgttgtctacaggatcgtgtcttatcatacatagacaatagcaacattggggactctgcaactaggaggaaccgactggataggctgatgttcagaacaaatgagcggcttcctggtgctgtactgcaagcacaagcacgtgttctagagagactgagaggcatttctattggttcatctgtgtcaaggccatctatcacattggatgaattttcagctactgatgtgtttagaatcattgacttcgggaacagggatgctccatatgaagcaaataggtccagctcatcattggcccatccaagtagcgagtcagatgaagaaaggtcacccattgacaccagttccttaaaaagatcacgtgggctgagcaaggcggccttccttcggctacagatagagatttttgaggcaagcaaagatgacaacagggaggcatcaccagaatgctcgatttgccttgatggattctatgacggagatgagctcataaagctacgttgtgggcacaggtttcactcgaattgcctggagccatgggtacggaaatgtgctgattgcccatattgtcgaacaaacatacagtcacgatcctgactaccttagttctgcattggcagtttggcactctcattagaactgtaattaacagtaagatgtattgttgtaattcagtgttatgtgcatgcctgttacccggagttggtatgacatcactctattgaatttcattgttgccactggagttgtgctgcaaaaggattgagaattgtgtgcaatgactgatagtatatggtagtacattttttttcctttttgtaaatccgatgagaaactgacatacataaccaatgttgtttcggttgatatgagtatggcgtaggtatgaactgctgagatgctttgaaatccttgaatagtctggtgtggattgtgtcgtcaaggcagtatcatgatctttatatttgggaaattttcatctataccatcatcaggattgcaggtaacagcaaaacatgcatcagtgtagcgagttctcaatggtctttgggagttgggaggtagaggtatttatgttatttgaaggtattatacttttacacaccttctgattaacactacaagttatatatacatcctcatattttcctttttctttgatattttcctttttctttgtgaagaacaataatctagttattcttcttgtagttttcttttcttttcttttcttagaatattagtctagattttgtgtgaattcttttgtgaagcgtaacgttcttaggtatttttcttcttgtagttttctttcctttccttggagtattggtgttcaattttgtgtgtatgcttgcagctgttctgctatggcaccattctttcccattggatttctgctacctaattctttttttgtgctgctattccccaggataccgacttgtttaatgtttatgaatcgagaatactcctacgtcttttagagttttgacatccattgcgatccattgtgtaatttgtatatcatctgtaaatatactgtactccagtcaataccatgttctttggatggcaatatttcttttgtcaggaatggttcttgaagtaagggaagagtgcatccttgatgccatcctcctcccactccagctgctgccaccactcgtcgctgccctggatctcccgtagcttcagcggccgcacgccgtcgagccgccggagagcgtaacattggccgacctcgaggatctccagggccgggaagctgatcgccgggacgccccggcacaagcacgcaaggctccgcatcccgtgcaccgccagagtcttcaggcaagggaacgtcgtcggcgtcctccggtcctccgccgcggtgtcgccgccaccgtcgacgatcgcctccatgtcgtggcagtagtgtagctccagatgctccagcgccgggaggtgcaacacccagttggcgttcttgagctggaagcagttgaggatgttgatccgccggagcgccgggaggacatgggcggctgccgtcgtgtgccggaatcggatcgtctcgaggtgacggacgctcaggagacggagcctgtccagcttcggtaggcggaaagatcgacgcagctcgtcgtcggagtcgctgccgctgccgctgccggcgtcgatgacaatgtccttgacgccggtgcagctccggatggcgaggtgctgcagtctttccagcatgtcaaggcctcctagcgtgtccgatagcgtggaagggagcagggtgagcgacgccggcccggccatgtccttcaggcacagccgcctcgtcgagacgttggtgaagccggagagcttccggagtgcggcgacgctgctgacattgatgccgaggaacttgatggacgcgttcctcgcttcaagctcatcgaggctcgcctcggatgcggtggcggcatcgtcgtcgtcggcgttcagcctccatcgggtgtacctgctggcgaagacgtcgaggatcttcagcttctggaggcccaggatgacgttccttggtatgctgtcgagcatgttcgtgtcgctcaggagcaggtgttcgagctgcgtgaggtgcagcagctcaggcggcagagcgccgatgaaggtgccggacacgttgaggtatctgaggccgacgagcgagccgatctcgccgggcagcgccatgacgatggtgtcggagagatccaggtacgtgagcgccggcacgcaccggaggaagctcccggggatggcgcgcagcgacgtgttcatctgcagcatcagcgccctgacgccgcggcgggcggggagccgcgccgggagctcctcgatgaggtttctcatcagcgagacgcgctccgtcgacgcgcccgccgccgccggcgaggtgcgccactgctcgttcagcttcgacgcggtcttgatgccgacgccggcgcgcaccagccacctgttcctcgtggcgccgcagtcggaggcgatccagatggccatgtcgcgtatcatgtcgtgcatcctgacgccccgcgtgtcgccgacgacgtcgccgccggactccagaaggcggacgtccttcagagcggcgatgatccgcgcgcccgtctcgacgtcgtcgtcgatgctgctggagccggcgatgaggccgagcccgagccagcactcgacgagcttctccctctcgatcgagtaatcctcaggccagaggcagcacgtcaggaagcactcctgcatcgtggtggtcgggaggtagtcgtagctgaccttgagcacgcgcagcatgccggcgttctcctcctccatgccggtgatctcgtgcaggtgcgcgttcctcagcttgtcaatggcgtgtcgccacagctccgggtcggtcttggtagacagagccttgccgatggtgatgagcgcgagcggcagcccgcggcactcgccggcgacctccctggcgagcccggcgatcgccgggtgggacgtgacggccgcggccgtggcgttcatctcgaagagcgtccacgcgtcgtccggcttcaggcactccacgttgagaacccgatcggccttcatgttgccgcagacgatctccgacctcgtcgtcagcacgaccttccgcggcagctcgtcgccggcgctgccgtctggataaggaacgccgatgagcttcagatcgaagcattcccacaggtcgtctagtagcatcaagaagcctgtgttcttgaggtgctcggcgatcggcagagcacgttgctccaagtcggcgtccgagtgttcgtcggggaggctcgccaatggcaagccaagtttcttcgccnacgtcgtcctggacccgatcgattttgcattccttcgaggctactgcccagacgacgtggtcgaacaccttgctgctctccggcgactgccgcgcggtggaaagaaacctgttgttgatggcgcggaggagggtggtcttccccacccctcccatgccgcagacgccgatgactccaacggcgtcgtcggcgatgtagccgagcgcctccttgaggtaatcctccgtcccgacgccggccgccgcgggcgtcggcgccgactggtgcgtcgtggcggcgaagctgccgaccccgcgccgcgcggcgcagatcgcgccacgctcctgcacgagctgctgcgcctgccggagcgcgcgcgacgcgcgcttgccgatgcggtagcgcgcgacgaggcggaggcgtggcatggacagcgcggcgtagtccgccgcgacggcgttcccttgcttctcggcgacgcgggcgcgccccagccagttcgccgcctcctcggtgcaccccaggcggcgcagccggtcggcggcgccaccgtcttcgccgtcgtcgacgcccacgacgcgggcgtccacgatagcgccgtgcaagctgctacgctgcgcggcgagctggccgacggtctcctccaggcggcggacgttcctcgccacgtcgagcatgtcgtcgagttcgctccacaggtggatcgcgcagcaggtggacgtgctgtcggcgacttgttggtcggccggagcgtccatgtcgccgtcgccgccggcaatggcgtctgatcgtggccgagtagtcaggtgagcggcgatggcagtgtcgaatgcttccgtggacggactagatcaaatttgtgctagacatatataatggatatatgaattatgccgccttgatgataaatttcgtataaagataaactttgtgaatttgagaggatattgaacacgtgctagcagttggattgacccagtcacccagctactccctccgttttttaatagatgacgccgttgactttttctc

SEQ ID NO: 6058 - DNA, 22937 bp, Oryza sativa
acggcgccatctattaaaaaacggaggtagtagtatttatagcaaatccaaagaaaaagggcaaagacgaactcacctacagaacagtgtatgcaactaagcatggcgtgtgagttgtgacagtgactgacaggaacagcttaatggtaatgtgcctttgactaatcaggtacgacctgaataaacaaagtcaaccatattcactgtgtgacgcgccgatttataggtgcattatgaaagctgaccatatgttatatatagtaggaaaaagatgaataccatatcttcactaaaatatgctatgtagcttccagcttcttttagcaaggaagatggggtgttggggatttgattggttagtcaaagtcattttcatagccttaagtcgtatgcttattcacaattttttttctggatttatatataaagtttggacttcaaattttatccgatactttatgcatactgtatcaatgttgtcaaatgttggacaacattgctgacatactgtttgataagtggagatgtccatagtataatgtcgtgaaacatgtaacttctcctttaccttgatgacggcaaaaaaaaaaaagtggagatgtccaactgagcaagggcctaagtgccgaactgacacaaatcagaggatgtgttcaacagtgatcagaactttagaagagggttgtatgatgtcaaaatgacaaacttaccgtctaaacaatcaaaagatgggacaaagcttggctgttggctctaccctggacagttggctgaactgtttactgttctccattgtatgttaatggtctggctatgaattctaaactaattcatcagaagacatgaaacattttcaggccattttctattctttttgcgattgagttagcttcagtagtccacattttttactcagtaaaatcagcagtcaatactaagggtggtagtgcactacagcactagaactacagaaagtaaaatgaagtagatacggctgtgtactgagaacagaagggaaatacataccggccagtttcttctaaagacagtgccagaacacatttttctgaagacagcaccagaacatattccggatccctaaggaacaacaaccttgtcaactgcttttgcccacttcggtacacaaagcacaacctaacactgagtcttagacttgttcttgttgattacatcgcttctgctatggaaaaggacaaaaaaaacagtagggagagataaaaataagacatgaagaaaatggccctgtgctgcttgtttgttggatggtttggaaggaaagaaatgtgcttgtgtttcagaaccagcggcgctcagccggtttcctgtttggttcaatcaaagaggaagtggcgatttggaaggaagccggggttttcagaaatataggagagtagtctctcagtgtaatcttttcttttgggaggttgctcctgtgacaacttccattacttcgacaacttcttgttgaagttaaaactttgtatatttgtacatattcttcaatcttaagtaaatttagttggcctatcttggtcggcccggcaaaaaatagggcatgaagatcaatatgttgagcatatggtactgaacaaaaaagtcctaagcccctacctcaaggaatcttctgaaacactgaaatcgaacttctcttgaacttggctgccggatgcttctgttcactcttcaagtccagtcattctggaaaaaaaataaaaggattgatcaatgaattattcaaagtgtgctatattacatatgggtgtgaacatgggatctatctattacttgactctaaagaagatatatgagcaaactgggttcccattatgactgctgacttaacctggacttttcaagtgaagcttctccatcttttactagatttaatctatcaagaataaataaaataggtcctagaatcaatttaacataagaatacatgaattagaacttctcaaagtgcgagaaacggatccttggagtttctttactatccttaggagttaggaggcattcaaaggtaatgtgtattttagtgttaatcatgaggtataaaaaattaactctagggtgaatctctacctcttgataactcccaaggaccattgaagaaatcattatgcgaacgttaaggttagatcagaaaatgatcctaactgttgtgaaactagagagccctactgctttatgaacaactttttgaatccttgcataatgataaagctacctttgttcatacatgtgatcttcatagcgttaagcaattatcatggatgatgaagcaaaaatatgtactacatgaaactacattttggactcgcaaacattgtattatagcattattagttaaaaagcaccggtgctcactgctgattttgattttgagacatgttgttgccagtactcgcacaaagaagctggttaattatgcaaggcaagcagtactccatgtccatggcatgttaagtacgatttggcactagataattgagaaaatctaaggaaagataccagcataggcactagctcttgctgataatctcttgtcaccaagttaatcagctaagcaccaacaaaaaccaaaagaaaatgtctcatctataattactgcagtatgaactctctaaacatggaattcttaagatacagtgtgtgaactgagaagcacagatatctccaagcaacaaagcaacatgttcaaatccaagctcatgttctggcactatagtagaatggaaagtacttgcaaattactgaggtcaaagagcccattttgggtgcaactttgaattgaccacctccaactataataactctatgtgaataatgtgactagttttttttccgtcctcatctccaccggaacagctaaaatccgttttaaaggtacagaaaacatagaacgtgatacctaaaaaatactgtagatgacgagcggcatcaccatgactacccctgcaacgaaatgcagccatctaagaaggggaagagggaggatttaccgtcggtgacgcctgcgccccgggaggtagataagatgccgaagccctagcggctgcagacgcggatcgtacggcagcggaggtcggtgccttcgcccatggagtgcaggagacggggggttagggttcggaggggatttgagttgaaggagaagttcgtctggagccattggaggaaggatccgagctcgccggcgccggagatgacggcggcagccacggtgttcgacgaaatgcgcggctgatgttgagggagcttgagatttttgcaataagacccctgatcgtcgatcaggaccgctaccaatggtaataacggtcgttgcttttcagatcgacgttttaagaactatttttttccaaaaaaactttagggattagggttagtaaaaactgttgaattttgagtttctgacagaagacgaaatgggattggatctataaactagaataatcatcgtaatattctttgtgcaatttataaaattcggttcaaaataaaaatgacgataattatatatggcattaagtgaaaagatgagtctagctctagtttaatatgaaactttgataaatacagacggtccaaagtgaagtttctcatgattttattacttgtagcattagaggaagtttaatagtatagccaactactagctccaaatcatctatagccaatgtaattatacaatagttgcttactatactattaatacctgatcccatctgtcatacacacattacgttttggagtccgtactgcaactggctacagatttatagcccgctgcttctctctctatttatctctttaaaatatgtttatagctggcttatattgtacatgctcttacttgctcccttggtgctgtatatgtggatacttttgtcatgaaactgcatcagctcacactatatgagcttctctttatcaacttctgtattatgattgggtacaaaataatttgcctgtctccatacttgttgaattgcacaaaatatgaatagctaaaacattttcaatgtgaatgatctatcaggctctacattttgtgagccaacaggtgactgaaatgctacaattcattaccatgattgccaataaatgcttgatttttttttaatttgatagcctttactctccttatgatcaattttttacatttcgggttactctaactgttaacccataccttaatttgcctaataaattaagtattgtacatggcttcgttttccttctcaagttgttgttttgctacaatttggattgtaaattaagctgaaattatgagaacctaatctacaaagtttgcaagtacccaggtaattaaacgaacagttcaccaagctgtagttcagataatatgcagttcgaataatatgcattgaaataaagtatcagtttcttgttaaaggtataaaatgttgagaatataggcatataatgatttaatatattccataaataaatcatgacattacagatgtatactagcattaacgcatcattatatctacacatgtaaactaagcagtaaaacatgaacatatcaaatatgcgcaacatgtcgaacacgtaccgaggtggcggaaagaccggttgctcggcaggaactactcgcggttgcgagcgtcgacgaatgcgcgcagcatgcgagcggagaggaaggcgagccgtcgcggacgaacagggagcagtcgcgcgaagcgcttcccaaaaaccttattgccgccttctctcggtgcaggatgtcgaaggcagaggttccggagacctgctctcccgatcgctggtgcacgctggcgagcgggatggagtagtctacgagcgacggcgcaacacagaggaggaggcaaaccctagattgatttcgcgtgtgttgcgtgaaggcggcggcacggtttaaatagagataggtcgcttgatcagggcgcccgcatgatctccactctgcgtaaccgagccggataagtcgcgcgtaacttatccggactccacgggcgcccgcacgatctccactctgcgtaaccgagccggataagtcgcgcgtaacttatccggactccacgggcgcccgcacgatctccactctgcgtaaccgagccagataagtcgcgcgtaacttatccggactccacgccgttttcacgcaccggatttttcgaaatgtttccaacaacaaaacaaatccgaattttcctgcagcaaaacaaaactgcaaaaggagactgcatatgcgcaagggtgaggagccaattttgcgggcggaccattcaacgcgtacgtcgtgcacgcgcgccgcctgccctgccagaccaggccagtgagcgcgcgcgtgtggtccccctcttctctccaccacacatgcttcaagtggctaggagggcatccttccttttaaggaggtcccctctcctagaataagcaaggtgctactaaactccatatgcatgccatctcatgaggtgggcttttgtgattttccaaagaattaatcttcgaatgggccttagcccatctattaattccaacataaaatatacggaagaatctcctctgacataaagttagatggacatgtaaagttaaaaagatttgggtccggggcccaaacatttgttaagaaaaaattgtgagtgttagggattgaatattggaccatcaagtgcactttgaaaccatacaccatttgccactgcactatcaagtgcatctccacatatcattatattacaaagcaaaccatttatcttttgtagttccattttttttgtgaagtatattattgtcgatggaattttaggtgcataactcatgtttccctgtgtgcatgcataggtgatttacagtttttgcttacattcttacgtaactatttacatggaattgcctgttcgggcccatggtagaaaaaacacagtaatgcatgtaatgcatatgctaagcttaggattgcgaaatgcatgagcaacacaagaatttggccttggattggatgaaaacccagaaatgttttaaatgttatatttgtatgacacagaaagattgacattaccctgaatcctggatctttggaacgaaatttcctacaaaaatatataaattcatagcaatttttcaaaggaatgggtaaggtgaatccaacagtccagttcctctgcaattccccggttcttcttttggttcattagaaaaatgttggaatttcacatgagtaataaaatcctccaatacagtacagataggaacttttttttaaaaaaagaaggaaattccaaggtaagaacaggcctgacttgagtactcagttttccacgctagtaaacagtaaactgtaaactatagttttccacccagatagtagctactaagagaaggaaaaccaaaaccaaccaccgcatgcactataatatgatgttgacccactgatggtgatgctcgtttacctgctaatttgtttcttttaagttagtgattgtcattctataacactcatctctattatactatctgctaatctgctatatccaaagtctccgttgtcctcaagtccacctcggcgggcttcatgcaagctgcaagcattggcatctaaatttcacccaaaaaaagaaaaaaaaggaaaaaaagcagagaagttagcctggcaagtgacaagctggaaaaagagcaatcaatttcagttgaattccgttaccgaagtgtttaaacttgctgaaagtttagcttgcatggtcagtagttggtcgctggactggagcaactagaccaaaataagctaagccatggcggagctggtgccgcaggtcgtcggcgccgtgagccgcagcatcgccggccgcctgctcgccgacatcgacctcgccagcagcgtcggcacgaacgtcgaggacgtcaccgacgcgctcacacggctgacgtcgatacgggccgacctcgaggcctccatggggaggctgccgcagcggcggcggccggaggaggtcacggactggctgtcgcgggtggacggcgccgagaagcgggtggccaagctccggcgagagtaccagcgccggtgttgctcctgcggcggcggcggcgccttctcgctcaacctgttcgcgagctacgccattagccggcgcgcgtgccacgagcgccaccgtctcgccgcgctgctcggggagtgcgacagggtgaggagcctcgccgccggggcgccccggccgtcgtccggcgccatggtcgtgccgtccacggtggtcggcatggagggctacctcgaggaggccctggcgtgcctcgacgaccgcgacgccggtgtcgtggccatctgcggcatggccggcgtcggcaagagcacgctgctgcgacgcatcaacaacgtgttcgtccaggaccccgacaggagggcacgagttcgactacgtcatatggctcgacgcgccgggcgactgcgccgcgtgggcaagatgcaggacgccatggctcaccggctcggcctgtgcgcgctcccggacggcggcgcgccggaccaccgtgcgcgtccgatctttgaagtcctcagggactcgagcttcttgctgctgctcgacggcgtaaccaagcctgtcgacttggtggacatcggcgtcccgcacctcgtgcacgacgatcgccggaggcagaaggtcgccatgaccacccgaacaaggggagtctgcggcaggatgagctcgtcgcgaaggattgacatgcaatgcttggacagtgaccattcatggcgtctgttcagagagatcgcccgcgacgagacgatcaacgctgacccgaggataccggacttggcgaaggaggtcgccgggaggtgcggcggcttgccgcttgtgctcaccgccatcggcggcgccatgaggtgcaggaggcagccagaggagtgggtgagcacggtgaccgcgctcaggaacttggagctcgccaagatccccgggatggacgccggcgagaagccaggcgccatgctgcgatcgctgcaagagagctacggcgacctgcgccatcccgtgctccagaagtgcttcctcgccacgtccctgtggcccgagggccacgccattgacaagggcgagctcgtcgagtgctggatcggcctcgggctggtgggcgagtcgctgccgatggacgaggccgtgcgcacggggctcgccgtcctcaacgagctcgaggaggccaacctgctgctgcccggcgacgccacgggcgaggtgaagctgcacggcgtcgtgaggggcgcggcgctgtggatcgcccgtgacctcggcaaggcgccgaacaggtgggtggtgtgcaccggcggcgtctccctccggtcgaggcagaagctagtggagttcttcgagcgcgcgcgcgacgcggagcgggtgtccgccatgcgcagctcggtcgagcggctgcgggcaatgccgccgccgtcgtccccgtgccggagcctctccgtcctcatgctgcagcacaacgcggcgctgcgtgacatccccggcggcttcctgctcggcgtgccggcgctcgcgtacctggacgcctccttcaccggcgtccgcgaggtcgccccggagatcggcacgctcgcgtcgctgcgttacctgaacctgtcgtcgacgccgctggagtccgtgccgccggagctggggaggctgcggcagctcaggcacctgctgctgcggcacacggcgcgcctctcggcgttccccgccggcgtgctgcgtgggctgccgagcctggacgtcctcgacgtgtgcccgagcaggtacaccgagtggtgcggcgcgggaggaggaggaggaggagcgagcctggacgagctgaggtcgagctcggcgttcgtccggtccctcgggatctccgtcgcgacgctcgccggcctacgcgcgctgcgcggcctcgacaacgtgcgcacacggcggctgaccgtgacgcgggtggcggcgaccgcgccgtctgtcgcgctgcgcccctccatgctgggcctgctcgaggccctgcacgagctcaccgtcgccaagtgctccggcctgcaggagctggaggttgtcgccggcgaggaggacaacgcatggtggcgccttccggagctcaggaagctcgagatcgatgagctgcacgagctggcggccgtgcggtggacgcggacggacgtcggggcgttcttgccggcgctccggtgggtgaagatctcacactgcaacaggctaaggaacgtgagctgggcggtgcagctgccatgcctggagcagctggagcttcgccattgctcggagatggttcacgtcgtagacattgacggcgacgacgaggagcagcgacgagagcacccggagacgcgcacgttccgctgcctcaggaggctgctgctggtggagcttccgtcgatgggcagcattggtggtggtgcagcgttgagcttcccttggttggagaccctggagatcgccggctgcgacagcctcggagagctacctgttgagctgcaaaaaaagttgaaggagatttgagattatgttagccaagctgtgaatctgaacattgttcctagcatcttaaagcttaagaaagaaagattcactcaagaagattagtctttcatataacacgcgaacagtgcagaagtttcaaacatcgcaatacatttagctaccccttatagctcctttaattaatagcctaacaaacgtaatgccagaggcatcaaaattctaattctagagccggatagcccgggctagcttctgattgtgtggcaattgttctagcatcttacacatttcacttcagaacctattctcatggaaccagctatgaatgaggggttcagaagatatatttcacaaaggaaattccaccactcttccaactttccaaagcgggccctacacggtgttgcatatgtcaacaggccatggtgaggatcaagatcttgaggtgcatcatgcaggcagcacactgcatttccgatgacatcctgatgcagcacacttctgtacagtcaatgcgataagctgctccagtctgatcattcttcatgcctcagatgcctgttcaacaccagttatatgagctatgcaggcaaaaatggtagaacctcgcaagctgctgtggtgaggcttctatggaaatcatgagcccatcaaaaggtcaccaaattttcttgaatacacacatgactgcaaggtagagtaaaccgtaaggtataatagcaaatgaaaaactgtagaaggctgtaacagaaaactgagaaaatcggctagtcgagagactccaggattgttagtgccaataaaaagttacaacggtgtgtacactaaaaaaacaaaatgttagacctaacatgccagtataggacagttgcaccaaccggcgaatgcatgagcaacagaaaaatataaaaagaaaacaatatggcagcattgtatcataatttattcaggcaacattttggatgagtgcaataagactatcacaacattaaatatatttagtaaaccatgctttaaatattgaataataaaccaatccatagtacctcagtggttcagtaactagaacaagatgtcaattgacaggctaactggtcattcaaagaccacaactgacaatactaggctttgttttctgtttgctcgtccaatgaaaatgaaataacaaacatgtaacaattaacaaacttacatattaagagggcagcaactgctaacacaattaattgaacaggacgcccataccgaattcgatatcgcgacctctgcagtcgtctatgcagggctccaagacaaccataaagtttcttattgtatgtactctcatcacaagtacttacacaactcttgcttctttcaaagcatctatccgatccctacagaaggaaaggccctacagcattagagaactagaatgtattcaaatgaaagcattgttggacaatgaatatttgcactcctcaaggatgccatctgtacctgacccatctgagaactgagagggattgtctcttccacatcttgttgatcaacagcggcccatttcacagatccaccttttttcttcgttctaggcttagattgcaaggcactcgtcagtgcacatgttttcactatcttcagcaaaggttcttggtgcttgtcatcatatggtaggtcagcagaactctcgctctcatttggacataacatagtccatgacccgatatcagcatgggcactagcagcccttctgtgcccacgatgcgtttcttcctttactcttgctgaactcaactcagcggagccagaatccttggagctgtcagcatacatatcctttttaaccattgctgcattgttgcccacatcaatatcaccaacagatggaattgtaactactttgtctcgctgttgaaaagagcttgcagataggaaggtagcaagatcattccgttcatcctcatccaaatcaatccagcttagggcaccccttccctctgcaacattggattctttcaaattgttctcaacctcaagtatgcgacaaccgattgccgcaacaaagtcatcatgccgtgcttttgtgtcctttccagctgagaaaaccttgtcgtttgatctaattgcccgctccaattcatctagctagaaacaaaacacaactattagactcttttgccatcaattttcaatataaaatccctgaaattgaaattaacacatatgggacaaattggcttctcatattcacatagatcagataggaggggaactacattccacttagggctcaaagcaccttaaatgacatgatctacataaatgcaggttttgtataataaaaaaaaaagttctcatttaccacaattcgtaattggtaaaaaccatgattttcaagaagcaaacatcagtggctcataacaacaaacaaatcataccacgttacgtgtcttcctgctctaagcaatgaactatgtttctaggtatcctaataatttagaaaattaggggcaaaaggcattcgtcaaccacagatcaccacgacacagaagagcaattaccgccgatcgtgccatggctagacgctagtatacagcagagaaatggatgtcgagagagcaaccaattcacctgccacttggcggtgccgagcgcagtgtgcagctcgcggcggagctcgccggcagggagccctcctccacccacggcagcagcagccgccgccgccgccgcctccgaatcgcccccactcctgtcctgcacccatatcctgtacaccgactccatgctacagagacacaccgagaatcaccatcagatccatacgaacgcgacgaacccccaaccgaaaaaaaaaacaaaacgggggaggagacggcaacgcaccggtcggcggatccctgcacctcctcggcggcggggaagaaggggtccttctcccagcggtcgaacgacgtcgccattgcgagcgagaagggggagacgagggcaacggaaagtcggaaatggccgagacgagacgagacgagactccctcgcgttttttctcgtggtggccagggcgcgggacgctgcctattattaactggcgaactggcaaagaagaggggatttcactgccggtttctctgaaaacggcaaaacgcttacgctttttcctctgaaaaacggcgaagcagcaaatcccaccaggaattgatctgcgcgttactacacgggaaagctcctcgtttcgttgaattttattggcaacatttaggcaaaggtgcgtggttggagactgctgttgccttgttggcttattgcttagtgctcgccgtgtcgttttatctcgtgctgtagcatttatccgttatttattaagcaagggctgtgttttttttttgcttagcttgtcatacagcaggtcagcaattgctgatccatggatatcttccaagttcgacatttgcatcacgatgagcatatgctgtctctgtattgtgtagatttgtagctgatgacagcttagggctatctatggttttccctggtaaaccaacagattgaagataatttgattgttacaatgcagtgccttctatatcaaacgaattgctggttcggatgagtgaaggcattagatggaagacagattccctgactaggatttgacaggcggacgacaacaaggaacacccaagtttgcatgttattatcagataccggacgaaacaaaaagacaaagttgaactgtaatcactaaaaaaaggtgagtcgaatagctgcactgactaattcttgacacgcatatgaaaacagttctgcaatcacgacatcaaagaacatcagcagcttgtctgagaacccaactggtcaactcacatgatcacatcttcagttctgtcgtccatgttccctgaacactggggcgctttgttacgtgtctggttctcagcttcaccactttcctgcccagagaattccttagcctggtagcttgcaatagtatgtcctcgggcgctaaatttcggacacaaacaactcgctcattatgattttctgcacaagaagaatgttgattagaaaactgaatgtcataagcttcgtttttctcaaaaacgaatttgttgtagccatgtaaacacaaccatgaagaaacattaataatggaacaagaaaaacagtatggctgtttggttcaaagaataccctcattcctagagtcttatcagatcctacatgatcctgtttggttattagaacgggaacatgtgaccaataaaaatttgtttggttattgcaatgggattaacctcattctttggattgaaacaatccaaaggtggatgagattatgaaaactcatggaatgcagttatccacaagggcacccattcatccaagatgggtgtactaattgtggtcaaaatgcattcctcaaattacaggcctcttaacaaggttccttcggagaaaaatcacatagtacaaccataatgatgtgtttaaaccaatgacccaatgtccggtcatcaattcacagataagacagcggcctactgatgttttgcatcttgtcaaacaggcgagactttgggtagacaactactcctatagtatggcattttactcagaatggactcaaagatgtaattcagtaccagaaagtgatatccttatcagtaacagcaataaggctcctatagagttcctggtaattttacaatggttggaaaacaagggagaagatcttactgtaaatgcccttcaggttaggatgctgtccacggactaactctgtcaccacctctaagtgggggttcttttccttaaaagctggaagatgcgcctccataaaagccctgcaattccaaaaatcattttcatgaaggagcaaccaaattaaaatatctaattgttcagacatcaacttccaacaacacaagtattggcaaaatgacaacttccaaatgtgtaagctgggaaatcatacaagtaatacttgaattatagcatattgatatacacaaagagaggatataatgtgaaaattactgtccagaaaaaaacaagttctcgaatgtcggccatgatcctaacgtggcaacgagcagcttataattggctctaattgtgaccaaactgcctaatgtctagctctgatttctctcatgtctcggtatgataaatgcacatcaatttaacttgcaacaattgaacattttcccaccagggcaatatgtatgtatagcccttcgttatgctttatccacaaagaattgaacgaaagtgcaaacctatctccgacgcacagcaaagactactcggggtaatcgaagacaaaaagaacagttcccggatctaaatcaattcccggcaacaaaggaaatccggaccagatcatctaggaggcccgtagtatcatcacggatgagagctatacctgatccccctgctgctccctccccaatcgcagtagttcaccacgagcttctgcagctgccaaacgcccctcagcgccatccctgccgccgccgccggggtcgatccaaaccgggagctacacggggactccgcttcgctgcacgcggaaattcggagaccccggatgaggaagacgaggatgcaagcggacgaagccaatcgatcagtccttaccttgctcgccgccggcgcgcgagttgggggaggagacggcgaacggaggaggagacgacggtaggaggggatacgcttcgttgctagggtttagcccagcgggagatgcaaagagtggagctgggcctcggtaggccgggctaagaccaggcccattttatccactagcctagggctttgggctttgggccatgggctgtacagatataatgtatcctaacgattctgtacaattatttagagaaaatccaaaaaaatcattgacaagcacttgttccaaggaattgttaccaacgagtacgagttctatgaaatagtagtagcatcattttagaagtgactttgtccaaaaaaaaatatcatcatcaatagggttccgttagtagttctcccttaggtgctatagattatagaataaatagtgtatttaacgatgcgggatggtaagaaccctaacggtgatatcatttctaagacaaaattgcttatacgatggcatattatgaaacttgcatttgtcaatgaaatttcttagattttggtgtttattatcaatagtatttcttggattttctctgtttttaagtggacgattccgtgctgtcgcttgaagttttcccgaaatgaactggctggtactgtgcataccagtcatgagcgcatggaatgatgcaaataaacattatctctgaatcttttttgaaaagagattatctctgataatctgatttatagactcggcactttatgatgtgtttcaaaatttaaggatgttaggcaccgctcagcagcaagcggacctaaggcgcaacatgctacaacttttgcgttgcctcagtagaatagaataaaacaaaggagcaaatctgcaacagatttccagtgcaatccaacagcagcagatggcgttccgttcatgttacgttctcattctgcagtcttctgctgccctcacttgttcaaagtagggatgcgcctgcaggggagacaaaaagcagcatatgttacagacttgcgatccagggtccaggccaacaaactgtttgcaatacatatgctcgaccaacagcaagttaagcctgtgaatgaatagcttgacaggaaccaaccatagcttcacgagcggtcagcctgtcatggtggtcgaagcgaataagtttatcaagaaaatcaatagcctgcacaaagattggtgcgacgtttagtcctgtactcctgatagagggaaatgggatatggaaaagaaaaatcataggacgagaaggaaatgcatataacctctggagagacaagatgcctattttctggatttataaacttagaccaaggtttcctggtatgcctgtgtgtagagcaacaacaaatgtatcaagtaattttttttttactaatccaaaatgtgatatgaagtgaaagcatcagaacaaatattctacgaggtaatacctcccaatcagagcctcaagctggggatcaagtgcaatcctgtatttattcaggtaagcattaagctggtctgtacctagaacctgctcaggtatagttcatcaatatgctaatgcctgcaatattttcaggcagaaagcagagcagacatatacagatacaagtgcaaatgctcagcataaacacatgcgcatgcgtctatgtgaactgtagcaaaccttggctattttgacaagctggtcatggttatcgtggccatagaagaatggttccttgcgaaatatctgcatcaaaaacagtaaataaagcataacagttgctatctttctatacgcaagtaatttacagaagtaaggccatggcaattttgataggttattttataatcataggagggcaaacacaccattccagcaaacatacagccaaggctccacatgtctaaagagtagtcataactttggaagtcaaccagcaattcaggccctttgaagtatctggataaagaaaataagtttgcagataaaactatccacattttcaaatataagaaaacttatatagtcttctaaaaccaataaatttgctataacactggtaacagaggatggattctgcttatccataaaattagcaaattcaaaataattattttgctaacaaatattatgcagaataaaggtaacaagcgatggcataaggctatgtcacttcagatattttttattgaaataacaaacgataatccataaatatgaatatgaaactaataggaagctaaactagtcccaagcactctataaataatgttctataatggaaatttagatatcttcttggggttaataggatggggtaaacatttaaataaacaggacaccatcaattgacggagctacagaatcatgaaggcatattttatgaacttgccttgaggcaacccgaacattgtactctttctctggaaaataaaactcagcaagtccccaatcaattaagcgaagcttgcggagttcatggtcaatcataacattgtgaggcttgacatcgcggtgcataattccttgagaatgacagtaatccaatgcctggaaggtaagcaggacggaatttagaaaaaagataacaggagattagaaataagtcctggctactaaatcgacgaacaccgaacaagcccaactgaataacggaagccatagaagggagattattgaaactagtaactaaataagaatataatagaatgttctgtaattaccacatatcctttttgttatcagtacattcacataaacaattaggtagactttctatgttaccgtctgacatgaaagaaacaaactttataagtggaccatatatgcaagactaatcaagcagaacataaagttgcaacatttgtttcagcctctaattcaaactactgtaggccatagcattaatactaagtatgctagagagtcaagttaatcaatttatagattaatgcatacagttctataagacattcaacattgcaataaacaacaattgcatcatagtcactatctaccaggcatagcctttccataatgccatcgtgaaatatgttaagctaatgccacttggaacaaccacaacccacaactccacaagcacaattcaagagcttgttattaagtccatacatagccaatggtcaccatctgaaggggtatgtacatacagatatttcaaactatcattgttagactaaagcacaaaaactgatttgtaagcgtgaacttattgtagcacaatggatttgggcaaagtttagcttaatatggtgtgataggaacaatcagacccaagtattgacaactatattcatcacaagagctgaaattttcaacacttctactaatgactaaattaaaacagaagcgctaccttaagaagttcataaatgtagaatcgaatatcatagtctgtcaatgttggatacagaactttgaaatctgtgctgtttacatattcaaatatcaaacttggagtttttgattgttgatctctgacaatattgtgaagtttgacaatatttggaccaccacagaggttctgaagaatttttatttccctctttatctgcaaaagaattaaactgctcatatataatagcacagagaattctaataagcacatgagcaaacagagaacagttcggaagaaaagatatgaggttaaatatccaacaaatgagcaaaagtgagatcgctcattgtagtggaaaggagcacaaaaactaaataataaaaactgtagttaataataatctaacttcttaagtaccaccatccatacaatctagtaactggattcaatgaagtaactgaattcaaaagtaccaacagccataaaatctgaaaatggcacaaatggacttgaacagaattaggatgttaaaatttagctgatttaaccaaggaacaagtcagcgtttagagaagtaggcaatgcaggtttgatccatcaaactgttccaagtattgagtgtgtcgcgaggaataatttaagcagaacatccatatatgttaattttcaaagaaaacaaggataccttctttttcttaacaggcttgagaattttaatgatgcagcgctcatcatttgtcacattaattccttcgaagacttcactgtatttccctctgcctacctttcgcacaacctcgtaatcatcctgctcactgaatggagaagaacaatccattggtaacagagcataactaaaagaaaataaatagtttgatttttttttacttcacattcccccaagttgtcaattaaaacagtcaaatagatattagcaaggtagaagaacattttttaatcatgataacaatatatggtcatgtaaatgctgtctattatccagttaggcatattggttggtgcaaatctagtttatttcaccaaaacctcctctggccatacattgagataaaatggtttccctcaatgaatatatttgtgagtgattttagtagtgtagaatgtagttccctcaatgcacacacagctcacatgataaatctagtcagatgacccaccaaaaaaaaaggccatcaatagtattgaagaacagtgcccatttgttcaactaatatatatatacctccccaactacaattaggaaaactttagcaactaatccttcctgtcaaacttcaaactatcaccgagatgaaaggaattgtatgatcatagcttggtaacaaaggtttcgaaatatacagtatcaaaaacagaaggtccaactctaaattggcaacacgatgatgaccagacccaatagccacatcgagcgataccactgccgaacaacacaccgatcgacaacagctagttcgcagctcgcacaatctccgcagttcaatcgtacgatctatccccaaccctccagcaacacacacacagtcacagatgcaatcatctcgcatcgctacgttattctaggcgacgacgacacgagtgggggggggggggggggggacaatcacacggtagcacggcgaggcgtaggtgggaaggaatcagttcttacccccattcgacggcgagggccttgtagtcccagtactccctggggcggtgcacgttcacgtcggcgtagacgcgggccgtcgacatggccgccgccgccgctaccgacgccaccgagcgggcgcgggggagggaccccgcgtgcgcccccgccgccgcgagcgccgcgacggcgcctgtggcgagggagccgacggtggcgaggagggaggggagtatggcgctcgtggtagcggtggcggtggcggtggccggcgcgcgcggcgaggcccgatcggattttttttttccttcttctgggtggggtcgggtgctctggtcgggtcggaacgcgacggggtcgctatatcatatcaggtcacggcgaggggagcgggttgttttggcggtttcccgctgaaaaagggggtgtgcgccatcgcgcagcacgccggtttctgaacaagagatgcgtgcacagctcctgcagcaacgagttgtctgtttttttttcccgaacacgtaaaaggattgtaggattgtaggttatttctgattgcagtaattggaaccaggttttagctaaccggttgaaaactacgaaacttcaaggtttcgagattggatgaaagtagattccgggtagactttgaatggtgttgaagaatttaaatttaaattttaacgaaagatgtcgtatagctaagatcggaatccagcacttatgatgcttctctctcgtggcccgatattctagaaatgggataactctcgctttgatcaagtgcaacgtttgcgacgtggctaccaaccagaacaagtccagaacgccgtgcaatcgctagaccacaaatgatgtcgtaccaaccgtaacgtgcggttgatgatccctacaatgcaaacgagagaacactgcaagaacaaaataaaatgcaatctaaatattgcgaataggggataactctcgctttaatcgagtgcaacgtttgcgacgtggctaccaaccagaacaagtccagaacgctgtgaaatcgctacaccataaatgatgtcgtaacaaccgtaacatgcggttgatgatccctacaatgcaaacgagaaaacactgcaagaacaaaataagatgcaatctaaatattgcgaataggggattaaacacaaaggaatagttacgattgaagtggtagatctaatcgacccggcaaatcaacacaccaattattaggggctctaaatttatagtcgccgactaatcaagcgaggacaagagacaagtgaatgacacttggcaaaattcaattaaacaaaactcaattgttctagagggtgtacatagacatttatagaagaaaatagatcaaaggtttagtgctaattcgtggaggtgggcctagtgtattacaaggtccaagtaccaagttcggtttcagcaacaacattgtcttgttttgacaatttccgtttactcggaatgaatttgtatatgaaaccggatgcgtttgaaaggtgacgagataagctttccatcaagtctaacatcacccgaatcggagttggcatgaagacactaggtccatttgaagtcaatgctgtctccggaggtcgaactggattccaaaactcattggagatgtatattgtagatcctccattcatccgatgtattcttgggcaatgttttatatttctcatgtttggttgtatacatatacttgatctcaacctattggcaaaatcctttaggtatgtttggataatgggaaatgaatggtgggattgggattgagaaattgatgaagggttttgattaaatagaagaaggagaatgaatggttaggatttaaagatgtatttttgtgggtaggaaattactttattatcccattagccaaacactgccttatactttagaccggaggtagtattcaaaagttgtttatggtaattggctgcaactcttttatatactctttataaaacaaaaacatctttgaatttgccgttaccaaaatcttcatcattttttttgaacggaaaaatcttcatcattgaatcctcaatgtactgctactgaacaatgtaacgcattttcattttgccaacaaaatggaaagataatgagtctgtgtaccgtcacgtcatcactttgttaattgtgggcctccatcagtttttgggcttaaggccttaacacctggaccactcgacgcaacctagctggaggcccagtacagtgccagcgccgaaaaggaaaaagtatacttcgattccctcgactatcacccgagtacgattcatatccactaactataaaaccagctatatcgactccttcaactattaaaaccggtacaaacaatatctctcaatgattttggagattgttttggctgacgtggcgcctacgtggtagtcttgaccaagtctttgtcgtacgtgacgcttacgtggcattagaataaaataaaaataaaaataaaacaaatatatgggacccatatgtcattcgcaaggaaaaaaaggcattgtgggacccacatgtcatcctccctctccttctcttcttcctccccctctctctctccctccggcctctctcttctcgggacgacgacggtagggagcagcggcggtggtggtgtcagtggggacggtggcggcggcggcggtggggagcggcaacggtggcagtggggagcggccgcggggcggtcgggagtagcagcgatggtggtggggacgaggcagtcgggagcggcggcggcggtcgggagcggccgaagcaccagcagaccagctcct

SEQ ID NO: 6059 - DNA, 10938 bp, Oryza sativa
gccgccgtcgccgctccccactgcgtcttcccccaccgccacagccgccgccgccgctccccaccgctgccgctgcctctccccaccgccgtcgtcccgagaagagagaggccggagggagagagaggaggagggatgatgacatgtgggtcccacaatttttttttcgaatgacatatgggtcccacatattttttttatttttattctaatgccacgtgagcgtcacgtaggacaaagacttggttaagaccgccacgtagacgccacgtcagccaaaaccaccgagaaatattgtttgcatggttttaatagttggaggagtcgatatactcggttttatggttggaggatatgaatcatacttgggcgatagttgggagagtcgaagtatactttttcccgtcgaaaaacaccttacgtgagtttggatttcctttctcggctgggccaaattctcttgggcctgaggattggaccagactctagagggcctaccagaaatggccgtacactaatagtctaattccaacactggtcaaaactctctaatggtcaaaaccgatccagcaactgtcctctccctctcaaagaaacagcaattatagcatatatataatcgcgtaagagcaaggataatagtagagctcactatctactattagcttattttatagccaacacatataataaattagttataaagttggctacaattttcttctcctatctctatctctcacttatacatttattatttttgttttggagcttgtgttaagctagcttttgcatgagagtcaatacctttgactttttttttgttacatctctcctccacataagtttatagtaatcttatagctcactattataattgctgtaataaaggtttgtttccaaaaatcgttcataccgcggcatccctctttttgctcgttttcacaacatgcgcacactgcaaactgcgaaagcaaaggaaaacgcgtgatcgtaagcaaatcgttctcccgttccgtgctactcgtactagagtctagtctagatacgttggtcaaccaggtccagatatgcccttcccgatatcaaccccagctgatcccgtacaagtcgcacgttcactcggatctgcttccgccggttcagagttcgccctctccccttcgcgctcccgcggaagaaaacggcggtatcatcttttcgaaaatggatcggtcataaacagatcatagttacttcctccgtttcatattataagactttttagtattgtacatattcatatatatattaatgaatctagatatatatgtgtgcctaggttcgttaacattcatatgaatgtggacaatgatagaaagtcttataagctgaaacggagatagtacatattataagtcattttaattttttagagcaattctacggttgaggagataccataagatataaatatttagtataaaatttggtacctcatagtataaaagaaaaagtggtacctcgtgtagctccttaaggatcgtaaaattatttttaaggttgtaataagtttacagaaatatatagcaatatttttaatacaaaacaaagaaactatcaacatatattcaatatgttagatttaatggaatcaatttagtgttataaatattactatatttttctataaatttggttaaactttttgaagtttaactctaaaaaattcaaaacgatttataatgtaaacaaatgaaataatgtatttttttcaatatcaatagcaatatagttgcgaagtgaacgtaactcaactggttagtttcctcgtggtggaaccaagatatactggcggctcagtttttcgaaggtgcttataggggtcccaggtaggatatgtgtatgtgtttatatgggtgagtctgtgtttgtattgtatttctcaataaaaaattagcaatatactccctctgtttcaaaatatttgacactgttgactttttaatatatgtttgactgttcgtcttatattaaaaaaaattatgaaatatgtaaaactatatgtgtacatgaaagtatatttaacaatgaattaaatgatatgaaaagaataaataattgcttaaattttttaaataagatgaatggtcaaacacgtattaaaaaattaacggtgtgcaatattttaaaacggagggagtagtaatgttgaaaggacttcaatttatgcaggtccagaattatataaacggcagaaaaatgatttcaacctatattccatttccacctatacggcgctcctagctttgggtagctaacaaacgcgtctcccctaccgttagtcccgcgtctcctcccccgcgcccccgcgtcgtgccgtgctcccgcggctaacctttaggctttagcctagcccgaccgaccggtaaacacgcgccccaccacatcgcccctctccccgcctatacacacgccaccaccaccacgcgcgacggacacgctccccctcactttcactccacacacacacttcacggttcgcgcgacgaacaaacgggcagaaaaaccctgccacgacgacccacgactgagccgagcgtacgcacgcacccacgcacgccatgggggcgctgcggcggtggctgccgtgctgctgctgctgctgtcgcggcggcggaggaggtggtggtggtgggagcgtgggggatgggctggtgtgggacgtggccctgaaggcgcacgcgtcgggggactactccgtggccgtggcgcaggcgaacgaggcgctggaggaccaggcgcaggtgttcgtctccccggcggcgacgctcgtcggcgtgtacgacggccacggcggccccgaggcggcgcggttcgtcaacaagcgcctcttctccctcatccaaggtctcgatcactgattcacttcctcatccatcctgatcaaacgcgcagtacgagtaaattagcaataaagagagatgtatcgatcgatttcgtcgtgcagagttcgcggcgcagagcggcggcatctcggcggaggtgctcgagaaggcgttcggcgagacggaggaggagttcgtggcgtcggtgcagaggtcgtggccgtcgcagccgaggatcctgtccgtcggctcgtgctgcctcgtcggcgccatcgaggacggcacgctctacgtcgccaacctcggcgactcccgcgccgtgctcggccgccgctctgccgccggcgccgcccacggccgcaagggcaagaacagggtggttcccgagcgcctctccagggaccacaacgtcgccgacgaggacgtccgccgcgagctcaaagagctacaccccgacgactcccacatcgtcctcaacacccatggcgtctggcgcatcaaaggaatcatccaggtaatataatcaaccaaacatcttttttttttaacgattccggtgcgaaattctattgatatagcagaagaaaaattacgagattataacctagaaagatcataaccactaatcaaccaaacatcgaatcatcgattctttctttctttctcgcaagatcaagctgctgatcgatgcatatgcaggtgtcgaggtcgatcggcgacgtgtacctgaagaagccggagatatgcaagagcaacccgatgctgcagcagacgatctgcccgttcccgctgcggcgaccggtgatgagcgcggtgccgacgatcaagacgaggaagctgaggccaggggaccagttcgtgatcttcgcgtcggacgggctgtgggagcagctcaccgacgaggcggcggtggcgatcgtggccgggagcccgagacggggcgtggcgatgaggctggtcagggcggcgcagctggaggcggcgaggaagaaggacgtgaagtacgagaggatcaggacgatcgagaaggggcagaggaggcacttccacgacgacatcaccgtcgtcgtgctcttcctcgacaagtgccgcggcaaggccggccgcggcgacgagatcgacggcaccgacggccccgtcgacgtcttctccctcagccccgacgaccgggaggacccgaccaggccagtgctccgttgatcgacggcggccggagcttcaattccagccgccgccggtggtgtgtgtacgtacatacgactgttcttggttctttaatttgctccccaaatcgaggtttgcatttggcgcgaaattggccgtttcagccagaaaggtttggttttttaagttgccagttgccacgcaggtctggtgttcatcaccctcaaatcgttttctggttcaaagcttcaaaattcaatttgttttggttggttttctagaaataatgctgcaaccacttcatcggagagaactacgtgtaatttagttgtgaagagtagacagtagtagtactgtagtagtgtcgtgtcttgtaaattctaaacataacaagttgctcaagcttctccattggagagaggcatccaaatttgttactccatctgttctgttagtgttcttgaatgcagccaagccaaccaaagcagacattgggtctcacaattcacaaaattcagatcgagaagctcaacgaagtccactgtgcatgcatgcaacaccgtcatcactcatcagcggcaaaacatgagtcatatagtcttgctgaaattttgcatgaaattttgaggataagagggcagccacaatcttggatcggttcaaccaacacttgtgagctgtgacttcaccggtcaacatgggtgctgtcctctcttccaaactgcatttatttgtagagatgaaaaagatatctgcgaagaaatggtagatgaaaaagatatttgtcaagcaagtgctttgaagatttcttggtagtgggttggatagtttccaagttagctgagccgtgaaagcgaaagcaaatttccagttctgcaattgcggttgctgatccattcaacgaagaaccatagtctaccgggttcaaacgcaagtcaaaagtacactagtgctataacgcgtaggactgtccaaatggcattttttttctttttaatctgaataggaatggaatccttattatacaaaaaacagtgaacacgaatgattcgggaattcctactgcttttcaatcctgaagtttctgaagaatctgatacagaggtgatggcgtagtttttagctgtagcttgaccaaatgaccatgtgttttgagtcctgagtccaggtctctcattctggtttttggcttttgacttctgaatcacttcattgcaggtcatcgcaggtggttagaaactttactactagcataattgcatttgcttatgatcaacttgactttgactccagctacaaggcgacctgacaaaaccaatggggcgtgtcagtttgttgtttccatgtgacttgttcttgcaagtcattttatttccctctcgacaacagttaccgggagacaatcatgcattaaattgctagttgttggtaccggtttacgccaaaatcacaccatcacgagtttagcctgaaaatatcagaataactagccggtacccccgcgcttcgctgcggtgagctaggaagattgctcatgttccagtaataagactataattaaaatcttgatataatcaggtcttgttgaatggcatgtattaaagaatgataaaaatatatagtgaacggttaatatttacacggataaatgagctagtgtgtcggttggacatcacatagcactattgcttatattggcagcactgcaataaacatactacatgaggtagatatggataaaacaatggttattgtttggatggttgtgtagcatttccttccccaagttacatgatgtaaacaactacctgcttgaagagctttcttctttcaggacaaatggaaggcataaatttttccaagctttatccctatctagagcgaactgctttcatcctgtcgcaaagctgaacgtctattaattgaaattgtagaagtcattgcggttgcctttcttcgaagagtttcaacctgaatatatgttgatcgctttgctacatgggtgctatatgcactaatgcatcataaaaataaactgataaccaccaatttaatactttgattccccatgaatcaatggaaacaaatgctatctgtccatgtgaccagcactaagaaaaaacacaaactctatagttacctgctggtgccatttaatttccgtggtacattgggaaataatttgttcaataagtttgacatcatttgatttaacataaacactaaaagcctagcacaagaacactatcatccatcatcagcactaagataaaatcaaaacatttactgatgctgaagacctctaaaatcatgcacttaatttggaactgaaatgctgcttaaacaggtattttacaattgtttttatgagcaggtataattaaagaaataaaaaatggcataccatgcattactctctattaatgctctgatcagggtgcacaaagccacaaaaagctggggtttccaccaactatatttggcaagtgcaataccaggatatgaagataataacgtttagcctgaaaaagatattagaacatatcccttgtttaagaacatatactaattatcaatctgataagaaagcaatgagaagaacatttagttttacctgtcctctatttacgaattactcaattattctatgcttgtctttggtaatgattattgatggattataaaccaacctgccaaaagtggaaataggaaaggaaacaaaccatcttgagtgagtatacaaaaagcaagagcagcagaatgaggctatagaaactgttaagatataaaggctacagttttgctatccaagattctaattaggacatgcttccaaaaggtttccctaaaaaaagtgctcccaaaagcttcaccgtttaacttgaaattggtcagaacacctgcgctcaaagtttctacttttaatgcagatgaagcccatagcagggaagagatccccattttaaaaaaggatatgaaagagaaagaggagcagacaacaaattgtaactgaaagaagctcatcacagcaactgaattacctccaaagacctccaataagtaaggagtaggagttcggcattcaaattagcataccaagatggcatctttaatacaaattggcatggaaatccgctcgtctaactgcaagaacaatggatgaacatataggaaacacgccaagctgagatcctgccagattacagtaccacattgtttaaccaagctaccattgcaaatcccttctcagcagcaaacaaatagacagagagaactgcagcaaaagaagtacatgcagaacatcattttaatagtataagctgtgaatttgctgatttgcaataactacaaagaatcaacctgctcctggcaatgcacctcaacagctacccaccgtcgaacagagcaccacttttgctccctctgagcttcagtgaaaaaacaaatttgtagatcataaaattgtgtggtattggcctattgagggcttcctatcgttcccaacatcattgagtggctccatcttacgtactctcaccaacaaaacagaaccaccaccaccagtaatgcatgaaagcatgagacagtgggccatggccagggagacaacgtgggcacatcaagatcagctggtcatggttagcattgaacaaaattagagaacataatctcccaaccatggtaggacacagggaatgcggtggaaacaaatgttgtataacaacacaatgaacgaataattactttactgaaggaaaagtaaaagcatacctagcctggtggagaaggaaatcaaagcggctagccagaccatagtgtggcagcggtttgagaaatgtcacactgttaacaaccaaatttggtaaattctatcactatgggcatcgaaggtgaagatcagatcgaagtggaatccaaaatgaagatcgttgcggaaacagagtaagaatcggctgcagtccaaatcggctaaggtcaggtcggcagagttcgagtcggacggggctagccgatacagccgattccgataatatgactcggcgtatgtcgtcgggttcaagttgatgtgcttcaaagatgattgccacgcatggatagagtcttgggaaggcaatcgtatctattaattaggatattctgtataatttccttagagatatgtttgggcaaaagtctgccgtaaagacttatggtatcttagagtttgttagagataatagtcgtgtccgttatggacgtatcttgtaattctcgggtataagtagacccgagccctatgtaaaaaaaaaggacacacatccaatacaatctcggcgcatcgccaccctttttgctttacttttcgacgagttcgtgctctcgggttgagctgcatcggtttcgatcttcaacaagaggtaaaacttgtcatgacgatttatattctcaggattagtgcttccatctttatgatactctaatcttgtctatataattcgtcgagttatcatatatctcacataatcttcgataatatctctatctaacctataaccggctaacatctgttaatggaaggcaaccgattaggttagacaatgatgttaacttagattatgtgatatatctaccactctatgaaacttccagcggcttgattgtctagacattgttcttcttttcatacttaatgttgcatcagttgagtttgatctattaagtcgtgcttagatttgcaatctctagcctgctttctggttgccgattagggtagtatcggagtttcagccgatcttatctgatttaactacttttattccatatgcttaatctatatgttaaatctgccctttatgttaggatcttgtcgcatctaggtatattaggcttctgtttggtatattctacttgctttaacatcttaatatagagtggtatcggagtattagccgatacatgctagatccatttgatcggctatgctataaatgtatataatcccactattaatatatatttcgatctaagtgatttatactgtctcggcaaggcgaccgatctatcccaatcacttgatttaagtatatatcgatataaggattatatatcattaatatctacagccgatcgagtagatttagttctgatttgcttattgatatttgctgatcgatgtacgcatgacatcggcttgaaataaatgatatgtcatcggcacctagccgatcggctatcatttataggattaattgcggtttctttgttctatttcttgttgattgcaggatcaaatcaattggcacgctcatacacccgaaggcgagttttgaacctgcactggagttaagcaaatctcccaggcctcgtgttttctgtcaacacacacatctcatcctgccatttcgtcaagcataacaaaattatacttaaatttaacatccctgaaatacataaaagcttaggtccttagagcaatgcaaggaacagggaatcgaaccaaaagctaagcacaaaaggcacagaagaggaaagagggaaaataagaggtgcagacgtcgtcgtacctgcggaagaggaggcaacgattggggatccactgagccgataggaggcgaggtcaccgctggcgctgaagatggaagggttcgcgagagggcgagagagggtaccgccgggaagcaacccatcgacggggaggccactcgccgtcggctcgaaaaagaggagcgggaagaaagaaaggaagaccacaatgacggcggaggcggcgacgacgacagatgcgcgtgcccgtgtacgggacgaaggaatcactccgcaagaaggcggcagcggcggcgacggccgggcctcactccgcaagatttggggattttaggaagggaggagccgtggatgtcgagatggtgccagccacgtcaattggttcgcctagcgtgtgtttggttctgggactaggtgggatgggatgaaaccatccccgatttgaggattgggatgattccattcggatgtttggtttgtagaataggacgatcccagttttttgtttggttcaaggaacgagggagggatgggatgagcgccatttgcaaccaccaacaacgccgtttgcaacaaccatggccgacgccgcctctgcccgcacctccggacgtggtcgccaccggcctccttgatggcgtcgatgagcggctgcggggggctcggcgacggcggcggtagacggctcgggcgacagcggcggcggcgggctcgggcgacgtcggcggcggtgggctcggcgacgacgacggacgggatgacccaaccgagcactggcggcgatggtgtcggccttcgcgcagagcagccgcggctcggcgatgacgacggcggcgaggtccgcgcgggagagggagagggagaggccggtggagaggagggcgagcacgaccaccatcgcggtcgggcgggcggagaagcgcgacgacgcacggtcggccttcgcgtagagcagccgcggctcagcgacgatgacggcggcgaggtccgcgcgggagagggagagggagaggccggtggagaggagggcgagcacggccaccatcgtggtcgggcgggcggagaagctcgaccacacacggtcggccctccgccgagttccccgccttcggatccgtcgccacaacctttcccatcggcggatccggcaccgccgcccttcacaccaccggatccgtcgccgccggcctccccaccaatggatccgccaccaccgagtcccccgccgccgctgtcgtcgaggccgccgccgccgccgtcgtcgagcccaccgccgccaccgtcgcccgagccatctaccggcggcgtcgccgagccccccaccgccgccgttgccgagcccaccgccgccgtcgccgagcccgccgccgtttcccgaggaaga

SEQ ID NO: 6060 - DNA, 5649 bp, Oryza sativa
caagccccccaccgccgccgttgccgagcccaccgccgccgtcgccgagcccgccgccgtctcccgaggaagagcgcgcgagcaaagcggcggtttcacgccgtcgctcgtcccaggtgggacgagttcgtccgccagttttggccggaccgattggtcccggatctgagaggaatattcctctgtagggaccaacccatcccactcacccctgaaccaaacacccctaaaaatgggttcatcccatcccatcccatcccatcccagcaaccaaacactaccctagggaagcgaggatggaggggatcggggaagccatgtgggacggagcgatgcgcgtgcgaggtgtggatggttggatcaaaccaacgcgcggacatcggacggtgcatgcatggcaagggactgtagtactgtagcacattttcctagactgtggttcatcgaatcactgctggtagtggggtcaaaaaaactaaggatttaatatgatagggggaaacatttttaaactcttaaatgagatatcctcttgttcgctcaaataccatctaaatagttatatcaataattttgacaacattcttacttcaaactactctaaacttaactcacacatcaagaaataaaaaagacaaacccaatgtacgagaaacacccaaggatcttctggctagctccaaagttgatggactagacgacttagattcgaagcctcaccatttctaattatttggtattagattattccctaatattcacgtctatttttttcaaagtcaatgtataaatagatattgcattactatttgtatctgattttttttcttctcaaagtgtagatcgagagggattagaatccattcctaataatatgtataaatcgtgacatccattttaagagatattttgcagacagagaactccaaactctggaaaactagaacttccgaacatcagaacctcaaattacaacttcaaactgcaagaacttttgagtgagttttttaaatctaacagagagctaaatatttttgaaaaatcggacattccgatgctcttagaacttccgatctaagttggttagtttatggtagatttgaaagtgaattttgagtgaattgtaaataccggttaatatttagcagagtgaattgcagtttgagccaccttttctactctataattcaccaactcactgttacacctacattacccattcatcaaatccaacgctctgtatttatcgaatccaacggctccgatcgccccacgcacactcacgcagacgccggcgatgccccagtggccccaccctgcgcagatcgttgccgcgccgccctccgccgtcatcgcctccctcacgcaccgcaccttcgtcgtcgtcgcatcgctcccgcgccgcccctctgtgattcctcccctccgcgcggccctctcccgctctccgcgtcacccctctccgctcgagcccatcccgccgccagttcatcgtcgcacgccgcatcactcggatcaatgtcgccgtcgcacgccttcatctgcacatcgcccagatcggcactcgccctcaccgcatacgctcgtcctcggacagatgggcaccaccgccgtcgccgtcgcgctcattcctccccgtccaacccgcgggcctcgccacagccaaccctgcccacgaggtaaaacagcaatgcttacccttggtactttctttgatcagttttgcattccatcaatattcctgtatcatatagtctttattgtacctagaatcagcaatgcttacccttgccactttctttgtccaatgtaatctcctttggcaagtttttgatgtaaggtattgtcctgcattttgtttcattttttcagttctctgacaggctatgttgggtttggttttgaaactctatacagtcactcgctttaactaaatagagaaattactgatgcctaaatcaattgagagtttctggagttgttaaggagtacatccaggagaagaaattggagatcagtgattcttaattatgcaattcaattccattgattaatgaaaagactaaagtgaaacactccatctaagcacaggttgatgggtgcaaatgcacttaactgttagtaattgtaggacattatctcattccttttttgagacattgcacaaatctgaaaaactgtaactatgggcctgtttggtacagctcaaactcctaaatataactccaggagctgagtctggagtggagttgtggagctgcctaaacctagctccacaactctagtacattttgtgagagagctccacctaactccactcctagttctggtggagctgaaactgtttggctgagctccagctccaggaggggtggagctggagctggagctgtgccaaacaggccctatatcttggtgttaaacttgttaatatcatctgggactttgaaatgtgtgggatatgctagagcatcatactttgtttctaagggaacaataatgagtgaactgaaacaatgagtgaaggatgcctcaagcattcaaagtcccagacggtgcaaagaaagtgctggtatactctctaatcttctcttgtaaatttcactcttgctttctctgtgcactgagcatccctcttgaatttcatttttttctgaggttcccaataattttgttgatttgcctgtttcattatcagattgaaaactaacaaaccgatactagattgtgatgattgttggacggtagactgttatgagcactacaaactgatatgattgttgcaactgccgttgagaggggctgattcaagagataatttgagctctgatgaaacagcttggaagctggaatatgcacatgaatattggatcatgttaaccaggaggtatatagtgacgttataattttcatcattgtaggtgacatatctatgtttagctataagatttcttagttaaaggtcatcaaaataaatggtgcagatcctgccactaaacaatggttagaggttgctggtgaacttgcatgccattcttcagtgatgcggttgaagttacttggtgagttaaattctgaaccattcttatggttgacaaccatgcacatttaagaattcactaggtgcatgtgataatcctttgtgtcatctaggggggggggggggtactatttccctgtattaaatatgtaacataaggacttaatattcatctctttgtttgccttgtgccttaatccgattcatcataattgtattttgttttgataggggaaagtatttcttccactgttttgcacatatataccacatattgcaggtccttctgttttggaatcagggaagtaggagggtggagcaaatcttttttgaagcaatgttgtatcaacacctcgttattttgtttgctttatgctcatatgagatttcttaagccaatcggcatgctccttccgaacatactttgaatatgacattgttcaactgtttcacaaattgatggaaatgaactaaattgttttctaattcttaaattttacagtaagctgttacctattgacaatattcccctatgcttttaggaatatgagcaattggttagcggttaagaactacttattcatagtcagaagataatgtcctacataagatgatcagaagatgtgccttttttgaagtgtaagagaatgttctgctctgcattccctttcactctttatagcttctgttttgttaaatactaacattcaattttactttaaatttgagtccctggtttagctacaaccatatattgtaagaccatactgccaaggttagcaattgcttgtatttttcttctgcaaataacttgaaatatcagcaagtaattgacccattacatacccaaacctgatgatagttccagatgaagtagtaatagctataccaaataaattattattgtttattctatttatgtcatggcttctgtattctgtccatgtacttttgtattttgtaaaacatgcagccaatcactcatgataatttgatgtaggcaataatttcatcttgccattcatataattctgcccgacgagagtgtctgtagctccccccctccctttctttttgcttcttttgcagaggctattgtggtagtaattatgttaattgcttgattgagtaaagatgacacttttcatggtttcttattcagcacagttagtcgtacactcttattggcttaagagggaatggcaatggacagaaatttcaggaaggagtccagctagagtataggaaagatgtggaggaagcaacaaaacaaattgtctagctgaaagaatcaacattaagtatgcctgtgtagattacaagcctgtggtccttattgaccattgcatacagttgaattaacggactgcattatatgctgcgtctggtaactatattgatgacagacaattattgcgattatatcgacatatataattctgtctttatctgtcattccttttttacgtgaattttaaatctaccttattctatatttgattgccaaaacgtacattatattttgcattggttgtttaatttgcattgcaaaaatattgccataacattagcacatgtatatttgccattgaaagaagatgtccgcatgcatcgagagtatggagagtatgagtaatggataggatttgaagcaaaactgactggtgcttggatctcccaaatctgaaaacttaattatccacttttgcttgtaaatatatatcctatcttatattgattggattgtccagatatctagcccaatctgctaggttgatacctatccacaatattagattatgaaaaatatatgtcacaatgttgttttaaagttgtatttgaatttattataagtaaattattggagtctttggaacgaaggtcaacaaattgggtgtaaggccaacatataaatatccctgataaatctgtgcctgaataaagttgagtgagttatgaataaggtcttcgagttgtttgactccaaactttatacaatttaataaatttatgagtatatgaaattatttttaagccaaatatacacaaatcatttatcgtgctcacaaatacatgcatatctttgtttggatattcggtttttaaaatattttaaatttatattgtaaaaatatatatcttgttttggttgtttgatttgcattaataacgaaatttagccgttgcgttagcacggacatattactagtattgataaagttttacttgaactattatttgcccaacctttacacttttcattagctaattttgtctttattataatttggatcaccccataccacttcttcagcacatcaattatctcgagcacaacaactccggtgcgcccgcgaactccacctatgtgtaggcagcatgctatacctttgcctgaagagagactagacatggttagaggagaaagttaggttggtttaaagtgtaataaacgtgaagttaactagtccaaagtaaaatatatatatatatatatatatatatatatatatatatatatatatatatatatatatatatatatatatatatatatatatatatatatatatatatatatatatatatatatatatatatatatatat

SEQ ID NO: 6061 - DNA, 7249 bp, Oryza sativa
aattgcaatcgatttgccggcttaatttgagatccccaagatcatccttcttctcggcaggtggtgtataagctgtgtgtttgtcacggccacatgggaactcacaatatagtatccatggcggctcttgccattggcctcctaagcagtttgttctgctcgagtaacttgcccacaggatagtttaatcagcttgccatgtactatctgaattcctgctagtacagtagcttgggcctaaagttcatcttttttggggcctctttttcgaatttctttccccttttttttcctccgtagggcagccggcaacatggatgcaggatgcagaattaaaacatttaaactgtactcctcacttgaaggaccacaaattgcttttgctaattgcaatgtatcactcttcactttgtgagtgggaatggcactttcagaaagacagagaaaaagattggtttgcagaaacataaatcagagtttcagacttcagcaggttaattcagaaaataaaaaggattagtcttgactgctggataattttcagtttaacattttagcatcagaagtcgaaaattcgtgtgagctacttactataatgcagggacttcgttgaaagctgaagctagcaatggtagctagcttctaagctagttaattagccaaaactagtttaattagcagagtgaaatctgacgggtaggtttgtttagtgttttgccgggtagaaaggcttcaggttgggttaaattaggctgtttgttgggggattaacacttaacagccgcaactttagaccttagacacgccacccggcgaattatcagcgctaatgacatgccattagcgtttgcagagcgtggttaagtgcatgcatggacacaattatccagcgaaagcaactgatgccaaatctttgtcgacgcacgcctagccctagttcatgccactgataatcaaccttctgtcaattaagttacacaatattgtataagaaccagacaagcagaggaagcaggcagtactgattactgaatcctgaactgatgacagagtgacttgtctgattcagagagattctgctgttaattaggatctctgacactgttgccatctgctgaaacattcccaaaaattttagctacctcgtactgaatgaactggagtatgtgtttctgtaattctgtctttacatgcaggttataagtacagtttcaggttaacttcgagcatcagtaacgggaagagaagagagaagcaaatttgttcaggctgctgaacatatataaaaggacactctagctctgcactttcatgaaaagaagttaagaacatcatatatataatcctttgcctaattgactaattatatatcagcataacacctgtcccactacttgtacaaaaccctactcttctcttctacctcttgcacaagcacaagaacacaagaactcggaaatggagctgaacaccagaagcttgcagcaatctggtagcagcaagagcaagggcaagatcatggcgaagatcgtcgaggaggatgaagagggggaggaggaggaggaagaagaagaagatagccttagctcaggttgtcactgcttcttgtgcgccatcaaggagcctgatgctcgcctccgccgcgccagcctcgccgcgttcttccgggagttgccgtactgtgaggatgacgatgccggcgccggcgccggcgccggcgttgatggcggacggtcatgtggtgaggtggtcggcgcggtgtggagggcggccatggcggcgcccgacgacccggagctcccgtcgctcggcgcgatccggtgcatgtcgctgctcctcgctcgcgcgctcgccgacgtggagtggcgccgccgtggccggaacgtgtacgtgccgtactacgccgcacacgtcattggctcgtacaccatccgctcctccgcgcacgccgagctggccgtcgcggccggcgccgtgcggccgctgcttgccttcctcggcggcgccatgacgtgggtcgagcagcgcgcggcggcgcgtgccctgggccacctcgccagctacgacgccacgttcccggccgtggcacggcacgccgccgaggcggtgccgctcgccgtgcgcgccgcgtccacctgcgtcggcaacgtctacgcgagcttcgtcgcgctggcgccgagcaagcggccgaagtaccagcgcgatctcttgacgcgcgggctcgacggcggcggcggcggcgtggtcgccgacggcgaggaacggaaggcggaggagtgggcgagccagctccagtgctggtcactctacttcctgagctgcctcgcctccagggacgtgtcatctcatgccacgatatgccatgaccccgtcttcttgcgcgagctctgccagatgtggggtggcctcgccaacggcgactcgccggccggcgtcgggctgctccgccttctctgcaggagcacagccggacgcgccgccatcgccgcatgccgcgacgcgctctccggcctctgcgacctcgcgcggtcgtccgacgactggcagtacatggccatcgactgcttgctcctcctcctcgacgaccgtgagacatggcacgcagtcgccgacgccacggcggcgcgcctcgtcgacctggccgagctccggcacctcggcccaaggcgacggctcggcaatgcaataacagctgcactgcttcttgacgacggcgacgacgacggcgacattgtccatggccgtgagctcggcatggaagcaaaggaggcgatcgccagattgagagaagtgcaggtagagaggaaagggagagaagacgccatgtctagggatgagctgctcaagagaaggatcatggcgaaggagaagaagaggcaaggcaacgacatgttctggcacggcgaggtggagaaggcgatcgagctgtacaccgaggcgctggagctgtgcccgctgagcaggcggcgtgagcggctggtgctgcacagcaaccgcgcccagtgccggctcgcgcggcgcgacgccgacgcggcggtgggcgacgcgacgcgcgcgctgtcgctcgcgcggcccgcggcgaacgcgcacgccaggagcctgtggcgccgcgcgcaggcgtacgacatgaagggcatggccagggagagcctcctggactgcctggccttcgccggcgcgtggctcaaccggaaggacgggacggcggcggccgcggcggcggcgtcgcgcggcgggaacccgaagctgccgtactgcgtcgcgcggatgatcagtaagcagatgggcttgacaggtctcttctccgccgtggcgacgaacagtagcaccaccaaggtagatagagatgatcgcatgccgcattacagcgacggcgacggcgacggcggcgacagcgacgacgaggaagacgacgacgacgacgatcgtgatgaaagcgaggaggaggaatttgctgagaaaggaatgaagctttgtaggccaggtagtagtaattaattaacctctcgagcttaatttacctatgcaactactgcatatacatgtgttatgcatggttaatcttgattctgatccaaattggttaattatcaccgatgatcaaagtggctaatcttgtttgaccaggtaagggtttaccaatcatcacggacgaggcttggaggagattagctcggaggaagaaggcaacgagccgagtgttgtctcatgatcatcgattctagcttgatccattgaagaaagacaagtagacagagacagatagctacagttcattgatcattggtcgggatgaatgatcatgattcagcaattcgatcagggcttaatcgcagacttgttgtcattagctagagctgatgtgatgggggtagtggtttaatttgatgttgacgctggcttagctatactttctagctagccttgcatttgtagtttcactcacgtgatcaaatgatgttcccattgataatacttccgtatctgtgctagatctctgttatttcttgcaagttagaagttgtcaatgtgagaatggccgatcgccctatcgaattggtgaaagcagctaagctacttgattcatagaaatatcctattattaggtttttcataacttgaggaaatgtttcagttgagaatttctgaagaaattattagcttcctgccaaattaattaatctgatccatgtcagcattaataaaacaataattaattataggaaaaacatcggtagcgtggttatatgatttcactcatcaaatttaagcatagtgttaatgaatattacgcacacgttaatgcgctagctctcaatagaacttttgtgagcctaaggatttaccaatgatcttttttttagtgtgtgttagtggctaaggatttgccaattatctttgcatttttagcgtgtttggagggtgtactcgtagacagcattgtatgtacgcatccgtcttttatgtaatcggaaaaaaaaacaacaactcattgaaatactagggtatcatttttgtcctcttcacccgtttgaacttttacttaaacacctaaaagagaccaaacacacctaaaagagaccaaaccttaattccaataaattatatcttctagcaagacattcaccgaggattaatcttaaccagagaacctgcttaaaattggcaaatgaaacaaccactaacacattgaactgttgaactctaacaaagttcaacagtttgttaaaagcacatctacatatgtgtaatatttatgagtaagatttaaatcttaggggcgggagccatattccatccttagatgcctcctccatcatactacctccgtcccaaaataattgtatttctaggattcaaaattcgtcccaaaataattgtaattctagagtactaattgccccatcaatcatctctcatttaaatttctccctattttaccctcaaccatcttcctactctcacataaacaccatttaatgaggggcacaatagtctttcttctcaaatcttaatatatgctaaacaacatagaattacaattattttgggacggaggtagtaaaacatttcttttgcgatcacatggcagatgtgcacgtatacgtactactatacatgcaacaccacactcacacacccacgaatatgcaccctaacaaatactcaaagagacgaaaatcaacggacattcctaatctcaataaattcctgttgaaagcacaattacacatgcgcaatatttgtgggcacttcattagtaaagtacttcactcatgagtcatggctccaccaccacatcactggtgctactccattataataataatagttgccctataataacttaaaatatatatctgcactagtaattactcactccctcccggtattcaaaatttatccaaaaagcttgttagtttagagtatattttgtcacatcaatcaccaccaatttataattttctctattctactctcaactatcaactatatacacaccatttgatggaggatattatagtctttttttctaaactttaatttttgctaaataacctagaacgataactatattggaacggagggagtaagcattaaggtctattctgactctgatttatttttcacattcctacgaaatttgaactcctatctgaaaatccagtgaagttccagacgtgggcatgaacagaaggatcggatgggatgagatgaacagtacatcatgattagaggattgagggagtggcgcgacgtacagaaggcgacaaggacgcatgattagccaagtgccgagcatgtcctgacccaataatcgactgaagaatgtggcggccgtacaggcaaattgagcgtatcgccaaatataaatcccgtgcaaaagctgagccgtgatgatttgattcgatcggcaggtggttactgggtactaagccaggactaaaagcggttagtgcatactaagacggtactactaaaagtaattatttttgtactaaaaagtgctttaagcgcgcacatgacgagcaaatgctagtggcccgtggccgctttccggatatagcaacctgggagcccaacttttcagtacagaatttacatttcttagcttagcctcctgtagaacagtagaagcatgcgaatagattatagtgaaaaattctggaaataattgggcggtatcacctttttatcattggttcttttgtaaaattgtatttgcagctttgatactaataattcatcaatacatcaacgtaagtcattgatcctccaataacataagcgccggcacctggcaacagtgatgacagcaacaggcataggaaaaaataaaatatctgtaaagtcatgtacataaccacaagacgcatgtgcgcagtgatcttgaaacttcactgtaacaacgatctactgttatctgaaaccttatcgatcagaacaatctaaaggatgaaaggaaagtgaagaaataaacaggcctaaatattaaatgcaacacagatgattaatctcaacatagatccacccacttccatttaacgatttcattttgcctcagcgcaccacatagttcctcaatcgtttctaatgcatactacacagagatattccctctgttctcaacaggggctccacgaactaaagtagttaaagttatcaatgatggacaggtcagatctcatcgtcttcggtggcttcatcatcaacagcagagctgttcccgttagcaggctccaattgcttgccattggaccctggggacttgccgttggacttattctttgttgttggttttttgcccttctcggcttgctgcagctcgaggcccttagccgacagcctccgcctcctctttgagttcacggcttcagctggttcttcagcagtagaattatccactgccagagaaataaaactaagaatgatgcccatgtttcagagaaaatagcagtataattgacggtggaattatcttgaatgaatacttgaaacaagatcctctttctgcctagaaatacattgtcatttattgccaatactttcaagttattctagtttgcaactttgcatatgatgacctgtagttttctttgaataacatggtttcccaactgtgcatttatattatacatatatatgaaatgagtaaactgctacaattttgttcaattaaactaaggaccaggttcaatttatatctcaccataatgactgcactacagtgttcccttgtgtgaagaaa

SEQ ID NO: 6062 - DNA, 13356 bp, Oryza sativa
tcctgcagccctactaccatagtctagcactttaccttccattggactagatgctggaggaatcgcttgtccattctgtacagcatccaatgaggatggggaatcagaatgattgctgtcctccaacttcgatgaacttccaaggcatttgtcgggctgctcatcgggagtgtctgggataggaatagctgccaagtagatgagctccatcgttgtgctactgctatcatccaaatcactgaacgttgagtttttatcatatgtctcaatatcgacatactcatcctcgtttaccagttgttcttcagcctatacagaaagatttagataaaacacatttttatggcacgagtaacagctaaaagtcttaaagacaggtaaagaattgtcattcaccttttctacatatgcatttaagtcaaactcatcctctcgttcaacatactcttcgttttcttctaattctacaaaatcaggagcaaatgcactccaattctctacatgttccttggcccaaatgtatgctaagcctgctacagacactgaaacaattgtaggatctactggatgccaggcaatatcaataagagcttcctttggaccttcaaggatttttacaagacgtcctgatcggttccatatgcacaatctgtgctctcctttgcttgctgaagcaccaacaatccactcactatcaccactaaagcatggtgccttccacggtatctttgcgatagcatccaaaagttcacaagaaatagctaggcagcttgcaccatttgcttttagcttctcgtagtgactctcatagctaatgttgttactgcttattttttctatctcctctccagaacctttaacaggcagaagattatcatagactctaatcacccgatcattagagtttgtgagtagatatcggccatccctgctgaaaacaatatccttaactactgttccacctgggatgggaatcacagcatgtaccttgatgctttttgaatctataattaatatctctcccttggaattgcccacatatatcagatccccatacttgtcaaatgttgcagcagttggtgtaaaaggtggagaaccatcagaaaatttattgcgagtattaggagcagggaggttaccattatcagacagaaaagctgggagaactgtagtacttccagtgtttaaatcaacaagaataggtgcagacgagagagggcatgccaaacaaatagatggggtagatggaccaccaggatgaagacggacacttaacggagtctgctgaagagtaatgcgggcaatttttttctcatttaccacatgccaaagtgtcaatgacttgtcagtagcagaggcgagcaaatggtgaccatatttagaccaggccacacttgttataggtgcagtacaatctttatcatgcagttctcttgcaatcccccttgtttcaaagtcccagataacacaggtaccatttgcacatccagctgaaaaaaaaaatcaactgacataaattgttggataaatttgctttcagggttcaagtacaaagcagcagtccaccaaaatttatggcactccacatgaatgatgtttttacatctgtgtatagatatatcacaaggccttacaggtgtgcacaggttagtcttagaaaagaacaaaaggatgcattaaagtaaacagatcccttatcatatcatcatgttatacttatatgtggcaatgccaagataaatagagatgcggagacaacacaaaagaagaaaaggaactacttcaggctacaagaaatggctttggttactgttaagtgttaacagctaaagaaacttcaaacagattaaaactaacattaatcgtgcaggcatgcttcacaagcgcacagtgtaaaataaacagtctgtgtgaaataagaagataattacatatgagcacaatttaagtgtactgttacaggaatataaaatgggataattaccagcaaggagagttcctctgcggttgaatgctatgcatttcatactcccatactgcaagaactcctcaatcgtctcagggaaatccccctgcaaaggatctaaaccaacataacatagcagaggtcagtatattgctgcaaaattcactgtagttttatcataaaaaaacacaagacaatgctcattgactcttagcacaacatccgtaattgcaaaagaaccagttatctgaacagaaaatttcagaatttgatgcacgtagaaaatgcagcgccactagtaaaggcaccagtgcattcccaaatttaaccaataggccaatactgcaaatcttctcaaatcctactcctagataagcaaaacaatcgaaaatctgagcctaaatcttgaataccacttcatttcaatgcatccaggagacagaaaccagcaaaagcgttcactatagcacaaatacacgctaatgttacccacaagtcccaaaatcaccaaaagaggggggaaactagggccaaacagcgcagccctaattcgcgcaaatccgccctagaaacctaaaatcccacccaaatcggcggaagtaccgcacaaatcccccaaactctcgacctacccacccccgaatcgctccaatcaccgcgtccccgacccatcccgccgcccccacgcagaatgcgagagagagacgaaactcaccgactatagggacgttcatcgcggcggcgccaccccctcagcctcgcctcgccgcgccgctgtccccaggcggaggcaaccggcgaaccgcccccaagaaaacaccaggtggcgagagcgcgcgccacgccggacggaccagggcgagggctagggcggaggaggccgccccgctgctgctccgctacacaaagccctaggaagggaaaaacctctctctctctctctctctctctctctctctctcggcggaagagtgaggaggggaaggaggggatatgcgtttggagcacgagtccgaaaccggcgcgcgctgggccgaggcgaggcgcgcgcggggcaggggaagggaggaattcgccctgttatattctgattctgattattcagattttatttcgatattggttatggtgtaacatcccggctcaggacttaataagattaatataatactcatattaacaagttgtaacttctttttcggaagctgatgtctaaagaactccagggttaaacgtgcttggcctagagcatatgtaggcggacccgaacgctttgtctgtggccaagagggggacctgaggacaagggatgggtgaccgaccggtttcacgggcagagcaatttgaaacgggtgaccggctgagaaattcttcccgggtgagtgcacacgacaatttgggatgggtgaccgaccgaaaactccaagggatgggtgaccgaccggtttcacgggcagagcaatttgaaacgggtgaccgactgagaaattcttcccgggtgagtgcacacgagtgaggacaagtgatgggtgaccgaccaggaattcaagcaatttgggatgggtgaccgaccgaaaactccagggttaagcgtgcttggcctggagcaatttgggacgggtgaccgaccgagaaattcttcccgggtgggtgcacacgagtgagtgtaagttcaagtgccttaatttggtttcggtgattaatgacaaatctaattatatgagactaacgtttttatgagtctttttttgactaatcttatttggatatgaaagtaaaaatgatgggaggtatgtattaaacttcacatattctaacttggtctctcttgtggatccaaaatatagtgtgagctcccttattgatcttgattgattatgtgcatatgcattccttcatatccatatgtatgcacatcttgagagggagcttattctatattttgttcattataagatctctaccttgatttgaaattatctttcatctcatctctttgtattgtttatatcggattattatctatcacaaaagagagaaaagattgaaagatcttggattaaacaatttgtgtaattgttactttggtgatagatgataaaccgatgtttatgggattaacctctcttttctataagttttcaacaaggttatttcccgacaatgagatgtggtagatatgcattctttggtgatggactttaatcatgacaaggatgaaattcatggagataaagcgatatgtatcacttcttatctcctactttttgataggttcatatatatgatttccatgttattgttatataagtgtaagactaatatttacttagtctcctttacattgagaacatggagatcatgaaggtatgtgtttttttttatcttcatcattactacatatgccttctctatgtgtataggataaaccccccattggttcttctttacttatgcatacacttgtctctcttgtatatttctttgtatgcatatacttagggggagcaaatcctatatatttattgtgcatgttttagatccatattgttcacctattatttatatcggatctttgcacttgaacttgcatacgagtatatgacacttgtgatgttaatgaatactcaacaaacatatacatatctttcatatgtaaccggttggtcattaagtgaaggatgacaaccgatttgttgagactaatgttctcctttgagatgtgaaaaggaataggtcccactatgatgaggctaatggatgacaccatgggttaatggtcaccaagccaaggacatcgccatgttggcaagaatgaaatcaagcttgtgatgagaagaaagtcttaacaaatgatggtaaatatcttggtataaacatggttgaatcaaatggtcacaagtgttgatctcgactcaagcttgaccccaagatggatagcgcaaggcaaaggtataatgtagctaagaatgttttcttagtcttttcccggtcttggtgtttggtgtagaccggatttgctagataggcgccgtactatcaagaggggtctatgaagcgagcttgtggatgatcttgtgccatattagttcatatgcatgtgtgtgtatttggtgggcttgtctagccaagtgtggtgagttttctcaagtcctaaacaaagagagatgtgggcaaatcctataggtttgggtagcctcatgtggttatgtccggtggagtatcctttggagtgtgagccctttctccctgagaaaagttgtgtttcttagatggattgttcatgggttggatagccctttgaataagctttccataaagtccaagaacgccaaattccgagacccgagtcaagagatatcgtcgttttactaacggtcggttgagttgaaaagtgacctgcggtctgaccgtgggccttaggccggtcggaccgggcctgttagccggtctgaccggcgtggtaaggccggtctgaccggccccattggtctgttgcactggtttggtttttggtggcgatacagagccgccagagccgcaaccagtcagaccgagccgacggcggtctgaccgagctgtggacggtctgaccggccactacactgcggtcagaccggccagattgagtgggctcaatgattgccctgtaacggctagttacagggcaaaactagccgttacaaagtagtccggtctgaccggccttacaacggcggtctgaccggcagagcacaaagttggggatttcggttccaacggctagttttggtagttgggggtatatatacccactccccagcagtaagggtaaggttttggcactccattgcattatcttgaacccttgcaagagctctcacacccttgtgcacttagtttatctagtgaggtattagagagtgagttaagccaatccaagtgcattgcttcattgttataactagtatggcacttgatcatcctcggcaagcatcctagacttgttactcttggaggttgccgcctcctaaacggcttgtgtaggtgttgcccggtgacctctccgaggagattgtggaggaggttaagcgtgcttggccgaactccagggttaagcgcgcttggcctggagcaatttgggatgggtgaccctgatgtccaaagaactccagggttaagcgtgctttatccgtggccaagagggggacctgatgtccaaagaaactccagggttaagcgtgcttggcctagagcaatttgggatgggtgaccgaccggaaaattcgtcccgggtgcacacgagtgaggacaaagtgtgcactagagcaatttgggatgggtgaccgaccgaactccagggttaagcgtgcttggcctggagcaatttgggatgggtgaccctgatgtccaaagaactccagggttaagaactccagggttaagcgtattttgtctgtggccaagagggggacctaatgtccaaagaactctagggttaagtgtgcttggcctggagcaatttgggatggtgaccgaccggaaaattcttcccgggtgcacacgagtgaggacaaagtgtgcactagagcaatttgggatgggtgaccgaccgggaagattcccgggtgcacacgagtgaggacaaagtgtgcactggagcaatttgggatgggtgaccgaccaggaaattcttcccgggtgcacacgagtgaggacaaagtgtgcactggagcaatttgggatgggtgaccgaccgggaaattcttcccgggtgcacatgaggacaaagtgtgcactggagcaatttgggatgggtgaccgaccgggaaattcttcccgggtgcacatgtgcagaaaagacttgtgttaccctgtgagggcagtttatgacatatgaaagctgtcatatgtaagcggacccgccctgggagaggcgggacgttattatcatgttttttaaactactaattcctctatttcagattataagtacactagtattttcatttacacttcaaatcatcagattaaaaaaaataaaaactactagttggctcgtattgttcaagtgtaagatgtggccaagattcctggtcgaatgctttcttaacgaagaccgccatccttattcttgtttgatgggggtttatccccgagagggagagtgagggtttattcccgacagggagagtgaccactacgtaggtttttattcatcaagaattggaatccctcccttcttgtctacttcctctattttataatgtaagtctttctaacattgcatatatttatataaatgttaatgaatctaaacacatgaaacaaaacagagggagtatgttatttcaccgtctttaccgaccaccaataagacctttattttatataaaaaagttcattattcaaaattaattactttggagggatccaaagtacaatattttaaacgaaaagactaggaattttttttcacctagtacccctgtttaatttagatttatgttaaacccggcacggtcctatcctggataaatagtgaccgttagatcatgatgagcggcccagatcgaagaggataatctacggcagcatttttacataaaagaccctttgttatcatctagtcctcgattaggtcggacgggagagagagaaaagtcaaagaccctagcgaggagccggagctccggcgattgacagcggttgcgccgtcgtcgccatggccgcagagttcccgaaggatgtgaggcgaggcggcacgccggcagcggtaacgagaggacgggtggagcctgacggcagggctgcctctgcatctggctgcctaatgagacgatctgaaggaagacgacggccatggcgacatctcctgaagataacctcggtgggacgacagggtcatttgcctagttcaaaagcatactgatactgaaccaatcaaccaatgatcatgacaaaccaggaagaaattcagcaagtgcaacaaggattcctgactgttcagaagttccaagtgtcaacagcaattctgcagatcatcatcatccaaaaaatgagaaaggtaacaaagttatctactgctgtttataacctcaaacacatgaatgccactgtggtttatcccaaccctaagtggagaagcccaaccaattcgctaatgcacttatacaacagcagaggaatatacagtgtagttcatcggtaggcttcttcctggagctaatacaaatagacttttttactatgcttcttcctggagctaatacaagcaggcagtagtacaagtttttacatgggggagcatctttcttctaatatgatctgcttcaccatggtagaaactaacagttctgaaggccgataagggaattgtcctgccctttttttgttcaaaaaacttctgaaggcgctcatgtgctctttgtcattgctgagcggaggcgagaatacagtgaggtatttcgcatgataagatagacgatgaatgcaaggtaaactgccaatacaacgcacaagcttgaccgaaccaatgctccccggacttcagtggcatagaaggacagtataagatacccattgatgagcatcaagaatactgtaacaatccagctaatcacctaagtataagcaaagataaagttaacagcctacccttgcaaaaacatatatattcaggttttcttttctcatctgaatacagatatgctgttaaacaaccaaagccgaccaaataaatctacagttgattaagaggttggtgaatggtgaactatatactgaaaaaaagtttatatagatgtaagaaggtaggatagcatagacaaacatatatgagatggatttcagcttcaaggctaacagcttaatggaataaaacattgaagaatcatgttcatgcatatcaatttaatcacctacagaaacaatgatctgaaactaaggaactgttgtcgatgattatgaaaatgaaaaccttttattcgttcagtttcatcagatgacaaaaacttaataataagatcacatgacctaaaacagcaaatggagttcaatactagttaaattatctgccaacatgagacatatgataaagaaatattaaagggaaaacttacttttgtgataggaccaaccacaaatgatcccatgacttgctcctttgagacaagtgtgatgagaggaatcagtgcaaatggtatctgtatggattgaagaacattgagtgcctcattcagaatgtccattgtaggatcctccgtgtcaaaaaataaagccacaatcatagttggaataattgcaaagcttcgagtaatcattgctcttaaccacttcttcaaccgaagattaaggaagcctcccataacaaattggcctgcatatgtgccagtaatagtgctactctgtccagatgctaacagcccaatagcccagatatacagtataggaaagaatgcagtcccatatttctgctgtaagtactgtccagcattctcaagacctataccatcagcttgttcagatccataaaatcctttcgcaaaaactgttgtgacacagatgttaataaagaacgagacaatgagggcaagaatggactcaatgttgtaatagaacactgcttcttgaacacgggatttcttgtttgtgtcaatcttccttgactgcactagtgctgagtgcaagaagacattgtggggcatgattatgcagcccacaattccaactgcttgtttgattgtccttgaactcaactttggaaccaccaaacctagataaagaaaagaaaagagagagaataaactcttcgacttctcaaggctgcaagataagcaaaagtatttgcaaacaagtcagcttgaataccaatcagaagctccttgccacttggctttgtttcaccaaacataattgcaaatgatactgccatgactgcaatcaggactccgaaaaatgcttccaattttctcactccatagttctccaggaataaaaagatgaagctggcatcaataacacgtcatgtaagccaaacaaatgtcaattttattggacagttcccaatcatataacaaaacagacaatttgtcagcacataaacaaagtaaaggctaagtcaaaatagagaatcattgaataacactacagcagaaacagacaggaaaatgttgtctctttattagtcatcccgatttttaatatgatttgttcctttcatcgttactagcttcatacccaaacatccctatctagtagtcaataaaattcaaaactaggggcctaaccagggaagacgataagcactaagtagaagtgtacggacaatacataaggacatgcccttagattaatcaacaatcccaggtctcttaactgaatataaattagaagtattaaaccaaacaataaacgtgcattatcgtctgaccgagcgactcccaggacatctgggaccattacagtttttaagcattccgcgaccaccaaacatggctttgatgacaaaaccaacagaaaaacgtctccaagaaaagagcaagcggcaacaaaaataattactacaacgcaacataataccgtcagcaagtagcacggaattgatcgaaaagaagcagaggaaaaactggagtttcgtctaaattttagctcccaagaaggaattctgaagatgaatgcaaaggtagccatcatcacactaaccaaaataataataataactgggggaacaaacaatggaagtgaatagtcccactcaaaatggattcgccacaagggcaactcaccaaaaagacacgaactttatttactcacctaacgattaacgattggcgggaccaaagaaaggaagggaagcgatcgaaggacaggaggaggaaagggaaagaacggaagcgaggtttctgctctctcctgagatgccatcgggaagagtccaacacgagaacgaacaaacaatactcgctgtgtcaatcgagagaccaacaggatcgacgaaaacacatcgaattacagtcttttagttcaaaaacgggaaaagaacaagggcagcgatgaagagcaaacagagcgtccaatttaaccaataagaaagcaacgaactctcctatccaagaaaggaactccttgccagtcaagaaaaaaaaaaaccgatgaacttactcgcaaattctactcgccgcaggtaagaaaggaaatcctaatcagttaaacgatatcgatgtcatactcgcaaattctactcgccgcagctccaaaccaaaacatgaaccaagcaaactcggggctgtatactatgatcagcaataaactgaaaaaggaaatctaggaattttctgtgaacaagaccaacggggtaaggacaaaaaggaaagcctcgttcgttcccaacacccaccaatcgaacgcggtgatgacgacgccgccccagagcgggacggtgccagcggagaggatcttgatggcaatcgcgctgccaatcacctcctggatgtccgcgccgacgagcgcgagctcggtcatggcccagagcgcgcgcgtggcccagggcgggtactcctccctgcagagctcggcgaggtgcttccccgtggcgaccccgagccgcgcggagagcagctgcaccagggcgcccatgaccgtcgcccacagcagcagccacagcagctggtaccccgccgccgcgccggcttgcaggtcgccctccaggttccccgggtcgaggaacgcgatgcacatgaggaacccgggccccgtgaaccgccacagcttgcgccacgagaaggccgggcgcatggcgtcgccgccgccgccgccgccgtcctccgagtcggagtccgagacggcgatggagaccttgtcgtcggagtcgtacgcgcgctcgtcgtactcgtcgtggccggtgacggtgacggtgccggtgacggccccgccccccacggggaggaggctctcggcgaggtcgcgcgacgccatggtgggggggagtgcggcgacggcgaggtgggcgagcgagtgggaagaaatggatgggtcaggactcaggagggaggttaggatgggaagttgtgctctctggactctaggagtggttgtttttctaagataacaagtatagtggcccgcgcagattgcgcggctagcatcattatattttctctcatataatagcatatatgttttctcattatattattcaaatatattaaaatgacaacataattttaaattttacaataactttacaaaactactaatgtgtaatgtttatattatattttatatacgtgttagttattaattatttttaatatcaaattttagttatttgtaaattatatatattcctatatggactctagactcgtcttttaatatttctttttttaattcatttttatttatgaatttttattatttctaattgtatttctatgtggactctaaactcatctttcaatattctttaatttttaatttcgaatttcagttgcttctaaattatattccaatatttgtattcctatattgaccttaaattcttcttccaatgtttttcttaattttgaattttagttatttgtaaattgtatttttatacagactctaaactctacttttaattttattatgtttattccaaattttagttagttttaaattcctatatggactctatactctacttctaatattccttatttttttaattccgaatttctatttttttttctaaattgtatttctatatatactctatactttacttctaatattccttatttttaattccgaatttatattatttcctaattgtatttctatatgtactctatactctacttctaatattccttatttttaattccgaatttcagttatttcctaattgtatttctatatgaactctatactctacttctaatatttctttttttttaattctgaatttcagttatttcctaattgtatttctatatggactctagtctcctcttctaatattcctttttttcattccgaatttcagttatttcctaattgtatttctatatagacagactctagtctcctcttctaatattcctttttttaattctgaatttcaactatttctaaattgtatttctatatggactctagtctcctcttctaatattccttattttttaattccgaatttcagctatttttaaattgtatttctatatggactctgtcttttctttttctccgattaatgtgagaatttctaggccatgagagcgaacttggaggttcctttttctattcctttaattatatatttaattccaaatttctttgtaaattgtatttctatatggactctagtctcctcttctaatatttcttatttttaattccgaatttcagctatttttaaattgtat

SEQ ID NO: 6063 - DNA, 12685 bp, Oryza sativa
  unsure (1)..(12685): unsure at all n locations
ttttaattccgaatttcagctatttgtaaattgtatttctatatggactctgttttttctttttctccgattaatgtgagaatttctaggccatgagagcgaacgtggaggctcctttttctattcctttaatggactctagtctcctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggactatatagtctacttctaatattccttatttttaattccgaatttcagttatttcctaattgtatttctatatggagtctatactctacttctaatatttcttatttttaattccgaatttcaggtattttctaattgtatttctatatggactctagtctcctcttctaatattccttattttttaattccgaatttcagctatttgtaaattgtatttctatatggactctagtcccctcttctaatattccttatttttaattccgaatttcagctatttgtaaattgtatttctatatggactctgttttttctttttctccgattaatgtgagaatttctaggccatgagagcgaacgtggaggctcctttttctattcctttaattatataatagattttatactcggttttttatatttatcttaatcaaatttctttagatttggctaaatttatagaaaaaaatagtaccatgtccgttccaaaatataagaacaaccgaatgggacattttctaggatgtggattttcattccttgagaggatatcccctcattgtttgcatgtcatttaaatagttataaaaaaaattgacaacatatattaatacgaaatatatcactctccaaacatgttaaactgaaaatagttatcgcacattcgccgctatatttattattttattacaacttgtagaagttgaatctaagcttgcatgtttgtagactgatatatttcatattaatctattttgccaatttgttcatattttttatgactatttaggtggcatgtgtaccccatttcctagtagtctgtccagattcgtggtaataaaaaatatcacatctagttcttggttattatattttgggacggatgaagtaatatttataacaccaaattagttttattaaatttaaaattgaatatattttgatatatgtttgtgtttatatttgaaatgtaaaatatttttctataaacctgataaaactttaaaaaaattgactaagaaaaaagttaaatgacttataatatgatgcgaagggagtacttttttaaccgcaactaataacatttaatatattagaactaagggacgagctataaaaaaattagggataaaacatgggatctgatggttatctatgcaaactacactcgcgagcttggtgcacgtggtgagaggagaggatgaaaggagcacgacttctcttttaagctagtagagaaacatccaaaatcaagtaaaaaaagaaaacactagccaagtttttgatagaaagatatgtttttaaaaatcaagaaattaaaatataggcatttgcaaatatttaaatgtaactaggcaaagtatttgtattgtattaaaatatggtaccaggtgctttttaaagattttatttttagatgcatacaccatcattccataaaaaatgaaccagtgctagagcaagtatgactgcatgagtaatcgagtactactgtctatatttaaattctgtcgtcagattgtacttggtatacggaagcattctaattaaacaatactagcccttttgtgttgacattggactataaattgggctattatcccattggataatatcttgggtacactttctatatctttgaaagttcttgagagctcagactcgttcagaaaaatctgatccgttaatgcttgtttgcatcggttgtttttcattacctttttttttctcactttttctgttctattttcgcggtgatgcatcggttgttgacaacgtcaaaagcagcaaatttatgatcgcttgatcagcgggaggacgatccctctcgcgtagcattttcgcccatgatctaacgaattttggcggctctattaattgctagtcgaggtagatgattctacgaagatagtgatggattcgtataatcgtattactagatagtagtaaaaattttagatacccatgtactgatgtacatattggatggtagcaaatagtgctttagcgccgtatcgttttcaccgtggataatttgggggcaaaggtagatcgttaaaccctttattctagttaattatcaggacaaggactcgatgagcaaattgtctttgggagttcgcttttccttgccaagaacaaaagtgagtgtagaatagatcgaatttcagagtgtagaatagatcggtcgagaacgcaagacctctcctttttccgcacctttttctctcgctttaatcgtgcgttccaccgggcatcaacagacagcaccactcggctgacgaatccacgttgctgactcactgtgtgtctacgttcatcagctgtccatatttttcaataatgtgaaagggcttatttagaaataataatctctctgtttcagtttatacgacgttttgactttggtcaaaatcaagctactttaagtttaaccaagtttgtagaaaaaattagtaacattttcaactcaagacaaatttattataaaaatatattcagttattgatttgataaaactaatttagtattacaaatattactatatttatatataaacttagttaaacttgaaacagtttgcctaaaacggagggagtagttaactagcatagtagtccgcgatattgcgcggctagcattgttatattttttccttatataatagcttaaatattttcatacgttattattaaaatgtattaaaaatagcaacacaattttgaattttgtattgtatcgatagttattaattattttcgaattttgaattttactcatttctatattgtatcgtatccctatatgttttctagactcttctctcaattttgcttgttttctaaatttaaattttagttatttataaattgtatttctatatgtactataaattatacttttaattccgactttcaattagttctaaatttagagttaacttaaaaattaattttaaatatttaaattttgatttttctttgaattaatagtccattccatgggactcttggatttcggacggtgcaaagttgcaaactataagtgccatgcgagtgaacgcgagcagtggcgcagctaccgggggtgccggagggggccagcaccctccccccggtggctgctagtagtatattacagggttagacaattagacatcatccactgttaggccattagtacgttagattatagtcagacacttagtacttagtcttatgattttcatctttttaaagtaaaatagaaaatgcttatttatgagactatttggtaatttacattgaaagaatttagcaacaaggactagttccaagcttccaatgatattattaaagatctgaattcaagttttttaggcaaaacatatggtgccttgttatattgaacatttgaacctctttttttaaaaacataacatatgatagttttgtaatctagctaaaaaaagctatatttatatacacattggttattgtcagtagtgactatttagcttattatccatattggttaatcggtcttatgacttcctcccccacatcccccctaacctcaaatcttcgccactgaacgcgagagtacccgtgtgtgtctcgcataacgtgtgacgcctcctggccgtgtcgaagcctcttcagccgagacgtacggctcgtctgttgcagatcccgtgcaaaaactgaacacggcggcgtcgcccgtcgcatcggccatggtccctggacagcgacgacggcgtcgcgcgtggcgcgtcccgtcgccacgacgcccgctcgtgcgagggagagtggaagccgcgagcgtgggcatcacagtacaatggtggagaatagctctatagtcccggttggtaaccctttgtagtctcggtttttcaaccgggacggactaaagatcgcaatctttagtcccgattcaaataatcgggactaaaaatatggtcccggttgttgttaccaaccgggactaaaaaagttttgtttgttttcttttcctttcatccggttggcctttttccttttgtattgttctttagctttcgctcgtggatcaaatgaataaaatcaacaacagagcctaaatcatagatcgaatgaataaaatcaaacaacaaaacatccatattctttacacttgttcagatctacaacatcttcagaacaatgagcattcatcacagagaacaaagagagcattcatcacagagaatagagaaagaaaaaagaaagttcacatctacaacatctccagcattcatcagatagcatagagaaaagaaaaaaaaagttctccgcctgccgccgccgccctcccgaccggcgccggctgtccccgacgcagccggctgccgccctctcgaccggcgccggccaccgccacctcgaccggcgccagtcgcccccatctcgccgccccgcgcccgatgcagccggccaccgcccctctcgaccggcgccggtcgccgccgccctcgatgcagcccgccgccgcctccatctcgtcgcctcgcgtcgggccgccgcggaggcctccatcccgtcgccctgtccggggccgccgtggccggcctccatcccgccgccccgctggaggggaggagaggggaggaggagatggggtgagagaagaaggaagagaaggatgggaggaaaggaggagagaagaagataagatggagaggatggctggatgggagaggaggggataaggatggaattaataggagactttcatgcgcgcgcgtggatagaggctttgttttaccggttgttagaatttttagtcccggttacaccaaccgggactaaagttaggatcaccaaccgggactaaagatcaaatatgcccactgtagccaccaaccaggattaaagatgatttttagtggaatcgggactattgtggattttggtcggccgaccaaaaatggtttctccaccagtggtagcaaagccacaacactgcaatgccacttgtacgtccggttccaatttatgtgtttagttcacgttaaaattgaaagtttggttgaaattagaatgatgtgacagaaaagttgaaagtttatatgtgtagaaaagtttttatgtgataaaaaagttaaaagtttgtaactaaactcggccttaagcgccggttgattctcgcatgtactagtacacagtacaccagtactactgtaccactagcactactgatcgcgctaatttttcgcttaaacaaacgggaatcagagggagcgcgacaggcgacagccgccggggacaatcagggtagtactccgtatctctcatccggtcattcttctcactgcgtgagacgaacgtcgcgatcagatcacggcaaattgcgctggtttatatcaccagaagatgaagatggtactccaatcctgcaactgccaggtgccaaattgaaggtgcgcatcacggttggtagtagcgtgctgccgttccgcacttcatcacagggcttcggttagatcctccgtatttggaattttcagatgatctcccggcctgtgcatcgctgattcgctgttagcgtgataagatcgcgactaagccggccggagtagactttttctggagcactagcgagcttggccttttaatttcttcagttcggtggactgtcttctgacgtggtgtatatgtggcgataccagtctcctgtggggcccagctggcagcctccgtagcggaaggggaaggacgcgccacgccggcgaggcagcgtcctcgccgctggccttggcctgactcgtggccgttatctgatccgatctcctaagtaaaaaaaaaagctaacccactactccctttatccaaaaaaaaaaagctaacttaggaggaaatatgattctatcctaatacaacgaatctagatatgatgggttacattctttgttaggttgtttttacaacgaatctagaaatgatgggtcacattttttgttaggttgttttttttaacggatagagtacttttagtagatggcgctgttaaaccgtccaaacgaatgctgctttgttgttgcacgggctcgtgattcgtgaatgccaaatcacttgaagacggctggtcatgtgtagaccgatcgtacacccatgtgaggtagtagtgagtatgaccacacggtccacgggaatacgggatcgtgatgcggctgatctggagttgctggaccatgtaatacagatatctggaatttcagcgtgcgctactgtacatgtgttcgctgtctggctctgggcacgcaggtttaggacgattggcggattgggatataccaatcatgtataggctagtaccatcgctgtgtaatcagttgtgattactcgttgttaaggactggagttcatgctgatatatatgagagttacccatattctcgggatgggaataatttatttgtgggatacgactagcagaaatagctaagcaaaagatactctccatgcgggcacggcagttccagctgacagagttcaattgggaagtgttaatgtggtcaccctgggtcaccatcaattgtaattataactaatcgcctatgcagattaacactgacgtacaattgcttatctattgtattagcaaaaaaaaaacagtgtcatgattaacatttgattaaactagctatactcctccgttctaaaatataagcattcttaattagcaataaaactgaacaagtgtttattttaaccattgctagttatgcaactagaccatcacaattataaatacttatatttgggaattgagctagtatatctgtacccccgtccaaaaaaaccaatcccgcctatgaatctgaacacatatctaaaaattcgtttttttaatgacggagtagtatgtgcctttcaatgtctaattgagcgggtgatatgatgtctaattgaactgggtgatacatgcctatctaagcactagactttaagggccactttcaattggagaaaaaatagaagaaaaacaaaagaattgaaatcctacactattcatgctcttgtttagtaggaacgaggaaaggaaaaacacatgaaattgaactttcatgttcctaggaatctagaggaaaaacgtgaaaaatttaacatccactctaagctcatgtttttctatctcgcgtaggttcgatgtaaatctattagctcatggccatttttctattcaattagtgtatgttagatgtgtataagtaaataaccaacccaatttattctaataattgaaatccattccttttttttcctaatcaaatactcattcctacataattcttgtgtttttcaattttttgtattgcatatatattcatatcctatttctttgttttttctgttaccatgttttttcgttcatgtgattcaatagggccttgagagtatcacaaacacagtaagtgggctagtggcttccgtttcaaccgcaataggggagtcggcctgaaagtccataccgcatgatggatgcctgcagctgctaatgtggacactgcaaccaaattggaacaagttgttgtatcgaagctttttctctagagaacatcatctgtttatctgcactagtacgatcctattcccttctactacatgctcactaatgtcagtaaccacacacaccaacggaattggctgctcagtttggaatcactcgacagacaagacacacagacatcggaatccggacgctatccttctcgtcttctcgttaatttttccggcagcaacggaagactgttcgtgtgggagctttcccccttggctgctgctagcgtccacaaaatgagttcagctccatgcgcgacgcccatgctgcgcacgcagccgcgaatccgcgatgcatctgcacgacgcaccggcggccgaagccctggacccgttgacgagacgcacgcacccgcagccgcgcgatgcatctgcagggatgcaagtgggtcacacgcgaactcacttatagattgaaataaacgagttcccaagttagttttagcctataagcgaatttttatgggtagctgcttgcacccttatctgcaggacgcccagatcccttttgccgctgctgtgcactcctcaaccttcaatcccctgccgccaccggtcagctctgttgacagggtgagaaagagtaaagagtgtgtggaacacatagagagagagaggatatttttattctttttcaataactaggatgacacgtggacgtcacgctaacaaataatactctcggtactacctccatcctaaagtatagcagcctaaaattggataggatacatcctagttcaatgaatatggataagtggttgtccagatttgttgtactaaaatatgtaccatctagtcctaaatagttatattttgggacggaaggagtattgcgcaacaaaactagattgcactcatattaagggactcaaagtggacttattccacgctgtggccgcagcgagactggaaagaggccgtgcaatatctggaccagaaaagcccgcagatgtcatgggccatatgcgatcctgcaatgggcccgctccagccgcagcgcgtttcccctttggccaacgccgttcgcggcggcgccaacgacgcccaaaaccctttgcagtttgcagccggcgaagcgccgccgccatcggaaaaaaaatgccgcccaagccagagcggcggctgttccagtacgtgagcaagccgcgcaggccggcgcgggagcctgcgccggcgcccgaggtctgcggcggcggcggcgaagaggtggtcgcgtccgacgcggatgccgacgccgtgtaccggatggtcacggcggcgcccacgccgtcggcgatggagtccgcgctgtccgcgtcgggcgtcgcgatctccgcgccgctcctcgacctcgtgctgcggaggttccggttcgcgcacggggacccgctccgcgcgctgtcgctcctctccctcgcgctcgaccgccacggcgtcgccccgtcccccttcgcgctcgacaccgcgctctacgtgctcggccgggcgcgccggttcgcgcacatgtgggacctgctgcgatcctcccgccgcctcgtcccggacgccgtcacgccgcgcaccgccatggtcgtcctcggccgcgtcgccaaggtctgctccgtccgcgagaccgtcgactccttccgccgcctctcgcggatgttgaggggccgcggggacgaccaggagggccaactcttcaacgcgctgctccgcacgctgtgccaggagaagagcatgtccgacgcgcgcaacgtctaccacgcgctcaagtacgagttcaaggtgaaccgccagacattcaacatcctgctctccgggtggaagtcagccgaggacgcggaggcgttcgtcgccgagatgcgggagctcggcgtggagccagacctggtgacttacaacagtttgattgattgtcactgcaagaaccggggcgtggagaatgcctacaagctgctcgacgaaatgcgggagaaggacatttctcccgatgtgatcacttacacgagcttgatcggcgggctggggttgattggccagccagacaaggcaaagcacttgctgaaggagatgcatgagcttggatgctaccccgatgtacctgcatacaacacggcgatacggaactttgtgatagcaaagaggcttggtgatgcgtttgcattgatggaagaaatggcctcgaagggactcatgccaaatgccacaacctataaccttttcttccgttgctattattgggcatacgacattggcagtgcttggcagttgtatgagcggatgcgttctgaaggatgcttcccgaacacccagtcttgcatgtttattgtgaggttatgtcataggcatgggagggttgcacaagcactagagctgtggagtgatatggtcaataatgggtttgggtcattcaccttggtgtctgatgtgttgtttgatctgttatgtgatgaagggaagctggatgaggctgagaggtgcttccatcaaatgattgagttagggcagaagccgagcaatgttgcatttagaaggataaagatactcatgcagcttgccaaccgtgaagaatctattgccagattaactgctcaaatggcacagtttggacggttggcgcctgaggattgccgaagagttgatcataccttgcagagcacacatcaaagtagtgatagaactgacactgacactatagtgaaacacagcaacacatttgaatcacgacgatgataaattggggaagataacttggttggacagggaaataactgaaaaagagagttctgtacttcgatatgttgttcaaggtataccttcatggtttctattgattattgttcactgtatttgttggccactttgatttcataagttcttatgactaatgacttttataacaggtatgaagttctgcatgtgatctatagatggccaaccatattattttcaatatcaatagaatatgtttctgcaagttctactgtggaagaccattctagcattgccttctgtgctgagagaaatgctattccagcatcattgttatctgcaagctgaatgcctggatgtaaaatcacaactactgtgtagagacacttcaacatttttgtaacctgtggtgtttgtgtgaatgaccatagagaagtcatgcctgactcttccccagctggtttatcctctgagtctctgatagagaatatatattgaagcatgattgcgagattcatcttaggcaagagggacgaaatacaaactgtaatagaagtttcgcacgacaagtacaaagacacatactataggagtacaatctgaagtacattcatgtgtttgagctgccaatgtcaatgtggtatccctgcttcctcaaaaacgcacagtgcgcgcccaggacaacagtttgacggctccaacaccgttatttaggtggtcttgccataaatcatgttatctctttactttactaaggtctcctttgacatagcctcggatctaagattattttaagctgtatattgctaactccacaaatctatatatctaaatatgtgatttgattatgttgataacatttgaataaattattttgtttctattttgtatgaaatttaaattttaaaccactataatttaacatacaaacgttaaatttatcgtaaatatgagatctgaaactgtgccaaacatagcgtaagcactaagcaagcttgagaatacatgtattgaaccgaatcacgcaattttttttctaatttgtatataccccaaagttcggccttattcgtgcattactcgagtagggctgtgtttagatccaaactttggatcaaacttctaattttttccatcacatcaacctgtcatacacacacaacttttcagtcacatcgtaccaatttcaacccaaacttataactttggaaggaactaaacacagtctagtagtactccatattggatatttggatttatgccgtttttggctttgccaacaaattcccgcctatggacggccattcaaatggccaaaccgcgtcaggaccctcctaaacccaaaccaagccaaagcgcaacaccgagagacgaaggcgagcgctgcgctgcgcggcagcgtgagccgcaggcgtcgccgatggagagcaaggcaatcaacgcgacgcacgcgccgccgccgccgccgcctattaatagggcggcaacgaaggcggcaacgccaagcgaggttgaattccccactgactccaaagcgaatagcggaataaccgtctccaccccacgccgccgcggatgacgaagccgaggacgaggtcggtggccaggatggaggccgcggcggcggctgcggcggaggaggaggcggggaatcccgacggcgtggagggcgcggccgtcgccgccgttgcgcccgaagccgccgccgaaggtccgagtgagccgaacgcaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 6064 - DNA, 822 bp, Oryza sativa
cggtgaagacgtagacgcccaacaacggcagcataaaggccagccgtgcaggcggaaacaccagtcggcggcggcgaaggcaagccggtcggtgaagacgtagacgcccaacaacggcggcataataggcccccgtgcaggcggaaacaccagtcggcggcggacgaggtggccggtcggtgaagacgtagacgcccaacaacggcggcataaaggccagacgtgcaggcggaaacaccagtcggcggcggcgaaggcaagccggtcggtgaagacgtagtcgcccaacaacggcggcataaaggccagccgtgcaggcggaaacaccagtcggcggcggcgaaggcaagccggtcggtgaagacgtagacgcccaacaattgcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttccc

SEQ ID NO: 6065 - DNA, 1481 bp, Oryza sativa
tacagcttcggtaccatcgtctcgctgacctgcctatgtttaccgcctttcacagtcatccctctaagcatgacgatttccccctcttctgccctcccctccatcctccttctaaagactagcttgttgagccaccgcggtcactaaagctagaggagtagttgcgcacgagtctgcaagcaaatcgactggttcaaaatatataaaaaaaatccccctcgatttttttgtcaaatattatttagcaaattacgataatgccaacgtgttgaagcattctcgtaatttgctaaataattgggacacgtggaacacgtcatggatgccgatcatattggatggaagttctaactgataagcaacttctccccttcgttccaagattttgtagggtcccacgaagcgtggtgccaacttgcctttcgtctgaaaacggtgtactccccggagcggagtgacacgaagatacacgtaatcccctgcctcaaaagtgagctcccttcggcggttatccgcgtagctcttctgtcaagattgggcaatcctcaacctttccctgatgattctgactttctcttctgcttccgctaatacctctgtcccgaacagttgacgcttgcctgtctgatcccagaagagaggtgtgcggcacttccggccgtataaagcttcaaacggtgccatctgtagactggcctggtagctgttgttgtacgagaattccgcatatggcaagtttttgtcccaagctccaccaaaatcaagagcgcaagctctcaacatatcttccaagatttgattgactcgctcggtctgaccatcagtttgtgggtgataggccgtgctgaaatttaaacgggtccccaattcttcctgcagcttctgccagaattttgaggtgaactgactccctcgatcagatacaatctttttgggtactccatgtagacacatgattctcgagaggtagagctccgccaaccttttgcccgtatacgtggtatgtactggtatgaagtgagcaaccttagtgagtcgatccacgactacccagattgaatcgtgacccgatgatgtccggggcagtgctattataaagtccattccaatctcctcccatttccattctgggatttgaagaggttggagtaaacctgctggtctttggtgctctgccttcactcgttgacaaacatcgcagagtgcgacgaattcagcttttctctcctcatgctgacccaccaaaacttttctttgaggtcttgatacattttggtgctgcctgcatgaatggagtactgggtctgatgagcctcggtgagtatcagatccttcagttccttgtcgtcaggtacacacaatctttctcccaaccagattgtgccgtgttcatcttcgtggaaatcccgggtttttccgactctcatgttctttttcagctctgctatttcagaatcatttacttgaactgctctgacttg

SEQ ID NO: 6066 - DNA, 6479 bp, Oryza sativa
  unsure (1)..(6479): unsure at all n locations
cccgtaccgagtggtgaaggccgtctttggaatatcctcttcccgaattctcaactggtggtagcctgatcgcaggtctatcttagaaaacactttagctcctttcagttgatcaaacaaatcatcgattcgcggcaaaggatatttgttcttgattgtgacctcgttgagtgcgcgataatcaacgcacatcctcttcgtcttatcctttttctccacaaaaatgaccggagcaccccaaggtgaagtacttggtcgaatgtaccctttctgcagctgctcatcaacctgcttcttgacctctgctagttcgttggccgccattctgtacggtctcttgtaaattggagcggttcccggtgccaagtcaatccggaattcaatctctctcttgggtggcatggtagtaaggtcttcggggaacacttctggatactcgcagactatgggtatatcttccaatttcctcaaattcttcttcacggtgtccactgggatttccgcctcaatctgattcaaagagaccccttgctttggtgagtctggtgatttgtacactgctgtttctcccttctcgttggtcaaggtgactgtgcgattcgcacaatcgatgactcccttaaacttggtcagccaatccatcccaagaatgacatctaggtctttggattcgagaagaatgaggttggctagaaatggtgatctttggatttctattagcactgaagggctaaaactgactgaggttgagctatttcccgaggtatgaaccctcattggtgtgctaagctcttctttccttaacccatgcatcccgacaaacttctttgaaatgaacgaatgtgttgcaccagaatcaaaaagtattgttgcagggattgagttaacaggaaacgtacccagtacgacctctggtgctgcttgtgcctcctccgcagatgcgtggttgacacgagcctggataaaccttggcccggcacgcctaggcttcgggcatttgtcagcgaagtggccaagctcgccacagttgaagcaggaccctggttttgctccagtctccctcttggcttgcgcggacgggcctgactgtgccggtgccgttggtgggcgtggagctgcaccgcggttgggctgacctccatggtggttctgactgccactggcgccctggggaaagttgctagggttgaacgggcggtactggcggacgatcatggtggtaggtccaccctgctgcccgggagcgaagcgcggcctctggtgacttccctgaggtgccctgaactgagcggccttcctcttcctgtccatcttgttgcgttgatcatcctgacggattgccttgtccaccagcctttcgaaatcggcgtaatctccagatatcaactggttggttagctcatcatccagacctgctaggaatttttcctgcttctcggcgtcagtgcggacatcctccggtgcatatcgcgcgaggtgattgaactcatggagatactccgtcacagttctgttgccctaatggagtgcccggaattccctcttcttttgtgccacgaccccatctgccacctgcgccttcctgaagctacgacagaactcttcccaagtgacttcagtgcctggcgggcgggtggccatgtgattgtcccaccaagctgacgcaggaccttgaagctggtgtgtggcgaaagcaaccttctcctgatcattgcactgcaggagattcagcttcttctctatggcatggagccagtcattcgcctccatagggttggtggtgctggagaaggtggtggcctgacacgtagaaactctagcaacttggactgagggggagggggaccaaactactgatgctgctgttcggcgtgctgcagcatccgctggtgcatctgctggtgttgctgctgcatctgctgcatcatggctgccatcatctaagtctgatgtgccatcacttgggctagcgtcggattctcgggaagtggtggcggaccattgccggaattgctgttgggatgcacaccctcagtgcgctcttcgccgttgctgccctcacctgttgcgcggctaccattcctggtgtagaccatctggaggaaaagcagacgggggaaaagaagaaaaatagaggctcaaaaactaagctttattatataggaatttaaactgtaattgttctgatctgaattaaaacacttaaaaagcaagcaaaaatccttattaagacagccatatcataggcacatgatatcgaccgtcgactgacccacaagcaagcaacctaaatacacaaactaacaaacaaatgctagacagacgataaactaatggaaaatgagcctaatgctcggaacggctcctacggtcggtggagtcgaaggcgtcgtcctgctcgtcaccaggtccctctgagcgactcctggagcctggcagataagtctcgccgctgcccagctctgagccactggatctactgctgctgagatcgcagctgccactgggagtagcagacaaccaacctccgttgccactggctggacccctagcggctgatgctggagcgaaggagagagcagacgcgggagctgacacgtgaacgggagctagagctggtactggagctgcaggaactaccggagctgcgagcggaactggaggtgctgcgggagctgctgatggaggtgggttcttgggcgcaagctggatgcgcacgggtgcagtcgtggtcttgtggggcgtagtgcggatccggactcctcctggcgcgggaagaccctttaactgagcattatccctcttcaggcgcgctatctcgtccttcagagcgacgatcctcatgagcttcccatcattcaaggccttggacgccttgtgcaagtctgagtgcatcctatccaatcccctcatcacagcacacatgtgaccaaaggtagtgtcgttctcgccggctgtcggacggaaagtactgacatcatcaccgctggctcgacgagggtgaaatcggtacgccgtgtcgtggaagatgtagttgtggcgctcccgtagtctggccatcatcaggtatgctgcctcctgacaggcgtgatctgctgtgcctccggatgcctcaaccaccatattagctaggcaggtacccacgtagccgtgaacctccaggcgaacacggtgaggaagctcgccactgagcggtggaacagtcgtgtactctggcgcgttggggtagcccaccaccagcgtcatacgtgccaactctgccacaaagtcaatcatgccttctccgcggtggttgggtgggtggccggccatctagagaagacaaaggagtaggatcaatgcatgctcaaatccaaatttaaataaagcaataaaagactcaaataagagaatcgaataagagcaaaattttatgcatagatcgttttgcatgagagcgaataaataagacagactcacataacgataaaatattggggaaattagatacatactaataataacagtaagagcataaataccttgcaacccatgttcctgagctaggacctaatgcatttcacccattaaatcccaactgactgacgaataaatctcaatagttttacaaaaaccctggactgacttgttttgacaaatctcacttaaacgagcgaccaagatttttccccttgaaccacaagaacagatcccaatttttccggaacaaatccaattgcaaagaacatatgcaatgaaaaggattcagagggctcttaggtttttccatttggcttgtcctacggtcaaggtcggctctgataccaacttgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcggaaggaaagaaagacaacaggagctaagccttgactagaactgcagcgggaacaccactccacaggcatcctcgacggcacggacgaagcctactcctcagagaaacctccatctgacacatactcgtactctggggttgggaaaaatagagcaaaactgagtactacccactgtactcagcaagtcataccggaataggggtatgatgtagagaattataaaagaagagctagagtggttcatttgcataaagcgagcatttataaacagaagttgacagatttaaacagttgtaataattaattaatattaactatccactgtccaacgctatcccacgttgcaacaggcccaaccatccacctaaactatccaaattcaaaagattacactagggtgagactaatcacggtgaatctggttgaccgcccataaccgcgggcacggctattcgaatagttttactctgatcagaggtgtacaactgtatccacaagacacagccccacgacacgtttccgtgcgccgacatgccaccacaacataccggaaagaggccgtgacaagacccttcgcataaccccctctaaccaagcacaccacacctcaggtttcacccccactcctcgcaaggcagcgggcagtcccctctcgtgcctaggtgaatccgcaagccgcataggccgtcgcaggtcccatccaaactccatcacgcccacccttgcctggatgcgtcggctagaggaaagctacgttacaagccaagccgttgcttacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtggcactaatccaacaataccattagaaccaacagtctaaacattaataagattttccccattgtgcactagttgaactaagcatggctaagcaatccctagtccaatctctagtcatgttataaccctaagctgacgaagggacatggtacaacaatagcatggctatgacaataggtaaacatcccatagtaacattataaaacaatgcaatatttgaaagaaaacaatagagcatttgcaatataggatcaacatgttcaagtgacaagcatgacttgccttgctctgctgctggaggaacctcggcgactatttcgaagtacaccggagcgtcggaggaaccggaatctagcgacatacaaagcaaacattgcaaacaggctataagactactgaaacagggaacaaaaccatttttaatggattctacacatttttcttgatttactgagacttgaatgggcttaaacggagctcggatgaattagttatgaattttagagattcactgtgtttattactataaaagaaaaatcttaaatcatttattgcgcaatatattccaggctgacgtcatcaaggcggggcgcggcgctggcaagcgggacccgcatggcagtgactcggagagggaggaagggcgccgacaagcgggccccaccggtcagcggctcggggagggcggtccacggcggatcgggtccacggaccgggaaggagcggcgcgccacgcggcggccgaaccgatggctggtgcgcgcgggcacggcgcaaaccggcccggcgaccatggcgcgcgacggcgcggcacacatgcggcagcggcgcaagacggcggccggcggcgactggccggcggcggagagtggcggcgtcgcggcgaagcggcagctacgtggctaagcggcggctaaacggtgcgggagagagagagaaagaggaggagaggcctcaccgacaacgatcgacgacggcgagcgacggaggacgatggcgacagcgggacgagctccggagcctcctaacgaacaaaaggagagggttagagggagagaggagggtgcgagagagcgagggcgccggccgaaggcggcggccatggcgtcactcaccagcgcacgacggggatggggctccggcggcgaatctctacggaggaggggtggacgaggtggacctcggccgcgcgaacccaacggcggcgacggcgcggtgcggcggcgagtgtagcggcggctagaggcgaccggagtagcgggagaggcagcggcggatgggcgcacggcgcgggagcgatggggagctcgggagagggaggtgaaatggggaaaaagcgagagggagcgacggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6067 - DNA, 3055 bp, Oryza sativa
ggctctgaaaattccactaaaaatcctgttagtgaatttcgacatgtagaactcaagaaaaatgccacatgccaatttcgattattatttgcattgatttaatagggtttacttttgctttgcaccggtattttcttagggtctcttattaattcacttttaggcttaggaggagaacttcagggtgtgacagtggctcaacaagctagtctttatggggaggggggaggggagggtcgaagaggggggaaatcgtcatgcttagagggatgacatgaaaggcggtaaacataggccggtcagcgagacgatggtactggagctgtagagatgaaggagggtggtgggccactggtagcaggggcaaggcaaggagagtagttaggaggccggtagtggtggattcaatggctcccgctactggagagaggaagacaacgagcgagggcatctaattgctgccggcttgagaaggagggcgtggcgaataaggcccaccgaggcaagggggtcgctggcaccattgcgacttctagccaagcgcgaggtcgagcagtggacgggcatgctgatggaactaggacttaggagcgaggaggggggagaggtggggttagagttagagtactatacaaatctcaaagcaatcggatggtgcaaaatttataagattttcttggagtgtttttgtgtgaaatgcaaataaattatcccttttttaagtaggataaccaattgattatccatggattccatggatgatctatactactattaaaagatagtattggtggtggtgagtctgccaccagcaccatcacttacatgtggcccatgatattaggattttgggcagtcgtttatattatgtagactgcagatctttaattttctaagcatgatatttttgtttgtttcttttagatgaaaggttgtgtttcaaccaattaaaaatatagttttttttaaccaggacttaatattgctattttcaatactgttgcaacgcacaggcatttggctagtatagtaataaatatataaaaaggcattaaaatgttgttttaagagtaatattggagacaaacaaaaaagggtttgttggaactatgccaccctatatttgcaaaatttgagatataccacccgtatctccgacatgtaggacccacatgagtcaatgacatgtggaccagggtggcatatcacaaatttcgcaaaatttgtgtggcatggttcaaattgtcccaacaaaaaatgtgtaacatagaccaaaagagactccatgtattataacatcataggagatgcaaagatactctatacattataatatcgtaagatcaaagtactctatatattataacatcgtaagagatgcaaatagacgagcacatcacattgactactctaatatatgcatgatcatattgacaagaattggtaagcagagttgtcaagggatgtcatcccgacgtcaacacgatggcctactactagagaggaggaagaaatagatctagcctattgcttgttttcaatttttgatggttcaactcaacgtattagatgtttcactagttaggtaaaaaatgttgcagtgattttttttggtattctttttgccgaaatcattcggatctactgatgtttcagtggtccaaaaccgatgtgtcatatgttgtaccaaaatgtttcaagtgtaagttgattgtgtttcatcgtttagattgttgatgttcaaaagttgagacatttttgttcgaggaatgaaaccttttttttctaaaatgataaaacatgcggaacactttgcaacattttacgtctgatctgtagtcgccaccgtaaattataaattaggttaaaaagtgagctactcctataaattagttcaggaattactctcatatatacatagccctctaatattggtcggatggaatgttagattttcttttacctcaccgcctcaccggtaaacgagtcaccggctatcctggccgggcaccccggtctaaaaggcccaatcccatatgtggaacaccgaacgtccctttggacggaccagattgctccgacctcaccgtctctcttctttctccccaatccctatagctctcgcttcgtcaaattctccggcgtttccagttcaaaaataaaaaataaaaaatctccggcgcaaatcctcctctccgccgccgccgcctccacctccaccgctcgccccctcgccgcgcctccactcctcacaccacgctcctcctgacctcctccctcgcgcttctccggcggcgcctcgctcctctgcgcggaccgttgcccctggccgagcgcggcgcggcgcgggccgcccgcggggggatcgggctcgggtagaggcgggcgacctggcgggggaagtaaggggtcgcgcgtggcggggagatgatctacacggcgatagacacgttctacctgacggacgagcagctgcgggactcgccgtcgaggaaggatgggatcgacgaggccaccgagaccgccctccgcgtctacggctgcgacctcatccaggagagcggcatcctcctcaagctgtatccttctgcccctcctcccagatccccccaccttttcccgccttgttcttatgcccaagtcaaatcgttaggggtctctcaagcatgctagggtttccagcggttcagtgattaccatccatgtttactagcgctcgctgaatcgcaattgatagggttatttggtttgcttagttttagttcgaacgttgtgctttggattagggttttggttttgtcagattagagatgcttctcttttatattatccagctaaactaatgaaaatgtcaatgttttctctttcttttcggagtcttatgttttttttcaatgtagaccaatacatcatttattcagtttgatgttctcaagaagattaacattatataaggttacacgcatcactgaatcttgataattttgattccaatgaaaaaaaatgcaaataaatgtgttatgtttccttgtttatgatataggagaaaatgagg

SEQ ID NO: 6068 - DNA, 3406 bp, Oryza sativa
gttgtcggttgctgggctgaatgaagtggtacttgtagtaaatggtgctcgctacaccatcttatcttctgccttgcagaggtaaaataaattggatggaattgatagttgatgtaaaatacataaaatttgtcttctcaagccattcaggttatcagattttcacaaaatgcacaagtttgaaatgtgtaaatttttattgggtcaggactcaggattatgtgggtatggatcagtgtgctacccacatgttttaggtatgcattgcctcatgatttttgctggttaatggaatatgatggaagcagtaggagttggttgctagggtgaacgaagtggtacttaacttgtagtaaatggtgtttgcaacgccatcttatcttctgccttgcagaggaaaaacaattcggatggaagagagagttgttgcatatattaggctactttataaattatatactataagtaaaaacctttttctcatactgacctatttaggagagggaacaaatctataagtcaaatagtggatggatcacatgcgtgtccatgtttttacatcgattacaaatttgaatattctcatatctgaggttgaatttagatatcatcattgttttaacatgaaatgatccaaaatgccagaacatgaaatgtgcatcctatggagtatttgggaagcactgaaagtacactctgtggagtggcaaaaatgtttttcactctgttttgttagacatgccacatatatcttcattgcattttctagttaaaatagaaaagagcataatacaacatatccaatggaaaacattaaaccatatttgcatctgtcaaatctagatgagtggcttatgaattgggtagcacaacaaagaaacaacagttgtggtcaagccaccatatttgcatccattctatttcagatgtcaaataatttagttagtcagatgtccaaccaaactaggggtatcaatcggatacgaattatctgtagactacacaattctttaggttaaaatatggtttattatttccatcggttaaatagtttttccctctatttgattgtgtatatgtgttctacatttccaaataatgttatctgagccgtttgtattcaataaacaatatacatattttattgtagtttgcctaacagttttttctttttatgttttttccctgttcactcaatttaatataattattagttatgttttctaagaggttaaacgtccttaatatcatactgctacataaattacatggatattgaaaatccaactgaattacttatgtgtttgtttcatatttttattcatcacaacaatcagttttcctttttagtccgtgtgagcgtatttgaatatcttttgttatgtgcttaaaacatgagcatgaatgtgtaaagaccttactcgattcttattagatctgttgacatccctaccccataccgtatttcatgttgccacaattgatgtagcaaatcttcaaagatatctagttgggagatagtgattttcataattttctatgtagcttgaatttagctaggccccattcttgcaacttttattttcttttcttttttaaaagtataatatttgcatgtggtggattccttgacgcaccaaagaccacaagcagtgatggccacagcacaagtattgtttcatcgtttttactgcaagaaatcatttgttcggtttagcgttaaggtaagcaaatcttttgtctcagttactctgatcaaaccagtctttgattttatgagttgaaccaatgaatatctctgtttatgcttgcagagagttgctgcaagctgtgtttggctggcagggaagttggaggagagtccaaggagatcaaagcatataatcattgtcttccatagaatggaatgtaggagagagaacgtaccaatagaacacttagatgtgttttcaaaggtttatctgtttctttactctctgtttattttaaatattttttgaacctttgtgcacttcaaatcttgatgtctctagttcttgctctcttgctgctagagctgtaatacctatgcttttttttagaaaatatgtaacttttataaagaattatgctaattgaaagctgtaactatttgttgcagaaatactcagacttgaagcatgatctggtaaggacagaacgccatctgctgaaagagatggggtttatttgccatgtagagcatcctcataagttcatatctaactaccttgcaacacttgaagcccccgaactgacgcaagaggcatggaaccttgccaacgataggtacttcatttgaactaaacttaccttattgtagttagatattcttattgaattttatgcagttcaattatatcttactcttaagtcttaactagttttttatagtccttgggaggtatttctagttgtagactattaaggctgtgttcggcagcttgtgttcccaacccctctccctcgttttctgcgcacacgcttttcaaactactaaatggtgtgtttttttgcaaaaaaaattctataggaaagttgcttaaaaaaatccatttattaagttaattttagctaatacttttttaattatgcgataataagctgttacgttttccatgccggagggatagactcccaactggcacaaacgaacacagcctaattgtacctgttatcttataatacctcccaaggaccaaaaataataatatattctaccttattggtgaaattttgttttagtttagaattattggttctcttaaaagatttttccagcattgctcttgacttttctcttatagtactttgtttgtctcgcagatccttaccatttctaattaactattgaaaagcttgactaagtgataccttttattttctgtagtcatctgtctgtatcatgtcatatatgtacatgaatccttaatattctgatcagtgtaaattatgaatgagttgcctgtagtttcagaatgtaccaatttgctaattgcaacagcaaaaatcaaataggggctaaaatgctaaatgaactgtattctggacatatagttctcccttatgctatcatatgtatagagttgtagatagtgctctggtacagaatgataacagttaacaaataacaaatcttcccatgacagtgataagatccagttaacctagtgcaggtttgtagtttcagcaatatgaatgcagcattgttaaaggtgcccttagaccaaaacaagccttcaataataatcgcattagcttttggattttgaaaacttagtcacatatgctggcccaaattacaaggagtatgattatgctgtagaacttgtggatgaacttgatggccaatacaatatttttttataaaaaatatgagtatgttacc

SEQ ID NO: 6069 - DNA, 907 bp, Oryza sativa
tacagcctccccaagtcacaatatatacaagtgtataaggacaatgattccttcacgcataggaggacttctgatacaaatgcttcaaaggttaaaaagaatgattggactcgctaagtttaatttaaaaaattgttaccgatgtcatttttttgtactcacgtgcaggaaagtcctgcaacgactgttgcaagcgataagggtacccctgtaccgtcaagttctagccaggaaaaggatgcactgattaaggcagggtcagataaggtgaaagaaaaaggtgacgatgatgggaagacgttaccttctgaacccaatggtaaagaaggccctgcagtgaatttgaagagtgagaagtcagaatccaatgttgatcgctctcgggaaagagaaagagatagatcaagagggcgggaccgtgatagcaggggccgggactctgatcgtgatagcaagggcagggactccgatcgggagagggagcgtgatagagaagcagacagggataggcagcggagacaccattctaaggacagaagttcaggtattgccattgatttttctgctttggctctttttataagcatgttacgttttcctgatgttgcatgatgcccctccaatgcaggatactctgacaaagagaagtcaaggcaccgctcatcaagaggtatgctagcacattagcggccctccagtggaccatatatagttttcttatctgcttcattttggctaccttttcagatcgtggtgatcactacagttcgcactcatctcgtgacaaagatcggcacaggcggcagtaatctagcagagctcgaaaacatgtaaactgatgaagtacacgttgcactatcgtggtaaaattgccattgcaactgggctccggggtgtttgttatgat

SEQ ID NO: 6070 - DNA, 19994 bp, Oryza sativa
tgcttctaacccattcggctgctgctattccggagtcatcatcatcatcatcatccgatccatacatgtaaggacagacatgattaacttttttaaagttcttccttgcttttgcaaacctctgttcatgcaaggtcaccttctgtgcaagatgtgacaagctatcaaagtcttgagatgagaacttctccctgattggagcaatcataccctgaaaagccaaatcggctaactgggcatcagttaaactcaagctatagcacttatttctcatctctctgaatctctaaatatattcatgcacaggctcatcatgtctctggttgatcactgttatatcggacagttttatctcatataccccactgtagaaatagctgtgaaaatgcttctccaaatcggcccaactgttaattgatccatatggcaaagaagaaaaccaagtgaaagccgatccagacaaagacaaccggaacaacctaacccttaaggcatccacagccgatgcttcaccacactgggccaaaaaccggataatgtgttcataatttgacgtactatcttgcccttagaattttgaaaagtctggaactttgaaccggttaggtagagggactccctcaaaccattcagggtaaggttgccggtacaaatttccagcgtctttcggcctgagcccaaactgctccttcatcacatccgcaatcatatcggcccatggtcgttgctgaggtgctccttgaggttgttgtggcatgagctcgaattgattgtactgaggaacaaattgaggttgagccgatcctccctgctgatattagacttgcggtgaaggaggttgatactgataattcaaattgccccctggtaatcttgaaaatttggttgaatattgcgcaccaaatgctcaggaacaacttgaggtaccaccgtttgattcggttgcacattatggaccaaatgctccggaacaacttgattcgcggcatgctgccttggctgattattaggtgttgcaaacccagccgatgcattcatcgaggcttgttgttgaatcagctgaataacttgttgccttaacagtgtttgctgaattggttgcaaaatctgccgcctaggtggcgtctgctgaattggctgcacaacctgttggattggtggcgtttcttgaatcggctgcacaatctgctgccttggtggtgtttgctgaatcggctgctactgggttgggtcaacagtaggttgaggaggtaagaacatagctacaacctgaccttgcgttagctgattcacattctgtccactatgctgcggttgctctctaaccaacaaccggggattcactaattgacccggcaccgatgatgctgcagcaggtgcaagagctgatactggtgccgtcggctgagccgatggtgcattgggaggaattggttgaacagctggctgattatcagtgactaatggccgataattcgggaacacccctcctggtagataaaccggtcctgtagcctgatattcagccattgaaccatcaacccttgtcttcaccatgtttgacaaagtgttgactaatattccagattgattgatcaaagcatggtgcacggcatagtcaacctgatcctggatgttgttaaactgtaactgtgccgcattgccgtcttgattaaggcctccaccttgaattccttgagagccaacaccctgaactccttgagagccatcaccttgatttccttgaaagccatctgcagcacctttatactcggttgagctgcatcatgtcacgtcccaaaacgaccctaaaatatatcctttaaattatgcctagaataattaaaatccgtgtgaaagcctccaacaattaaaatgtgcaaagtaaaagtcaaataaggcttagaggatttttttatatttcctaaaagcctaaaatgtgtaaataattttagtggaatcttcagagcacaggtaataattattaaggaataaacaaagttgaaaaggttttataaaaagaaaaaccctaaaaaccatccctccctctcttaggccggctcggcccacttccctccccctctctcctcttcccccgcggcccactcggcccctcccgcgcccgcgccgttgacgggcgggcccgcccgccaccctcgctgacgggtggggcccacccgtcatgcgcttcctcccaccgctcccgccgcctcgcccgcgctagcgccgccgccgccgcgaatcccgccgcctcccgtcgtccccgcgtgaaatcaataggggggaattactccccgtgatcccctctccctttccccccatttttccctctctctctcgcattcaaacggccggatttgctcccgcaaatctcgccggcgccattgatggcggccggacctcccggccggtttccttccttccccggccaccctctcccccttccaaccctatttaaaccctccccgcgcctccctcgcccgtttccgccccttgccgcactgtctcctcgccagaatcgagctcgcgccgtcgccctctctctcctccgtcgccgacgaccttcggccggctctctccactcgccgggaccgtttcccgccgcggcgtcgcctcctccggcttcgccgcaccgtcgccgtccccgtccaccccctcatcgagctcgccgaccgccggagcgccaccgtccccgtcgaccggagccgcgccgccgccttcctccgctccggccgcctttttcgtcatcgccgtcgacctagggtgagtcgtggaccgccacctcgtttccccctttccctcccctctctcggccgccgctccgccgtgcctatggccgccgccggcgaccataggggcgcgggcgcgccgcctcccgccggctgcgccgacgtggccgccttcgggcacgccgagcggctgccgcgtggggcccagccgtcagccgcctgcgccctcgggtgcggctgacgcgtagggcccacggcgccggccggtgtgagcccgggtgcacccggtccaccgtggaccgtgaggctgccgcgtgggccccactcccgtggacccggtccgcgcgccctctcccctcggctgacgcaataaaccatttttaaattaaaatttaaatgaagaaattcgtaaatattcatttaaagagcatataaacttcaaatggccataacttggccattcgaactcggaattggaccgttcaagtctctaattttctcttaagaagtcaaaaacccatttttgtgctttgttcctgcttgttatatggagtttattagagtaaaagcctttttcctttccgttggtcgtgtagacgctgcagcttcggaagatccgctctacgtggaggttgaagccgacgtttgggaaagcgagcaaggtaagtcacatcattcttgaacatattgaatcccagtttataaaattattttgatttaaattattacattatcgctttatttaaattcccgcgttatcactgttttatttagccatgcctttttacctttgttatgaccttattattattgttattgttattattaccttgttcaccctagaataaacaaaaccccaactagtggatactgtattcatggtaccactagtatgaatttaggtagatgcttcgctgcttaattaggcaacattaggtggttttacaactctagactttaggaatattcttatcacctggacactatggaatggttggattattgtggaattggattcacacctctccctctattcaaaatcctcaaaatggttttagcctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaagtacacggatggagatggacgaagtcgagggtcgatggacatctctagggcaaatgaaggctacacgagctgcggcccggtagtcgagatgtcatggcacagggctggtgtcctgctgctaggggctcagtcctgcctacctgtcccggaggttccggccgtaggtggggttcggtcggtactcttgtctatggctaggatgggttggaaactatgtcacgtcttccgtccgtataccatggtggtatgtggcacgtggttacacgtgacgaagatgtgtcttgtgggtaaagatgtacacctctgatcagagtataacctattcgaatagccgcgccctcggttatgggcaagcctagcaatgtacccaagttagtgttttaattcttaaaacctgcttaacaactaaaatgtggaatggttggcctgggttggttgggacgagctgggacctagggtcgggttgccagttcagtctgaatcatcgtaggccttgggttaaggcaggttcgtatgggttcacggccttgattaataatattgcatagctctaggatcgtgtttacaaagtagctttgagcaactaagtgacttttaatgatgtttactgcaaaccctaaccccctatattatggctcccttgtactcccttgcatttattttgcacttatgggtgtgtcttgttgagtacggtggttgtactcagtcttgctcaatttttcccaaacccagaagatgagttcctggaagatgaaggctttggtgtctagctcgtgcctgccgtcaagcgcctgtggtcgtcgccctagtcttccgctgttttttgtttgtcttcttgtgtgctgggccttcgctacccatgtaataaattatctatttacgcttccgcttgttaaactctgaattgtatcaacttttggtgtaccttgcctcctgggacaaggaataatacacgcacgtaaggaacgcccgttgggttatttccggtcgtgacacatcatctgaagcttgtttcacttcttcatccttagaagaaccggtcctaggaacatcagcaattacctttactttgtacttctgaaccagtgttcccttgcgggactccgtgaatgagctcaagaactgattccgtgcttgctgcatcattgtatcaaggtctttttgctgctcaggtgtcaatttatccagagtgataggcacaatgttgtcttcatcaatctcagatagacccagcttcaggatcttttctttaacagagctaggaccagcctggacggcgatgctggcaatttctcggccatggggaaaactgctgttgtgattctgacttctgatgggtcccaccaggcgtgccaaaagcgtgttgatgaaaaacacgaggcctggaagatctgcttcacttcagtgcaggtccaaaacacgctttcgggtatgctagcgtgccagttgatttgatcctgcaatcaacaagaaataaagacaaagaaaccgtggttaaatccataaacgatagccgatcggctaagtgccgatgacatatcgtttatctttgagccgatgtcatatatgcatcgatcggcagttataaatagataataaagaactaaatctactcgatcggctgtagacattaacaatatataatcgttatgtcgatatatacttaaatcaagtaattgggatagatcggtcgccatgccgagacagtataaatcacttagattgaaatatatactaacaacaagactatatatgttcatagcatacccgatcagatagatctagcctgtatggctaatactccgataccaccctatgttaagatattaaagcaagcagaatataccaaacaaaagcctaatatacttaaatgcaataagattttgacataaagggtagatttaacatgtcaataaagcatataaagcaaatatagttaaatcaggtaagatcggctgaaaccccgatactaccctaatcggcaaccaagaagcaggctagagattgagattctaatcatcactcataagatcaaactcaactgatgcagctataagtatgaaaagaaggacaatatctagataatcaagccattggaagtttcatagagtggtggatatcatatataatctaagccaacatcgatatttaacctaatcggctgccctctattgatagatgttagccgagtgtaggttagatagtgatattgccagagattatataagatatatgataactcgacgaattacataaacaagattagagtatcataaatatggaagcactaatcccgagaacgcaagccgtcataacaagttttacctcttgttgaagatcgaaaccgatgcagctcaacccgaatgcaagaactcgtcgaaataaaactaaagtaaaaaagggtggcgatgcgccgagattgtattgaacgtgtgtgttcctttgattacatagggctcggggtctatttatacccgagaattatccaacatgtccatatcggacatgactcttatccctaacaaactctaagatatcataagtctttacggcagacttttgcccaaacatatctctaaaaaatttacataaaatatcctaactaatagatacagtcgccttctcaggactctatccatgcgtggcaatcatcttgaaacatatcaactcgacctgatgtcgtacaccaagttgtattgtcggaatcggctgtatcacctaacctagtctgactcgaacttagccgatcccgatcgtagccgattcgaactccagtcgattcttactctgtttccgcgaccatactcatctcttattccgcttcgatctaatcttcttctccgatactgatattaccaaatttggtcgttaacatccagccaccccaccggatccaccaacgcgtcgagctcgttctgcacaaagatggtccccgaatactccttccacggccgcgccatgtacgtcttcgccttctccagatccgggtgcggcgccacaatgcggttgtgcagccccgtccctcccgcgacctgcgccgttaattatgatgttcacttggttccccatcggcttttgcagctggatcaagcagttctggagcaccacctgcatgcatttcatttgcttttctcaatatttgcttattcttcttcgtcgtggtggtggtgttaattgttggatcaaaagaaagagaagaagaggagtttaattatatacttgcctgcgagttgcagtatatgaagtcgatggtgccagacacggagcagtcgcgttagaactgccgctgcgcatgcgggtagagcgtgtcctggtacgtcttcaccttgtccgtgaacttctccaggtccgggtgcagcaccaccatcacgtttggctcgaattcctccggctcggcctcaggccgcggcgcctccagcagcggctgcttcccgccctccgacatccacgtcggcatgccgtcctcggcgagcagccactgcccgatgctgaggctgccgagcgtcgatgagaactggtcgaccacggcgacgatgtcctccatgagctcctgcgagctgttgagcgcgttgggcatcttggcagcggcatcggtggtggtgttgaggaagtcgtcgaggcaggtgccctggtaggtgagtgcggcgctgagccacgtgcggaggtcgtcgacggccttgttgaaattggtcatatcgaagccaccgagcttgtcgaaggacgtgttgaggtcgtctatggcgtacccgagcagctccttgcaattctgcagcgctcccactattaaaaccgctggtgcccttcccggctcctactctacctctccgtcgcggccgccgccctctctactgctgctagaaggggaaaggggaggaagaggaaaaggaagaggaaggagaaggcaaggagagggagagagaagagggaggaggaagaagaaaaggggagagaggatgacatgtgggcccacatgtcagtgggtcccacaatattttttttacatatgggtccctcttttttttttttaatgccacataagcgacacatcaatgtcaagtgagacgaagactaggtcaactatgccacataggcgccacgtcagcgaaaataaccttcaaaaccagctagggagtcattttgcactggttttagtagttgggggagtcgttttatccggttttgtgattaagggatatgatttagactcaatctatagttgaggaagtcgaattatactttttcctccccactggcccacatcattttagcccagatacaagctagggttgggcctcccagcgaaggccataagatgctgagtaatccagcaacaccaccacacaattaccgtattccttggattataacttcataagcaaactaaagttttgcatggcgattattaaaaaaaaaagctttgcatgacgagaaaggtacacatggcactttcacatattaacaggattttaccctagccatgcaatattatcaatgttgtccctcttccaaactcagcgtgaatgcgtgatgcaaccttccaactgcaagaaattctctgaaagagtcagcttcagtaagtgaaggagacacagcttcagcatcatataaaaaacgatgttgcgcttgtgtaaagttaagcgcctatgaattgatcaagacttttttacacaccagagacaaccataagttacacatgatatatggcagtaaatttaaagggaccaggtgctttgcttccagagatcaacattatgcctaactggctaaatgattcgatcagcagctggtagacttcaggcaccagccaatgactcgatcagcagttggtagccttcaggcaccacgctctggttctttacgcaagcggtgagggcaggaacatctgcttttatgtctaggaaagcagcaaccaggaggagaaggtggaagtccgagatccgcttaacaaatggtagatgcttagcacgatccaggtggctcttgagcgcgctcattgctacagggtttccacggttctcgataggaaagccggttgaaagtggaccctacatacacaaaataaatataggatgttaactgatatatctttatggatagaaggtatatgcatataatcgactaaaatggtataagagcaaatgacacaagctcagttggtggggggtgtgggtatctcttctctattgattcgattccaagctcctctgcatctttcatttttagttttaaaaaacaaaaattaaatgatagcagagtgttgaatcattgccctgttccctgggtggaattatgcaagacatgcgagatgtacagcccttttagaaaacaaatcatttgcttttcttggagagacaatgttaaaaagaagagtcaccatcattttgaaacctcaactatcctgaaatcaggtgtatttcgaaacaaaaggatggtggccatgtttatagtctaaatagaaaaggttcttgattaaacaaattgacaacccacaatgtaatcaccaaagcagtaaatgaagagattgtgcatatgaagattgatctacgccccagaacacaaatctaccagaagtaaaatgcaacgctaccacattcacagttatctgattacgctagtttctattatggacatcaaaagatggaaaaatagtagatttctagctgatcccttccactctaatcactggcccagtacatcatgatgaacaaatataggtggcttgtttaggaaaaatacagatgcagcactgtaatttaacttccataatcaagtgcatgcgaaattgcccaactaattaatgatgaaacacaacagtttcactgaagtatgtagccaggtgcatattggcttgatgcatggactgtacagtccaaattaaacgtattttcgtttgtcagcaaacaagacagaagcttacccccaattttaagtgtttaaagtttaatgtatatgatcatcaaatgcctgatgataagtaaaggtaagttaatatagatgatcttacatgaagctcaagttattccaatagtctaattataaatttctgtaagtgaatacagaagatagattcggatacaggttgtattgtgacattcagtttgccacgttttctttccacatagggaatcaaatactggatataaaggtaatgaattattagaactttttaaagataaaaggtaaatgttcagatggagattcttatattcttttcaaagtagatccatggaatatctgagaaaaagaactgttagtgtattctaggtcagaatatcaggttcccctttattctcaggtaagcttcagacttgttctacacacaactatctgtgtcagtgctaaagcagtacatgccgcatcttgttctatacaaaaagatcagaatagttatctttgatgcactctagcaccatccaaggcctcagaacactgccatagaattcttccctagaagcacaccaatataaaagaaaccttctattcttaggacctataatttttaaaaaaagaaaaaaaaaacttttcacacctagcacatcagatgcatgacatacatgacatcaccctggcctattccatatacacaagaaatggtttacactaaatatactagaagggcacatacacttggtacctcactaactctctctctttttttttggccaggcgaacaatggtatgccggccaaattttattaagaacaaaagagaaaccagtacaaggaaagcaacaataggatcattgaaggcacccaagcttgaatgcttagaatgcttaaaattagcaacaggacccccaagcctaaacatgaactagaacagctagaacaaaagcaaaaggaagaaacaaagttaggcagggcctcagcaaccctgttgttgtttccttgtactattatgccttctattcttaactaaaaagaggctgcatcatataagaactaaaaatcacccattgattctgctcttgaaataaattaaatggaatcacatcaaattcatgatatcagttgcatagatatcaagaatcgtcattcacagattcattctcatctagatcagctctatgaactaggatgcatcactgaaataagatgctcttttctagagtaaatttcacaaacactatagatattttggcatatctatcaaaaaaccacagatctcattgctaagtttgcaacagctacaacattttggcaacacttcctgacaaacacaaggctttgtcctgttccatgccaaataacaaaaatgtgtgctgcatgtcatagaacagggcctttgtgtgtctgcaagtggtttgaacaagtagttaaaaacttgtagttctatggaacataagagtaactatatctttacgttcttgaaacagttacttaaatcagtaggtcttcaataaatgtgccaaaatgcctgaatttttctacacatactccttttcttatatagtggttaattacttctcaaaagtggatctattattactagaattatgaatatttgtggatggctgtttactaacagtctaacactgaacagaactcatatatcatgcccttacacccagagattcagtttttcaagacagtgcaggaggccctctacgaagtttgaatcaaaaaattaacagaaacataatgactttgcagaaaataaatatgtcatgaattaattgcttgcatgcaaataggcactctactatttagtggataacacaaaggctctaattcttctcttgtattgggaaatttttatttctaattcatgcggcatatctaccttgttcgctgaccattatgttgtttcattgtcagttttacatcaaattactaaaacgagcacccactcagatcacctgatgattcaaggtttcaaacatgctgctacccagtcaagtgttaatattgctatgttgtaggaagcaaacttatttagtaaactgtaagttcattatactatgcaacagagtaggaaagaataagaatacctgatgatcagagatcttgacaggcaccaggaagaagtcattgtccacctccatagtatcctttcccccagccaccacctctttccgcatcttggacaggcggggatcgtctttgtccccaatctccgtctccagcacaccatccttgaacagcttcacacaaatctcactcatctggaacgcctcgaagtgcacatcaccggagccatcatcccccacctcgagcttgactatggcggtgacccactccgggatcccgccctccgcctgcagctcggtggcctgaagcacctcgcggttggacatggtgtactcgccagtgtcgctggtcttcctcccgactgcctgcgtgaacaccaggccgacgcggcgcatcccgaggccgtgggcgatggcgtcgacgcgggcctcctcctgcgcgtcccgcatgagctggacaacgtcctcggtgccgacctgcggcggctcgtagatgaaatcgacgaagacctccttggtgtcggcgtcgacgcggccgtagaggaagccggcgcgcttggtagcgaaggcgagcgactcggcgacgtggagctggaaggcgttggcggagtcgcggtcgaaggaggcggcggcgcagagcggggcctcctggcgggtgacgcggatctggcgcgcgatgaggtcgtccatggtcatcttcttgccgaaggagccggcggcggagagggctttggggggaggcggctgggaggagcgggcgtcgggcgggtaggagaggtagacgaaggagccattggagaggcggagggaggagagcggggcggccgggtcggcgagcagggcggcggaggcggaggaggggaggaggagcgccgggtcgagggagaggcgctggagcgggacggggacggtgacgcgcgccgcgatgagacgctgcaggtcgccgacggtggcggcggccgggtccggcacggtgatgcggtccgtgccgtcgcggctgcggatgcggaggatcatcgcggcttgggttgggttggggatctcggtacttggcttgcgcggtggggtttttggttgcggatttatagagcgggggaaggcgagttgggggagatggagtgcgactcgactgcggaatctgtgcgggaggaggaaacgggacggcggcggagaggagaggagaggagaggggaggcgacgagagatggattctcgaagggttggaggctttggggcggtggttgcgtcttcgttggctacggtagtttgggtacacctggcccggtgcggcggaaagacgagctggtttctattctctggttttgctctgtaaaaattggattctatcctatgaccatctgtgattctaatggtgtttgaactttatttataaagataaagataaggattaagtgtctcacgtaagacgaggtggtaataacatgtgattaattaagttttaattattataaacttaaaaaatggactaatctgatattttagaacaactttcatatagaaagttttcacacgaaacatatcgtttagcagtttgaaaaacgtgccatgataattttattgtttgagctgctactccatcaatccttttcaaagtatgagagattttggttggacttctatgaagattcataatactataatgtatcatgtcgaatcaaaatatcttatatcttaagatgaaatgagtaatacttctacttagatatgtcctttattgctaaagagagtaaaaattgagctatccgaatgctatcgacctaactataacctacagaaaactttgaaaaaaaataataataatttagaattagcaatgacataaatataggcatgcatatgctggcctgctagattccaaccgaccgccaaaaggtgattaggtgagtatggaatttcacctccatccatgcatatcctctttgtatgctcttccgaccgagcacaaggccgttgacaccttattgacacacatgaacaatacttttccattattctttccttcttttcttttcaatttagtaacaagcattcacttgtgatctcactggacatgtatgctatgggctaacacaaacatggagaattttctagcatagagaaataaaagaagcattaaaatattaagcattaaacggtttaaaagctaatatctgaaaacaaactacaatgaaaaactaaaattaactctaaatttattaattttcaaaatgagtaaagtgcacggtcagtctctaaacttgttcatacgtgttatacagattccgaaattctcaaaatgtattttgttctcaaacttgttaaggtatgtcattctagtccaaattacaataactcttcggatcctatgttgcacacaaatgttagatttattttctttatattttgtactccctttttcttctcttcttccttcatgttcgtgtgaaaaaaaaaagacaaaataagataaggacaacacagaggggaaggaaaaaaagaaaaattgggactggaatatcagtgtggcatatcgctttagtgactatgtggcatgccatgtaggatactcgaagggtcatggcaatttaagactgaaatgactcactttaataagtttggagacccaaaaatgcattttgagagttagagaacccagatgacacaactgaacaagtttaagaaccaacaataaacttcactcttttttttagaacacgcttcacttttccaaaaattatttatttttagcactcgcgtttatgagctaacaataagttcattcgagcttttaaatagttagcaggtttaaatgatgctttatatatatttcatataatgatactacctcaaaataatctactattcatattttttattctcaccctttctcccttcatctattttacttacagtaatatatttttaacgcatctatgattgtatcatatcttatgtcaaaattttagcattaatattcgtccttaatttataagtaacgctccgaggacttctaccacttgcttgtagagtcagccttttcctccatcaccttcatcatcctcgctaacggtgagaccacaaggaaaaagggacatgtttcttgttcgtttgtaagtaagtttggagagagttctatcatatgtttatggtcttttaggatgtttatgaagttaggcttgtttagagcctcttaatggctactccttttcatgaggtctcttatgaagcctcatttttcactaggctctttttaggatgtttattgacttatttgttgagattattggtgacgaagtcagtagccattttaggtcatggcgccgaattattcaatatcatcagtttgttgttatgtctatgaataaagtcttgctgatatttgtcaatatgatcatgcatatattagagtagtcaacgtgatgtgctcgtctatttgcaattcttacgatgttataatatatagagtatctttgatcttacgatgttagaattatgatgttataatgtatagagtatctttgcatctcctataatgttctaatacatggagtctcttttggtctgtgttacacattttttatttgtctccaatattactcttaaaacaacattatattgccttttttatatatttattactatactagccaaatgcatgtgcgttgcaacagtattgaaaatagcaaaattaagtcatggttgaaaaaaatatatttttaattggttgaaacacaacctttcaactaaaagaaacaaacaaaaatatcatgcttagaaaattaaagatctgcagtctacatagtacaaacaactccccaaaatcctaatatcataggccacacgtaagtgatggtgctggtggtagagtcaccacaaccactactatcttttaatagtagtatagatcatccatggaatccgtggataatcaattggttatcctacttaaaaaagggataattaatttgcatttcacacaaaaacactccgagaaaatcttataaattctgcaccattcgattgctttgagatttgtagagtactctaactctaaccccacctctcccccctcctcactcctaaagtcctagttccatcagcatgcccgtccattactcgacctcgcgcttggctagaagtcgccaatggtaccggcgaccccctgcctcggtgggccttatccgccaccccctcctcctcaagctggcagcaattagatgccctcgcctgttgtcttcctatctccagcagcgggagccatcggatccaccactaccggcctcctaactactctccttgccttgcccctgctaccagtggcccaccaccctccttcatctctacagcttcggtaccatcgtctcgctgacctgcctatgtttaccgcctttcacagtcatccctctaagcatgacgatttccccctcttctgccctcccctccatcctccttctaaagactagcttgttgagccaccgcggtcactaaagctagaggagtagttgcgcacgagtctgcaagcaaatcgactggttcaaaatatataaaaaaaatccccctcgatttttttgtcaaatattatttagcaaattacgagaatgcttcgtctcgaacgttcaatgtgggatgaaatattagatgcatcatcgagtgagtcccaccaccgaaccaatctcctaccttttcctctccactatcaaacctatccccgttcccctctctcgcatctcactctcttcctctccacctttcgctccctggctctcagttgcttcgctgagatgcaatagcaggaggccggctttccaacctccacgaccaccattggtgccttatcactaccgtatcccgtcgaatccaaccacgctaagctccgggcgttagatctgggctggatctagggaaaggggcgcactagtcatgaagggaggagctcggcctcatcttcgtcgccaacggcaacagggatgatggcatatgcaacatggatcaagcttcagcgcaagaaggcaatgggcaatctttatggcattggtaagtagagttgtcaagggatggcatcccgggcgtcaacacgttggcctactactagagaggaggaagaaatagatctagcctactgtttgttttcaatttttgatgtttcagctcaacgtattagatgtttcactagttaggtaaaaaatgttgcagtgattttttgtggtattctttttgccgaaatcattcggatctactgatgtttcagtggtccataaccgatgtgtcatatgttgtaccaaaatgtttcaagtgtaagttgattgtgtttaatcgtttagattgttgatgttcaaaagttgagacatttttgttcgaggaatgaaacctttttttctaaaatgatgaaacatgcggaacactttgcaacaatatgacgcaacaccgtccgacattttacgtctgacggagatggagtgcgactcgattgcggaatctgtgcgggaggaggaaaacggggacggcggcagagaggagaggggaggcgacgagaggtggattctcgaaggattggggggctttggcctttggggcggtggttgcgtctttgttggctatggtagtttgggtacacctgtagtttgggtacacctggcccggtggggtggaaacgtgagctcttcctctggttttgctttggaaaattggattctattctatgaccatctgtgattctaaatcgtcgatctcgggagcttttatcgtttgagccgctactccatcaatcctttcaaaagtacgagagattttggttggatttctacaaagacttatagtactacaatgtatcatatccaatcaaaatatctaatattttaagatgaaatgagtaaaaattgagctatccgaatgctattgacctaactataacctacgaaaactttgaaaaaaattaataataattcggaattagcaatgacataaatataggcatgcaaatgcctgcctgcaggattcgaactgaccaccaaaaggtgattaggtgaggatggaatttcacctccatccatgcatatcccatttgtatgctcttccgaccgagcacaaagccgttgacaccttattgatacacatgaacaatacttttccattattcttttctccttttcttttcaatttagtaacaagcattcacttgtgatctcactggacatgtatgctatgggctaacacaaacatggagaattttctagtatagagaaataaaagaagcaaataaaaataatttctatgtaaaatattaagcattaaacggtttaaaagctaatatctgaaaacaaactacaatgaaaaactaaaattaactctaaatttattaattttcaaaatgagtaaagtgcacggtcaatctctaaacttgtccatatgtgttatacatatttcgaaattctcaaaatgtattttgttctcaaacttgttaaggtatgtcattctagtccaaattactataacccttcagatcctatgttgcacacaaatgttagatttattttctttatattttgtactccctttttcttctcttattccttcatgttcttgtgaaaaaaaaagacaaaataagagaaggacaacacagagggaaagaaaaagaaagaaaaattgggatcagaatgtcagtgtagcatatcgctttagtgactatgtggcatgccatgtaggatcctcgaggggtcatggcaatttaagactgaaatgactcacttcgataagtttggataccaaaaatgcattttgagagtttgagaacccagatgacacaagcgaacaagtttaagaaccaacaacacacttcactctttttttagaacgggcttcactcttccaaaaattatttatttttagcactcgcgtttatgagctaacaataagacggtagtgttaatacgtttgttcgagcttttaaatagttagcatgtttaaatgattgctttatatatatttcatataatgatactacctcaaaataatctactattcattttttttattctcaccctttctccctgttagaataaatgggctaggcccaatttatttttattaaaatctcaaggggccataataaatcctatcttcctatatagtttatacctactaagaagcatttactcctataaagcaagacatgcaagaagccacatcatcaacaattttatgctattagatcatattagtacaaagataataaccattggatcaagaaactacttattcatccaattcaatcatttactagttattgcgcatggaaataatattcatatattatatattatactaacaatgacgcttggaaaaataaggcatgaattgtattgcagtaataacacaaggcatatataaatccacattatcatatattttgtatatacatagagttacacctaaccatttaaaactacaattttgtttgacaataaaactacaaaacccgcggcaaagacgcggggtgccaactagtgttaaagataataataccaccttggagattaaaagtggagtatctcaacttaaagagggagttattgaaggctccctattgaccggttgaggtgggggtcggatagccacgcgcgcgcgcgacaagccaggcgtgggcgtggcgtggcgggcgagcgctgccgctcggctctctctctctctccctccctctctctctctctctccttttgcaacggctgagaattcaattcgcgagattacctttgtgatgggcgggcgaatcaattctgattgatcgcatcattactgcggcaatggatgcgaatcctctctctccctgcgctattaggacgagacaacgacccaattcacgagattacctctgtgatgggtgggcgaatcaattctgattgatcgcatcattactgcggcaacggatgcgaatcctctctctccctgcgctattaggacgagacagcgacacacgaacaggctctccacgaattctctccattgctggttcatcctctgtgctgagaattcaattcacgagattacctctgtgatgggtgggggaatcaattctgattgatcgcatcgttactgcg

SEQ ID NO: 6071 - DNA, 11255 bp, Oryza sativa
  unsure (1)..(11255): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaggttttcaacttcaagaaaatctagtgttgtcatctatccaagcatttggatttgcagccaatagatcacaatttggtatgcactatagtacttcaattggggctgcagccaacacttcttcacatggatgagcttttccataccatacaagatataaggagaaacaagtagttgagattgaagaggcaagtgaaagcagtgaaaaaggaagaagagggacacgcatcaattggactgaagatgacaatatacaactaatgagctcttggttgaacaactcagttgatcccatcaaaggcaatgacaaaaaataatattagtattggaaggctatagcttgagagttcaacaccagtattgcctagcaatgggcacaaaaggaaccccaagcaatgcagaacacattgggataatgtcaagagagatgtcactaagttctgtggattttattgtaaagctagaagtactttcactaatgggtattctgatcatatgataatagagaaagcccgtgaatggcacaaaagttagaacaaccaaaatactttcaccttggattatatgtggaaagatcttaaagaacaacctaaatggtgtagagtccttgaagagagtagccataataagaggaacaagatttctgaatcaggagcatatacttcatcatcgaaccaagaaatagaggagaaaacagagcgcaaagagaagtgccttgagaggcaaaaggcagcaaaacagaggaaaaaaggaaaaggtgctccatcaactttgggggacaagccaagtcaaaatatggttctctttcatgaagctattacaactaaagcagcaacattgctaaaggccgcagaagcaacactgattggagcagaagcaaaaataaaagagaacgcaagtgctaaaagagaggaggcaagggtagaaaaataccaaatgtatttaaaaattgatggagaaggatacatcaaccttcaatgaagcaaaactaagagacatgaagatgtgttgaccaattagctagagaacttgttgaggaataaatgagcagcaagcaatgtttgcaactatgcttattttataatttcaatgtttttgtcatatattaaaattatggattgtgttgatggttcgattgggaatctattcgtattgtgctatggaatatattaatataagtatggtgtaatactctatatatggaatgaaactacaatatctaagtacttcctatgctgagttcggtagccagagttcccaactcactctcctctttttccgtgcgcacgcttttcaaacggctaaatagtgtgttttttgcaaaaaaattctaaacaaaagttgcttaaaaaatcacattgatccatttttcaaaaaaaataactaatacttaactaatcacgcgctaatggaccactctgttttccgtgcaacagtgattagttgccaaccctagcagccgaacacagagttctcttcttaccatgactatgtgaaaaatatgtcgacagccatacatatactcccttattgaaatatgatgtgattattggatgtttatactacggatttttcaaaatctatagttaccaatcatattttactaacaattttgtaatatttgaaaacaggaaacacctgaaaatacatataaaatttcagttattttggatggtcagatatgtgcaccatagtaacattctcctatcttctataccacctcctctgtcccacctccacccattaaaagcacctcctaaccaagtgctgacgcctgccaatttcggtgctagcaaggctagccggacttaccttcttcaccttcccccccccccaatctctcctcctccacaagccgcacagtagcaaggcatcctgcaccgacaacttccttgtctcatatatctctccaaggcattctgcaccaatgtcttccttgtctcatgtatctctctgtcatcaaagacgtcaccatcgctcacgcctcctaaccacttcgggtctaactccctagatgtcgaagcctgcccaccatactcctccaaaaccatggcttcggcagtgccaccgccgtctctacacgcctatgcttcaaagtctaggaaacttcccctccctctctcccctaaccctcctgtcctagctcaccctggaacattgaacactacaaggaatctgttaatgcatgatgaaaaatttccgtcacggatcatcaaaaaaccgtcactatgtagcacctgtgatggtttcagagatggtcacggattgagcgtcatggattaacctctgtgacggtttaccaaaaaccatcacggattaatggaatcggtgacggttttaaaccatcacgatagagcccgaggcctagttagcccagcccaagttcatttcctatgacgaaaaataaccgtcacggattgaatgccacatcatcatggatgcttacatggttgcttacgtggatgatgacgtagacactacctcaacctatttattaacaggccaaaatcaaagatgggccaatttttagcccaattccatccattttcgcagctccttttcagccattttggcagcccattttcaatagctttacaacccatttcagcagctttgcagcccaattttgtcaccattttttggtgcccttttcagcccactactacatcgcttacagcccatatatacagcttaatttcacaactaaagcccatatacacagcccatgcaactaatagttgcagcagcaaatcaaatagaaatatcatttttccattcaatatcatatcacatgatttttcatccaacatcagattacaacattcaaagtgcatacaaccttgcagtttaccatggctcaagccaacaacaaatagagattccaagcaatgcatacaagtctaggagcttaatgaatgctgcggcagcaaaatgcaagcatgtatagcttagcttagtcaaaaattgacttgacacaagttagcaatagcagcaaaatgcatgtagtagcaaaagatatagcatcatgcatgaattaacttgatcgaacttgactgatcaaaagattaagtttccgcttccatctcagattgagtcctcttcatcgaacttgtagacagcttgttttccatttgagtctagcaagcaaggagcaaacattgttgttgatgagagaattaaaaataagcattacaaagagcaaagtttgaaacttatcttacaatagcctactatacagcagtggtgtagcattttttttcttgctgtagtggaactccttgaacaaatcaaatgcattaggttcttcttcattgtatttgtcacgctgaaaacaacatatatgcattatgtccagcaaatgtgtacagtgttgaacttaaaaaaaaaaggatgaatctagatagcatcaaatcaccgttgagctgatcaaatcaagcatgatccatggtatcccccaagtaagctgttttctgcacctctttttctttttgttggcaaatggattaaaacattattcagttttgaagatatctgaaaatatagcaactgtggatttctgaaaataaacacattctttttttttatctaaaacactgttcttttttttatctagtttctatgaaactttcacgaatattctttcttatttatgactgcacttgcatttgcagaaacaaggaattcagttttttgtcagagatcatattgttacagcatgaattgactggcttaactaaattagaggtttctgcattcatcagattcaggaactttgataagcaactagcatcagcggatagagagagatgttacagttgggatgcggtcgctcgcagtcgaagttggggcgcttcaccaatcaccagtccctctcacagtagcagatcccgcctccgccctcctgcacatgggtgaggcacatgcgtcaaaactcgccaagaaaactaatgcaagaaacaaagaaagaaagactggcgcctctcctcttctttttcatccgtgtcaaaccgtcctcgcccaccatgatcgcctaccgtgctccctatgctcacgcgtgcagcagtgcggcgtcctcctcgagcagcctctcgatggacggagctcgcgagatgtaggaagcaggcgcgctgctgggaggggatctgcgccctgacctgctgccggagaaggaggaggaggaggactcgtcggagctctccctcgccggtgcttcttccacctcgattcacgtcaccggtggctgccccggatgctgcgctgcacgccccctctgggcccgagaggcgccggcggcagcggatccaccgctcccgcgcctggcagcggtggagacggatgccggcatggcaagcggcgaagggggaggaagccggcgcggtgagcggcgcccggcggcggcgaagacggaggccggcgcccagcagcggcggagacagaggccggcggtctcatctgcagtagcgcctcgcgtgtggtggcggcttatctgatttggatcggctagggttgaggaaccaatgcgattttactaaaatacccatggtgcatccgaagttaccactaaaatatctggacaaaatggtcatttcacgttgaaattttgatcaacatcccgccacactgaaagtttggcgcccgctgctccttcgggccgccggcccagcgtctgtttttcctccctcctctcattaatttcaaaatattaaaacttcaaatcgaattttatcatactaaataaatttatgtgaaaaagatgtcaaaaacaaagttatataacttaatgagatctacaacttttgttttggtcattttgctatatgactttgtatcaaaaatttgaatttgaatttcaaattatgacaacttcaaacaatattttcaaataataaatgatttcaactgaaaaagtcatcaacaataaagttgtacaactcatcaatatttacaacttttgttttggtcatttttctatatgacttggtttgaacaatatgaatttgaatttcaaattatgacaatttcaaacaacattttcaaatactaaatgatttcaactaaaaaagtcatcaataacaaagtggtataactcatcaagatctataacttttatttgggtcatttcttcatccgttaaagcgaattgtaacattattcacaaaatgtacatatctcttatacagtttataaactatgagagagatatgtaaattttataaataatgttactattactttgtcggatgaagaaatgaccaaaataaaagttatagatattgatgatttatataactttgttattgatgactttttcagttgaaatcatttagtatttgaaactgctgtttgaagttgtcataatttgaaattcaaattcaaattattgaaatgaagtcatatagcaaaatgaccaaaacaaaagttgtagatcttgataagtcatacaactttgttgttgacatttttttttcatttcaaattatttactaccagaaaaattatttgatttttcttatatttaaaattcaaattttatataggtcaatcaaagtcagatggagaaataaccaaaataaaattgatagatctaattaagttatacaactttgtttttgataactttttcacataagtttatttagtatgataaaatttgactcggattttttatattttgaaattaattgagaagagggagctaaaatggacttctcggcgaggggggagcaaatgggctaggctggcagcccgaagaagaaggaggggaatgggaagccggcccaggagggagagaaaggctgcgggctgagggagggagagagtaacacttgggccaaaaaaggcccaaggacagagagatattttaatttattttccatttattttaataggttaaatgaattttgtggtattaaaactagttattgagctccgaaaattcacggaaaattttagagaataatttagaccgcttagaattttacaaaaatatttccggccatgatttttaaaggaaaaatttagtttcctgattaattcacttgattaaattgctttaacttttaatatatttcttgtagtgaaaagtataagtgagtgcatacataatcaactaaaagaagtagctatgaatgttgctggataactataggtgttaggttaaattcctacaagctccaaatattttttgttcgcacactatatatatgcaaatattttcagttttaccatatgcaacatatacaagtaacaaattagtaacaaaataatttagttcaaaaaaaatttgtcttttgggtttgatttgttttgcaatcatttactgcttcaaaatgttgtttgaagttgccactttttgaaatttaaatcttcaattgataaaacaaagtcacatgaaagtatgacaaaaataatagttgtaatagcacaataaatggatagatcatgagtttagaaaattttataaaaaagaataattaaagttgaagttagtatgagggagataaactaatttaaatttttatacacgcattaaaagtaaaaatctgcagctattctcgtgaattttatgatgaacaccacgagtaggtggcaggtccattacctgctacagtttaatatatataatacagtgcacgtcgtttggcaaaacgcttcagtggctcagtggggtttcctcatgaatactgtgcgtgttgtcgtaggttcgagtcccctagagggctacatttttttgtttcttgtttttttacaaggcgcagggtggcctgcggctagcctgtcttggctgcccatgtggaaaatgggccgctggcccagctgaaggggcagagcgcgagagggaggctggcccgagcccaagaggagagagtgagccagaaatggtccaagagagagtgtagcttttcatttttttaaattcatttgaacctcaaattcaaatccttttcaagcaaaacaagttttgaaatgccttttgattatcgtcacactgtgacgattttaaaatcacacactgtgacgatctggataaaaccgtcacgagttaacgggccaagaatatccactagtgcacgtccacgacggaaaacaaattatcgtcacggattgcctctgtcagtgacggtttatgaatccgtcaccaagaattcgtcatggattaacaagtttcttgtagtggaattccaagttctctgtcggagttttaacacgctgatgctacaatctgaaagtcgttgtcgccaccgctggtgagttactcattcccctccacaaattcaatgctaggttaaatatgttacatgatgacaaaacccagtaatttaaaagttacagataacacttgaaacatcaccaaatgagagtatgagtctgtatatatactgatgacatgatgacatccagttgatccttctttttttttctgtatgtcttatccatttccaaatgatactgtagcaatctatcgctcatggtctcggagcggcacacgcaaggcagggacaagcaggaggtcggagcaccgccgcgtggtgagccccaacgcctccgtcatgtccagctcgccgggaagcatcccgccgggcagctcccagtcgaagtggtacaggagggcggcgagcgcgagctccatgttggccagcccgaacgccatcccggggcacatacgccgcccggcgccgaacggtatgtactcgaagtccgtccccttgaagtcggcggcgccgacgccctcgaacctctccggcgcgaactcctccggcgagtcccagtgcgccgggtccctgccgatcgcccacgcgttgacgagcaccatcacaccctccggcacgtcgaagcccatcacccggcacgtctcccggcactccctcggcagcagcatcgtcaccggcgggtgcagccggagcgactccttgatgacgaggtgcaggtaggggagatcgcgcaggctctcctcggtgacgccgtcctgcccggcaatggcgagggctcgtcggacctcgtcctgcgccttgcgcatcaccctagggttcctcatcagctccgacatggtccactgcagcgacgtcgccgccgtctcgctgctcgccacgaacatgtcctgcacaaaaagaagaggaaattgaactttttaagtggggaggtagctgatcgagctgagctcggcttacgatgatcacggtcttgatgttgtcgttggtgagggcgggattcgtcttgtcttggctctggatccgcaggaggacatcgagcaggtcctcctcggcgccggcggcggctctgctctcgtgatgctcctggaagatgtcgtcgatgaaatccatcatctcctgtcgctcccgcttcatccggcggggcatccggctgacgagcatcgccgcgcgcgacgacgggaagaggtccggcaagcactgcgccggcaggagcttcatcctccgctccagcatccgcaggaacgcggcgcggttcttgaacctgctcccgatgacggcgcgcaccgcggagtccgccacgtacgccgaaatccgctcgctcaggttcaccgctgccgtcgcccccggggtcgtcaacgccgccaccgccgccgccgccgccacggcgcggagcagccggccgacctcctcctcgcgcacggcgcggaaggaccggacgcgtcgcgcgcttaggagctcgagggtgcagatcctgcggagcgtcctccacccgtcgccgtagggcgcgaacacgacgccgacgctgtccgcatgaggaccttccccgtcggggtgatgggccgcgtcgcgaaggcgaggtcgtgggtcttggtcacctcgcgcgcggcctccgcggtgcaggcgacgacgacgcggagctcgcagaggcggagcagcatgagcgggccgtggcggcgggcgaggtcgcgcatcgcgcggtgcgggagcgcgcccgcgacgtggtggaggtggccgatgacagggagcgcccacggcgacggaggcagccggccgccgccgccgccgccatgccggagcgaccaacgggtcaggcagaggaaggggacggcgaccagcagagcaaggagaagtagatagagaggaagctcggccatggtgatttcccgtcgcaattcgtccgcacgtgctagcgtgttgtgccggtcattactcattaacactcatcgggttagagcaagtttaatagcatcgctaactattgagtattgactaagctaacatgcatactatatagtatagattatttttttcctcactatctttactctttactacttaaaaaattcgtagtggtgatggtgaagccaacgtaaacatacgtatagacaccacacccgcgcctccccctctcacgaccgcactcgcgcctccccttctcatgcccgctcccgcaccagctaaaaacgccctgcaccgccgccacgaccacaccgccgtgccgctccgccgcccctctgacgcctgccgccgccgctccgtcgcaaataatacctcacgaaataaactcataaatataatagtcgcatacaataaatttatacactccatcaatatactttataaatttatattttcttgatactagagggtaaaatagactttatgatgtgaatttaacggtcaactaacggtcaattgacggaaggggtatagaagtgatccaaactgaaatttaggggcatgggagagaatgagcaaatctcagggggtatagaagggattaggtgaactttcaggggtacacagggaattttctctttaagtagagtagggtggttcaaacagatctaaaaaatacaagtgaattgctatgacaactggtagatagcatatggtcctcatattctagcaagtggtcccctttttgtctcttggttagtacaacacccatgaatatatatctcaaccatcatcaactgattcagacggctcacaaaagggtcactagataagaacatgcagtgcacacgcactggatagattttaccaatcgatttatgatcatttcaaataatcatattcatcaaaattaaaccatttaagaggactatggtttaacataaaaagtatatatctgcagtctcgctctatagttctaatacccctaaaaaaataaaagataatgtttttggtttattaagatagccacaattagttgaataaagttcctttgtaagtgggcaagttagcttgggtcaaggcccaagagcctagccaaatcccttacccccacctaaaaccctaggggagaggaaccgaaccatccccccctcccttcccccatgacgccggttgtgactcctccacctcctatacttagttttgcttcctctcctctctagcagaccttgctctccctagatctccaccttcatagcttggatcaagaagcaaagtggaaaaatggaacgtggaggaggagaagagtagaaggaggggttagatcggagtttccccgctgtttcccgtgggatataaaaggaaaaccctaggtgaggtttatccccttgtgcatcagttctggggtgaatttagtggtttaattcgtggttaaagacggttagagaagagtttggacattgtgaatcgaattggtagttctagctaggctgggcagatttatagtgcctctgttttccatcaattacatggtcaaaatgatatattctgaacaaagtgtccacagaaacgttgtagataacatcgtgatctatcttctgaccaaagggaatgattttatctcaagtggaataagcgatatgaatttttgagtatgactattgcttttttttgtcaaaatctagatagttgtagattgaactgtttttggagaggttaaacagtggaatcaatcaggccccttagagttttctgtgagctttccatgttggtaaagtacactttgatcggatgggtagaactccggatatagttgttttctatgtatcctctgaaattctgtacagattctgaagcctgcattcaagtgtgaattagaccatttaaatggcagaacaaaaaagtgctttctacataaaagaactaggtcttgttttgtagatttctaaaatgtattttttttgcagtcatagcctttttatattttgagatataaaggtttgaagtagt

SEQ ID NO: 6072 - DNA, 24261 bp, Oryza sativa
  unsure (1)..(24261): unsure at all n locations
atcatcaaccaagatacttttatatgttatacaaaggatttacctatccgagtcatacttattgatttacattcttatggttatgctttatgctattggagataattatgtatattggtctcctatgtaggaatgcagttgtcgtattattactctagaattcaacctacattcgcgtcacatttgcattggatttggatttatgctacgaacctattgttgcgaccgtaccggtacatcatcgtatattgttgtaatatgatgcagcttcacaccttgttgggtgtgaaggcagtagttcatatcattgcattgcatacacacatattgcaggatgctatggaaatcatacagtcgaagacatctttgagaagtgttttcttctctaggatttgtgaggatgtggattttattgataaggttatgatgttttagtgcttggatgttcaaattgttttcatgtgaatcataactcgatatttaattaactatacaatgaatctatggtttaaatagcttgtcaaagccgtttgcttgccgagatttattctcaccaccttatagccttttcaggtactcggtcggatatgtttgcacgaatggatgggagtagctacaccgctgcacattatgatatcacatagtttataaatgttgtgattagggggtaaaattagagtttgttgttatagtggatttattaaatactatagatattcaccatggtttatctaccattcttagtttgttcatatgtgtcagattgttgccatcttagatccttgtatctatatgtcgaagcttccacaataatttttttataacaaaaagaatctaatgtaaaaatttcatcattttcacatggtcgtatggttctttagtggcatcccaggcttttgggaatttctggggtgttacagttggtatcagagtgtaggctttagattctagggaaaacaatgattaacttgacacacatgcacatataggatggctgtgggtttgcgacttgcatccaactattatttttgtattgcaaatgattatgattcccatatttcttaatgcctgttgtagatgttccttatcttgttgtattggtaccctgatgtggtttatatcgttgctcatctgcgtaaatagagttacctttccatatgctttgtacaagtacacttgtgttaatttttcaccatggttgtttgtcatcattaaggcgttgtatgtatgtgtgtgatcttgtgttgcctttcactatgtttttatttgtatatcattaagattttgtattcatatgtgatgacgatgctaagaggtttttgttgttgctcttgtctgttgggcctgttttcttttcctacatagtaagtgtaataaaacaatgtatgtgtgttgagtgctagtgccttctattgttctgtctcaattgttagggtcacaactatccattttgagaaaaatatttgagtgatagatggactagccaccatgccatgcatcttaactacttgctaggctggatatttgtttgagtgctctttttagtgatgatattttcagccaatcacaatatcataatagggggttggacttgagtgttccaagaaggctgtgagggatagatgaaaccatatttcgatggaatgtttgcttgatgctttgagaacgagtgtacaagtctaatgattgcattatcatgttattatgtttgcttaaagtttttatggtggttgacatgctttaatgttttgttttgtataatgtttgttttgagtggccacaaaggtatctttgctactgattggttagctgttagcctagttgattgtttgatgggcatttgaggttatggtctacctattatgtaaaggttgttggtgtgttcattgtactcttctttgtgtttgttgttggtatttcttaacgacattactagaaatataattcccagcaatggcgcagaaatacttctgatatattatggttacagagttcatccgcagaaacacatttcacccgagagtattctaatggtatcgtatttattttatcccgtgggaagatcatgtagagagaacattgactaataatttatatattacttgtgatgatcatattctaagcaggggttaagataatccaagggtagagtgatacacaagcattcactactcattctcataatatatcatctaagctaagtggaaagaaaagaggaagaaaatctatttttatacttctaatatacatagtatacatacattctagttaaccgatatactagctaataccatctatccgatgccctctttgtacttcgagaagccacccctgactaccgagttccttacgacagctcgtcatgaccatacaactggggctaaatacgaaggaataccctccctagggaattaacttaagattatataccggcgcggaggaatacccgtactgagctgtcaccatcagcggcccacctctcatccgcaatatataaccccaaataatgatatcccgtaatttagacaccacgcctaaactaccagatactactctaatatcatcgtcatgacatagagtaattgcataagcaaacattatacccgcaccaaagcatctcccagataagctaaccgtatattcagtataacatgaacataatgtaaagtaggtactcatatactcggaaagtatttcaataccataaatttatataaaagagtattctaataaaattacaaagcttacaaaagagaagagaaaagctactagagccatacctgaactcttccgaaggctccggactcctgatttctactctattcctattccaccagctagatactactaaactaaacttgatgagaatgagagagctactaaactaaacttgaggggaatgagagagctattacttgaagtgtgtgagtgaagtgagaaggtgaagtccttatatagaggtagttatgacggttgtggaaggggaattgtccgaagtgccctccaaccgtcattgggatgcaatcctggacgtccacgccaaaccttgcatccaacggtgctaggatgggttcggccgaaccatgggctgggtcttcccggcccatcttcggctggcggcctcctctattgcttcactatgtagacttgtaaattttggcccaattcatcgtgtcaattctgagtttgtggcccattcatacataagtctggttatcgacaacgtctgattgatttatcgtctgagttgatgtcgattctcctccactttattgccattgtctgcaaaaggttagtatacctaatactagtggaatattattattctaacagatatatgcgttgcaagcattactagttctatattttggcaatattgacggtcaaaactgatcgataacaaccgtcaacaaaaccccccaagcttgaacctttgctcgtcccaagtgaaggacgaaaggaaacaaagacttggttgttgatcaggagttgctactatgctgcatatctcaaagatataggtgcaaggtatatgtactctctctcagattaaataatctttggtacggtggcttacccttacccctgattcccacgagacactgcttctccttgccttgggcagttgaaagacagaacaacaattagagcaccaatcacccaatcattattcaactcttattccggaagttttcaaatgattttgcataagaaagcctagttcctcaaatgattcactcagtctctctaagtgtatcaaaatgaattcctcaccactttgcctttttgattcctactctaaggcttgatatgtggagctcggtagggatcaaacatggcatacttgcattcgcctttattactaaataaaaacttagactaaagcaaatgactaaacatactcaagatcaagatcatgcaatatgtgtgtgtggtatatgatggaaatggtatataaaggaaaataaagaaaaagcttctcctttgtgcttactttcttctcccaaaaaatcattcttttattgattaggagagggcatggctacatttttttttcagtgtcatgctcatgcttaatggagcataactttatttttattatttatttttttcataaccatgcctttccctctctcttttttttttctttttcaaaaggatttttttaggagaagaaaacatatgaaagtatggagaatttattttggtggtaatatggaaatggaatggaatattgcttactcccagtgtaggagtttagcatgtgcatatatgtgggtgtatgatcttgatcatagagcatgagaattatctacacaactcacaagagtttgacaaagttcaatggaatgacaagcaaccaaaatgtatatggtttaatcatgatagcacatttttggctctggtaggaatttatatcaaatgaggaactctcaatttatcattttgaaaaacaaaacatcctgaatgaaagtcaaactagtatcaggatcatagcaactcatatttactatctcatatctcgcaacaacttagacttagatcagcaactgcagctcatttacctcaggttcccggataattgttggctactaatatttaacctttgagagagcatttaccaagaacccatatatcagagatatagaacagagcaactattcatcatttcaacgaagagaactagcttgtcttacctagcatgacttaaacctatcctatctttttggtattttctattttgcaaatttttatattgttttcaagttttataagatgcaagtggaaagcaaatatgcaattggaaagggaaatatacaatgtgatacaagttaccttagtggagggagaggtatatccccccaagcttggctttcgctcagggtccttgataaggattgaacccctgaaagcgaaagtacgcttgtaggtcatcgtgctgttgctgcatcatgttgatgttggtgaactgagcatcagcagattgttgccattcttacgtttgagctatgtgttccgtgaggttgtactggatctcccctgtctgcacatcaagggtgtccattctcctagtgatttcacccaagtcccaacgagaggaacttgagcaccattcacttagagatggaggcacaccacatgatctgggaggttgattgtccccccattggatgtcatgaggcgcatgccaccggtcctcactggcacttgcccaagttgagactccgatgctatggcgtggagcttaggtccatccgggtgcatcctcggttggtgcccaacctgcctcatacatctatacggttggcaacgggatttcatttgtacaactgggtaaaaagtaaatcaaagatccatctactccatgtttcagaatattgccttgcgctagataagcctcatcaatacacggacgagcggctgagataaaagcaatttggttgctaacgacccctagcccttttgctatccaagtaatcaaagaagtgcactcaacaggagcagagaactttatactttctaaccattgccttatcatacatttcacaggagtaattttaatttttctaaccgtggcaaacatgattgacggagcgtggggctcctcaccgggagaccgcgcaggcccccctttgccggttcggccgggggcgctaagtgaggttcttcgccctcgatatgaggaatgtcagcgagaaaaagcgcacaagacacgggccacgtagacaggttcgggccgctgagaagcgtaataccctactcctgtgttctggtggatctgtgtgtgaaggaaaaccgagagctccagagccagagagctcgagagcgagagagagttcaggctctccgatcaagtcgccagcctctcacctcccccccttttttctctccttaggcctgagcctcctttttttatctggttagggatcaccacatgggcctctctctgcctaagaaaagaaacatgctttttacaatgagggctaatctacagccggaaatgacctctgacaagcagtacacacgcctcctgctccgctcgtcagctctcccggtggacgcccgtttcatccttcattcaatggccagcgattttcttgccatgcttgcactgaagcctggaatggatctgaccgggactgacataccaactccaggagtcagcatgccagctccggctagagacgagaaccaggaagctctcatcattccgacgggacggggtgaggcgtgcgacaggccgcctgttgccacataacccgcgatctgaccggtctgtgaccggtcacataccgcgactggtcacagaccggataagcatgcgctgcgccgcattgaatgcggcgtgatgcgcttgtctaacccgctataaatgcggttaggtgagtgccgctgtgctcacctaacccacacacgtggcgccaatcaccacagggggtcggggtgccccagccctcggggccgaaatgggagcggcccgacccctcggggagacagagggagaggtggccacgtcaccgtcgggcccgacccccccgagggggtcgggccacgtgagtgatcgcggctacccaagcctctagtcacgatacccccggccccatgtcaccgacaatgataatcaattcatctcccctaatgggtctaagatcacctcaaggaaacaaagtcatagcaatccatttgtgcatgagcctaagtgtaggattatggatatcattcgtcctaggtttcttgcaaattggaccaccagaaatatcttcctaaaacctatttttctcgaacccagaaattcctttctggatatcgattttacaggaatcgtgaaaaccaagaagtgtacttaagcctttccatgtaagtgtgaactcctcacggaaaaagcgagaggaaataccatcttctatttctttcaaagtgtacagaaattgcaaagtaagcagacgagaaccaggctcatctaccacagcaaatctctaccaatcaacagctttccaaatagagtgaaactcaacatccatacctatcttttttagcagctccggtgagtactctcgcgtgtgagcatactcctggtcgctcagcatgtagtaggtttgtctctcccgatcactgacaagttcgaggtcggtgtcgtttaggagtcgcctcagagcttcggcatcttccatcgagacatctgctgatgaacgagtactagactcgtcatgatgacttgatgaagagccggaccccttgaacagacgagacagtcgcctcctcattctgcacaatggaacaagaacggactaactcggcgggggttaattaggaatgacaagaatttcacccgccggttagtttcacccaagcaacttgtatatatgcaactaagtatttgaatttgagggaaaccatcaaagcttgattgaacttgagagcaaactttggagagggaatgaaaatgtgtttaaacagggtggagttccctctcccggccggttggcttaagaagtgcacccacaacgatcaaaactgacctgtggggcccactaaccattgcctcaaaaagagaggcagccgaccgttggcctggccagtcactggttcggccgaacccctggtgggcccaaccggccccacttttggccgttggattccaacggtcagtgtggtcgtggcacagcaaatttacattgaaaattttattttggtttgctttgaaagattcatttgaagaatttcctcaaaattcataaatgcaattttgaagttcaaacatatgttgatgcaaaaattcaaattgttgaaagaaaatttgcggatacataccaatttacctgttggcgaagctcgcgtcatttaaagtccgacgtgcaagaccatacctccttctgatttagttccacccatcttcgggggtgatggagcgggcgtctttggcttttccttccacaccttcttcggctttggtgcggaagacggcttcttctgagccggctgctctaacttcttggccggtatgggtggttttaccggcgtcttccaataacggtgcttgggcatcgttatttccttctctaggaaattctgcatgaatttcaccaggctgtccattttgggtggctccacttcgaccacttgaatattctacgggtttggcccgtacttgattctgaccacggagcattgttctgtcctcggttgaaactcaaacttttcctccttcccgttaatatgaaaacggatactccctgttcccacgtcaatgttggctactgcggtactaaggaacggacgccccaggatgaccggcgtttcttttcccgtgtccatgtccagtaccacgaagtcaaccgtgatgaagaaatcccgtatcttgactggcacatcctccgctatccctactgggtaacggactgacgagtcagccagttgaaggcgcatcggtgttggtgccaacaccgtgaagttgagcttgtcgaagacgtctttcggcatgacgctgacactagctccaaggtcgcacaaggcctggtcgaattgttgtgccccgatcgagcatatgatcgtaggacaccccggatctttcttcttttctaggagcttgtggagtatcaagttgctgcattgttctatcagcttgaccacctccgttgttaggagccgtctcttgttgttgagtatatccttgagataacgggcgtatgtgggacctttgggccccaaattaaagggcgttcccccaaaaccaacccggggggccaaaccgggttttttgggaaatggttgggnatttctttctagattactttaacaaaacgagcgaattgctcgtccaccgacggtttcctactccgttgagggaacggcagcaaccgtgtgtcacaatactcctgcggcactgacttttctggttgaacttccttgtcagccgagtcattagatggcgcttcttttgatatcccactagttcctgcagggttaggatacggcggatcacgagtagacttacctcccctcatcgtgatcgccttgacattttcaatggaggagtcgggttgccccggaatcctcccagtttcatttgcagggactaaggatgccaactgagctagctaggtttctatcattttgttaaagctcagctgattttaaaaagcagaagcaaagccatctaatttgacattaatgttatctaggatcttatcattggccgcaagctttttgcttaacgcatcagtggttttagattgcgcaaaaacgagatccttcaaggaggcctggctagaaaaattactgttgttgttacctccttgataatatgggcgtggttggttccacccctgacctccttgtggacggtacccgttgttgttgcccatctacatcgcctcctcacgggtttctaggcaatcattcccagaatgacccgtgccgccgcagacctcacacataacgtgtgagtccaacgccttgacggtgccttgtggccgtttctcgtggtcgtccaaacgtttcatgagaaggtccagcttggcagcaagtaactccgtctccttgacggcgtgcatgcctcgctgatgggtctggagtcgttcctcgctccaacccatattggagaccatcttctctattaaatcaatggttccttgaactgttttagagaagaaagctcctccagctgccgcgtcaaggtgatcgcgggacatcggggtgagtccattgtaaaagttctgcaggatcagccagtcgtccatcccatgatgaggacatgcggccatgtactcctgcagtcgttcccatacttcaggaatagactcatctcttgtctgctggaaacttaaaatccttctacgaagggcattggttttgcccatcgggaagaatttcgagaggaatgccgtagagtatttgtcccaggtgttgacagcagcacggttggcataaaaccactgcttcgctctcccgagaagggagaacggaaacagccttagcctaacggcgtctggactgacgcccttgatggtgtacgtgctacagatctccaggaactattgcagatgagcattggcatcctcattaggcttgccacagaatgggctagcctgcgccatcatgatgaggctggacttcaagtcgaaatccacgtctcccatgttgatctgcggcccaatggccacattgtcagcagagggagcagcgaattcgcggagagtcttgtttgctacagatctccaggaactattgcagatgagcattggcatcctcattaggcttgccacagaacgggctagcctgcgccatcatgatgaggctggacttcaagtcgaaatccacgtctcccatgttgatctgcggcccaatggccacattgtcagcagagggagcagtgaattcgcggagagtcttgtttgccatagtcttgaaggtcggtggcgctggtacggctgatttctctgtcggtagagttttctgcggagcagcgactcgtggcctgacactccggaagaaagcttctggattttctttgaagttttccggcaagttgaaaccagtcatgcactaccctgtttgcacaacaaaaagtgaaaacaaccaaggttagcctgcaaaggaaaatgattatacagaggtaaatataaagtataagttcaagtaatctctattatgaatcttccccggcaacggcgccagaaatgcttgttgatatttcttaacgacattactagaaatataatccccggcaatggcgccagaaatgcttattggtatttcttaataacattactagaaatataatacccagcaatggcgcagaaatacttctgatatattatggttacagagttcatccgcaagcgcatagatataccattgtagcatttcacccgagagtattccaagggtatcgtatttattttatctcgtgagaagatcatgtagagggaacattgactaataatttatacattacttgtgatgatcatattctaagcaggggttaagataatccaagggtagagtgacacacaatcattcactactcattctcataatatatcatctaagctaagtagatagaaaagaggaagaaaatctattcctatacttctaatatacatagtatacatacattctagttaaccgatatactagctaataccctctatccgatgtcctcctggtacttcgagaagccacccctgactgccgagttccttacgacagcccgtcatgaccatacaaccggggctaaatatggaggaataccctccctaggaaattaacttaggattatataccggcgtggaggaatacccgtactgagctgtcaccatcagcggcccacctctcatccgcaatatataactccaaataatgatatcccgtaatctagacaccacgcctaaactaccagatactactctaatatcatcgtcatgacatagtgtcgaaacatgaattcggcaataataaaacggggtagcgcacgagacctaaaagtggatggatgtggagacaaaggattagacaggttcaggccctctcaatgagaggtaataccctactcctgtttggggatttgaatccgccgagtatgtattgatctgacgatcaggttgtctcatcatgcccctagagggggctccctgccctncttatataggttgggggggcagggttacaagatagaaaccttaaccaatacggtatcggtttcctaaatctactttacaatcttatcaaaccaggactttaggccgttccataatatacagggaaacgtaatacccaagtcatgatctgttacatattccatagatataagttatcccctatagccagtcggataactatgccatgtaggtatggggtacccataatctccacagtagcccctgagaccttcacagtcgaaaagataatcttctctcgaactagattactccaaagctgagtgcttcaatcatcttcgccatggtctccgaagtacttttaccaaatacgaagactgtggagggctgaaaaataaagtcaggtgcatcgactagatgcacctaataggtgtagcccccgactatgtggttaattgaacaaaccaagcatatagtcaaggaataaataatccaaccaaccgagtggttttaataattatagtcaaccaagcgacctgatattaatatgtagcatatgcggtgtgaatccctgaataacatgatccgagtgatataccgactgctttgtaaaatatgatgagtgtaacctaaagttggttacatcattgaaaattcacatagcaaaacagctataaagaagcttatatattgtgaataaagaaatttccaaagtattgggcatacgccatgcgcacactgctttaacagatgtgcttaagtccctaaaagacacatggtttcaccacacccggaaatatatggcatatgtggtataaaatccaagtaaataaactcataaaggatttaccaaccgcctgaaaaatgaccacaatatataatcagcctaagccataatattggtcaataaaaatgcacacttacgtggcgaaaagcaatgatattgtatctaatcaattgcttaaaaacccaaacagcaccttgacttatatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctagaccaaaaaatatgccttcgacaccctttaaaggatgacgcatgtaacatgctctcgagtaataaatcttccgggtgatatagaccaggtgtagctcatatgaatagcttctgatctgagtgattatcccttatgagatactccaaaatatatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcggagaaaccagtcggcaacagtcaggtcagctagcagtgaagatgtaggcgcccaacaacaacaacaaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgaagaggcttaacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcttgaatattggagagtcacttgttgtagtaaaatatcatggcattgcatgccgagatgtcgaggttcacaaagacgtcgtggttggtgaagtagtaaaacttgcgaagtagcagcaatagagtttgccggtgccgaagataataaagatgaagtcgctccaccatgatgacaaagttgtattgccgtaatgaagtgaacacaagtcggcggcaacagaagcaaaccggtagtgaagacgcgtagttgtgaagataaaagcaccaatcggcggcagcataatcagtcggcgacggaagatgatgatgtccatcagtagtggtagctgtataaaccagacgtagaggtaagggcactagtcagcagcagacgagacgaccggcgatgaagatgtagatgcccaacaacagctgcataataggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggtcgaggcggccggtcggtgaagacgtagacgcccaacaacggcggcataaaggccagccatgcaggcggaaacaccagtcggcggcggcgaaggcaagccggtcggtgaagacgtagacgcccaacaacggcggcataaaggccagccgtgcaggcggaaacaccagtcggcggcggcgaaggcaagccgtcggtgaagacgtagacgcccaacaacggcagaataataggccagccgtgcaggcggaaacaccagtcggcggcggtcgaggtggccggtcggtgacgacgtagacgcccaacaacggcggcataataggccagacgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaacaaagtttcacggatcagaatttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggccagccgtgtaagcggaaacaccagtcgacggcaacgaaggtgagccaacggtgaggacgtagacatccaacaacggcggcataataggccagccgtgtaggcggaggcaccactcggcggcgacggaggcagaccggcggtgaagtcgtagacgcccaacagcggcggcataataggccagccgtgtaggcggaggcaccactcggcggcgacggatgcaggccggtggtgaagtcgtggacgcccaacagcggcggcttaataggccagccgtgtaggcggaggcaccactcagcggcgacggaggcaagccggcggtgaagtcgtagacgcccaacagcggcggcataataggccagccatgcagacgggaacaccagtcggcggcgacggaggcaggccggtggtgaagtcgttgttgcaatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagtaagaaattaatctgagattagaaatcaatctaatatatattgataacaaattgaaacgaaaaactcaagtcgagcagtgaggctggatcatgagtgatagccggcgacgtgccatgcaacatgtataagccccggcaactaacagctaactcgatgttctttcggcatgatgccatcatcggaggtagccggcggagcccatcaaccatcatacatgcaaacaggaatcgaatcctggcggcctgtgccactcctgcaacacgtccatctgcaaggaaaggaagagaggagcactcggacacggcaagggcacccaagtaggcgacgatgatggccgtgtttcgatctcatccagtatatgaaattcgtcaaaatatcaggaaatcaaacaatgattaaaaattaatctaatagagattaaattgcaacggtagacccgattgaagatttgagccatcgaaattgatgagattgatctcggggtttcttctgaagttgattccatcgcacttttcgacaggtaattcgacgcaccccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtatgtattgatctgacgatcaggttgtctcatcatgcccctagaggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatagatataagttatcccctatagccagtcggataactatgccatgtaggtatggggtacccataatctccacacatagagtaattgcataagcaaacattatacccacaccaaagcatctcccagataagctagccgtctattcagtataacatgaacataatgtaaagtaggtactcatatctttttgctccatccacattattgtgcgttgttcttccatcactcaatgatcttcattttgagacatgttctattggatgaatcatcttcatccagtgatgaaatcatcgttgctgcaacaatagtcgcgcaagatgaatatgagcagtcgaatgctccatggcgaggtgattttgttcctgatcgtcaggttattcgtcgtaatcgtcgagccggccatgataggttgcaccacaactacttattggagcatcctacatatgacctagtcttattctggagaaggcttgcaattaatttacatattttggttgatattgttttgttctccacttatattaattcacattttgttgcgtaggtttggaatgagtcgtcctcttttcttgcgcatatagttaatgatgtggtagcccaaaaaaggaaatgatgctagtgctttgggtctatcaccattgcaaaagattaccgctacacttagaatgataaccaatggagtcgtagccgacactcaagatgaatatctgcaaattgcaaatagtaccactatagagagtctgaaaaggtttgtgagagctattgttgagattttcggagacgagtacttgcgttatccaactagtgctgacacttctagattacttgcacttggagagcagagaagttttcctggaatgcttggatccatagattgcatgcattgggagtggaaaaattgcccttcagcatggaaaggcatgtataaaggaaaattaagcaaacgaactatagttttggaagttgttgcttcaaaagatctttggattccgcatgcattcttcggtttgccatgatctcacaatgatattaatgttcttcatcgttcccctctctttgcaaggctagctgaaggataggctccacaagagaaatatgaaatcaattgtcacgtcccaaaatgactctaaaatacatcctctagattatgcctagaataattaaaatccgtgtgaaagcctccaacaattaaaatgtgcaaagttaaaagtcaaataaggcttagaggatttttgtaaatttcctaaaagcctaaaatgcgtaaataaattttagtggaattttcagagcacaaataaaaattattaagaaataaacaaagttaaaattattttataaaaagaaaaaccctaaaagtcccccttccctcccttgggccggcccggcccatctacctccccctctctctcctctccccacggcccactcggcctctccccgcgcgcgcgccgctgacgggcgggcccgcccgccacccttgctgacgggtggggcccacccgtcatccccttcctcccgctgctcccgccgcctcccccgcgccttagcgccgccgccgccgcgaatcccgccgcctcccgccgtccccgcgtgcaataaagtgggggaaatcactccccgtgatcccctctccctttccccccattttttcccctctctctcgcgttcaaacaggcggatttgcccccgcaaatctcgccggcgccattgatggtggccggacctcccgcacctattccttccccgccggccgctctctcccccttccaaccctatttaaaccctccccgcacctcctccgtccgtttccgcctctcgccgcccttcctcctcgccggattcgagctcgcgacgtcgctctctctctccaccgtcgccgccgagctccggtccgccgccgtcgtcgccccggaccacctcccacctcggcgccgcctccttcgggttcgccgcatcctcgccaacctcgtccacctctccgtttcggtcgccgactgccggaacgctgtcgaccccgtcgacccgagccgcgcggccgcctccctccgctccggccgcctcctccgtcgccgccgtcaacctagggtgagccgtggaccgccgcctctttcccccttcccttcccctctctcgaccgccgctccgccgtgcctatggccgccgccggcgaccataggggcgcgggcgccgcctcccgccggccgcgccgagtggccgccgcgtggggcccggccgtcagccgcccgcgtcctcgggtgcggctgacgtgtgggacccacggcgccggccggtgtgagcccgggtgcacccggtccaccgtggaccgtgaggctgccgcgtgggccccactcccgtggacccggtccgcgcgccccctcccctcggctgacgcaataaaccctttttaaattaaattttaaatgaagaaattcgcaaatattcatttaaagagcatataaacttcaaaaggccataacttggccatttgaactcggaattggaccgttcaagtctctaatttttccttaagaagtcaagaacccatttttgtgctttgttcttgctggttatatggagtttattagagtaaaagccttttcttttccgttggtcgtgtagacgctgcagcttcggaagatccgctcttcgtggaggttgaagccgacgtttgggaaagcgagcaaggtaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgtttaccctagaataaacaaaaccccaactagtggacactctactcaaggtaccactagtatgattttaggtagatgcttcgccgcttaattaggtaacattaggtggttttacaactctagactttgggatattcatatcacctggacactatggaattgttggatcattgtggaattggattcacacctcccctctattcaaaaccctcaaaatggttttaggctgggctcggggtgcatggttttgatagtagcacctcggccatataaggacaggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgtggcccggtagtcgagatgtcatggcacagggccagtgtcctgctgctaggggctcagtcttgcctacctgtcccaggggttccggccgtaggtggggttgggtcggtactcttgtctatggctaggatatgttggaaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagtttggtctgaatcatcgtaggccttgggttaaggcaggctcgtgtgggttcacggcattgattaataatattatatagctctagaatcgtgtttacaaaatagctttgagcaactaagtgtctattaatgctatttactgcaaaccctaaccctatatattataacccccttgtactcccttgcatttattctgcacttgtgggtgacttgttgagtacggtggttgtactcagtcttgctcaatttttcccaaactcagaagaggagttcctggaagatgaaggctttggtgtctagctcgtgcctgccgtcaaccgcctgtggtcgtcgccctagttttccgctgtttttcgtttgtcttcttgtgtgctgggtcttcgccgcccatgtaataaattaattaattacgcttccacttgttaaactctgaattgtatcaacttttggtgtaccttgcctcctgggacaaggaataatgcacgcacgtaaggaacgcccgttgggttatttccggtcgtgacatcaatggccacaactacacaatgggttattgccttgcagatcgtatttatccctcatgggccacttttgtgaagacaatattagaaccgcaagggaataagaagaaacactttgcccaacaacaggaaggagctcgcaaagatgttgagcgtgcatttggagatttgcacgctcattttgcaattgtgtgtgggccagctagattttggtatgcagacacattaagtgaaatcatgacagcatgtattattttgcacaatatgatagtagaagatgagagggataaagaaggttttgactacaactatgatgatgagggagagcgagtcacacctttgcatacccctatagctgagctgtgggactttattcagaaccatcataacgttagaaatagacagactcacttcagcttcaagaagatctagttgagcatctatggcaatttcattgtaggaactagtgtagtatgcaacctcccagttatgtagtaggcaactccaattatatatgcaacctcatttatgtaagcaatacatcaataatgtatgcaacctcaattatgtatgcaatcctaattatgtatgcaacctgtatgtgctcacaattaatcatagcattcttgcatataacataaaggtcacaaaccattaagttctaacaataaccagtacataatacatcaaagcctacatggcatacaacataaaagttcagaacccataaagttcttacaagcaacagtacataattcatcaaagcctacacagcatacaccataaaagttcacaacccataaagtttttacaagcaacagtacataattcatcaaagcctacacggcatacaacataaaagttcacaacctattaagaaatagtaaaaatagtatattgtcaacggtgggtacccgtagaccagatatagagggtattggcgtacgctggtacgatgatctacgtaatacaacatcaaggaaacaagagacaaagattatactggttcaggccccttaataggtaatagccctaatccagttgatatgggattatatggagagatccaaaaattacaaagggaataatagaactcgatgataccgatgagatcgtagtcgagttgattcaactagatcacccgacgacttggctcctgtaggctccggctttgtagctgtggtcgttgtattggctatgagattcgatgtgttaggtcctcccggggggtctcttttatatcgcaggtcaggtggtctccaagtaggactcggagacatcggaccctgcacgatacagtgatgacccagtcctatacgggtaggaacctttccattggtggacttcgtgatgaattttcttagcgtatacagagaacgtccgtacacgcgcagatgtaccatattgtcgtatagtgtacatccaagggtagagggtataccttatccgtaaccctgacagtagcccccgacttctgcttaaatgaactcatgtaaccgatcgcgacttctgatgtcgaagttgctgtcgttctcaactggtcgatctcagtatgagaaccgtagagacaaggagtggtcgacaacaccatccgaagttcaacggttataagtgaatttaaattgaagtccaaaaaccgcctcgtgcaacggacccagaaatttccggcggccatctctctcctttccttggaattcgcaccgtcgatagtgcgcctatttaagggggttttgggaatccattttagagtccggctgttgcgaaaaactttttagcctccaaacgctcttcgtcttctccgcttccatgcaaaccctaactcgctcgcctcggtttcttctccggcgatctccagcggcgatggacctcgacaagtccacttccaccagtgcgtccttgaagaagttgcaggaggagggcgctctccccagtcgtgggaccatggagagggaactaggaggtactgaacctgaacccgtcttgggccgcatggttgcggttgaggactatattctctgtggttttcttcctccgccatctgagtttttccttcttgtcttgaacttctacggcctttctctgctccatctgaaccccaactccatagccttccttagcattttttctcatctctgtgaggcctacattggggtagagccgtttcttgacctcttccgtttttactacgagttgcactggatggaacctaaaaaggtatccgggtatgctggttttcgacttcgggatggcctgaagtcgcgatacatccctttccagtgcccctcttctcatagcaaatggcgggcgaggtggttctatcttcagatagaagattcggatccagtcttcattgttcctgaggagcaaccagacaagattccgtcttggaccgccaaacccgccttgaccccattcctccagtctttcatcgatatcatcgatgacctccgagtacgagggttgtcgaggtatgaagtcgctgccgacttcattggtagacggatccagccgctccaggctcgagcccatccagcctttgactactctgggccagaggacc

SEQ ID NO: 6073 - DNA, 1099 bp, Oryza sativa
acatcatcgggccgctcgtggaccagtaggcggtagcttcgttgaaagagggcattgcccaggaggcgtccgacggggcccttgccgctgctgctgccacgaccagtggtggcaatgttctgaggaaagggaggaagttttcctccgtgctcggcaaccgccggaagacgcccaccccatcggtaagcctctttggttatcgattgtgtagtcggaagatgtcgctctcacatcgtactcggtttacctagcctcggatgcgtctcccccgcctccacgacgacagaggccggtgacactcggcgagaagtaactggacaaaatttgaggcccttgccttgatcggattctggcatactgttatgatgaccaccatggcaatcttttgtagggcagcacgggcgaaggctacgcaagatgggtctagagggaactcaagcgcgtctcctgcagtggcctcgaccgatgtcgtggttgtgcccaggagccgcgaggtgacgtccagcggcccagccagcgatcttgtgcccgctcgagacccgcctgctgtcgtcctcacctgggaggagctccaagtcaagatgggacgcatcctcgaggctggtgctcgcggcataagtcacgagattgcggaggcgagggcggcggcggcatcgtcggcgaacgaacgcgccgacaggctgacgcgtgatctgacggaggttcgcgaggacctccagaaaatgagggagctggtggccggcaacgaacggtaacggcaggggcttgagcaccgtatgtcggagctcgagaacaacctgtcggagatccgtggctcgctgtgggttacctacaccggtctgcaccagctcgccggggagtgcggtgtcacgaccaccatcccggtgaatcccgacgagttctcgctgacgacttcgctcgcggaactggcgacggtgatggaggcgatcccctccaagcatgcgaccaagatcagagaggagacgtccaacgggatgtacatcgggacgtgccatgtcctcgcgtgcataaggttggcgcaccttgagctcgatctccaaagcattttggatcagggcacggctaacaacgcgcgtaa

SEQ ID NO: 6074 - DNA, 3155 bp, Oryza sativa
  unsure (1)..(3155): unsure at all n locations
tttattgaagttgtaagatgtcttacaagtatggatactattgacttatacatagaatttacgcaattggtcaatgttccaagaatttgctaactcgcgaccatcgccgtctgcaatcttgaatgcgcctggccgcaagacttgtgtgatcgtgtacggtccttcccatttgggtgagagtttgtttcaccctgcttggctttgaactcgccagaggacgtagtcgccgatcgaaagtatgcgtgctcggatgcgcttctcgtgataccggcggagggcctgtcggtagctagctgccctaacgacaacccgttctcgatgttcctcgagtaggttcacatcgtcgtttcgctgttcctcctgatcctcgtcggagtacttctgtactcgtgtactctgatgtcgtaactcggtcgggaccatggcttctcagctgtacacgagaaagaagggtgtctccttgttggacgttgtcggtgtggtgcgcacggcccagagtaccgaggggagttcttcgacccacttcttgtcatgtgacatgagcctgtcgtagacacgggtcttgatcccttgtagtactatgccgtttgtcctctcgaactgtccgttgctctgagggtgagaaaccgaggcgaagcagatcttgacttccagtccgatgcagtaatcttggaaatcggcgctaatgaactgggagccgttatccgttatgatgcggtgaggcaatccatatctacaaaatatccttttaatgaatttgatggcattgtcggccttgatttcccccgtgggtattgcctcaatccatttggtgaatttgtcgatcgccacgaacaggaatttgtagccggcctgtcctcgtgggaatggaccaagtatgttgagccccagcacgagaacggccaagtgagagggatggtttgcagtgcttgcgctggaagctttgtgtgtttgctatgaaattgacaagcttcacaccgttgtaccatgtcgcaagcgtctttgagggcagttggctagaaaaatccttgtcgaaaggcttttctgaccaatgtacgaccggcggcatgtgacccacagaccccttcgtgtatgtcgaggaggaggtgtttgccgtcgttggacgagacacatttgtgaagtaacccgtttggcgccttcttgtatagatcgttgccgatcatacagtagatttttgcttgactccattgttgacgctattgttgacgaagcttgatgtcataatagtagaaccttgagcaccaaggccccctacctggcgcgccactgtcgacggtgggtacccgtagaccggatatagagggtattgaggtacgttggtacgatgatctacgtaatacgacatcaaggaaacaagagacaaagattatactggttcaggccccttaataggtaatagccctaatccagttgatatgggattatatggagagaaccacaaattacaaagggaataatagaacttgatgataccgatgagatcgtagtcgagttgattcgactagatcacctggcgacttggctcctgtaggctctggcttcgtaggctgtggtcgttgtattggctatgagattcgatgcgttaggtcctcccggggggtcccttttatatctcaggtcaggtggtctccaagtaggactcggagacatcggaccctgcacgatacagtgacgacctagtcctatacgggtaggaacctttccattggtggacttcgtgataaatttccttcgcgtatacagagaacgtccgtacacgcgcagatgtaccatattgccatatagcgtacatccaagggtagagggtataccttatccgtacatatatatccatacatcatgaactcaatccatatgacacgatatgatctcctgctgcaaacacaagtaatatgcttttcttggcccatctagcactaagatccatgttcataattctttcttctctttcatgggtttctaaatctaactttcgtttctctactttcaacctttctttctcttgtgaaataacttcagccaaccggtcatttcttttctccctagattgtgcactcatctacattttctctaaccatatgttatttaatgcaataactacaggactactctcacttgagcatgaagaagtattacctcgcgcgcattttgccttttccagcttcttcccagatggtctcaccaaaggatcagaggtattaatgtcggggttgtaatgaaattcactagagttttgagtttgtgcatgcagatggtntctccaaaggatcgacatgagccttctgctttttctgggacaacctatcattcccctttggatgatgatacaaaatctcccaacagtgcattaaagaaaatgttttcttctcttctgatttgtacaaagtaaaagcctgagttatctgcaataattggcaagagtgtacctatctgtcgtcttcctggacactatcccaagctcttgtcttactgcttttagtataatcttcagaatggcacttgtccttcaattggtggtggcatggaggctacaggtgacagcggcggaggcagtggcatgagtgcggttcatagggttaggtggcactagcggagaggatctgctagcgttgttagagatgatgatatcgagtccccccaaggacacgatagcgcaagtaggatcctcccacagataaagccctacttcatgcaatcgttgagacagcgatctctaacagtgcaggcggattgagggctgctgcgcttggcgacagtgacaccatgcgaatttgagggccggtaacgggaccggacacaggatgaccacaacagcggttagcagcctgacaatttggaccatttgggtgggtgggggttggggggggggagcgcctagctaaggatatcgacaacatagcagtgcatcagggggaggagcggtggcaaggcagggtatccgcctagaggtagtgagcgggccaacaatttgggccacaaagggggaggagcagtggaaggaggcgctggcagggcagacacctggaggtagtgggtgatccaacaatttgggccacaaggagaggcagggaactgagggcaccaagcactaatccaagtgttaatccctatgctaatccaactcacgacatgga

SEQ ID NO: 6075 - DNA, 14066 bp, Oryza sativa
cttggggttctaacatggttagagttaggactagggattgcttagccatgcctagttcaactagttcacattggggaaaatcctattaatgattagactgtcggttctaatggttttgttgggttagtgacaccgctttggtgttggttaattaaaatgaatcacatggtgggctgtgggtgcatggttttgctggtcgcacccatggcagttaaggaccggttcgcgggatgccctgaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgctgccttgcgaggagtgggggtgaaacctgaggtgtggtgtgcttggctagagggggttatgtgaagggtcctgtcacggcctctttccggtatgtcgtggtggcatgtcggcacacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgaaactggatagttttggtggagggttgggcctgttgcaaagtgggatagcgttggacagtggatagttaatattaattaattattacaactgtttaatctttcaacttctgtttataaatgctcgctttatgcaaatgaaccatttagctcttctttgatgattccctgcatcatgcctctattccggtatgacttgctgagtacagtgggtagtactcagtcttgctctacttttcccaaccccagagttcgagtatgtgtcagatgaaggtttctccgaggagtaggcttcgtccgtgccgtcgaggatgcctgtggagtggtgatcccgctgcggttctagtcaaggcttagctcctgttgtctctctttctttccgctgcatttatgtaagacttttatgatgtttgtaagacgtggatctgaatgtcaacattgtcgtttttgtaccccggctggtcctggacggggattttaatgcacattctgcttgaaattctattcgggaatttctgggcgtgacacaaggtatgggatgactttgaagaattctttgaatcacgcaatagcgcgcaggttcgcatttctgctaaatgcaatcactgcaaaaaaaactttgtctgctcattcatctggtggcactagtcatttgcttagacatctcaagtcatgcaaacctagaactgctagtaatttgtctcagtctatgcttaagtacaatgctgatggtactgttcgtccatgggaatatgatcctgattatgctagatctgagttggttaaattgattgctgtagaggatctgccacttaattttggtcaatctcctgcttttgaggagtacattcagaatgctcataaccctagattccatgctgtctctaggcaaactattagtagagatgtttttaagtactttaacaagagtcgtgctatgcttattgagaggttcaagtctgttaactctgttgctttgacatctaatatatggtctggtaatgctaaggaggattatttaagtgttgttgctcattttgttaattctgattgcaattagagaaaaggattttgggtctggtgctgattgatgtgaagcacactgctgagaatatttctaaacgtgtgctttctgttgttgaagaatatggtttgactgataaggttttttctattactctagacaatgcctcttctaatactaaggcaatggattttctaaaacctaagttgtctgcttatgttggtgatttatatttgcatcagtgctgtgcatgtcatataatcaacttgattgttaagactggtctagaagttttcaaacacatgcttcaagattttagaacagccatctcatttgtgaatgcatctaatcagcacattgctttatacaaaaactggtgtattgctaagggtgttcgacctcgtaagtttggtttggacatggatgttagatggaatgcaacttatctaatgcttaagcatctcttcccacataaggagcttttttcattatttattgaaactcattatcctagggaaaatggtagactattgcttattgatttgcactagacaattgctgaaactgtgcttttattccttgaacaattttatgattcaactgttattttgtctggtgtttattatccaacatctccattaattatgcatcacattcttgagattgctggacatcttaacacttatgagaatgatattaactttagaaatgttgttgttcccatgaaaagtaagttcttggcatactggtctgagattccatttctgtattcatttgcttttatcttggatcctagggctaagatcagaggttttagcaatgttctataaaatatgtcacaaattttgacctctgattactctacttatttaactgaggttagggctgcattgtctgacatttttctaagtatgaaagtaagtttggtgctgtgagattgcaaagaacaaccccaggcagtactgctagtaagaaaaagacagcctggggaaagatttttggtgccagtgatgcacttggacatggtgctggtgccagtccagaacctggacttggtgctggtgccagtccaggttctggacttggtgctggtccattttccaggagaacttctgctactgctttgattcaagctgtttcttctaatgctaacttgaatgcctctgagttgtctgcctatcttgactgtgacattgtcaaccaattcgacgatgacttcaatatcctaaactggtggcatgagcacaaacacacatatcctattatgtccatattagctagagatgtcttgactgttcctgtttctactatatcgtcggagtctgcttttagcttaactggcaggatcatcgaggagcgacgacggcgtctaggtcctaacatggtgcaagctttggcattgatcaaggactaggtgcaggtagacaagaagttgcagcacactgctgagaatgtagagcttataaaatcatttgagaatttgtgtcttgatgatgtaaccagtggcagtgccactggaactggatgattgtattggacttggactttaatatgatagttagatgaaagctgtgggctgcactcttttttcctttctagggttttctgacgaggtgtgagtttttacctagaaaggtttttaatgaggcagccattgcactacacagctactattatttttgaaagtgtttgtgacttgatcacttgagtttgaactgtgatttgtgaactattagacttagtatttgaaagtgttttgtagatttgtgacttgagttgtgaattgtgagacttagtagttgagttagagaattgaattgtgatattgcacatactataacttgtgaattgtgatattgtaatctgagacttgtgatattgtgatatgttaacttgtgaattggatggttttgtgctgatttttgtgatggacattgcattttcgatatgtatgtgcaacactgaagtgaacaagtggcagttagtgtttggcgtgcctgggctagcccgggcacggtgggctcatcgtgccgtcgggccggcacggcccggcacgactgctgtcgggccatgcctgggcctaaggttcagcccgtgggcaggcacggcacggcacgaagtgctaggcgtgccgtgtcggcccgatgcgtgccgggccgtgcctgggcttgaggttcagcccgtgggcaggcatggcacggcacgaagtgccaggcgtgccgtgccggcccgatcgcctcgggccgtgcctaggccgggccaggccgggcgggccatatggccatctataactatagcaactaaattgccctgatatattaggcaattctcaatacaactcacctgctagtgtcacaattcaagaggtacttatgtcgcctattataaaatagagtacacatggcccatgctagaagttatttgtgtctagaccagtagaagtctacgttggctcggtccctaaatacatatacatcgcaaagtgattatttctttattgttaactttcaaaatcaacaatttgtttatgtagcattttaagtgccttgcaaatttcaacgggactgtaactagtaccacttccatacaaaaataagttcactttatatatgaacctggtataggctatatctatatttatgtacaaaattgaagttattgtagaacggggcagtaaatatttttgagctagggttcaactatctctctttgtttttagttaccatgtgtattacatctgaaaaaaaaaataaatactccctccatcactaaaaacaataaatttggacttagttgagttttttttttatggaacatataaagtacctggttatccccaaccgtacgaatgcaaatgtcccaagtaccaattaaaagtaggtaaaattaactccaaagaagtggccaagaactcaaaaaccccgcactcccctaattaagacacaaaatggggatatgagactttctaattaagcaacggacctaatgtagaaaaaggtactactcgaactagaagatgtaaattccttcctctaaaccgtacgtcatccatatatagtgggaattagaaacggagcgctagctgtacaagttttcacaatttgagccttttaaaaaactaattttacaaatgaaccgccgccaaaacttattttaaaaatgatcctttttttcagcgccaaatcatgtggtgttgaacttagacacctcagcgccacatcaactagcgctgaataccgtaccaccgcagatgggaggctaagtcagcgtgccaacgtacattcagcgccacacgatttagcgttgaacagaagggtcagttttgaaataagttttgacggcggtttatttgtaaaaatagttttgcaaagggttaaattgtcaaaatttgtgcgctagctgtgagttaactagccactctatatatttctgagggtgttttttttatacagctttaaaagttctgggtgaaaaataattgctttttgtagttagggagaaaattagtctttgagcaagttagacgtcaaaaatgtactttacccaattaatagcatcaccaacaacattggctaaatttcatctccaaaaatatgaatttgagaatcttaaatgaaatttgatgtgtaaaaatagttatcttctgttaaaaaaattgggtaaaattaacccctaaaaccaaaaggtgggccctatatgaaactaaccaaaaggtgggccctatatgaaactaacataatatcgtacagacgggcacctgttaatcagtactacagttgtacaaactacaacgtaaaatatgacaatgaaagtagatattgaattaaattattgtgatcctatgtatttttcttccaacacctaaattaattaaagtggactatcatcgaagggcaagcatgttgcccgtgtacgttcagattaacggaataagcaccactacgtactaaaacagattcttgcgtaggatcggagacgagagacgttgaaatgttgacatcctatcatgatgatcccccttaatagctcgggctggtggttgccacttgcctgcagccctgctgataaagtcaggatctatctgtaatctgacatccgctcacattaatcccgtgacagagatctgcagacgctcaacactcgcataaaagaaaggcaagaattttgccggcgacttgcattggtgtacgttgatcgagttagttagctgggctacactaattggaaatataattaagcacatgtgggtacactaaacatgcatgtatatcaatagatccatatcatatgtatatgatttatacatgtatacgacagcactgcatgtgaatagatcaacacgaaacatagtcgaaacgtactgatggtttagttctaaaggacgcacaacaccactgctacaaaatacttcatatcttataggaaattgctcgtaggtaaaaccgacacatataaactttttctacatccgtgtgatgaaaaaaatatagaactagcatttttaaacactatagatccacatccgtgatgaaaaaaatatagaactagcatctttaaacactatggatgccagttcttaaaaaaaaaaagggcacttatacttataagtaccgacacatataatcctatgtatatattcttatataattcatctcctccactaaatataattaatgctattctctcttttttcattaagccacatcacctcaattatttttagtctttggatgataggtctatggttcaaattgtctcttttttcttctctcataacactatgcgatctcacttgtttttaggatcaaaattcataaatatcaatttattttagttttaataatcatattgcatcttatttgtatatattatgaaacttaattttccacggtaacgcggcggagtattcatctataccaaaccgagccgagccggtgaaccgagcgccatccttatctactcccatccagcgctcgcgtcctatccatttctctcgtctctctccctcgcgtctctatgcctcccctctctctcgcacatctctcgcctggcgctcgctctctccctcgcccggcgctcgctctctctcgtgtgtctctctgcctcccctctctcttgcagcggctgcccagcgaaggcggtggtggcggcggcggcagtgggctccctaacgccagatccagcgagaggggaggcagcgctctccccttcgccagatccggtgagaggggaggtggtgggtttcccacgtgtgttcctttagttctcttcacacgcattacttaggccatgcttctttcagcttaatattattgtaatctagattattgacccagattactataagttggattataataagctgacatagttgttagctgtttgtttatctggattattagctttttgttagttgttagccacccaataatttaaaaaagcacctttagagtggattactagattatagtaatctggcttatagattgtaataatttattataataagctatatgttcgttgcagcttactcataataatccagattataataatcataagctgaatcaaacaggaccttaattgattagaagagcattaattattttaaggtggtttcacatgcatgcatgtctcccgtgggctaaagacccacgtataatttcatcatatctagacatatgtactataagcattaatttatgtgtagattaatccggctaataaaaacacaaagcaaacaaaaagatacaacacattcatactaaagttacactgttctatattttgcaaacttaggccatatatatttgtgtgcaagttcaagtgattgacagataaaaaaaatagacgactaacaaatagcaaaactgtaatttattttaatatcatcaagacacatcagcaacaacttgtatatatggtcaattaatatgtaataatgtattagtacccggcgtacaagtatatagatacacttgcacatacatcggttggctatatatataaccgatgagtcgatataaaattataaattaactcggctagctagctagatagagctcacggccggtcactactcaccatcgagaggagagcaaaaataattgagtgatagctgttagctaagctacctagcatcatgcagggaggcgccaataataagggcttggtatgcttgatcgccgccgccgccgtggtgttggtattcgccggcagcagcggcattgcggcggcgcaggcggcccgggctgaagaaggggttctacaagaagagctgccccaaggcggaggagatcgcgcagcgggtggtgtggaaccgcgtcgccggcaacccggagctcgccgccaagttcctccgcatgttcttccacgactgcttcgtcagggtacgcacacaaattgaatatatccatatactggccaatcatatatatattcccctctgtagattataggtttgactgattaaagttaaactgcttcaaatttaattaattttgtagacatatatataggatgtgtttttcccctttttcccaactcacatctctcgttttccacgcgcacgcttttcaaactgttaaactgtatgtttttttttacaaaaaaaaatatatacaaaagttgtttaaaaaaatcatattaatctattttttaaaaaatagttaatacttaattaatcatgtaataatacgtgcttcgcttgggaggagaggttcccaaccccttctcccgaacacaaccatagtaatatttacaacaccaaaattagtttcattaaatcgataattaaatatatttcttaatatatttgtctaaattagttttagatcgataattgaatatatttttatgatatatttgttttgtgttaaaaatgtttttatttttttttaaacttggccgaatttgaaagtcagaacaagttataatctgaagcagagagagtatatccaaacgatacaccatgcacaattgtattcttgatgtgtgcaaatggatatataatgtacatgaaggggtgtgacgcgtcggtgcttctggactcggctagcaacacggcggagaagaacgcggcgccgaacctgtcgctggcggggttcgaggtgatcgaggaggtgaaggcggcggtggagcgggagtgcgccggggtggtgtcgtgcgcggacatcgtggcgctggcggcgcgggactcggtgtcgtaccagtacaggaggagctgtgggaggtggagaccgggaggcgtgacggcacggtctccagcgaccaggaggcgctcgccgacatcccggcgcccacctccaccttccccatcctcctcgcaacttctccgccaagggcctcggtctccaggacctcgtcgtcctctcaggtacgtacacaatttcttgcattgcttgcatcgatcactgaagaagtatacgtacggagactaattattttcttagataatgggcagttcattaagactgtgttcggcagtgcaggatgggaacccattttttttacacgcaaaacggagtggtcttttaacatgattaattaagtattagctattttttttaaaaaaagatcaatttgattgcttaaagcaactttcgcaataaattttttttaaaaaaaacacactgtttagtagtttgaaaagtgtgcacgtgaaaaacgagagatttgggttgggaagatggggtgccgaactcagcctaagtacattcatgaaagcatccgttttctgaacaaaactgatgaactcgaccaaaacacaacgacgcacacggaagaagaataaaagaacagtaccggccggtactccccctattacatcttaacttgaacaaactcattagctaagtccaagatggttacgccatccaaaattagaccacaaagcacagggacaactaatcattggggttgatttcttgatttatcacttcagcagtatcaaaattgtttaactagctagggcctattttgtttatttgtatatgcctagtattagcctgtaatatgttttccaagttgtcctagtgacctagttcacgacatttctcaagaaaaattctactttgacatttcttaatgcaaaaagggaaataattttaccatctttgtaaaggtaaaaaagataacatattttcgaattgtaaaatttggtatctactaatatctcaaggtattaaagtttttagtttaaaatcttgatacatttagttactttctcaagtaaagtaaaatttgtaaaaagaaaaagaaaaccgtccatatgaaaggttgcatggatttgaattgaagcatgttgattaaagacaactgttcccgtagtgtgaaaacaaccgcttgattgcaatagcccagctgaaaatgacataattgtcggtgatggggcaaagaattaattaaacttcaccacaggccacatgcacgtccggttaatgcgcatgtgagccaaaacagtatacgaagatgcaaccaccagattggatagatttagcttcaattcggtaggtaaaaaaaaaacaatccttgggaaagtaatcccagtcaagatagcagctttaggaattaaaaaaattcaaatcaaacgtcggataaaaaaaattataccaaacatgaatgtttttttattcatattcaacattattaccacagtccatttttggattgttgtaagacggactactcaccgtactaaagtaggatggatgactgcagtacttaattagaatagacggtaccgcttagatagcagacaatcctcctaatagcatgcgacccatacttagagcgcgtgaaactcatcacatgttatcttgagcggtatgttactagaaagcgtcggtttctcatcagtgttactatcatacagctgttcaacttaaaagctactcgctctgtggttcgcatgggtcgtgccactatctattggacaagacccataaacataaatccttcgaatagaattacacaattttatacatattctctatgttaatataagtccttgtttttcgcaaagtaaatatttgaaaactaatcttaatgaaacaagtcaaatttaattttggaactgatggtacaagagcatgtaaggtggagcaacttagtacatgaatatgtaaaatgattcgttcgatctatatgaacttttttggatcgtgtggatcaagaccaaaacaacgtactatgactaattttgtttagttgaactctgatcgattaatataggcgggcacaccatcggaatcgggcactgcaaccttttcagctctaggctcttcaacttcaccggaaagaacaaccccagcgacgtcgacccgtccctcaacccatcctacgccagattcctccaggtaattaattaacctgttaattagtggagtaatggctaatctctgcagtaatttaatctcatcatgtcttgcaaaattcagaattaagatcagtagctgcaaaaaggaaaaaaaaaagcatagaaaaatatgtactacagcaattgtgtgtgtgtgtgtgcaagtgcaggggcagtgcaggcgtaaccagcaggacccaaacgacaactcgacggtggtgccgatggacccgggcagcagcgtgtcgttcgacagccactacttcgtgaacctcaaggcgcggcaggggatgttcacctccgacgccacgctgctcaccgacggccgcgccgccgcgctcgtcgacaagctgcgggaccccggcgtcttcctcgaccacttcaagaactccatcaagcgcatgggccagatcggcgtgctcaccggcgccgccggccagatcaggaagaggtgcaacgccgtcaactcctagctagccggccgctcgctagcttggcttattatcattctctaagctttttagctcttacgatgaaaacatgcgtcatatccgctgcgcgcacaaccattattagttgttgtatcctaattattgttatgcgtcgaatacagtaaaattaatgcccacgagttaagtacaagaaacataaaaagattacagatatatatattttattggtaaacagaagtactgccagtatatactggtagtacattgtaccgtaaaagttcaacccagccatcccttcaaatttcaaacctacacctctcactaatttcccctccctctagccgtcctacgccctccttgataatccctctcgagtccagacctctccctccacttaccctttcttcggccacccacagcctcaaccccacactagaacccttatcgatggggcttgttagcagttgtcgatagcgctcatacgggttttgatagggttgattagaatccgctcgattggaacggacgtttgcaaaaagcaatttcaaacaaatttcttcttgtacaacgaatgagataccgagatacttgctcccccatcatctagaagctagtattacgttacgaaaatgcttatcatcatacgtccgataaaggaggaaaaattggacacctcaactcaatggagtagtagtatagcacaggtgcatgacaactgacaagtgcaagcagccaatggagcgtgcatgaaaatcacatcgattcaaaatttaaatgatctttctcttaaactatttatcagaattatgaactaattataccattggatttgttataattaactatttataacaagatctcacatgacaatattctgatgatttttatcacataatgttattataatgtttcaatatgtttttactcatatttcactaattcagatgtaatgttgcatgtggtctttttatatgctttatgctttagtaaatgtattttatgtttcaaaaaaagtacaacttgacgcttcaagagtgatataaaattttaacaaaataaaatatttgcaaatatgttgcaccatatatatttttatgtttccctaggtatgacctaatgttttatgtaatggtagttattgttgtagccagtaatttttatatagttattgttacacgtgatctatttatatgtttcagcaaataaaatttttatgtttcaaaaattgcaggttaacgtttcaagaatgatataaaattaaacaaattaatatttacaaatatgttgcatcatttttttttagtttcagtagtttgggacataatatttcatgtgacggtgcttattgttgcatttagtaatttttataagttacatctctctgggttgagttatccgtacaagtgataaaacaatattatggtgcaacaaaaggttgatttttccaaaacacatataaaatgttgcatggcaatatttcgatatttcaataaatatttttctgacgtttcactagtttatttgtgaatgttgcacgtggtattattggatgtttcagtaagtattttctaatatttcactaattcatttataaatgttgcacgtgttgcttgggatgttgcagttaatattttctaatgtttcaataattataactcgttgtttcacatataatatacaaatgtttcaattagtataggtggaatctaaaccatactccctcaacaataggtggaatctaaaccatacccctcaaccataaaaccgggtaaaaacgactcatccaactatttaaaccagtgcaaaatgactccctaggtggttttgaaggtggttttcgctgacgtggtgcctacatagcacggttgacttggtcttaagctgacgtggtgcttacgtggcattacaatgaaaaaaatgtgagacccacatatcattcacataaaaatttattgtgggacccactgaccatgtgggacccatatatcctcctgtccctcctgccctcctttctccttccactccagtgttaatgaaaaacacgaggcctgggagatcggcttaactccagtgcaggtccaaaactcgccttcgggtatgctagcatgccagttgatttgatcctgcaatcaactagaaataaagacaaagaaaccgtggttaaatccataaacgatagccaatcgactaagtgccgataacatatcgtttatctttgagccgatgtcatatatgcatcgatcggcagttataaatagataataaagaactaaatctactcgatcggctgtagacattaacaatatataatccttatgtcgatatatacttaaatcaagtgattgggatagatcggtcgccatgccgagacagtataaatcacttagattgaatatatactaacaacaagactatatatgttcatagcatagctgatcagatagatctagcatgtatggctaatactccgataccaccctatgttaagatattaaagcaagcagaatataccaaacaaaagcctaatatacttaactgcaataagattttgacataaagggtagatttaaca

SEQ ID NO: 6076 - DNA, 1838 bp, Oryza sativa
tttgaatatggaactgaccgtcggcagcaaatctatagctacaacgttctttgtcatcgatgggaagggtttctatagcttgttgcttggaagggattggattcatgccaattgttgtattccctcaaccatgcattaatgcttgattcatggcaaggcgacaagattgaaattgtgccagccaacaggtcagtcaatgttgccagtgccgatttagctctttgggagatggatggtcttgattgtttatctggaaaagtttgggatggagattttctaaaagtgtccgattctgatatacggccaattgaagatggagaaccaaagctattattttgagggcgtcgtggagggttcaaacgtctacaccaaggatacaatagatgatctcgatgacaagcaaggatatggtttcatgtcggctgatgaattggaagaaattgacataggtctgggtgatcgaccaaggccgacatttattagtaaaaatttatctccggagtttagaaccaagttgatagagctattgaaggaattcagagattgctttgcttgggagtattatgagatgccaggactcagccgatcgattgttgaacatcggctacctatcaaaccaggggttagaccgcatcaacaacctccgagaagatgcaaagccgatatgcttgaacctgtcaaggctgagattaaacgtttatatgatgctggttttattcgtccttgccgatatgccgagtgggtttctagtatagttactgttatcaagaagaacggcaaggtcagggtgtgcattgatttccgaaacttgaataaagctaccctaaaagatgaatatccaatgccagtggccaatcagctagttgatgctgcttcaggacacaagattttaagttttatggatagtaatgcagggtacaattagatctttatggccgaagaagatattcataagacagcttttaggtgtcctggtgcaatcggcttattcgagtaggttgtaatgacttttggcttgaaaagtgctggggctacatatcaaagagccatgaattatatatatcatgatccgatcggttggttggttgaggtctacattgatgatgtggttgttaagtctaaagagataaaggaccacatagccgatctgaggaaggtttttgagagaaccaggaaatatggcttgaaaatgaacccaacaaagtgtgctttcggtgtattggctggccaatttttggaatttcttgttcatgagaggagaattgagattactcatagaagtgtaatgcaatcaagaagattcatcctccagagaacaagacagagttgcaagagataatcggcaagataatttttgttagaaggtttatttctatttgtctagaaggttagaaccttttacaccgttgttaagattgaaagccgatcaacagtttacttgggggtagagcaacagaaggctttggatagtattaaggaatatcttagctctcctccagttttgattcctccacagaaaggaataccttttagattatatctgttggccggtgagaagtcaatcggttcagtcttgattcaggaacttgaagggaaagaaagtgttgtattctacttgagtcatcgactcttggatgcagagactagatattctcctgtggagaagttgtgcttgtgcctgtatttttcatgtacaaggttaacgcattatctattgtccaacgaatgcactgttatatgcaaagccgatgtcgttaaatacatgttatcagctccaattttgaaaggtagggttgggaagtggatattttccttaactgattttgatcttcggtatg

SEQ ID NO: 6077 - DNA, 6225 bp, Oryza sativa
acattataacaagaaagtggtacccaagactttttctgaaggtgagcttgtatggaagtgattttgccgattgggactcgagatagcaaattcggcaagtggtcgccgaattgggaaggaccattccaaatccacaaagttgtgtctaagggagcttacatgttgcatggactcgatggagaagtttatggacgagcactaaatggcaagtatttgaagaaatattacccaagtgtttgggttaatgcatgatcggctgatgttgccgatacatgacagccgatgtgtctacatcgctttgagatggctgatattgttatatcgcccttagttgtttttcatattgtaaatcggttgtggtttgccgatgtacaatggccgatattgttatatcgcccttagttgtttttcatattgtaatcggttgtggtttgccgatgtaccgatggccgatatggttatatcgcctttagttgtttttataattttgtcaatgcttttgacgttgtaaaattaggggggcacatatatacgaaaaatgaaaatttttgagcaaatttagaagttatattaatcggcacaaaggtttgtcaagacaataaagtaccagagtatcttagccgattacaaaaatttataagatctattacacagaaagtcaccgagacaaatattgctggatagccgatatagctctttgcctaatttgttctacttcttcaatagcttgggcatcttgagcgtcggttccagggatgattttcaaggacttggtcatatcagcgacatttttgatggccgatttcagcttcgccttttgttcttcaacgactcgcgggagatcggctagctttttgtgttccagatccagttcggcattgcattcttgaagttgggccaagagctcaatcttgcgagcttcgagccgattaacgttggatttgatcgggccctcggatagcagatcaagcttggacttctcttcgtgcacaagctgccgattggcttggattgtggcttcaatgtctgtcacgcccggaatttctatccaaaattccaaacgcttacatgtgtgtaaaccctcgtccaggaatcagccgaggcacacaataacaaattgataatagagtaccattattactctaattaataagcgaataaaatgtcattacagaggtagatagttcctctcaatcaataaagatctaagcagcggaaaaaaaaagataaacggcgtagacggctccactccacaggcagcttgaccagggctacacctaatcctccacaccatcagcatcattgtagaactcttcctctgatgaatgattgcaaggtgagtatatgacatactcagcaagtcacgcagcaaatatgcaagtgcacaggataacaaaggatggcataatagggtttcatttgcataaacagcatttagtaaacatttcagaatttaataaaacagttaagtaataattaaacaatattaatccaacgctatacaatataccctgttgcataggcccaaccattctgaacaaccatcccggctgcacaattctatctccaaaccaggagctaatcaaattattaccagttatagcatcttttattatggtgagaagtgtgaaactaatcacgaaagacattgttagacccacccataaccgcgggcacggctattcgaatagttctactctgataagaggtgtaccactgtacccacaagacacaaccccacatcatgtcaccatgtgcctcaataccaccacggtacctcggaaaggagctgtgacaataccccttgcataacacaatccaccgcagcgcaccattcctagatcataatcacccccttgtaaacaaggcatggactccccagcgacccccgtgggcttatctccgccatttctcagtctggtgccccacaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccatcatcaggttttagttggcaagtgattaattaaccaatcacgattgaccatcgtgaactatcattaagccatcattaaataatgtagtatatatgattcatcccattagtgagctaatatttctaagcatggctaagcaattatatctaacacatctagttgaaccaatatatatattgcccaactagtcaagttataacaacccaaggtatcaaggaataaagtaatcaagaacaaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaattcttctcctccggaaacggactctccggaaacgtcggaatctaaacagaaaagagcaaaaacaccaaaaacagcacataaacaagcatgaacagtacatgtggatatttttaacatgtagatctcaattttagaaaaatttagagacttgaaccaactaaatccgagctaagatgaattagttatgaatttttaaagattaaatcggattaaaacacttatatggattttagttgaattatgacgcaataatgagttatttttgaaaaggaaaaggggtttactgcgtcagcaactagggtttgcggtggaccgggcgcacggcggcggttcacgggaacgaacggccgagattgatccatccaaaacggacggccgagatcgatcgggtctacggcggctcacggagaaacgacgacgatgacgtcggcgatgacgtcaccaccggcggcggctcgggcgactcgggcgcgcatgctcgccggcgaacgacggcggcgctaggtcacacggcgctagagctcttccgacggcgagagacgaaggcgagggtggcgacgggtagcggcgggcttggggatccttttaaaggggcaaggaggcggcggcgaaggcccacggcgaccggcgacgcgaaggaaacttcgggttcgggagagagagaggaatccgattcgatctcgaatccaccgatttccaaaccgaaatagatgatgtttccaaaagggaaaaggtagaggagatctcgggaaacatttcccctcttttgatttcaccggagaaggaaaggagcggccggatttggaaggagacgacggcggcgcggcgctagggttcgggcggcggcggcggcgcgaggaagacgaagactgacaggtgggacccacctgtcagcgacaacgagcgcgcgcgcgggcggctgcggctgcggactgggccggcttgggccgagggagagagagagaggtttttgggccgactttcggcccaagccaaaagagactttttaaaaacctttttcaattaaattatccatgaaatgcaatttcatttattaaaattacttccttagctcaaataaatcccagaaaaatctaggaattatagaattaagcaaagtatttaatgaaattttatctggccccattttatattggaatttattaattaaaattagatcttcccttctaggcttttaaaaaaataaattctaataattccatttaaacaacaatttacatatttaggatttttagggtgtgacaatgtccttgcgctcccgacgtttggctaatcttagtttggctttctccagcttgaattgatgctgctcaaggtagacagctggtgtaaggacatcgactagctcatttgggattagagcttgaacctcgtgtgaccgagtcctaattggcccacagtttaccaccaagctgtctaatgatgatgcctctagccgaagagagatgtcttcaagggttttcttcacattatcagacaagggagctaaagacttgctagtagtgtcttcttctgtttcttcatcaagatagtctttaatatcgaaagagaacagatcggctaagcctgcaagaaggaatttaaaaaattgagtctcaacatgagttatttggctgattcaagagttttataaacaagacttactggaatggcaagagcagctggttgtacttcttcttcaacatgatgaccccttgcagccgatggagtttgatcacttgatggttgctgaacaggagaaggaggaggaggaggctgcaaaaagataagtattacggaaaatcggttgagatcgactattaaaagaattaagaatatcttattggtggagccggtttgggaattggtgctgccgacttcttctttatagcaattttcttcttctgcaaccataaaatctgtgagtaatcgactataagtgaagggattgcaaaaagaaagctgcttacctttgaaaaatggaatggggcagaaggagttggaggagtttgcttaggtgaagccgatggggttctttcagtatcgcttacttatctgtggcttgatcaacatcctcgccgatttcttcttcacccagagcttgttcaatggatggatctagggcaggcaggtcatcggttggtttaggcttcttgagtttggccttcttctttggggctggagccaatgtgtccacagccgatgacctagttcttctcttcttgcctgcatcggctggttctctgattaggccttggagaagagttgaagtcttgggggcatgatagccgatgataggaggagatggcccacctccattgggaatcagacctggggcatattcaatgtctctgtcactgttgctttcatgtggaggggaagattcggttgtttgcaaaacagaaacaaaagattagtcaagttatgaatcagctgacaattgtttagattaatgatgacaaggtttacctgaggtacaacatcagggaagagatctgtcatgtacatcgaggccggttggtggaatagatgcagcttccattcaccccaccatatgtcaaagtttttgctcttgaatcccgccagctcgatattctcaatgctgcccagaggaggtccttggagattgagcagtcgatccatcatcaaggttgatgaaatttcccctcggcactggatcttatcggcgaaaaataagccgattgggagttggcccattccaagttgtctggctgagctcattgggtgatagaattcataagagacttgaatgtttcttccctgatgaatgccgatagaaaggatgcatgggctgattgcaactgagaaaacttccctagacttttggtatcttttatgattgatatcttaaaatctaaagtctgacgggagctcaaggtctgctgagtcctcataaaagctgcagaaccaatccttgagcagttcagccgatagttttgctccagcattggctggtgtggatgcatactctccatataacatgcatctgcgatgggtgcgttcttctccatcatcttctgtgatcggctccagccttgggaattcggcttctgtcactgatggccaattgacaactttcatgaccattaagttgagccaagattgtagtagccaccatggtccacctgcttcaaccaccgagccgacggctattttggccgatgcattgttcaacattttgtataagtagccgaggaggattttgcctagaggaaattctctttttgactcaagagctttggctgcaaactgccagttggttgtagggccacaactggatccacagaaaagaaacttttctagccacatgagtaaaaatgccacatgctctcgaggagtaacaaatctatggcccatatatgctgccacataaccagaccaaccacctatgcttttggtcctgaaatcgtattggttcttggtgttcaggttcatgggattagcagatgaggatacatctagaccagtgatcatagtaatatctatcagagttggtgtcatcggcccttggttgaacagaaaggcgttgatagtattggaccagaagtaggtggcgatggccattaagggttcatctttggctgaatttgatatggtgagggcaagtgcttggccgattccaatttcatcccaatgtgtttgcttgctggtcgatacacgcttgtaccatgaggtccaactcttctcaggggtggttttctcgagagagggccaagactaaaagagtgttctttcag

SEQ ID NO: 6078 - DNA, 1057 bp, Oryza sativa
aatcaatctgatgcgaaaggagaagatctagccgatgaaaacttacctcagcgtattcggccgacggcgcggtagacgggctggcggaggacgacattgccgtgggcggagatctggccggagatggagtcgcttggggatcgccttgagcgtcggagaaatcgccggagagagaaaggacaaagttgtcttcggcgatgaagatttttcaggagcaacggttagtatttaaagcgctggaataacggtcagaaaacggcagagtgcgaatcttgctcggagccgatatatggcaaatctgaaacattaccaaatattccggacttggggggcatgtgttaacgaccaaatttggtaatatcagtatcggggaagaagattagatcgaagcagaatcaaagatgaggatcgtcgtggaaacagagtaagaatcggctggagttcgaatcggctacgattgggatcggctaagtccgagtcagactgggttaggtgatacagccaattccgacaatacgacttggtgtacgacatcgggtcgagttgatatgcttgaagatgattgccacgcatggatagagtcctgagaaggcgactgtatctattagttaggatattttatataaattccttagagatatgtttggcaaaagtctgccgcaaagacttatggtatcttagagtttgtcaaggataagagtcttgtccgatatggacatgttggataattctcgggtataaatagacaccgagccctatgtaatcaaaggaacacacacgttcaatacaatctcggcgcatcgccacccttttttactttagttttatttcgacgagttcttgctttcgggttgagctgcatcgatttcgatcttcaacaagaggtaaaacttgttatgacggcttgcgttcttgggattagtgcttccatctttatgatactctaatcttgtttatgtaattcgtcgagttatcatatatcttatataatctgtggcaatatcactatctaacctacactcagctaacatctatcaatagagggcaaccgattagg

SEQ ID NO: 6079 - DNA, 677 bp, Oryza sativa
ctgaggcaatggatgctggtcatggactcgaggcgtctcagctttccggtcgatcggccgcgagtccactccgccggcttgtcctcgccaccgccattgctgattgcaacaacgacttcaccaccggcctgcctccgtcgccgccgactggtgttcccgtctgcatggctggcctattatgccgccgctgttgggcgtctacgacttcaccgccggcttgcctccgtcgccgctgagtggtgcctccgcctacacggctggcctattaagccgccgctgttgggcgtccacgacttcaccaccggcttgcatccgtcgccgccgagtggtgcctccgcctacacggctggcctattatgccgccgctgttgggcgtctacgacttcaccgccggtctgcctccgtcgccgccgattggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccgccggcctgcctccgtcgccgccgagtggagcctccgcctacacggctggcctattatgccgccgctgttgggcgtctacgacttcaccgccggcctgcctccgtcgccg

SEQ ID NO: 6080 - DNA, 1029 bp, Oryza sativa
tggtgtttccgctggcacggtttgcctttaatccgcagttgttggcgtataggtcttcacggacgggtttgctttcgccgccgccgattggtgtttccgcttgcacgcctggcttttatgccgccgttgttgggcgtctacgttttcaccgaccggccgcattcgccgccgccgattggtgtttccgcctgcacgtctggcctattatgccgccgttgttgggcgtctacgtcttcaccgacgggccgcctcgtccgccgctgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcacggctggcctttatgccgcaattgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacgtctggcctattatgccgccgttgttgggcgtctacgtcgtcaccgaccggccacctcgaccgccgccgactggtgtttccgcctgcacggctggcctattattctgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcatggctggcctttatgccgccgttgttgggcgtctacgtcttcaccgaccggccgcctcgaccgccgctgactggtgtcaccgcctgcacggctggcctgttataacgccaactgatgctatct

SEQ ID NO: 6081 - DNA, 909 bp, Oryza sativa
  unsure (1)..(909): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgtccaagtgcatcactggcaccaaaaatctttccccaggctgtctttttcttactagcagtactgcctggggttgttctttgcaatctcacagcaccaaacttactttcatacttagaaaaatgtcagacaatgcagccctaacctcagttaaataagtagagtaatcagaggtcaaaatttgtgacatattttatagaacattgctaaaacctctgatcttagccctaggatccaagataaaagcaaatgaatacagaaatggaatctcagaccagtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6082 - DNA, 714 bp, Oryza sativa
tcaatgcaggaaactaattgaagattgttgagctatatcaaattataactactcatttcaatatagttgtccacatagtctatgctcacagaacaagggagacaaaagatcaaagtaatgtttagggatcttttttgttttgggagttggtgtgcgcttgtgtggtggggaaaatgggggctagaattgagagctggtcaactacaattttcatccaggacagtttagagcccccaagccagcacatattattttttactcccttcatcccagaaaaaaagcaacgttcataatctggacagaggctatgtccagattcgtgtatagaagttcccccggtttctagagtctgattaaccccttgttaaatagggtacttggtatggatagcagggttagagaatacaactacactataaattccctcaatggagaattattttgaaaaggcaagtcccaataaactggagaacaattttgcacggaggggttgagaaaacaaaattttcaccaatactaacctttccgatgcatccactttggcccttaagtcttccagttctgcttcagcaattgaaagcctttgttggcatgcagtttccgcttcatttgctgcttttactcgaagttcaagattatgctcttctaaacattttctcaaatattcagcttgcttgcgagctcgggttttctgattcttcaatctctgaaatt

SEQ ID NO: 6083 - DNA, 902 bp, Oryza sativa
cgccaatccattgactggaagactttctccgccagcggcgccatcaacttcgctaggttgtctatctccgcgggagtcctccgagaatgagaaaacccttcgtggaggaactcgaggtacaactgcggacgatgatctcgtatacacaccagcacgtgccctccggcataccggctcgatcgacggcactcctgcttcagggcctcgtcgatacgcttgccgatgccttcgagctgagcacaggctccgtttagccacgagatatatccggccgctgactcctcgggatccccgcgaggtactcggagttccctgcagacgacggccatgactgtgcaacaactcctgaggtacgagttgaaccacaccttgcgacctctgagtgcctccacagcccggtcctttttcacttccaacatagtcctctcaagttcggcgacctcgaacttcgtcctccagtattggatgtgacggtcgcgatcagcaagcgcactctcgaggtctgctcgacaagcaaacaactaagttaagctgttctcctcttttgagagcacggcaagttaagctaatccagatagaagagcaaaggagatggaaacaaaaagaaccaacctaaaggagtcgtcgtcatgcatgtctccacgggcagattctggtctatgtcgtcttgcggcacatacggctcaagcgcaagtgccggaatgattacaggcaactcaggctgcccgcgttgctggacatcctcgacatcgacatctctacaaacaacaacaaagtactcggaatcaaaatgccaaagaaaactaaggtgataactgcacacaccaaggcagttggaaccaacaaattgttttacaatgcatgattgattaaggagtacaggcgaaccgaagtcctactct

SEQ ID NO: 6084 - DNA, 283 bp, Oryza sativa
tttcatctggtcgggcagaatcaaaactggtgcggatactaatttcttcttgagctcctcaaaactcttatcgcactcagctgtccatttaaacttctcatctttcttaagcaactgagtcatgggtcgggcgatcctggagaagttttcgatgaatcggcggtaataacctgccagtcctagaaaacttcgaatctgcgacacggtcttcggtgggatccatttggtaactgactctacgttcgatggatcaactgccacaccctgagctgtaatgacatgg

SEQ ID NO: 6085 - DNA, 18864 bp, Oryza sativa
caaaaggaagtggaagggtaatgttaagtgttgtttttgtgatactaacgaatcaattcaacaccttttctttgattgtattttggcaagattcatgtggaatgcagtctatatatcttttggaattcacccgcctaggaatgttgctagtatgttcggcaattggctaaagggggttcaacccaagctaagagctcaaatcgttgtggggatttcagctttgtgttgggcggtttggttatgccggaatgatgtagtctttaatggctccaatactaattttctgttgcaggtgattttcagggggactttttaggcaagacaatggtctttgctacttaaggaggaagatggccaaaaagtgagagaaggttgcttgatcctagagatgagagtttctagctttttcgcaatgaagggatggaacttaaggaaaagattgggagattaatgttctcttgttcttgtgtggtatggttgaaactttgtattaactttttaagaattgctgttgctagagcctaagtgctcgggtctagttgcttgtgatggtgttaaaccttgtgtaagggtgtgagtctatgtactcttgtgagttttgttggggctgtgtacatccttttttgggtgtagaggccggtttaatccattatctaaaaaaaatgtgtgtggattatgctgcattggtattcttataaattgcttgtcttgtatgcccataagaaggctctatcaaaatctttgataaattttgtagtaggccttttttgtgtgtgttttaatggcacttgaggaatataaatacatgtttttgacaaagtaaacataacttctgacatttacacacaccaactaaaggtacacacaaccatatatgtgaaaataaggatttaaatcttggtgtgcaaagtcatacacccacgacgttgtgcagctcatagattccatctcatcttccaccaccctccacccataaaactgagatgagcatcctccctctctctatatatgctacctcaacttgcatactgccttctatcctcctaatttatgcaaagaaaaacgattaatttaaacaactaatgcaccaaggaattcacaaattatatgacgtttggattgtcctaccaaagtatgtaaagaatttccaaccacaagcctcgagtgtgtgtggtgggtgtacatacatggcttcaacatgtggacaggtgtcattcttcatactacaagaatccataattttgttggcgcccaaaataaaagcgccaagaaaaactttccacattgttagccgccaataaaatggactttcccttgccctctagacttggtgggtattccttgttggttggctggcaaagcttattactttggtagttttatgtttttcttggtggtttgtgcccctgaagaaatatatatcttgattcttgtcatgaggttcatgacaggaagaaagaacaaagtggaaaaaagttctagcgcaaatggatgcaaaggaaaaacaaggattcaataggaaacaaatacaccattcccatccatcccactttaaccgaagtcttattcataccattttccatccatctcactttaaccgaagtcttatcaaaacaatacctattcattcatcttcctatttaggcatgcgtactactccccccacaacctatagctaaccatcaacctccatccactccatagctgccactacccccaccttgccatgacatcaacacaatggatccaatctgtcgagtctctgccgaccaccatgacgcgccttcatcaatcctctttggcgagtcactcatgacatgatcctctccagcatctttagagcgggaaccgctagatttgtcatcatcaaaagctagttggcctgccacgactagattcaccacagggtccttctcttacagtcttctcccaagctatatatctccaccactaacttatcttgttcacttgatcttcttccagaaaaaatgtaagtaaagagtattactgaagtttacactaagaagtggttcttattggccatgttattataacatggtctatcgtagcacaacatagtgttccaatttataggaaaaagtagtcattcttattaaccattttactgccatgcatcaaggaaataattgaaacagaaccaggtactaccatactagagatcagtctagacaaactaaagaccattgatgatatataaattgaacttgtcataccaccaatatcaatcactataggcatcacttccacacatatgtaaaagtgtcttacacattttctcatattcaaatttagctaaaaattgtaaaatagtgtagtgcctaaattcagcagggaacttcgaccttgaacaacctctgagtgttcctggtaactatattatatatcatgtttacctgttgctaagtgtgagtagttgagcccaaacttgttctattttcattttatctcaactaatacaaagatcgttccgatcagctctcggaacctgctttcagggttaacgccaatcaccaaagccaagacgacggcatcaagatgcaccacagggtcagaggtgggtgggcacatatttgagatcaacgggtacagattccagaagggcatcggtgttggcaagtttgtccggtcgaacatcttcactgtcggtggcttcgactgggcagcttctatcctgatggagtttgtgaggcttacaaagagtacatctcagtctatcttgagcttatgagtgacaatgctgaggtccgggcattgtattccctcagattggttaatcaggtacctggcttgtccaactgggaattgaccctgaacaaacagccagtagtgttcagctctaggggtaaaaatcggtttggaactgtcatttcacatgcctatttcaagctaagaagcgatcttgagctgccagaatcaggcttcatcaaggacaatcgcctcacaattaaatgtctacttctggttgcgaagtgagcatagctcaactggttaggttccttgtggtggaaccagcccacccgggttcaaatcctagatttgacacgggtgctcgcatttacggctaattattctttcagtggtaggcgacgtacccgttgacagcgaggcgcctgtggtgacttcgtcaatctcaagacatgccggctcagtctttcggaggtgctcataggggtagagtgtgcgtgtgtgcgttcataggggtgagtgtgcgcacgttgtaagcgcctgcgtacgtactgtgtttctcaaaaaaaaaatgtctacttctggttatcaaagaatcacatgtgtgtgaaccttcagggaggtgataagattgagatgatccggcatttacttgtggctgcggatagatatgccatggacaggctcaagttgatttgccaacacatccttggcaagagtcttcatgtggacaatgtggcaactacattggctttggcaaacgtgcacgtcacaactacacacctgatttttcctagacaaacacctcaataggttgcagacggataagtgtctgtgtctgcataactcgaccctcatttttgcatacagcttcttaagagacccgcatgcgaaaatctattttcatagacatccctcttagggaaccgtatgcaaaaatatagctatttttttagatgtgccaattaatcggccgcatggaaaaatatattttcgtagacggacctcttaaagttccacctagaagtctgagttacttcctctttcactctttagcacttcgaatttgttcaagtcatcccctctctatctccttacctcttccttatctcctctcttcctcctcctctcctcctctcctctcatactcctctctctctatctctctcaaactctctcccaggaactctctcctttccaattctcgggcgcacagcggtggatggcggacgggagcgcggcggcagaggccagtgggtgcgtggtggcaggctccccatgcatcgaaggaggcagcagtggtggtggttgcatggtggcgcccgggtggtagtagatccagtgttgggcgacggaagacgaaggcggtgaggagagcgcgacagttggccggcgggaggaacaaggcagcggcggtggcggtggcgcgcggtggctggcggtcggcagcggatccagtgtagggcgacggacatcgaaggtggcgaggggcgcgcggtagtcggccggcaggaggaacaaggtagcagcggcggccatccccctactcggatccacgcgaatccagcggcggtggcaggaggagcacacccgcggtggcgggaggagcccgacggcggtgaacgggcccaatggctaatgggttagggaaatgatttcccacctaccaaaagatatctttaaatcctaaccattcattctcccacttccatttaattccaaccctttattcatttcccaatctcaatcccaccccttatttttcattatccaaacataccttaaaggtaagcaaatgtaaatacaagctaagtgacacatcatcaccagacaatgtcctaaccatccgtttcaacaataaaagaacaaagaaagactaaaactgatcaaccataagcaattcatcattcaaacattctggacaattaatgatttggtttttctagagtgtactttatatccatttaattaattagtattttttttgaaattaaatattttcttcactagcggcttcttaaaaccagatttattagtttgcactatttctttcatactgatgttggcataacacatatatgaacaggtttacaagatagcataatatcaaaattttaatgtaagtcctcttaaagtaaatcttattttgttgctaactactagacattttttccctttgttcagttattctttttctttagtgtgcacatctttttaaagtcattaacatgtacataatcatcccgcaacaatgtacgagatgtgattagtataactatatagttcattcacactaagtacagttaatgctatttatcttctatctcattaaggcgcatcacctcaactatgttaagcccttcgatgattactctatggtctaaattgactccattctttttcttctcttataaagtcacagtccttaattagtttttgcctttgcatgatcaatcaattgtttgtagcttttatcgatgattgattaaagatgtaaattacgcaaagtatataaagttatgtcgtttagcttagattaaagtcatcatatgttgtatttctaccatattagcatacaatactcctgtagcaatgcaattatgcaaagagtttcatctagtattattgcacattagcttgccattgtgtggagcttatggatgtagcgcagcatatgccttatgctatcatagtgttgattgcattatcttcaaaatgtgacaacacatttttggagaacgtgtgtgttggatattatatactccctccagtcattattatataatccctccgtcactaaaattagcgttaaaacatcatatactaattaccggaggaagtatataagtactacactcacttccctaaaataatattggtgatttgctactctataaatattgccacttttgattactttgcactctgacaataccatgtaagaccatctgagttcaatgaattgtgggctaggatggtaattaattgaagcacatcctatttctagagtagaaaaataccaaatctaacaaaacccaatgcttatctccccattttctctccaccatggttcatctctcctacatggcaaccctgcgaagctcaaataagcctgtaactgatcataaataaaagagtaaatttcacaaaactacaggtactttgcacaatctatcacaaaatctataattttaaaaattatctcataaaactacatatttagggaccctgttattacaaaactacatgttttagctctcttcgttaaatctaccgtcacctgacagggtggcccacttgcagcctcaggaacttccccgttaaatgacacggttcctagttttcctagcgtgaaccgaataggttcctgagtcggatgatgcagttatagatggccatctgggcggcacggctcggcacggcctaggcacggcccgaccaacacaccggaccatgacgtgccagcccacatgctgaagcatcggcccaggcactgcccaatacgactcgggccatgttgggccggcccgaaggcacgacaacccatcatgcttcttcataaaaaaggtataatttccgtccctcatttctttgggtcatgtatgaataattgtaataagtctatatgcatcccttctctcttggcccgtgaattatatggctacactaagtctaattttagtccctaaactatttttcttccctcctcattggatagggccgtgccgggcttgcccaccgtgtttgggaatcagcccaggcctggccaatcgggccaggccgtacctgggccgggccatcgggccttatggccatctatagatgcagcttggacgaattgaagaaccgaaactaatgcaaacggacgacgcgcagcagaccaaccgatgcatctttaaccgtaaaacactcttattttccatcatcttaaaaaagaaaaagttggatatccaattggaaggggcaaaatataaaaattcactgcctagggtttgatgtaggagatcgaagaggcgtctcctcgccgtcgtcgctcaccatcttccgccgcaaccgccgccgccgatcgcctctaccctcgacgcacgcaaggttggtatccatcagcttcaccccgcgcttcctcctcctccgccgccgcaagaagagctagcttgcccctttcccgccgatttgatccgatccccccaacctgctctgatcgatcggttcttgggaaatttcgcagcgggggatggtgtccaagaagaagaagacggtgtcgaggcacaccacggagtcggaggaaggcaggcactcgttcgagatcgtcgggtacagcctcaagaagggcatcggcgtggacgagttcgtcgaatccgccaccttcgccgtcggcggctacgactggtgcatccgcttctaccccgacggcaaaggcgatggtgccaaggactacatctcggtctacctcgagctcctgaccaaggactgcgccgtccgggcggcctacgacctgagattggttattcttgcccccgggttgccaaagagtgtctactctgaaacaactcacaggatgttcaattctgaggacagtagcaaatttgctccgcattacgcgactttcatgcacagaagtcaactggagatggaagcgtcaggctacatcaaggacgatcgcctcacaatcgaatgctttgttaccgtcgtcgtccaggaatcgatggcgtctaataccgtgaaggcccatgaattaatcaaggtgccgccgtcagatatattggaaaattttggcgaattgttggagaagggggaaggggcggatgtgactttcgttgttgggggagagaaaatcgccgcgcacaagatcgtccttgcagcacggtcatccgtcttcaaggcggagctctatgggcagatgaaggagaagagggcccggcgggtaaccgtggaagacatgtagcctgatgttttcaggggcctcctgcatttcatctacaccgattcgttgccggacatggatgatctcagtgatgacgactactatgagatgatcaggcttttgcttgtggctgctgataggtatgccatggacaggatgaagttgcagtgcgaaagcatcctcggcgagcatcttgatgtgcagaccgtcgcaactacattggctttagctgatcagcacaactgcaacggccttaaagatgtttgcattgagtttatcgccactcaaaacaagatggatgatgtggtggcaactgaaggctatatgctgaggacttgcccttctgtcttagttgatgtattcgagaaggcaagtaagttacgtagaatttaaatgctaatgaacccccttctacttaggtgctgtctaggagtaggttctagttcttaaattgtatgaatagcatgtctgttttgcaagagcagctctgctaacaccgggggttatatgtgctgtgttaaattatgatctccttttagggcacccacaatgttgtaaaaaaccaggtagtaagcattaaatggttgcttactacctggtattagtcattgtgggagtagttcatacttaaagccaggaagtagcgctactgccggcaagaagggaataaaaaatgaaatgtgtacagtggagttctgacaaaaaattttaaattgcaagtagcctttgcttcttccaaccgttgctctcctccccagccaaccgttgcatggactgttcttcttgccatcttcatgccctacaaaaacagagatggctcataatttctttgaatcaacacaaacacattctgtgaaacttagctagctgagagcttgagatggatccctccaagagaggtttcatgaacttgttaaaccaaggctctccaagccaacaatctagccaaaactcccctcctactcaattcccctcaactttctcccaatcacaatttccccaatccccacattttactcaagcctcaccacctaatttccaaaccttcaacccttttggtcctccagccaactatcacctatatggtagttctcctccaaactttcaaggttttcagcagcaagcaagctggttacaatctgcaccaataagctttcaaggttttcgtccccaagaaagttggatgcactcaccaaatcaagttgtcgggtccgcctcatctcatggatccgaatcagcctctcagtgccctgcaagacaggaagagaacaatttggttaacatcgaagagtcaagtgacaatagccaagagacagggagaagagggacacgcgtcaactggaccgaagaagaaaacttacgactcctcagctcttggttgaataactcactagattctataaatggcaatgacaagaagggagaatactattggagggatgttgctgcagagttcaatggtaatgcatctagcaataaccgcaaaaggacagtcgtgcaatgcaagacacattggggtggtgttaagaaggacattgcaaaattttgtggagcttattctcgagctagaagaacctggagcagtggattctctgatgatatgatcatggagaaagcccatgcattatataaatcagaaaacaatgataaaacttttacattagagtatatgtggagagaattaaaggatcaaccaaaatggcaacggatacttgaagaggacagcaagaacaagaggactaagatttctgaatctggtgcatatacatcatcatccaaccaagaaactgaggaggagaccagccgaaaagagaagcgtcctgaagggcagaaaaaagccaaagccaagcttaaagggaaaggaaaaaaacctgcaccgtctcctttgggggaccagccatctcaagattttgttctcttcaacgaagctgtaaaattgagagcagaagcagtgctgaaatctgcagaagcaaccaccaaatcagcggaagcaaagaaggaacaaactaggatggagaagtatcagacatatttaaagttgttggacaaagacactgccaattttagtgatgcaaaactcaagaggcatgaagctgtcctcgaaaagctagctacagaacttgcagaagaatagaagatccctaagttatgtttgtacccctagtacttagtgtgtcactgtttcattaagtttaacttgctagtaatatttagacttgtgataggtttgtagggcaagtaattgttgtattgtgaactcagtgaatgatgaatgtaatatttcactagtgagaaggcatatgaagtgataatatttgcccacaatcataatatgtctgaaccttctgctctgtagtctctgatttgtcccataacaacagcaatttgttcttaagcagcctgcagaaaaatatacattgataataattagcacaacattttataatatggtggtttgaatagatagaaaaggaaggtatggttgtttaaaatctagctgttagaatacatccaaaaagcaagacatggttgtttaaaatctagctgttggaatacatccaaaaagcaagacacagttgtctaaaatttagctgttggaatacatccaaaaagaaagacatggctgttcagaatctagctgttggaaactagccgttgcaatggaagcaaaagcaaggcatcaatgttacacatagctagcaggatgaaccatatataaataagacatgcacatcacgaaggcagcattccccttcctttccttcaacttcttaccaacataacaacccatctccaaaaaagatgtccactgagtcacaagataattctagtcattccgatgagtccatcactagtgagaagcttgatgatatgacatgggaagaaattaatgaccctatggaagctcagcttgaagctcggttggaagctcaacttgaagcgagattgatggctcacctagctggtagctctaatcagctggggggctacacaaggaggtacattagtagagatcatgaagatgaccccaacagattatttgcttaaatatttttctgagagtccattgtacaccgatgatcagtttcggaggagatttcgcatgagaaggcatctttttttgcgcattgtacaagctcttggtgtttggtctccatattttcgtctaaggcgagatgcatttggcaaggtgggtctatcaccattgcaaaaatgcaccgctgccatgcgaatgttggcatatggtacaccagctgatcttatggatgagacctttggggttgcagaaagtacaacaatggagtgcatgatcaattttgttcaaggtgtgcggcatttatttggtgaacaatatttgcgcaggcctaccgtggaggatattcaacgtttacttcaatttggagaggcacatggatttcctgggatgttggggagtattgattgcatgcattaggaatggcaaagttgtccggttgcatggaagggccaattcacacgtggtgactatggagtacccactattatgcttgaagcagttgcttctttagatttatggatttggcatgctttctttggtgctgctggttcaaacaatgatattaatgtgttggaccagtctccattattcactgaaatgatacaaggaagagcacctcctgttcagtttaccataaatggtacacaatataacatgggatactatttaactgatggaatttatccggagtgggctgcatttgccaaatcaatcaccaggccccaaagtgctaagcacaaattatatgcccaacgtcaagaatcagcaagaaaagatgtggaaagagcctttggggttttgcaaaaacgttgggccatcatacgtcacccggcgcgtatttgggaaagggaagagcttgcagatataatgtatgcctgcattattttgcacaacatgatagttgaggatgagagaggctcatatgatataccggatgacaatacatatgaacaagggcagtattctcctcaaatgacagggcttgaccatggaccaatatatggatttcaagaagttttagagcaaaacaaggctatccatgaccgacaaacacatcggcgtctgaagggagatttgatagagcacgtgtggcagaaatttagtggtcagcaacaataagattagattttaataattccatatcaaccttgtattttactagtttaatttgtctttaccaatttagaatctaaatgtttgcttccaaaagtacttgtatttgtatgtcaaatgtattactttttatcagctacgtattccaatagggactatgtacactagctagttatcttgcaatacctacaaaaatggattgccttttatttctgaagaactatatatatgttctgtatacagctagtagactgaagaaaaaaggagagcaaaactaccaacagagaggcaaaatgtggttcctttttcctgaaaacatttgaacaggaaacaactgtgttgatacatagcaacaaggttacttacaccaacaccaatgcactggtgtcaagtatactcccctgcagctagctgatcgagaatcgagaatcagctagagccctgacaaacatatactccagtagctatatcgaatactattgaagttttcagattaatcaaactccgatgcttactttcgattagtgttgtaagaattaaacataattatatctcatcatcatgtagcttgtatttttgagaaaaaagacagtcggttgctgttaacaggccggcaacatagcaaatagatatattttggatggcaagagagttaaattaaattttctgcaacataatatttagcaagaacataaaaggttagtgctagctacatccgttcgtgatgtagaacagtagaaggttaatgtagctacctgttttaaactgttgtatgctgggctcttatggagtggggaaacctagtgttgtgttctttacttggatagaagcacgaaccataacacagatcaaacggtaaaacaactgaccgtgattaaacaaaaaatctgtccacatagttatagcaactccgaccgtgattaaaaaaaaaatctgtccacacagatatggcaactccgattctcataaactgaactagaaaatataacatgcgcaacatcgacagagaggtacatggtacaatatttatcatgcaagcacatacgctattctactacttaaatcacaagcataggggttagttggacttacagttggtcttgcagctccgtcgcagatctcagcaggaggatatgaagccgaagctgatcacacaccagagaagatgacctcctcagtctccagccgggctgaagcaccagtccgccataataagggaggtggcttgcggcgtcgggcggcggggatagcggcgacggatgaaggggaaagcgtcgcctgattgcagagaaggaaggtttgcggcgtcgatggtgggggtggagcggatgcggcgccgggtggtagcgatagaggggattgcgtcgttgggtggcggagaggaacccggcgtcagtggaagggtggaggggtttgtggcgttgatttcggggggagggggagcggatcgccgcatggatagtggggacggaggagttggcggcagcgagtggcggggtaggagcggattttacggcggcggggaaggagaggagattgcggcgccggtggaaacagcgaaagaggaattggggatcgatctggccggaactcgcgcgaaggaactgaggagcgccgattttttttatcctgtggaccccacctttactaccctctcgccgagataagcattgtggatagtgtcttctcctattaccgcctgtgactgggtcccacactaatactcatcttgataatatacattggtgttgcccttagggaaaagtgatagatgaacaatagttggatatcgatgtaaggagctgtcatagcctcaagctctcaagtgctgagtcgaacaacattagaaaaaagtttcattccactgagtgtggcaatatagcagcataactagcaacacactgatgctgtcattttaatattctgtttccctgttatacattgcctgcagagatatggcattttgcggcatgacagcatgagtagtttgattgttcaatcaatattgcaataattttgtagttggaatttgtttggatgatcgtgttcatgattaatgtttggttatctggttagctgttaggcttttaagtttcatctggcgttcgagtccaacagctaaacctgctgatattgccccaagtctatattaacgaataattaattattctatagctttgcgtgctcatgttttactgctgcaatgggaactttggatagttcataattatcagaggattttatcgactgcattggtgttctattagttattcagagtaaaaactaattatcttttacaccagcaagcactatatagagagattatttaccatgttgaaccttatgaaggtggtaaaatgtaggcctgaacagcagtacacttgaaattttagagctaaacaggaaagtacactcgaaatgccgtaggaaactgtcgacataataaacagatacgcccatcctcgatggttacgcgcgacatcctcgcctccttcatacccacgcagagctgcgcctggaagacaggcgaccgcatcgcgagcacgatcttatgcgccgcaaagctcccccttccaacaatgaaggtaacatatgctccctgctttgtctccagcagcttgccaacttgccaagatgctccgcgatgtctgacggcggcacttgaatgatctcagaggtccccttggtttcgctcagccgcgattctttgatgaccttcaccgtgctttcaaccgtgatggtatcatccttgatgtaacccggacaatgaaagatccaccgaatctggcaagatgagtactgcaaaccggctgataccttcatggctgaacaccggctgataccttcatggctgaacactcacggtgtccggcgccggccggaatcctggttcagcttcagcaatctcagttcataggatgcccacgctgttgcattctcggagtcgagcacgaggaagaatgaactggccggcgatttatcggatgccccgctgctgggtagaagcggatgctccagtcgtagccgccgacggcaaaggtggccgattggacgaacttgccgacgacgcccatggccttcttgaggccgcgcgctgtacccggcgatctcgaacgcgtgcgtcccctcctccacctccgtgacgtgcctcgacgccgtcttcgtggatttcaatcccatctggtgggtgttcgtgcaagtgcaaccaagatcaattcagagtaactgtcagttacgaggaagaaggcgacgagagtggtcgcgaacggcggagagcggtgaaggcgacgagacgaggccgattggcagacaaggatgaggtcctaagattttagtgaggtttcttcgagaaagacaagatgtagcagaaaacatgaaccataatactctcttcatctacttttcatagtcatatttcatcttggcacaatgactaaagataagtaattcttctaaacatccatttaaatatgctactccctccattccaaattgatctacatatatttttttggttattcctaaatgatgtacatatttgtgttcattcattgtgcattggagtaaatagacattgatgcatgcatccatgcacacaagtatttataacccacatgcaatatcttgatttttctattggctaggaaatagtggggatcgtacatacattgagtttgttgctagagtaaatatagtatgagagagttattagtttttcttggtcttagtgtaccaatgaaatatgtagatcaatttggaatggagggtgtcagggttacgggtcaggcataccctctacccttcgatatacgttacatatcgacatggcatacctacgcgcacgcagatatttcctacatatcctaaggaaacctttcacgaaatctacagatgggaagagtccttctcggacagaactgggtcgtcgacgtatcatattgggtctgatatctccgagtcctacttggagacctccagatctgtgatataaaagggaccccccggggagggcatagatcatcgaatctcagagccaacacaacccacacagcctacgaagccgaagtctgcgaggagccaagtcatcgagagctagtcgaatccactcgactacgatctcgccggatccgacaagttccatcgttccctttgtaatctatgttttccaccatataatcccatatcaactggattagggctattacctactaaggggcctgaaccagtataattcttgtcttttgattgttcgatgtcgtactagatccttgtaccaacgtaccccaataccctctatatccggtctacgggtatcacccgtcgacagtggcgcgccaggtaggggggcttggtactcatggttctactactatgtcatccagctttgtcgacaacaatgtcaacaccagcctcagccaagcgctccctgcttcaacaatgctggtatggactcaagtcggcgaaatcgtcttcccggtttacaccacgacgccgatctcaaccggtcctccaatgaccgaaaacgagaacgcagtggctacaaaccaaggcgactccatgtcgaaaaatccacccgtcgaaatggagaatggatcatcgacgacatccaagctcgggaaggattctgatacggccaaaccttgtccttccgacatgaaccacgagccggcaaagatgacttccgaagccacaaggtcttggtgtcctatccacaaaaccaagaaacacaccctgcaagattgttgggaactcaacgtccgtgttgaaattcgcgcctgcaaagaacgtggaattcagcgtacttctccaactcgggatgtctattgtcctattcacaagacaaagaatcatgacctctcgagctgcaaagtcttcctcggcgccatgaaagctccgtctcctaagtcatacgtctccgtcagggataacggcaaggaacaaggagcgactccagccttagatcgattcattggggtaatcgatatcgatcatcacgaaccatcggtcttacatcttctcgaagactatgggtcatcgacaacgagcgtgccgcgggaggtattggctatcgatgacgttggcacgtcagcgcaagccaacgcagaagtggcgaatcaatcgactactccaacccaacacatcagggccgttcaagctatactgagggaaactccttacgatcccgttctgaacgatgacctcgagcgttggacagaacgactacgggaatcggtgaccaacctcagcaacgcgtttgaagaagccgctaccgcaacgcatcaagatcagccgccaactggcgacgccaatggtgaagatccggaatggagggaatcacctcaacgagccactcctccacctcgcggcgctggtgatctccgagatcaaatcaacggccgccgagaagcacgacgcacacgagacaatgtaaatagctctcggcgtcatgtctcttcacggcgccatgataacggaaatcgaggagaccactcaaacgaggaccgggatcacgacgaccaccacaatcgcaacgatcgtgaacgacgggggccagacaatactggtcatggccgccgccgaaacgacgacgataatggagattggtgccgagagaatagcgagagacaatgacaggattcccgagatccaggccgtcatcctcgtaatcgtacgccggaaccaagcgacccatcgtcatcatcatcatctgcgtcctcctcattgtcagacagacatccacgaaggacacacgaccgccgataacccaccgcccccaacgctgggtgtagggctttcggtcgttccctacgtgatgtccgatggcctgagagattccgacccagagcaattgaaaagtatgatgggagcaccgacccagaagaattccttcaagtctactccacagtactctatgctgccggagcagacgacaacgcgctagtgaactatttaccaaccgcgttgaagggttctgcacgttcatggctgatgcatcttcctccctactcaatctcttcgtgggcagacaattcgtcgccaatttccaaggaacgtacaagcgccacgcgatcgaagacgacctacatgcgttgacacagaactcaggtgaatcattgagggaatatgttcgacgctttaacgaatgcagaaacacaattcctgaaatcaccgacgcttttgtaatctgcaccttcaaatccggtgtcagagatcgctacactacccaggaattggcgacaagacgcatcacagccactcggaggttattcgagatcgttgagcgatgcacccatgtggacgatgcgctaagacgcaagaacgacaagctgaagaccgggggagagaagaaatcagccacagaggcatctgagtcaagcaagaagaaaaatcgcaaaaatgggaaaaggaaagctcaagcgaaagtcctcgcagcagaatacgcgaaccgtcccaagcacccagactcacaagacagcgacacaaagaaatcttggtgccccatacacaagacggacatacattctctagaagattgccttgttttcaaaaagtcgctcgagaagcacatggcgtttgaaaaaggcaagcgagtatgcgttgtcgagaagaacgaagagacggctcctcacgaatcggattctgcgtatccagactccgacctccacatctcacacattttctgcagctccacaacgtactcctccaagcgagaatacaagaaagtggaacgtgaagtctgttcgacatggcggggagctgcacccaagatgaagtggtctgagcagaaaatagagttctcggaagaagaccaccccaagaccgtcgttatcccaggacgatatccgatcgtggtcgaacccactattcggaacatcaaggtagcgcgagttctcatcgatggtggtagttcgatcaatctttttttcgccagtactctggacgcaatgggaattccacaaagtgagttgacaccaactgatcaacccttccatggaattactccctaatcatcatccagacctttgggcaagattacgttgcctgtgaccttcggccaagccaacacttcccaacagagcagatc

SEQ ID NO: 6086 - DNA, 10078 bp, Oryza sativa
cttcctcgatgcttactctggctaccaccaaatcaggatggcaaaagaggacgaagagaagacagcattcatcacgccgttcggggtattttgctatgttaagatgccgttcggactgataatcgccgggaatactttccagcgcacggtctagggcgcacttagcaaccagcttggcaacaatgtcgaggcttacgttgacgacatcgttgtcaaaaccaagacaagcgactcattgattgacgatctgcgggaaacattcgacaacctccgacgatatcgcctcatgctcaatcctgagaagtgcacgttcggagtaccgtcgggcaagctactcggattccttgtctttggcagaggaatagaggcaaatcccgagaagatcaaagcaatcgagaacaagaagtcgcccacgagactcaaggaggtacaaaagctaaccggatgcaaggcagcactaagcagattcatcgctaggatgggagaacgaggacaacctttcttcgctctattgaagaaacaagacaaatttatatggacataggaagccgaagaggcatttattgcactcaagcgctacctatcaaacccccctgtactttttgctccccaacctaatgaagaattattcctctatattgccgccacgccatattccgttagcactgtcattgttgtcgagagagagaaagtacagcgactagtttattacgtcagcgaagctctctatgacgcaaagacaagatacccacagatccaaaaactgctttacgcagtcatcatgacatcaaggaagctgcgccactactttcaagctcacagagtcacagttgtatcctccttcccccttggaaaagttgtgagaaacaaagacgttgtcggccgcattgcgaaatgggtaatcgagctaagccaatttgatgtccactttgtgccgcggacagccatcaaatcccaggtactcgccgacttcgttgccgattggactatgccagacaacaaatcagacaaccaaggcgacaacgaaacatggacaatggcgttcgatggcgcactcaacagccaaggagcatgggcaggatttatcttgatgtctccctccggagatcaattcaagcacgcaatccacctcaacttcagggcgaccaataacactgcagaatacgaaggactactcgccgagatacgagctgcagccgcacttggggccaagcgactaatcgtcaaaggggactccgagctagtcgcgaaccaggtgcacaaagactataaacgctctaaccccgagttatccaagtatctcgtagaagtcaggaagctagagaagagattcgatgggatcgaggtccgacacgtctatcgcaaggacaacgtcgagccagacgacctagcacgacgcgcgtccagacgagaaccgctcgaacccagcacctttctcgatatcctgacgaagccatcggtgaaagaagttagcggcgaagttagcccgaacacacccgacatcagctcggaggtcatcgaggcagaacgcgccgttgctgacatcgaaaccacagacgactggcgcatcccatcaatcaaattcatcagcagtgaggagttgcccgaggacgatacagaggccgagaaaataacccgtaaagcaaagatctactgtatggtcggtaatgatttatacaaaaaagcgctaaacggtgtacttctcaaatgcgtctctaccgatgatggcagacacctcctcctcgacatacatgaaggcatatgtgggtcacatgccgccggtcggacattggtcggcaaagcttttcgacaaggctttttctggccaaccgcccttaaagatgcatgcgacatggtccagcgatgtgaagcctgtcaattccacagtaaacacacaaagctactcgtgcaagcgctccagactatccctctgacttggccgttctcgtgctgggggctagatatacttgggccattcccacgaggacagggcggctacagattcctatttgtggcgatcgacaaattcaccaaatggatagaagaagtgcccacgggggaaatcaaggccgacaacgccatcaaattcatcagagggatattctgcagatacggactaccgcaccgcatcataaccgacaacagctcccaattcatcagcgccgacttccaagattactgcatcgggttgggagtcaaaatatgtttcgcctcggtctctcaccctcaaagcaatggacaagtcgaaagggcaaacagcatagtactacaagggatgaaaacccgcgtctacgacaggctcatgtcacaagataaaaagtgggttgaagaactcccattagtactatgggccgtacgcaccacaccgacaacgtccaataaggaaacacccttcttcctcgtgtacggctccgaggccatgctccccagcgagctacgacatcagagtacacgagtacagaagtattccgacgagaaccaggaggaacaccgagacatcgatgtaaatcttctcaaggagcatcgtgagcgagttgccgtccaagcagccagctatcaacagtccctctgccgttatcacgagaagcgcatccgagcacgcatactttcgatcggcgactatgtccttcgacgagttcaaacccaagcagggcgaaacaaactctcaccaaaatgggaaggaccttacatgatcacacaagtcttgcggccaggcgcattcaaaatcgcagacggcgacggtcgcgaattagcaaattcttggaacattgaccaactacgtaaattctatgtatgagtcaataccactgtacctgtaagtacccttacagtatcaataaagcctatttctaggtcccatatcacaatcaaagtgttttcacccgatgatcccttactctgatgacacctagcgttgaaacctgtccttatgtccctttacgccatctcgacaaggcctccgaggaacctatgggatcttcggctggggacgcccagagtcgataaggccttgtcagatcctgtagagacaaaagaccatgtaagatctggtcgtgtaagagttctcgccgtgcgtattaaccaagccgtgaaatcggaaatcaactttccaacctcatggctgggggctaggatcagagcttattcaaccaaggcaggtcaagggtccaagagccttatcctccgagaaaattcctccgacgacaaggctgggggctagggagagtgtacgactcaaacggctgaccaaagtcgttaactgagaacacactcttacacacgacatccagagtaagatacatttgtttaaggaatatttctttattcacaaaataattcttgtagtttttacataaattttccactacacatctttccctaagatatctgtgacagggcacgagtactaccaagaaggccaacgccagtccatagactggaagattttctcggccagcggcgacatcgacctcgctagatggtctatctccgccggagttctccgagaacaagcaaaaccttcgcggagaaactcgaggtctaggcgcgggtggtgatctcgtaggcaagccagcacgtgccctacggcatatcgactcgctcgacgacactcttgcttcaaggcctcgtcgatatgcttgccgatgacatcgagttgggcacaggccccggttagccaagagatgtacccggccgccgactcctcgggatcaccgcggactactcgaagttccctgcatactctagccatggaggcacaacaactcttcaagtaagaattaaaccacacctcgcgacctcggaccgtctccacagcctgctctttcttcaaggccagcatggttctctcaagttccgccacttcaaatttcgtcttccaatattggatacaacgatcttgatttgcaagggcaccctcgagatctgctaaacgtgacgaccactaagacaagctggatacctcctttacaacataaataacctaatcaggaggtcactaagaggtgaaaaggctactcacttgaggtggccgttgccatcccggcctccgcatcaagagtttgatccacattgtcaaacgaaacatgtggttcgaaatcgagtaccggaatcatcgccagtaactcaggctgcccgcgctgctggacatcctcgtcatcaacatctctacaatggacaaaaactcccgagatcaacatacaaaattggacaagggtggtaatcgcacgcacgaaggcggccagagttcaagatttacacaatatgtaacaaatacaagaagtcctactcttcaaaaagggggagaacagactcccccagatcaccgacttcttccatcatctccttacgcgtgtcgcttgccaccccctgatccaagatctcgcgtagatcgagttcaggacgcgacaaccttacacacgcgaggacgtgacacgccccggtgtagatgtcgttcgacgtctcctccgcgatcctggccgcatgcttggaggggatttcccccatcgccgtcgccagttccgcaagagaggaagtcagcgaaaactcgtcgggattcgccgggatcgtggacttgacgccgcactcctcggcgagctgatagaggccagtgtaggtgacccgcaacgagccacggatctcggagagattgtccccgagttccgacattcggtcctcgagccccttccgttgacgcttgttgccggccaccaactccctcatcttcgtgaggtcctcacgggcttcagctagctcgcgcaccaatctctcagcacgcgcgttcgccgtcgccgcttctgacctcgcctccgagatctcgcggccgatgccatgagcaccagcttcgagaaggcgccccatctcgacttggagttcctcccaggtgagaacggccgctggcagatcacgacccacagcgggatcgctgacggggccgctaggcgtcgcctcccggctcccggtcacgggcacaacatctgttgaggccgtggcaggtgacgcgctggaagctctctcggacttggcccgtgccgccttcgcccgcgcctccctacggacagccacgaatcaaacaccatttgaacgagaagcacgagaatccaagaatctgtttacttacttctcgccgatcgtcacaatgcgctgcttgaaagacaatcaatacagagtaagaagaaaccctccttgctgcacgatctgacgacaagatgaaattatcgagggggtcgctgccttgcggcgatgtccgagtacagacgagaatttcctcgccttggttgggactttgccagcgctagtggtggccgcatcagatgcctccttgacaaccttctcctttagagatgtcgccacctgatggtccgcgagcggcccgatgatgttagtcaaaggaagggcctacgcttaatcacgtcataaggtgatttcgaaaggagaatactggatgcttatcaaatacacttacgttgatggcttcatcgcgttccgccgcccccttttcacaaaggggcacggggatgtcgctagccgtagtcggaccgctgatcatcacttgatcgacgcgccgctctacagcttcgctgctcagacctgttaaacaggaaccaacttttgataagtcaagaggaacacgagtacaagtacgccaagatgaatacgagaaagataccccgaggagaaacccgggtcacgtcatccggcccgaaatagttataggctggatgggcccgagcctggagcggctggatccgcctaccgacgaagtctgcagcgacttcatatcccgacaagccccgttctcggagatcatcgatgatgtcgataaacgactgaagagagggggtcaaagggggcttggcggtccaggccggaatcttgtccggttgatcctcgggaacaacgaagacagggttcgagtccttgatctcaagatagaaccacctgttctgccacttactgcgggaagaaggacactggaaggggatataacgcgacttcatgccatcacgaagtcggaacctgacgcaaccagacaccctattggattccatccaacgtagttcatagtagaaacggaagagatcgagaaaaggctccaccccaatgtaggcctcacagagatgaacaaagatactaagaaaggcgatggaattatgattcaaatggagaagagaaagaccatagaaattcaacaccaggagaagaaactcgaaaggtggaggaagaaaaccgcagagaacgtaatcttcgatcgcaacaatccgacccaagaggggctgaggatcagtacctcctacttctctctccatgtctccatggccgggaagggcgccgtcctcctgaaggttcttcaatgtcgcgccggtggaagacgacttgccgagacccattgctgttccaagatcgccggaaaacgagcctgagttggcgaactaggttttcttgcggtggcggagaaggcaaggagcgctggcaggcggtgtgtgttcaacaaggttggcagacttcaaaatgggctcccaaaattcctttaaataagcgcactaccgacggtgcgaattccaaggaacagagagagatctccgccggaaatctctgggcccgttacgcgcggcagttttctggacttcagttcaaaattcactcgtgaccgttgggcttcaaacggcatgctcgactacgttctatctccgcggtcctcgcaccaggaatgacaacgttctcgacacccgaagtcgtaaatggttgcacgagttcattttaagcagaagtcgggggctactgtcagggttacgggtcaggcataccctctacccttcgatatacgttacatatcgacatggcatacccacgcgcacgcggatatttcctacataacctaaggaaacctttcacgaaatctacagatgggaagagtccttcttggacagaactgggtcgtcgacgtatcgtattgggtatgatatctccgagtcctactggagacctccaaatctgtgatataaaagggaccccccggggagggcatagatcatcgaatctcagagccaacacaacccacacagcctacgaagccgaagtctgcgaggagccaagtcatcgagagctagtcgaatccactcgactacgatctcgtcggatccgataagttccatcgttccctttgtaatctgtgttttccaccatataatcccatatcaactggattagggctattacctaccaaggggcctgaaccagtataattcttgtcttttgattgttcgatgtcatactatgtagatccttgtaccaacgtaccccaataccctctatatccggtctacggatatcacccgtcgacagagggaatactagttattcctcgtaaacaagagattcattaatatttacattttccgatgcccatatagccaattttgtgtggaagaatggagagtcacgcattaaatccaagaaaatcattaagaggataagtggttggattgaaatatgtctatcaaaagtaaaatttccagatttggaaatgtgcctatcaaaagtagatggagggagtaagatttattgtactgtaataacataaacttggtgaaacgcatatctaagtagagaggtgccctcgcatcgctctcacgtgggcagctcgggggaaaaaccctagctgcccgcactgccaccttcctccccctctagctgcctcgccgccaccagaaactgtgtggccagacaggaaggcagcggcggggagaacaagccggcgaagagctcttcctcggtgtgggaggtggacacgcagcgctgctgtgctgccgatcgtacgatgaatccccggttctgattagtgtgactgtgaacgatggaaactaactgcttgagctgtagggatattattttcccgtggcatttgttgttggacgcgtgtgttgtgtagcaaccggttgacgtaaaataccatcggctgtatgagcgctgtgtgtcgctctgcctcgcccgcccttgccaggccattcagcagggaaaggccatcgtacttacaccgttacataacaaataatatgaaacggcttcatagatatcgatttttcaaaatcgtatatacatttttcattctcctgatcgtactttactcgtagaacattatgaaccgatatctataaatacatgtatatgccgatttttagtgaaactaataaatatgaggttgtcgcctcagatgtgcttgttttttttaatgaagaaaaagaatattatatgtatatgtgctgttataaaaaatggaaaaaaaaaacgacttaacgtggcaagacgaagaggccaaaagtccatatattttgccgagtgagtgaaagagccaagccgatttcattcatcttgatcctaccgtctccaattctctcctccctatcctcccaccctcccagtatggctacctcctctccctcgacgttgacttcctcctccttgacagcagcgtcgtgtggcggcaacggcggctccggagcgatggtggcaacccggctagtggcggagctggaacaaaatataggggatataggtgcacattactcatctaatggtattttcccgtatatagtttcacgttattcaaactaacggtacttttgtcatatatagcaagacatttctctagttaataatatttgtcgataacttttgaaaaaaagatataagtgagaagtgagcaaaaaaaagcttactcaaataaacagttaaaaggagcgataccatcaaaaatccctaaatacaacctcaaagtggccgatcaaattaaactgtcaatagtcaatcgccaacaacaaaatcataatagaaatgtcttaatcttcaactgaaaatatatacaataaacatctgaggtaaatacaataactatgaaagtcaaatagtcaatgagcatactgtttaactagtgtaggctgcaggagtccccaagttgcataaccgttgtctcaagaatacggcatgcagcctttaaaagctcactatctttcatttatgtaaatcccaatttgaatgttcaatctttcaaaccctaacctttaatcagggaaaatgaaaaggcactatcaacaatcgcataattcaaatcggagtaattggataactagaagaaaggatagatcgatacctttcttagaattcctgtagcctgtcggatgaaactagaagatgcttacgacgagtaacagggcaaggaactaaggattctcaagctgtgtgggctgagctgcgtctaccactgaggagcgatcaattccggctactcaacagattgacccgagcggttctagctatagcagatcggaaaaaaaagaaagaattgtgaggggatcgaggcgtcgcacaacgtgtttctttgctcgcacgcgtaagcatttaggccgtccatctcacgaggggtatacttaattgggcttaggggggttcctatacggtgaaaataagggttaagcactaaaaatgagaattgggctgggagcctaggaacccctggcttattgggctccgcccttgaacctagggctaacggaacctagggctgacgtaatggtggctcctcctcgatgaccgccaaatccgaccactgcaagctcgaggaccaccagatctagctcccacaagctcaggggtggctagatccggccgatgtagcgtgctcgtcggcggctgcttcctccccaccccatgacaacgatggctacttcctccctacccatggtcccggctgcttcacgatgacctcctctgtatccgcgttgtcttcttgctaccaaaaggtgagtacaagattcatacttttctggcctgcatgtgatattaagaataaaaataagtgtataggattcacaattcacctaaggttaagtggggataataacgttcttcttccccaaagctttaataattttacggatttggtctggatttgcaattgaattaatcccaaggctcaaagcatcataaaggcggggtcctttccaatatttaataagggttaaaaaaggctgcctttgggaaaataattggaaggtacttaataaaggtagtaatatatttt

SEQ ID NO: 6087 - DNA, 6629 bp, Oryza sativa
  unsure (1)..(6629): unsure at all n locations
gtgtgggattaactatacagataaataatttgaacttgtgtagtactatttaactaatgtattgtttttatatgtggatcaaatataatttctctaccatcttctccttttctcttttattcatttacctattgttttgtgtcatagacactttttttcacaaagtgtcatggacactattttgatccccaatactattttacatgtttcttttcttattgtacctatttgtttgtcctgataaaacatactggtttatcttttctcatgtaggaaaatagtttgaggatccatttcaaaacaactttctagagcttttataatatcttgtgccttattagaccaaaatttgctagagattttgcttctaaaagtttgaagataagaggcgttgtttcaagaaacaatcaatcaagagcaaaaccttagtttgatatatagaggaaaatatatatgaaatccggaaaatacttgatcctattgtgcacatccataagggtgacaccctttaaaagtctcatctcagatgagagaatcagttgtgattctaaatcctcttcctcatcaaaaggaaatcatcacactatggagaacactgtagcaatggggactctgtttttgctgggaaatgggaataaattactcaggaataatatcgtttcttacaagaactgaaataaaaacgcacctagagaggtcctcacaccgaccccttatagcaagaaaatggatggccatattctgctcccgccgaattttcctgagaacaaattctctgcttccatccaagagatccctgatctccctaacaagataagcntgctcagacattgctctttcttttgactgtatcagctgcaaagcaantaagcaatctgtttccaggataactggtttgagcgtccaacggagcggcagatagatcccctctttaagagccaggagttatgcttcaagaggggagctgcatctgctcacagacgtgcaggaggcaaagataaccgccccctcccagtcccttataacgacaccaattccacccttaagctgctggctgtcaaaggaaccatcaacatttgccttcatccatccttcctgtggcctctcccatctcattttactggctgaactggatccatcaggtccacggcatctccttggagtagaagggattacagcttttcctttcactgaaccagcagaagattgttgtcggataatgaacagtgaactgatgtagcttctgtaaaaaccatttggaaaattcaatggggggaggtaatttgtcatgggtaatttcattttggatataccaattacgccacataatcattaatgataccatccgttcgtcctcagagagcatggccagctgatcgaataaccaatttgggttcatcctccccacagccggtacggacaaaattgttcctgcatcatacatggaaagccacaaggatcttgcttgggggcactggcagagggcatgtgcagtatcctcatttgcagttccacagatcgaacaaagggcatccgactcaagggttcttttgaacttgttctccttcgttgccaaacaattgactgctaccttccgcgcaaaaatttttaccttctgaggagcagcattcttccaaatgagatcccacgccttacaagaaatctcactcgaggaaccagagcactttgacatgttcttcagcttcagagcccagctgtacgcacttcttaccgagaatctgccatgtttgatcggatgccatgcaataaaatcctcctcttcccgaactggtaacctaattctcagaataatctcagcatcaagcggtaagaaatattggttgattttgtgtatattccaggagccatcttcattaattaaatccaagacacacttgagtctagaagtacccttgctagaaatgggtctcctcgaaaaatctcttggcaaccagggatcacaccagatgcgcaccaacctgccattacccaccctcgatatgatcccttccttcagtagagacaacccatgttcgatagctttccaccccggagacacattgcctccaaaactggtatcaactagggagccatttgggaaatatttggcttttagaacttgtccacaaagactatccggattctctattaatctccaagcatgtctgcaagaagggcttggttaaacaatttaaaatccctaaaacccagaccaccttggttctttggtttggttagggaattccaggctttccaatgtgtccttctcctaccattgtctgcaccccaccaaaaattctttgtgagtttggtaagatcttctgcagctgaatcaggtaatttaaagagccccattacatacacaggaattgcctgtaggacagctttaatcaacacttctttcccaccgatagaaaggagacttttgccccatttaatcatccttttccaaatcttttcttggagactctgaaatttacctctatttatcctgccctcaggggttggaaaacccaagtacttatcctcaaaggaagtactcgttatttgaagaataagtttaatgtcgtccctaatagaggctggtaaggaatctccaaacattatggagcatttggcagggttaatcagttgtccagtggctaaagcataacaggctagaacctccttaatcgcccgtgcctgctgaatttcttccctgaaatatagaagtgtgttgtccgcaaatagaagatgcgaaataccagggctcggcaacagacatgcactggtgaaatttctcctttgattaccctatcttccagaagcaaggatggaccgtcggctatgaagaggaacaagaagggagataggggatcaccctgtctcaacccacatgatggagcaaatgacgagagaagggttccgttaaatttcacagagtatctcaccgccgttatacactccattatctagctaacccaccggtgagagaaacccatcttgtgcatagcctgctccaaaaacttcaagtccacgcgatcgtaagccttggatagatccaacttgtacgcacatgcagcaccgcatggtcttttgttcttttggatataatggaagcattcaaaagcttctaccgtcttctattttctcttttatccatttacctattgttttgtgtcatagacactttttttttcagaaagtgtcatggacactattttgatccctaatactattttacttgtttcttttcttattgtacctatttgtttgtcttggtaaaacatactggtttatcttttctcatgtaggaaaatagtttgaggatccatttcaaaacaactttctagagcttttataatatcatgtgcctaattagaccaaaatttgctagagattttgcttctaaaagtttgaagataagaggcgttgtttcaagaaacaatcaatcaagagcaaaaccttagtttgatatatagaggaaaatatatatgaaatccggaaaatactcgatcctattgtgcacatccataagggtgacaccctttaaaagtctcatctcagattgaagaatcagttgtgattctaaatcctcttcctcatcaaaaggaaatcatcacactatggataacactgtagcaatgggaactcttgatgtagaacacaagatctatacacccatcgttcctcatcacattgttagcatgcgtcatctttgtcgcccgttgcctccatgtgcagcagatggattcgtatcccttgcattaaatgcgagggcagctgcgtgacatgcagaaccaacggtccaggccccatcatatttatggcacagtaggggccccgagcagccaacggggcctaaactcggggcctaccccgagctcatgtcctgagctcaagaatcgtctttgtttaaagcaagaaaatgagttcctaatcccacctttcgctggcatggcccgatgccacatggccttgccatgaaatccttcgtgccctgagtagccggtagtggggacctaggcccccacttcttcgatagatgaatacctacaaaaataacttggaacaacaaaaccggtgaaattcgttagtctaaagaaaattggtgtattgaacaatgtttttgcgcatttagtgcagaaggtcaggggtcaaaactatgtttaatgaccaccaggacactactagtaggacatccacaatgtatggagaacctgagtttaagcaattttttttatggctattcaacatacattgtgaggatggacataagctctttatctgaaaactagctcacaagttagaggtggtattcctgtctctacccttcatcattgcagtcatgctactgcgaacccagatatgtgaaccggcaccgatgctatgcaccattagtgctgctacttgggtgccaattggaacatccagcatatatgcacgaaatatgattgttgacggtcgttatcgatcagtttcgaccgtcaatattactaaaatagaggagaactagtaatgcttgcaatgcatatatctattagaataaaaatattccactagtattaggtatactaaccttttgcagagaatgacaataaagtggaggagaatcgacatcaactcagacgataaatcaatcggacgatgtcgataaccagacttatgtatgaatgggccaaaaactcagaattgacacgatgaattgggccaaaattcacaagtctacaaagtgaagcaatagaggaggctgccagccgaagatgggccgggaaggcccagcccatagttcggccgaacctggtggttcagccgaacccatcctagcaccgttggatgcagggttcggcgtggacgtccaggattgcatcccaatgacggttggagggtacttcggacaattccccttccacaaccgtcataactacctctatataaggacttcaccttctcacttcactcacacacctcaagcaatagctctctcatttctctcaagtttagtttagtagtatctagctggtggaataggaatagagtagaaatcaggagttcggaagtcttcggaagagttcgggtatggctctagtagcttttctcttctcttttgtaagctttgtacttttattagaatactcttctttatacatttatggtattgaaatacttttcgagtatatgaatgcctactttacattatgttcatgttatactgaatatatggctagcttatctgggagatgctttggtgcgggtataatatttgcttatgcaattactctatgtcatgacgatgatattagagtagtatctggtagtttagacgtggtgtctagattacaggatatcattatttggggttatatattgcagatgagaggtgggccgctgatggtgacagctcaatacgggtattcctccgcgccggtatataatcctaagttaattccctggggagggtattcttccgtacttagccccggttgtatggtcatgacgggctgtcgtaaggaactcggcggtcaggggtggcttctcgaagtagcaggagggcatcggatagagggtattagctagtatatcagttaactagaatgtatgtatactatgtatattagaagtataggaatagattctctttctcttttctttccacttagcttagatgatatattatgagaatgagtagttaatgcttgtgtatcactctacccttggattatcttaacccctgcttagaatatgattatcacaagtaatatataaattattagtcaatgttctctttacatgatcttcccacgggataaaataaatacgatacccttggaatactcacgggtgaaatactacaatggtatatccgtgcgcttgcggatgaactctgtaaccataatataccagaagtatttatgcgccattgctggaaattatatttctagtaatgtcgttaaaaaataccaacaacctccctcctgccgctggtcagaccgcccttgcctagccagtcagaccactgcaccacatgtggttagaccgccgccttgctatcggtgtgactgtcgggacctagaaaacaccggtagatgaaaactcgaagatgtagatttaaatatgtcaactttattgcatcaactagtgtttacaaagtgcatcaatagcacccctcacaaaaatctcgactatattcaaagccctaacttttctctcacctcaactctctaagaaattgatatctagaggcctcaacacctctactattttataccctcaacgtgtctatgcaaagcccacaaatctaacaacaatttggactaccaaccaactacttcccaaaatcttaagctctccaaataggatgtgtgtttgatgccttggcaaggtcatgatgatcatgtggtgagaattacaaaattttgctatgcccggtatgatagtgaaattttctgttttatttgaatataattcaaatttcaccatatcgactgatttaattgagacactaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6088 - DNA, 636 bp, Oryza sativa
ccgggacaattgtgattttggataccacgggaaaagatcagttctccactagtgaatgctctattcactaatgttgaaggtgacaaaaataggctaaaactgtcatgccaagggttccttgctacaataaaacaaaagcaaatgcagatgatgaattagcagtggaaacctcataacaaaagaaccttggaagtgcacgtagagtgcaccattccagtactccgcacgtataaatcgcggtccccaagacatcatgtctggtgaatccaacagcacctctaatgatgtccctgccatgttggtggcgtggccttcatggagaaaagccttatcctcccacctcccagtcctcgacgagaatacccacaatgtgtgcacagacggtggccattccgctgtagcgtccttacccacgagtggacctttgtggcacttcttcttggtaggaatttcaggcaaatcagggatcaggaacacctcatagtgcagagactctgcagggtcgaagacgaggtactcagcactaatgcatagactatcatattctgtgaacggtggaagctggacccatcgatgcgtcgcggggttgcagacaaatagcttatattgttctgagattttgccgtggtacaggat

SEQ ID NO: 6089 - DNA, 1563 bp, Oryza sativa
ataatttaaacatgtatatataataacaaatgtaaagttaaattgcaatatcttccatgcacgaaatgccaacgcatctgtgagtacaacatactaaaaaagcacaatatggaattgtaagaacacatagagatttgcaatgaacaaggggtatgatcgtgaacaatttttctttgaaaaaaagcatgacggttatgaaataatagtttccatcccaaataaatttgaatttaaacaattatttccatctaaaatgaataaaactgaatatttattttgaaatcacatgattcaccaaaataataattcccattgtggacaatcttgaatgtgtccttaccatttactgttaaagccgagccgattgggggcaatgcttgcccaaaagaacacaaataaagaaccaattgcaacaaactcagcaaataaatcagtggcacctgaaccatccaaacctgaaaaaaaataacccaagactagtaaataaataccactaataaatcctcaatgtaaattataaagcctgaaatctagaactccaacaaactagcaaaaacatggtatcccattattaatttgagcatatcttttaaaccaccaaacttagcaaatcaattaagtaaatcgcagcatctacagaattatcaacaatttccatggtttgcttctctgttttttccgacacggtcatcagcagtgttttgatgatatgtcaaccacttattcgagttaattggaaaaaataccaaaagaaagatattgaaatatgacagctataacttttctttttaagctacaaaacatgattaccggtgcagagtgctagatccaatcaccccaactcccggaaccaatggattgagcctcctcaggccaccacttccctccatgcgttgcaccttctcctccagatcttgcaggcagagttgacggtaatggcaaggtggccatgatgacggcactatgctagcgtcacttccatgtctatgctcgtccttggccttgttctgctgacatccatggtcacctttctccgtctccacctcatgccgatctggtaggtagtagctagtgcacgccattggcaattgacttggagtgattggatctagtctcaccctggaggtggtggagcctgcatggatggtgaaaatgatgacgaaaagaccggtaaggcggtccggctaccgacaacggtgacaaaacgtgatgacaagggggtggcagacacaagatatagtgacgatgcagttacatcaatgacagtgcatgatcagcctagcgcgtcggatggggttaatgatcgcttgttctttagaataataaatgattgtggcaacaaagtttggaaatgaaagcaaataacattgaaaattattgatatgttactatatataacactatgttgatcgtcctaacacactcaaattaaggactcgtagcaaaactaattaaaggcaactgctttacagtacacaaaagttacgcatatagtaaaagaatacaattaattaaagcagtacaagacattccgtaggttctatttttccaaagacacagaaa

SEQ ID NO: 6090 - DNA, 12060 bp, Oryza sativa
cacctggaacaaaaaccgaattatgaatcaatttactgaactacaaaagcacgcgattaaccctaattctcacttgaaaccgtaccctaaagagaagaattaggttttctgatcagctcctatatatctccctcctatattaagtaaacgagcagcccaacagcagcccggcccattacaaactaaaaccctaaacccaacttttctgttccacgttggtccaacattctctcaacttgatccaaacattaatccactccataataataattattctctaacaggaaaaaaaaacggggtgatggcaagcaggtcgtacggctgcgaagaaggcggtggcgctggcccgcgatacggcattttttttatatataattttctttttatccatgagcagattgttcagtttagtgttaaaatgtaaactagaattcgtatttgaaatgtaatgtatgctgtatgcatcggggactaatattaatttcgggttacctcaattcgggaaggttaatttcaaaggaaaaccaccattccgttccgagaaaacgtacggaaaaacggaaacagagagctatatatattcgcacggcgcacacaacttgattgcttaattcacattcatacgcagacgcgttggccggggagaacggcctcgccgagcgcgatgaggcaggtcatcgtcggtccatgtcgtcgcggcagccaacagcacggcggctctcgcccaatgttcggaaatttcgccccccaccgaaatgctaacatctcatccgaaaattttggttttttgcaattcttttatgaatttggtcaaattttattcaaaatccgtcaaaaattcaaaaaatttccatctatcgctcagctacggcagaaatgttgatttcgaaatttaaaaccctgctctcgccggtgtcaaggtggagaaggggtaggcaagagagggatagagccgtgatgctcctgtcctgtgcgccaaggagggtggcgccgacgatgcgaggaggcaggacgacaagaagaccgagacggagtcgtcggcaaagaatgccgcggcgacggtgtgggcaacttttttaacaagttgacaagtacgatcgtagcaccttaagccttgcggtgatcgtagcacctcgatctagcaaagagctaaacctaaatgggttttgataactaaaccggctagcggagccgatttctagataactacctgtctcgtgggcaaaacggaaggttttcaggacaaacctacaaagaggtgtcgcactcttgcagcggcggcggacggtttacagtgcaaaccgacaaagatggacaaactaagagaaaactaaaagcaaaatgaaaaatgattcgattgattgattatagattggttttttacaatgaaccggccatgtcccttatataggggttagtcatgccctctacaggccctccttcacgtccaactcggggtagaaaccaaagaaaacccgaaacatgccttcccgagcaaggaaacctcgagacccgacgaaacacagtcggactcggacctgtcggtcagaccggcctcataccaccggcctgaccagccctcaaccgacggtctgaccgcccaacacacggcggttagaccggcccactcggaggaaaccggtagacttccaaattttagcaatctttcctactttaatcctaggtgccaaatttgggtgtaaacacatgcccccctgccttttttatgaacaacgtgaatctaaaagcatagaacatgttttggtcttaggacgataatccaattaccggccatatatagtacctcctaagcatcttgccaaacgctcgggaagtatttcttcaagtatttcccgttgattgctcgctgaaaacgctccccttgaagtgtctccaaaaagtatgggttccctcgaacaatgccgcacactcgataaggaccctcccaactaggagaccacttaccgaactccttggatcgagtacccaaaggcaaaattgtcttccaaaccaagtcttcaacttgaaacaactttgctttcaccctcttgttgtatgccttggctaccctcttcttctctttctctatctcttccaatgccttcaagcgcttgtcgatgacttcatcaaggttgtctcccatcaacgtcttgtaatctacaccaacttcaacaatgttttattactcgactcggcttgtccattagcctgagcgtagtaaggagaagaactcaacaatttaataccataagattcggcaaaatttttcacttccttagacataaaagaagcaccttgatccgtagttaatgcttgtcaaataccaaatctatggataatatgcttcaaaataaagtcaattacctccgtatgagtcatattcctcaaaggcacggcttcggcccacttggtgaagtaatccgtagcaactagcacgaacatatgcccttttaatgacgaaggataaatttgaccaatgaaatccaaagcccatcctcggaacggccatggtttgattatggggttcaacacggcggtgggcgccaattgaacattgccgaaccgttgacaagcctcgcatcctctataatatttaaagcaatcatcaatcatcctcggccaatagaaccccgctctcctaagcaaccaattcatcttatgggccgattgatgagttccacaaattccttcatgtacctctcccatagctactttagattgatcttcatctaagcacttcaacaagacaccatctatattccggcgatataaattcccatcaagcaatgtgtatttgaacgcttgccgccgaattttccgatcaaccttaagtgtgggatctttcaaataccgaatcaaaggaattctccaatcttcttctgcttcctgggcacaaatgtccgaatttacagttaactcggcctccaaattgatcgcaacgtgccccctagcatccagcccagaaccggtcagaccggccacacaaggccggtcagaccgctcggggtcaccggtcagaccggcggcatgcagccggtcagaccgcccctggtcaccggtcagaccggccgtgcaatgccggtcagaccacccctggtctccagttttgccaatttcgcacaaagatttaatatcaagcaccggctcttctattattagaaataatcccttcttcacattatagccagatgcttgttgtgccaagtcatttactctagaattatcacgactagcaatatgcctaatagcaaaattatcaaaattggcaataatatccaaaacatgaatcgaggtacctatttagtgatctgtccaagcatttgtagactccgacgacttgttgcaccaccaattccgaatcaccaaaagcctccatgtatttagctccaaccatctccataacttgtaagccgaacaataaagcattgtattcggcttgattatttgtacaataatactcgaaacgaaccgatgcttcataacacatgtcattaggtgaaaacaaaactacccctatgccttgaccttctttgcaagaagaaccatcaaaataaatcttccaaggtataacttcaactaagcaaacctctccctcataagcaatatctatatgatggtccactataaaatcacatacaatttggcctttcatagatttcaatggttcataagccaaatcatattctatcaaagcatatgcccacttgccaattctcccacttagaattggcctttgcaatatgtgtttaacaacatcggcttgacaagcaactatgcatgtactagataacaagtaatgcctcaatttggtactagcatagtataagcataaacaaagtctctctataaagacatacctcgtttcggcatccaaaagacggcggctcaaatatgtaatgatatattccttgccatcttcctcttgcgtcaaaacggcaccaatgactttgttctcggaggcaatatataactgaaaaggctttccggctttaggcgctcgcacaacgggtggagtagacaaatacctcttcaactcttcaaacgcctcttgttgttttgcccctcaagtaaaatcggcttcttttttcaagcgaagtataggaacaaaagcatcgattttacccgctaggttagaaataaaccttctcaaataattcaccttacctagcaacttttgtacttccttcttgcatgtcggcgctttgaaatcacgaatcttttctatcttcttaggatcaatctcaactcctctctcatgcaccatgaatcctaagaactttcccgccgacacaccaaaagcgcatttaagtgggttcatcttcaaaccataccggcgcatcctctcaaaagctaatctcaaatcggctatgtgtccttccataccatccgatttgacaacaatatcattaatatagatctctaagataatacctagcaaatcatggaagatcaaattcattgccctttgatatgttgcaccggcattcttcaacccaaaggtcatgacaacccactcaaataaaccaacaaaccccgggcacctaaaagccgtcttgtacatatcctcttccaccagaaagatttgattgtagccggcattactatctagaaagctaatcaccttatgacccgaggcatcattaatcatcatgtcggctataggcataggatacccatctttggtagtggctttatttaaatctctaaaatctatgcaaactctaatcttaccactccccttcttctccaccgggactatgccagaaacccactccgcataacgacatggcctaataaaccccgccttcaataaccaatcaatctcctctttgactcagtcatatagcaaaggattaaaacgacgaggtggttgcttataaggcctaaaacccagtttaattggaagccgatgctcaacgagctcacggctaagacccggcatctcatggtactcccatgcaaagcaatcaacatactctttaagtagctcgattatcttaaccttataatcggctctcatgtttttgtttacaggtttagttccatcaccaatgtccacttcctccaatggatcggccgatgtaaacccttgtccaagcttctccacttcatcaaaatcttcaatggtttcaccaatatcgttctttgtagaccgatattcttgcacccttttttgtaaccactctaaattagcctctttactcattatacaaatttatatggcttagccgtgctacactagccggctttacagagataggtacaaatttgccatcggatatactaataaaatcatagctagaaagatccctccccgataagcattggatattcccatgacgccactcaaaagtagcatcggccattgcaacctcggccgatgtatccgcttgaacaatttcaacatcatcgcccgtcccattgaattaaacattgatgcaaggtagaaggcacacaacaattggcatgaatctaacaacgacccaaaataacattgtagttaccttgcacatcgacgatgaagaaagcggttggtagcgtcttgtttcccacggtgagctccgccaaaaagatacccttcgcctccgttggttcaccattgaagccattgagaatcatgttggtcttcttcaactcatcatcctcatgccccaacttcttgaacaacgaatatggcatcaagctcacggcggcacctccatccactagcatcctagagaccggcttcccatcaacatggcctttgagatagagaggcttcatgtgacggttcgactcatcaggtatctcaaaaaccgcgtctttaggacctaatgagaattgagcaacctcggcttcatccatagcacaaaactccataggcaacatacataccatgttgatatacatgtcttcttttggagatgattcacttttatgaaccgattgttcttccttttcctctacaccaatcggttttgccttctttatggatttaggcctccataccggtgggggtcgcaactcattgaaccttttatccctttgctcttcgcctttttctctcttagctcttgggcccgaagacgttgcaactttctcttttgagtagccatcaaatccttaggcatccacctaggattcggctctgttccgggaggtagataatgccctctattaaccctgtttgaagacgatgaagccctctcatcgcctttcgcaaccctcctgtcaaaccggcgctggagcccggtcataccggtcgtagaccaccggtcagaccggccagatgcgccggtcagaccgacacttggcgcacggtcagaccagcctgaggtgttggtcggaccactatcgggtcggcggtcagaccggccggtcagaccggcctaatagcccggtcagaccaaatactgacaaatataccaagagtattgaaattataaacttattgctttgtagatgaatatcaagttattagagtacagtatgcgatatgatcgccaaattcagatgaaaatgtgtcattttgttgccacagaaatgcaatccaaataaacccaatgctgggacaatataaaagaaaaattcaagttatcattcttgatgatcggctggcttgactgaaattggtgtaactagagcacacagaggggtggcctttgcaagtgtcaagccaaacttctctgacatatctatcccattcctttctaccttaactggtaggttccatttgaattggtttaacaatgatcccaaaattagatgtaccatcctatttgctagtggcattccagggcatatccgacgacctgcaccaaatggaataagctcaaaatggactcctttgaagtcgatcttacttcccaaaaatctttctggtataaatttttctggttcgggccatatatccttatctctgcccatcgcccatacatttacgaaaatccgtgtccctttgggtattgtataacctgctatcttcattgtcatctcagcttggcgtggtaataataagggagctggaggatggagccgaaatgtttctttcaccacagcttgaaggtaaggcaactgaccaatctctgattccttgatatttcttcctaagccaataacttgtgaaagctcatcacaaactctagacatggactttggattttgcatcaactctgccattgcccattcgacagtgctagagcttgtgtcacttcccgcacaaaacaaatcctaaaacatgaattataattgtcaaattagttacattactagcagttatatcgttatagataagaaaaaatattacaccttacaatttaattgctttttttatggaaaatacttcatccgatccaatttagtcatcactgaactttcaccaatgtccacctcctattccatgctgcatgcacaggccacaggggcaaagctagctaggcatagcgcagttaaagattaagccctaggtttaactcgatccctaatcccatgtaaattccatacagaacaacacgacttaggtatataaagacttgatctgttgggataagtagctatcaattgctgtgtttagttcttttcaacttctatttttccgtcacatcaaatgcttgaacacatgcatggagtattaaatatggataaaagaaaaccaattgtacagtttacatgtaaattacgagatgaatcttttgagcctaattacaccatgatttgataatgtggtgctacagtaaacatttgctaatgacagagtaatattaggcttaatagattcatctcacagtttataggcggaatctgtaatttgttttattattagtctacatttaatacttcaaatgtatatccgtatacgtcaaaattttcttggcaaagtaactaaacacggccaatgtcaaactgcctgttgggacttgggaaacacttctagctaccgacaaagtctgccacaagtgcttgccaggggtctagcagtagagacaaatatttgccgacaaactttctttttgttagcaggagatgtatatatgtaggttgttcaatatttttcatgacagataagataatttctgatggataaatataccccaaccgaccatgtgatagcacctttcacgacagacttagtgacatctattttttccatgaatctattgtctctattttggtgttgtgttgtagtgataacagaaatactacaacatagtataccaactaagatgaaatagtttacactcctcacatcatcatgatacctaagtattagaatgattggtacatacctatgggtatcaatgtatggtactcctataccatatttgataacatatataccacatctagtatctaaggttctgtgttatcaagacatcaaaaagttttactggaccaacggtataacgttctctagctagttcccctcatttcaccggtgatgtggtggtggagtcgtaggtggatgacttcacccaccaagtgctcacaaatattagacatatgtagttgagctttaaataagaatttagtaagattaaggatgtcattgagttatatctctaaggatatgtgtgaggagatgcatttgctcggtgtgagtatggtgttatatgtatagtgatgtatgtgcatacatgtctaacaccatgtgattgaaaaaaaaataaagataccacgtgaatttttaaagtagtgaagacccgattagcagctcatcaacgccctgtgtatgggtttatcctctctctttcccctaagagcagatacaatagcaggctataagccatctataaacatattttaaaaagataaaggaagagagagaagagcagcgggctacagatatgtagccagctgcagcacggactccaagatataatgtgtgtatgacaggcagggtcaggtattaatagtatagtaagcaactattgtataaattggctattacattggctatatatgatttagagatagtagttggctatactattaaacttgctctaatgcggtagggcgtgatggttggttgtggtgcttaattaataagctagtatatagtatattagactagacaacaaccaattgggtgcaagtcaattgatgtggtactatagattagccttgctccctgttcgatatgataatttgggactacagattgtttggtcaagagcatgtacaatagcaggctataaggcagttataaatatattttaagaagataaatgatgagagaggagcagcgggctatagatttgtagccagctgtagcacggactccgagacacagtgtatgtatgacaggtcaaaccatgtattaataatgtagtatgtaactattatataaatgagctattagattaactatagataaattagagctattagttggctatactattaaacttgttctaagtagatcccgtgtgtattttatctcagatctgatgagtttgggtatttttctgatcttcgttagtacagtactattctctattgataatggccagatcgagagagtactagcggagagtaataattaattcattcgacaagtcataggtttggcaatgattattaattatagttctagccccttctagctagttgcactttatttaaaatactttattccagcgttatacttagcttgtatactgtacatataaatgggacaaactatgggcgcctatttccatggtcaatctaccacaccggctactatatccttaccaaaataaatcaatttaagattagatgaaacaatcttctatccaaattcattgtgctttttagggcctcatttaattctaaattgatttattttaatactaagagatacttagctattattaacgccatgcaatgtcctatgtgtcgcaccatatggcacctatttttttagtgatggcctcgatcatatttttaattcaatgtgtgccagcactaacctatatagtatcactattacaaccttaaaacaatccataccatcgttacaatacatatattatatttaggacttaggatatgcattttacaccttaaggagatgtgtcctctcatcaaatacactgggtctctgttcaaaaacaatgtatgcattgactccctccgtttcaggttataagactttctagcattaatttcccacatttatatagatgttaataaatctaggcacatatatatgtctaaatttattaacatatatatgaatacgggcaatggtagaaagtcttataatataaaacggaggaagtattaactaaaaaacttaaggaatgcattgactcacattattacaccttacaatacatatattatatttgaaaacaatgtatgcattaacgcaggattaattaagtattaactaaaaaacttaaaaaaaatttacagaaaattttccatatgaatttttaaagtaattttcgcatagaaaattttttttacagaaaacgtaccatttaacagtttgaaaagcatgtgcataaaaaattgggaaagtgaccaaacgaactcagcataacgtactcgtgaaaaccaaatccgaaaacatttcacgacacactttctcgtgtaaaaaaattgggaaagtgaccaaacgaactcagcctaacgtactcgtgaaaaccaaatccgaaaaaattcacgatacactttcttcatatataccagtataaatattcaagtctaaaaactcaccatagaaagcgagtggaagaaaaaggacaaaatcaaactgtgaacagtgcaagtattgcttacttttccaactatgtgattttgctcttcattttttaactaatacttatgtttgtcctcaatccactaagaggactaacaaattgcgttataattcatgtcaaattaaacaagaacacaaaagttatgtcagttatgcttggcaacatttttttaatcgcataagtgaaaattcatgttaaaacgttttaaaaccataaagggatagaattcatgtcaaagtggttgatgtcaaaatagggaaaaaaatcacaaagtactaaaaaaacagcggcaaacctgcaaggccgggcatacgtacattttaaaactattaagtcctctaaactggggcgtaaggggacaaataagggctaaatcacgaagttaaaaagatagtagtaatgttagtatataattaagggaaaatgaataaattgaaaagattggtgtaacattacaatatttgaagttaaaaaaataaaggtaaagaagaattgtctctaaactttataattgattcttaccctttcaaggtaaagaagtatatatatttacggtgatctctactagcatatttatccaaaatatattctcgcgtggatgtccagatattaaaaaacatcatcaaggaatacatgaaaacagatttgctaaaaaaattgtcgcaattaattatgctattgttacattacattgtaactacagtatacgtaactgcactgtaacacatattacggagtataatttaagaaatcaccgccattccgttcaattaattaaagggattaggggggaaatatagtattaattggattaccgtgaataatgagcggagagtgtcacggtcgagctccgccgcatcatcccgccgcgccgcgatgccgaggagcacgtcaaggaagtcgcccttcctggcctcgccggcgtcgtgctcgcgtagcctggcgtccacctcggcgtcgaacacccggtgaagccgcgcgaagaggcgcgccagccggcggcgccacccctgcaggtcggcggcggcgaggacggggaagaagtcggacacgttgggccgcccgccggcctccatgatcctcgccaccgcctcctggaaccccttggacccgccatggtcgtccaggctcgtcaggtcgcgggagaagatagtccggacagcaggttcaggctcgtcgcgaacgccacgcgccccacgtccaccaccgccggcttgcccccctcgccggccgccagcctcgcgacgtgcgccaccagctcccgcaccttctctcgccggaggcgccgcggcgcggccgcgtccagccggtgcggcgcgaacagctccgtcgc

SEQ ID NO: 6091 - DNA, 10878 bp, Oryza sativa
ccaccgtggtgaccgcgcccagtcggagcgacatgagtgggccgtaggccatggctagggcggcgagagagcggtgtggctggtcccgaggaggtggaggctgcctatgaacggcagagggcggggacccggcgggaggcggcggcgagagtgggcgaggaggtcaaggaggtagacggagaggagagagcccagaagccatggcagccatggaagaagaagggacgggaagaggaacgccattttaatttcttggtgatcgtttcactactctcgatctgaccagcagacaatgccatgcactgtttgtatatatctgcgccctcccgtgggtggaggttcctctgtcgctcgatcgtcaacttgtcattcgccatcctaatacttgttcgttcccaatatttttgaggtattaagaaagtatgttaagatgattattgaaagaagtgtgtgattggttgaaaagaaaaagtaggtcaaagagaatagtcaatagagacgcctatccgttggctaaatgctgaaatatgtcatacgttgtattagcaaaacaaaaaatatttgcgaataaaaattgtatatatatatgtcttagtgatttaaatatcacagtaaaaaataaactttgatgaaaaaacttgaaagttataaaattttagttttttacagtgaccgaaaaattttagttttttacagtgaccgattctatatagtggaaatgacggggcaagagtatatactccctccattaaaatatataataacatacaattggattagacatatctttgtattataaatctggatatggacatcgagattggtagtattagaatgtgtctaatttgatcctagattattatatgagttttaaaacagagaaactaagtcttaacaaacttaaagtcttcgttattgcacttcaacggttaattcgctaattaatttgcttcaaaatatattacaaagtactataaaaaattaacaccataaggaagtagtttcatagcatgaggccaaatacattgttattttgaagtgagcatactggttaggtttttttggtggaactattttactcgggtaaaaatcctacatttgacacgggtgctcgtatttacggctaattattttttcagtagtaggtgacgtacacgccaacagcgagactcctgtggtgactttgccaatttcaagatatgcatgtttcaatttttcgttttcagtgtttgtatcgggcggtgctgatatggcgaaattttcgaaatttggaacaaaatttagttaaatttgaacacatattaccaaaattcacaaaaaattaaaaatattgaaaatttcagccaaaataatatcgtataggagtgggtccaaaatgaccgaaatttctgatttcagtctgaaatgtcagaccctgaagatatgtcagcccaatcttccagatgtgctcgtaggggtagggtatacgtgcgcgtccatatgggtaagatacattgttattttatttatttttaaaaatttacaaatattatgttttcaaaaatacggacgccttctatttatttttggaaggaaggaaattaatctccctctaccctaacgctcgggccgtctcctcctcttccaaactcccaattacctttttcctcctcctccgccgcttctcctcctcctcgtcttctcaggctcccctccgctcgcctcctctcctcctccgccgccgtcgccgtgatggggacgggatccaagaagaagaagacggtgtcgtggtgcacgacggaggtatcggagggcacgcacgcgttcaagatcgtcggctacagcctcaacaagggcatcggcgtcgggaccttcatccggtcgggcaccttcgccgtcggcggccacgattgggccatccgcctctaccccgacggagtcaccgaggattccatggactacgtgtcggtgtatctggagctgatgaccgagaacgccaaggccatggcgttctacacgctgggcctggttgatccggtcaccggagggatccgctgcaattggtcccgatcatcgccgaggctgttcgattcctccgattcgagccgtttcgggccaagatccccactcttcataccgagaagtgatctggagatggaggaatctggctacattgtgaatgatcgcctcacggttgaatgcgaggttactgtcaccaaggggccgcaggtgtcaagaaccattggttgctctgaaatcggcgtgccaccttcagagctatctgaacattttgggaagctgttggaggaggaagaggatgtagggagggatgtggttttcagtgtcgagggagagtccttcgccgcgcacaagctcgtgctcgccgcgcgatcgcccgtcttcaaggcggagttttacggggagatgattgaaaggggcacattttccatagatatcaaggacatgcagccttctgtcttcagggctctcctgcatttcatctacactgatgtgttgcctgctgacattggcgatcttgagggagatgattatgtcgaatttatccggcatctagtcgtggcggcggatagatatgccatggataggttgaagttgatgtgccaaagcatccttggaaagtatgttgatgtgaagaacgtggcgactacgctggctttagctgaccagcataactgtgataagcttaaggatgtttgcattcagtacatttgctctctggatgaggttgatgctatggtcaggaccaaaggctatgcaaatctcaaaagaagttgcccttctgtgttggcagatttatttgagaagacaagcaagttccgtgcttcttgattaattaagcttactctatgattagttaatttagttccctatagtattagcttgtccaaactttaagccatgggctgttagtttagatctaggtgaccaattcatggataggttagcagagctgatgggtaggttattcactttatttttgatttaaatgaatggcctgcagctaattttcatagagtggctcatatcctggtaacccatgtgtcattagtttatgtcttaaattttgtgcacccttttgtcgaacggttattgtataaattgtcaaatatcagtgtcttcagctgtccagtaaataaaaaagaacttgcttatgcttatagtgctttgataatgaaaccactacagaatacagataacaaatgcatgtcattgtggtaggaatggatgactaaagcaattattttgatgatattatgatattaatcatgcaaccttcaaaattggatgatagctgttaatgtacaatctggcacataatttttggaggtatgttttctgttcatatatccgtgaatgtagttactcagccaattaggctcaattatactttgtgcctggaaagccgtaagattagttcttgtatatctggtcacctgataaactatcaaatttcaatttaacatcatactgaggtttaaatgaaaggtgaaaccaggttttatagccctaagtcctcatcaataaataggtcaccgaggtattttaagtgcatataagaaggggcagagccacaaattggtcaagcagattattttctgatgtgctcatgtctaactattttatatctctggattttcataatattttaatagagctactaataataagcctaaagccaagctcaagcccaaatttccgtaggtttgcctctgcccccgcatatatataagagatttattcctgtgttatgagtcagccagaataatagctctatttttacattgccgagcacaacataaaaccctctctcatagtgaagtttatcaaggttgtatgcttggaaagctaaacaacagtatggacgaagcttcagaggtaaagatatgatcattgtcctaccgtcctactgaaattctgctgcattcataacaatattcaagttcaagatccttcataagattgaagtgatctaatatatctagcgtcatatataggagcataagaatcataagtcttgaatcaagcttctgacggcatagtttggcagctgatggaactactgcatcttagttgtttcaaccagaggagaatcaggtattgttttcctctgtaatctatcttatgtatgagtcgttcagttattcagtgatgctgatagctttgagacgacgctttattatgcgatcaaacttcagggtcatcttttagtgcatagtataatatcaaggttctatacttgtacattttaatagcatgacagctatctccatatagttgtttcattttgataagtacatggttctggggaaagatggtcctatgtagctgtattgaattccttcttttccttatttaagcagcatccatgacagaacatgaggaaaagaagatttgatgaatcctaatttaaaaatatttgttataacaaatgttaaaaaaaggataacaaagtttgtcaacttgagatggtagtgtgcattgtgttagaaacatcagatggcctatatgctgcatgtctcatttttattctgtggtgtggtttcagctcattagtttgttgagaaaaatatgtagttgggacttgggagtatattagtataaacaagcaaggcttattagagttcttcctggaggatgttggttgctgctgttgccaacttgtcgacctgaaaccaatgcatgcatatcctgacctgttgcctgatggttatcatgttatatgtaccctgattagcctcctggtcttcttttatttctgagaaacaatgcatttgatgattattccttattcaaaagcgtatctggattgaatgctactatttagctacgcatagaaggtatgtaatggctcatggctggacttggacttgatatatagcattctagattttactgtttcaatccatcgacccagatgtattttgaattttgcacaagtgaaataacgacaagtgaaatcaatctttgtggtgaagaaaaatcaacctgtctcatttccagagattccatctgcatgccgaaaggatgtgtcattagcttgtatgacagcttgtagggtgaaaattttgttcaaactgtgtgattgtctacttgtcgtgttgaggttggaataggtggtggactgatggtggtgccatggggagcatgtcagccaaattttgtcatattatggcaaaatttgctacataacactcgaaaaatatgatattggctacaagacatcgtaagattatggttttgctgttggacactgtaaatttatggtattttactactagacaccgtgagcattattatattattttcatcacattgaggagagagaagccgcatgaaatgtccgttttacccttctgatcaaactaaatatgtgtgcttagcagcttagcctgtgtagattgatgggggcacagcggcactggctctagcaggtcgatggacctctcatcatactgcccaacgggcaagcatggctgctttgtgtccactgaagagggccatcaggattcggttcctcacgcaattccgtccggcctcctcgtccatgtcgccacctggaggattcggttcctcactgcttgcgatcgactagtcgtttttcaagttcgcaacctcgcggtggcaaggagaccgaaaaggctgcaggagagcagttggccgtgctcctctgtccccttaacaccaatggagaagcaaggtggcagtagcgcaagtttcgaatggaggccaaggtgaaaggaagtaaaaatccatttgaatagaaatgtaactaagtattataagaactcactggtgaaaggaaattggaaatagggctatggatgaagagattgtgctcgctctttaaaaacctaagtgaaaatgagaagggtgctgaggtcattctttagtgtgtttctcttttaatcactcaaatatattattttaatgagaggcatgtccattagcaaaataccacaattttatagtgtccagcagcaaaatcagattattacaatgtcttgtagccaataccacattttttaagtgtcacgtagcaaattttgccatattattattgcattggatgtacgggtgatttgatacgaattttttttaaaagaaagggaaatgttcgatctaagtatataagtgcattatggttatttagtttgattttggttagccagatattgtagatgaggggtatgtgcattttgcgaatctaatcttctcaagccgacagtttggcctcaataattagaatctaatcttctcaagccgacagtttggcctcaataattagtatcattgaaccacgtggcatatttaaactttgagataaatctaggattaaaatgaggtaaagaattgataaaaatgcagatccatcggggaaaaactaaatacagaaaacaccagtagattttaaaaggaaaaacatagggcctgcccctttgcaactaaagaaattcattttccattaatcatcaaaaaataaaagaaaatgaagaccaaactgggaaaaaattaaaaaaagaataattgtgaaattatttaagaaaatgaaaataaagttaaaaaggtagaagcaaaataaataataataataaactacaaattttactgttcctaccatcacggcatcaccactgtccttcacggtcacaaccgtactgacaagccaaagctcagtgtttatgccaactacgggctagagctctctgtcatgtcccaagccatcaatgcctggccgaatcaaataaatctagctaggaatcgttctgaaaaaaaaatcacgatttgttaaataggaaagaataaaataaatagtgcattgggaaaaatctgacctactttcttctaaggataattctatcattctcgagaaggtatcatatttttcagtataaaattgaatatctctaagtattaagggtgtgttagtgtgtctaaaggcattttggtcttttctcatactcttgtgtacattttatatggtctattgatcccaagtcaatgcacaaattcaatccccaaatcttctcttaaagtgacattagatccaaaatctacccaccaaatctcccatagccggcgcgcgccgggccatcgtcgttgtcgtctgtcatctacaatcgtcaacagcaatagcaaaaatatttttggtcgctgctagcaggaagccgcattggtcatcactagtctcgtcgccggccatccatcgcgtcaagcatctcgtcactcttcgtcgttgttgtcaagtagcaccagcagcaccagtcagtgccttcgtctccgagcaacagccagcatcaagctcgtccgtcacttgatcttccatcagcaacaaaatcaaccatcatcatcttggagtagcaccagcagcaaggtctttctcccccagatcagtcctcgcttgtgctgtaggatcgcacaagatcgaacaaacctaccagagagaggtgaatggtagggaagaccaaaaacccaaaaatcttttgcggaattaaagattaccctcaaacgaagtcgatgacgaagtccagtcgccgccagtcgaaccgcccacctgccgccggtcagactgccgaagcctcgccggtcagaccgcccgtacacctgcggtcagaccaccgctatcccaccggtcagattgcgcgcacacctgcggttagaccgtcgggacccagaaacaccggtagatgacaaactcgaagatgtagattgaaacttttcgactttattgcatcaactagtatttataaagtgcaccaacagcactcctcaccaaaatctcgaactaaactcgaaaccctaactttctctcaacttgtgtctctctaaaatcgatactaggaagtctcatgctccctctttatttatagataaaaaaccccatacttaaataggtatagaactcctatttctaatagaactcaatccctcactttcctttttctccaaaaccacagccgcaccagccatgaaaaatcgccgtcgccatgtcggactccctctgctgatcaaatccgtcttcaacacatgtccttctccgtacggctcccgctcgtccagcgtgggccgacgcctgggcctgctcggccttccaacagaccagaaccaacacacatgggcatgcatacatcacgtacacacgcatgtactgctcgccacagtacacacatatgcatgctacagtacctcgccgtactgtagcgctatatactccaatccaatttcttccgatctccttgaacaccgatgcttgcacgcacacctcgtgaagtccgttgcgaagatctctctcacacgatgtccatacaccgtatggcattttgtatccaacttcgtcacccggtatccttgactgtctggacctcagctcctctctgggtctagtcctgatccccaccattgaccgaagttgacctttaagaattctgactctagtcaccttctcacatggtatcccgacctcaatagacctttgctcctctcgagcatagtcccggtcctcaccattgaccaaggctgatctcaagccatctgcaaacaatcagacaaaacgaccgtttctgggcacagatatcacaacctgacccacattagtcacatgcactcacgccaacattcacacatcatttcaaaccaattcattgattaaattatttgcacagccaattattcattacaaatattaatcatgacaatgatttcacatgtgcttgccatcctcgtccgctgaagctcgtcgtcttcccaccgcgtcagatccggtaattgcaggcttgcagccatcgtccagctcgtggtggcctctcgtcaatcctcctgtcgtcctccagttcggttccagcagtgacagcagcaagacgtcctctttgtccatcttcaagcaacaaccaacaatagcagccagcaactcattgttgcctcgcctgtgtctccgtcgacacattcgctgctgttggctccggcaaggacggcttcaccttcagtgtcaaattaaggattgtgcagtttgttcggttctaatcctaatttcactcgcagaattcacatgtttttaactttactccatcacatgtgcagtcagttttcgtgcttgctggtcgctgccatctgataaccactcatcaatcatcaccatgcttctgtcagcatgttcattagtagcatcctttggatctcttgctaataagtaatagagcaattttacgatccttgaggaggtaccatgaggtaccactttttctattgtaaatttggtacctcttggtacctaagtactatgaggtactaaattttacactaaatttttggtacctcatggtattttctcaaggaccgtagaattgctctaagtaatatgcatctttgcttgctgcacatctatcaatatttccttttgctatatctatcaatccatgtcctctactaatcaatttcctatgtctcctaccgagtcaaccaaagtacattgcatatccttcgattcgttgaagtcttgctagtatatcatcatcatcttcactagttccatgttggagctagccttcatatcctcaccagcttcacgtcggagctggtcttcgtcatcaacaactcgtcggagttaaccatcatcatcagcttcccatcaaagctggcatcatcatcaatccgtgaggtccgaagaacagtttgtgaagggccttcatcaatatcaatgtctcatcatcagtcaaggacctaagaacagtttgtgaaggtccattgtcatcatcatcaacaactacatctcagaatcaatgaagagccaaagaacagttcgtgaaggcttcaaatgtaccaaggttcgaaaaacagtttgtgaaggctccgaggtcaacttcattgaggaggagatggatttcttcatcatcatcaacaactacatgtcagaatcaatgaagagccgaagaacagttcgtgaaggcttcaaatgtaccaaggttcgaagaacagtttgtgaaggctccgaggtccatttcattgaggaggagatggatttcttttcttcttcatcatccaagaattgcacgttccgatgacatcttcaagcatggactttagatttatcctagtgtggcattaatctagtgtttagtttcaaatgcaatgttattgcatacccattgcatttgagtgagggtgttaagtatgtatgtgtgttagtttgtctaaggatgtgtgttagtgtgtctaatggcattttggtcttttctcatactcttatatactttttatatggtctattgaccccaagtcaatgcatcaattcaatccccaaatcttctctcaaagtgacatttggttgcatgcattcctctggcccgcgccggctcatctctctcatccatggtgagtttggcttggatgaggagatactacaacaaaaccattgttttaagacgtttcacttaagttattctataagtcgtctctcttttataagtaaaattgaaatagggacgatgtttgagacgctttattagttgaggatagtttaagacgctttacatgttagcacaaaattaaatcgtttagagaggaatattgagacgttttggaacgtctcatgtgtagaaatgagttttgagacatttttattatatctgtgtcatcgttattagataatatataattatttatatcgagaaagacaaaaataaacacactgttcctaatcgtcatcatcaaataccgttataataatattataattatttggacaaaaaaattgaatatttaatattcagtctcagattaaaaaagaagagtatctgctacaggacgcatgtttgtagagttgcagtataagaaaaactatctatttaccttcaagattgttcacgttaatgacttggttaatgc

SEQ ID NO: 6092 - DNA, 1820 bp, Oryza sativa
aaaattttgttttggtgggttgtataaattgtgtgtaaaattttggtacctcgaggtactttctcaatagctagcacatcccgttcttaatagaacgatggcagctcaagcataaggagatggatagaaggaaaggacccaaattagagagaaaccggatggtcgcggtgatgatggtgcatggataccgcggaagcaacggtccgctggcggtaggggcgcaaccaaggcgggcaagtgggattttgcctacttatcccacttttagttcattttttatcctaaaatttatactactatgtggcggatatgggatcgggttcgggaacgtagtatccgacggatatggattatccggtaaaaaattcaagtattacccggataaatatacggatattactcgtattatgtttttgtgaggcactttttctattatgtattggttttactatgatgtattgtgccctatttatttcctaaggtcctaatggcctaatataatcgtataatgtatatatggaattgttaaatggttattgtctatgtgacatataagattgttgctccgacttgatatccgataatattcgtaaccgatagtatatgtatctattttggtacgtatttgttccgtatttttgcctgacattatcgagtttgtatccgtatttgcactatccgtgtccgacccgattctgattataaaatgtgggttaggatatgggaagggtgagatctgaccgaacctgacccgttttcacccctacttatggctcgattactttctctcctctggtcctccctagcttctgacctcatttggatacggtcaagtaaggttatcatatcgtgtaaaaaaaagtaaggttatcgcgtcttcggattggactacaaatcctttagtgtcattctttacctatatacttattcatatttgggtatatcttatgatagatattacttttgactagaaaaaaatacccgtacgttgcgacgagtgaatgctattttaatcatattattgttaaattgttttctaaaaagtacatcctccatttcaaatatgatgccattgactttttcacaacatttgaccattcatcttattaaaaaatttgtataaatattatttattttgttatgacttcttatatcatcaaataaaatataatcttaacatatacttttacatatttatattatttttttgaataagatgaatggtcaaacgttgtgggaaaagacaacagcgttatacaatttgatagttttgatatctagtttgaaacttttattggggtgatggtcatatcttgtacgttgctttcttatgacttggcaagagttctgaagaaattaggagtctgattcttctcgtaagttaacgtgcgagttttttaaaaagatttcttatatcattccttatgtatttctaaaagcaaacgaacttgaaaactgactcaaatacggatgacgtaccaaaatatcgacgggaacatcttcaatttttatgtttgatgtagataaattaaaatcgggaagagtgctactaatggtgttttttttcttctttttttgattaatgtggtataataattcctagtctctggagtgaacatgttagtttttagctatatttggaacaaaatttgaaatccaaaagtttgttatattttagcatgagggagtttttttaattgcgatctaaaataaataacacgctcaaatatttttttagttaaatagagagaactttttggcagcaactgaaaaattactcctcgcaatatgtatgtatgcatgtatatgtgttgatacct

SEQ ID NO: 6093 - DNA, 8455 bp, Oryza sativa
tcacttttccatgatgttgatttcttgtttatatatcttctcaactcgggaatcatgttttgaatttcccaattgctatgtcaaatctggaaagcagttctaatttgattgcatatgcttgccaataatcgagatgtagtctccccacgccaccacacatttttctatttgtaactctacaatgcttgtgtcaaatcatgcatgtttttaatttactttgttgttttttctgtttaggcctagacttttgtatggatacaatgtattatgtcgaaccacaacctttgtacagcgctgaggtaggcctgctgtgcggtgcttcgcgttgtgaatcgaggtgtagcttacgcgatggtggcggtcgtgagatgacattttattttcctcggtggatctgaatttttgggagtggattggaagttgattatatgttttaactgctggaaataggtaagctctacggactcttaagctactataagttgtttagataaccataacaaatacatgtttcagtacaatatatataaacaaaatatggtagtcaattatctatttctgatacattgaagcatgtctctgacaatttggggcatactgctctcacattcattctcttggtacgtcaacagctctactaaaaaatgcttccttagctcgtattcatcttgtacatgcatttatttatgcaagtgatcaaggttaccactgtatgtgtaaaaaaataatagcatttaaatgataaattctagtgtcatgatactttgcctttgtaattggtaactgcaattcttcatcattccatttgcacatgaagagggacacaagataaccagatagttcgctaagaagattgaattgttaattaattttgtgttaggaaataaaataactggtgctgcgcataccgctccctatctctttgtctttttcatacattgggatccaagagtggggatggtgatgcagacagtgtggcaccaacattaaacatgtgggatggagccggtaatcataaaaagaattatgtactccctctgggttgataatacttgtcgtttggacaagggcacggtctcaaaaaaacaaatttgaccattattttttattataatatgtataaaagtgttaacaaatatatgattttattaaagtactttttaagactaatctatacatgtagtcattatatttaaaagacaaatattttaaaaatgattcataatcaaagattctaaagtttgacttcacccttgtctaaaacgacaagtattatcagccaggagggagtagatgatttcgtacttccatctcaatattataaacatagtccatcttaaattccatcttttttttcatgattgagttagtctttagcactgaatcattaacattgttttgagcactgaaaataacttattttgctgcagcctagttgttaaagacatgtgcaccactgatgatttccgtacttccatctcaatattataaacataaagtccatcttcttaaattccatcttttttttcacgattgagtcagtctttgttgggagtttatgcagggtgcttagaatatttggtactatcctttagaatcattacacaaatgcaacagactattttctgtctttgctgatgattgctaatgcagctcgaacttatgggagtaaaaaagccctgagaatactttgcgtatgcatcttgtttgatcgggcatttttctttgatgcaacttgagtttatgtttgttgatgactgtcgttgatggagctgctcctgccaaggtggcctttttggcgatggagtagaactgtctgaatttttttatcacaccacaagaacggattttgtttgtggtaccattttttgtatatataaaacatattttggttgtatatatatagaataggatgtatctaccgttcttgtggtgttgttcatgtgtttggatgtaatatggggtgtccttgtggtgtttggataaggatctgttggagtgggcctaaatgtgccatgggcctgaacagatctggggagtaaaattgagctacgtgctaggggatctgttggggtgggcctgaatgtaccatgggcctgaacagatctacggacgtgagagggaatcggaaattgtggaccgatctgggagggagcgatctggaaggaattggacagaaataatcgcgtgtgcactcgggaggaaatcggactaaaaaatcgcaatacagggtgtgaattggattgaaaaatcatgcattactgggacgacgtacgaaaaatccctgacaaaaacatcttaaacttttataataggtaaagactagaaaaatacccatgcgttgctacgggaggaaaagaccgtggaagcgggcgtcgttctatggcagagtccgtaatgtcaacgaaggagtaatcgtggcggagctggtggaggtagtgtccagacaccttggtggttgatggcacatcgccgacgaagcttagtgcggccgactacagcaagacggcgtcaggagctcttgccggcatggcaaggaaaagcttgctggcggcagcaagatgacgacgcacggcttgggagggacagagcggcatggaatgaaacaattcacgtccttggtggcatgttttgaaagtgttgcgaattgagtggcacatcctgaaggtggtgcaaatcgaatggcatcttctaaaaattctcctaaaccatttgtaatatgtgataatacaaatgccggcatgtttgcaatggaaaaagatacaattgcgtatgtaaatcgggacatgtttatatgtgtttttaagtgagaccgtcataaattttaatatcgattcgtcagttccaacaaacatattgtcatgggcggatcacccaaaaaattcttagcctaacacataaatatacgtatgtgagcagaaacttttgaaaaaaaagaagaaaaaaagctcgtttttaatatattatgatgcatatttgatccatttatacttttagctttgttatatataagttggatcacccatataaaagttcgagatacgtcattggtatagttaaatctattattaattagtcattttcatttttaagggagtattgtttccagtttataaattaattacatttgaggtcaaatagtagtatttttttgcctcaacaaattgattgagaaatgagaaaaataaaaggaagagaggtctggtaggaaaaaaaataaagaaagaaagcagagcacgagaacagataagtcataagtccccattttcactttctccttcactttccccaaatccatccgctctcatcccgtgtcctttactgctgtctagctgtctcccccgattcaactccccaccaccggtcacctctagcatcgctgtgcttcttccctgtctgctaccccacacaacaatccttgagctccttccctacttgctgcgccccatcttcctctcgtggcggcatccggttatgcatctgggctacagctcagctcaagtagttgacgggggcggagtggcctcggcagcggcgtggagtggattcgacggtgatgatctgcttccgagccaagtctgatgccgtgcacggccgcctcctggttctcttccgcacgcagccaaggccacgacagcgagcctcaaccttgcgtggcccacgagaagcaggcgcaaggccggttcagggtgacggctagggtgcgtgcatggtggtgctaattctgtgctcgcatcacatgatggcggtgatttgccaaattggtaagccatcaatctgatttgcttagggatttacccagaaatttgagttctaaatttgggtattttttcgttttagggttttgaaatcatgcaacgtgcggccgaagatagaaaccggtgagacaatgattctggtggctggagttttgctttatttgggtttgggatctaattcgaggaaaatttggaatttagggtttgtgcaaattgggtattttttctagaaccaatttttgtatttttgtatgttgtatatatgcaagttgtcctagtgtaacacgaaccggtttaaatttagcccaatttatgtaaaatcctgatcggaaccgatttggtgcggacttaggattaccttgactttttttctccatgtcaaattgaattggatctctgattcttttgtgcattggccagcgtatgtgatgaactcatacggatacggacacaatcagggacgacgcacgaaatttgtggcaaaaacatgttaaacttttataataggaaaagaagtagagaagagatagagagaaatagagatgggcacgctataaataaaactataaataagttggtcgaatttccatatccgtgcccgacggaattgcatcctgacgaccaaaaattataatctgatccgatttgtagtgcgtacgtactctgaattctcaaataggcatagtccgtggttaccacgtgaaaattattcccatcttttctcctcgtcaaggaataatacgattttcaacatttgcaggaacaaatcacaaaacatatcctccgcttacattgcccatcgtttcgtttctgcccccgacgaatttgatttctttcctcgatcctcctcctcgattaatctggttcaattcttttcccctcatttggctcgattccaacctggtttgatcagttcttggaacttgaaagacagaaactgaagaggatggggtccaagaagaggatgtcaaggtacgccaagaagcacgaggaggccacgctcaagttcgacgtcgtcgggtacagcctcaacgagggcatggccgccggcgagttcatccggtcgccggccttcgccgtcggggctacgactgggcaatccgcttctaccccaacggcgccacggtgaccatctcaaggctcacctccgtctccctggagctcttgaccaagaattgcaaggtgcaagccgcctatgacctgcgattcgtcagccacgccaccggtcagcgagagtgtttcttcgctatcagagccaagaatgttcagtagcaccagatgccctaagcctcagcgctcaaatccgatgcaaagatatcgtctggagaaggaagaatcaggctacatcaaggacgattgcctgaaaatcgagtgtgtcctgaccgtagtccataaaccgatcgtgtccaacgccaagggacgatccgaaatcgaggtgccgccatccgatttatcggatcatctcggcaaattgctggaggaagaggaaaccgcagacgtggatttcattgttgggggatcgaagattgcggcgcacaagagcgtgctcgcccgtcttcaaggcggagctctatggagggatgaaggagagggaggcccgtagcgtgaccgtggatgacacgcagcctgacgttttcagggctctcccacatttcatgtacaccgactcgttgcccgacatggacggcgttgaagatgccgactatgttgaaatgatcaggcttctactcgtggccgcggatagatatgccatggataggatgaagttgctgtgcgaaagcgtcctcgatgatttacttgatgcggagacagttggaactacgctagctttagctgatcagcatagctgcaacaaccttaaggatgtttgcgttaaatttatggctacttcaaaagggatggatgctgtaatggcaactgaaggctatgataatctcaagagaaattgtccttatgtcttgatagatgtgttggagaaggttagtaataagcttcgtagaaattaagatcaatttgtgaatcccatataggccaagttgattctgtgaatagcctgtctgtttttcaagactagatctgtttagacaacttatacaacaatggtatcacagttatggcattttatggcattagtagtttaatcgatctacaaatcattgcaagcatgcatcttctgttgctttaatttttctttttctgattggttaatccggaacatatgtgctcatgttttactgctacaatggcaattttggataatcctaaaatcagaggattttctagactgtattgcatgctttctgttagtaggttaccctgtaaattcagagtaaaatctagcaaaacatcttttacacccgcaagcactacgtatagatgttctttaccctgttgaactttatggtggtaaaatgtaggcatgattaaccttatgcattgaattttgaagctaaacaggggcaaggcaatacatactacattggccttgcttgttgtaacgaatatattttcttcatcgaacatgtttagcctctttgaacatgaagattaaatgtctttattttggtagaactgaaaattcaaaaaaggtttagtgttcaaacatcattgccctttaacatgaataaatgaaagccaacctgataatttctctgaacttcctaaaagctcattttgaattgcctcctagagatacatactgtcgtctgtcaatattgcatgtggagcttttctattcatgaatttgagaaatagtacgtaggagtacctgttaaaaaaatgacttgcaccctataaaaaaagaaagacttgcagctaatgtttttcatgaaaaaaaggaaagaaagacttggtatgagactgaatagttaaaaagagttctctacctggtttatagacaatattgcagattttcctccgttggctcaaccaaagaagcaaataatcacatgaatatcatagtagtcaaccgatcgatgtagttgtgtccaatacaacagcatcactaaaaatatctcataagaccgcagtaagtactgatgacgcaaacgaccagcaatatattcccaagactgcgtgtactgagatgatgcaattattcgaacaagcaaattcacatctgtctttgttgaagtcatacttgaaacttgtatacttgtgggcaagcagaaattcagatcaactgatgagggctcgctcaaatttgtgcgatagagagagagaggggaaacggaggatgaacctgatggcgtgtaccagcgctggcggccgcgggggactgcctgcgacgaggtaaaaaagcccgcccatatgcaatcgggaaataactacaaagcagacgcccgatttttcccaaaataactcaggcatcatttcacccctcgtaaaacaatgttttagcgcttagtgaaagaatatttcagttcttgaaaatagtgaaacacaatttgatcaccagatgaaataattttcttcaacgtatgaaacaaatgattaaagtcattgaaatatcaacaagatccaagtgaaattgagaaaaaaaatgaaacaccataaaaaaaactccacttaggcattgtttagttcccaaaacaagaacttttcacccatcacatcgaacgttcggacacatgcatgaagtattaaatgtggaaaaaaaacaattacacaatttgcgtataaattgcgagacgaatcttttaagtctaattgcaccatgatttgataatgttgtgttacagcaaatatttgctaatgacggattaattaggcttaataaattcgtctcacagtttgctggcagaatctgtaatttgttttgttattagacaacgtttcatacttcaaatgtgtgtccatatatccgatgtgacaccccaaaacaaaaatttttggtaactaaaccgggccttaatcacttcgatctaactaataaaacatctaaatacatagattggaattatcgaaaaatcacccaaaaaataccagctagatacacttcttccttctctccagtggttagctagatcgtcgtcccgagccgcgtcgcgagggcggcggctgcggctgctacggtggctgtcgggtcaaggctacgtatctggttgttgtcaccgtcgccgcaaccactagtgaacctgttcggtgacatcgccgtacggatgaggagtgagtcgagaagcgcctcgtgtggagagaaacaatgtagagagagaaggggaatggataagattgagagagaaggagagaaaagggcagtgggacgcaaaagcccgatattctctttccactcgaacgcctgatcgagccagagcattttcatatgtaatcgtgttcattcaccctatacgggcctccgcaccgatccaaagtaacagagaaatagggcaaaaaaatcgtgttcataacccgttctcgttaccgattcgacaccgaacaaggaggaggaatttaactatttgccacttttaggtttggcaattatccaaatacccttattaggtttgtactttttttttgcccctcttaagaggtggtcccttaactatttgccacttttgctcacgtagcatgccagcgtagcaaactcgggtgaaaacgttgtggacccacttgttaatctctcactgcccttcatctcccctgcgttcatcgccggctcgccaccgtcacccctcttgtacaccgcgcggccgacc

SEQ ID NO: 6094 - DNA, 4169 bp, Oryza sativa
ggccacgaggcggcgccggcgtcgatggggcggtcgcagccacgcggtagagagaagaggggcggcggtggcgagccggcgatgaacgcgaggggagatgaagggcagtgagagactaacgagtgggtcccacaacatttttcacccgagtttgccacactggcatgctacgtgggcaaaaatggcaaatagttaagggaccacctcttaagagggggaaaaaattaagtgcaaacctaagaagaatatttggataattgccaaacctaaaagtggtaaatagttaaattccccaacaaagcgatgtgtttttcctagtgtcaaccgaatatgactgggctatctgttcgtttctaatgaaaagagtggatgaaattttggatacttgtagcacgcttttcaaactgttaaacggtgcgtttcatgcgaaaattttctatatgaaagttgttataaaatataacattaatctatttcttaagtttgtaataattaaaactcaattagtcacacgatattaccgtctcgttttacgtgaaacacttaatctttatctacatcttcatcttcaggagattcgggagattaatagtacgggacttggctgagtttggattgaattggaatccaaaaatcattcgatttgtttaatccaaaaatccaagaaaaagttggatttccaattggagggggcaaaatataaaaattcactgcctagggtttaatgtaggagatcgaagaggcgtctcctcctcctcgccgtcgtcgctcaccatcttcccccgcaaccaccgccgcgccgccgccgatcgcctctgctctcaacgcacccaaggttagtatccatcagcttcaccccgcgcttcctcctcctccgccgcctccgcctccgccgccgcaagaagagctagcttgcctctttccccccagatttgatccgatccccccaacctgctctgatcgatcgattcttggaaatttcgcagccggggatggtgtccaagaagaagaatacaacggcgtcgaggcacaccacggagtcagaggaaggcacgcactcgttcgagatcgtcgggtatagcctccagaagggcatcggcgtggacgagttcatcgaatcggccaccttcgccgtcggcggctacgactggtgcatccgcttctacccccacggcaagggcgatggtgccaaggactacatctcggtgtatctcgagctcctgaccaagaactgcgccgtccgggcggcctacgacctgagattggttaaacatgccaccgggttgccaatgagtgtctactctgaaacaactcacagaatgttcaattctgatgacagtagcaaatttgctccgccttatgcgactttcatgaatagaagtaatctggagatggaagcgtcaggctacattaaggacgatcgcctcaccatcgaatgctttcttaccgtcatcgtcaaggaatcgatggcgtctaataccgtgaaggcccatgaattaatcaatgtgccgccgtcagatttatcggaaaattttggcgaattgttggagaagggggaagggtcggatgtgactttcgttgttggaggagagaaaatcgccgctcacaagatcatccttgcagcacggtcatccgtcttcaaggcggagctctatgggcagatgaaggagaagagggcccggcgggtaaccgtggaagacatgcaacctgatgttttcaggggcctcctgcatttcatctacaccgattcgttgccggacatggatgatctcagtgacgacgactactatgagatgatcaggcttttgcttgtggctgctgataggtatgccatggacaggatgaagttgcagtgcgaaagcatccttggcgagcatcttgatgtgcagaccgtcgcaactacattggctttagctgatcagcataactgcaatggccttaaagatgtttgcattgaattatcaccaatcaaaacaagatggatgatgtggtggcaactgaaggctatgctgatctcaagagaacttgcccttctgtcttagttgatgtattcgagaaggcaagtaagttccgtagaatttaaatgctaatgaaccccttcttcttaggtggtgtctaggagtaggttctagttcttaaattgtataaatagcatgtctgttttgcaagagcagctctgctaacaccgggggttatatgtgctgtgttaagttatgatctccttttggggaaaagtgttagatgaacaatagttggatatcgatgtaaggatctgtcatagcctcaagctctcaagtgctgagtcgaacaacattagaaaaaagttccattccactgagtgtgggaatatagcagcataactagcaacacactgatgctgtcattttaatattctgttatatattgcctgcagagacatggcattttgcggcatgactagcttaattggtctttagtgccggtatgatcgtttaattgatcaatcattgcaataattttgtatagttgaaatttgtttggatgatcgtgttcatgattaatgtttggttatctggttagctgtaaggcttttaagtttcatctggcgttcgagtccaatggctaaacctggttatattgcaccaagtctatattaacgaataattactccatagctttgcgtgctcatgttttactgctacaatgggaactttggatagttcataattatcagaggattttattgactgcattggtgttctattagttatgcagagtaaaaactaattatcttttacaccagcaagcacaatatagagaaattctttaccatgttgaaccttatgaaggtggtaaaatgtaggcctgaacagcagtaaacttgaaattttagagctaaacaggtgctatgtaatgctgttctgcattgccccgattttttaatgaatgccctcttttccatccaacggtgtcaacgaaggttgaagatgatgtttggcctcatagaactgaaaactcaaaaatgttttgtattgaaacattgccctttagcctgaactcgattacttctgatcttgttactgttaaatgttaggatcaggtgtaatctgtagagcataacctgattacttggtaaggcaggttaatatgtgcatagcatttacttaattaggtatatgacatacatcatttaggaacttctgctatttgtttagtggtgattagtgaactctttttttaagggaagattagtgaactcatgagactcgcaaatagatgcttgattagtttgtattgcaaaactgtaagaactcaactttcagaaatattggaagcatttagccaagtccaaatgtgattttcattgtttctcttaactttgaatattcattctacaattatcctggcctgaaagctatcttgtgcaattcaaggtctaacggtcattgaattctcatttgttttacatttttataaatactagaaaaatgcccagcccatgcgttgcaacggggaagactattgtaatcttattattattatatggcttagttaaggtgaaattcattgcgttaaattcacttgatatatattttgttagaaaatcatgtgctacaattaagagtccgatcaacttaaattagcatgcgagttttttaaaagagattttttatatgatttcttctatatatttcaaaaatgaactaacttaaaaactgactcaaatatggatttgtgtttctaaaagcgaacgaacttaaaaaccgacttatatacagatgacgtaccaaaagtacaagcaaaagcatcctcaatttttataatagtagagatggagattatactccctccgtctcataatatacgggattttggatggatatgacacatccgagtacaacaaatatgtcgatgtgtcacatccacccaaaatcacttataaaacaataatttctactctcttcattttatattatcaaacgttttagccctttccatagtagttttactatatttattgaaaaaatagcaatttctacattatcaaattaatgttgaataaaatataattattgctatatttttttataagcttagaatttgactagaaaaaaaaactcagaacatcttactccctccatttcaaaaaataaagcacaatcacccttaacacaaaaattaagaaacta

SEQ ID NO: 6095 - DNA, 11525 bp, Oryza sativa
cacagaaaaatagagagagatccaaaacacatgagaggggagatgctagaactggaaatcaaacacacggtggtagatcaaacgatgtgcaaggggaaagaagacgaagcaaatcaagaacaatggtctcaagtgttgtttcaatttcttcgcttttcagccatcattgtgtttcacctctcccaatttcacaacatattgggtctaattctagtcctggaagcaggaaatgatttgtattaaaaaaattgcagttaagttttttaaatacaagtgtctctgaactttaatatataagtatgtaagatgcaatttgagtaaaaatcatataaaagctagtgcttcatataaagtttcccagttttaaattttctccatatattcattttctcggctttatcaaaacatacatgtgaaaacttcttgcaaacgaaaagatatgatacgagaaagtcaacaagagagagtaacgaaagcaataagcaatggcagcttagcagtggaactggactaaatcaagagcagtctcttcaaagagccggggacactcgttgctgttctcactataaaactcttaagagtgtaaataatctgttccctgacaatattgatgtacttcagtatattgagaaagatggtccaaatgatgggaaaaaatgtcaagcacgtggtcttttggattatgtcaaggattttgacttcgtgtttcatttgcacttgatgttgcttatcttgggacatgcaaatgctctggcactgtctttacaaaggaaagacaaggatattttggaggccatgttagaggtgaaattaaccaaataaagatttcaacaagttcgggatgatggttgggaatctcttttggagagatcatactcattttgtgaagagcacggtctccctaaattggacatggaagaagagtatgtagatcggcataaaccaaggagaaaaactaatcgcactaattatcaacattatagatatgattgcttgaatcctattattgacttgcagctcacagagttcaatgatcgtttcaatgagataaattctagcttgcttactcatatggctgcattcagtccaaaggattccttcgattcctttaagcatgaccatctaatagagctagcaaagtcctatccggatgattttgatgcaaggcaattgaaggatcttgatcatgagcttcagatttacattgacaatgttcgagaagatgaaagatttgggaaattaggcactatttcacaactggctaagttgatggtcgatacaaaaaaacatcttgcttttcctttggtctatcggagcctcaagctagtgttagttcttcctattgctacggcatcagtggagagatgtttttcagcaatgaagattgtgaagacagcactacggaatcgtattagtgatgaatttatgaatgatgctatcttatggttcgtggagaaagctttactagctacaattccaaatgacgacgtgatagctctctttcaaaacatgggaattactcgtagggtggaggtggaagtataataggtaactattgttgacattttatatttcgttggcatatattgttaattaacttgtttactgtattttttttcaatctattattaatccattacaatctactagcatatagccctgtacaatcatgaatcgtcaatcagttagtgttaaatttttgaacaactagttagtgttaaaaattgagagtgacactggtgactatttttcctggatccgccactgatgaaaaggaaccatataacaaaaattaaaatctgaacaatcaggaaatcagatttaactaatgacaaatttagctgcaaaatttgtagaatttttggggtatattcattgtcctatcaaaatcaaaaggaaacaaactgttaggcatctaaaaaaagtacagatatttcatcatacaaaaatgcaatggttgggctcccctaagttctaaaaatgcattccagaagaaattgcaatacccttcagtgaaaattgcactataatttgcactgcaaatatatcaaatttaatatgcaattttgaattgattattaccttccatgagtcctgaaatcaagcacagttttattatttcatcaatgactctcttttttcttctccatggttctcttcttcttcccttcaaacagctgtaggagctccatggaaatcaatctacatatatcaaaaataaagaaataactgaacaattagatttaaaacaagataagtgagaactgttggtacattaaaaaaaataaaaatgttgcatactgccatgtagtgaaaattacattatgagagttgcactgccactatgagagatttgcatgatgggggtaattggaggctggtgtttagaagaaatctttatgagcggagagaagagcttgctgaactaaagagtatgattaacttgtgtcagtttgatgaggggaaggagagggacaaagttatattatttggcctataataggaagaaaaccttgttcactaaatgcatacaatgtatagaatatacagaaatggtggaggtgtggaaaaacaaaatcattttctcttgtggggaaaaatttacaaaacctttgtcacagccttttcttttgggggggaaaaacctgccttgtctttaaaaccaaatggatggggtggggggggggggtgtcctatcctttgattctaattggccgatcctatataggaatgtttcctcatagaggagggaaaacttgtgtaataagattgaaactactaatcacatcttgtttgaataccctttagcaatccctccgaaaaaatcttgtcgatttcagggagtgtttagggctgctgaatgagaagaataagtccagagtgtgggtgcgtggctagtggctagtgtctgctgggttttgtggcctgttagaacttacaaatgattgggtttttaaaaatgctcttataaattctcctttgtatgtcatttataattccatatccttcttataaaaatatagcatcttgctaaaataagaagatcaagttattctagaatggtggcacaaagcgattttggagcagcttttttttaaaaaaatgaagaacactagacattgggatgattctggagcagctataacaagtgaagccgtggaatctgtctgtagtttcctctacggtgatacggagtatgttattgtctggtgtttgtgcttttttgatgattgttgccgcctgcagcatggtgttacgagctgtgcttgttggtgttgggttttctcacaaagtcagaccaatataataatataatctatttcaagaagacgaatgaaaaatctcaattattttttatcaattttataaaatcccacctattaggatcaaattgtataaaatcacagtgattgacatgacatattaataaattatgtttctaatgtttcgtaaaaccacgttgttaataaatctgatatactcatatatcaaagtttttaaaaaaaacttcagttacatggatatatcatttgtatgattaataaaaaacaataaattggagatataattatagaaaaaaatatgatagatcatatcaaaatgatcaatagtggttttgtgaaactttataactatataataattagggttattttttatataccaaaatccctatagttttgtgcaacttacaccatataatacctagggttaggttaaatttactctctctttttttggaaaaaaaaatcagttatagcgccagccggcaattccactcctgatcggagcagagctaaccgaaaaatcccaacaaaaaaaaaatccgcaaaaaactccgttccgttccgtctaaaattcaccgcggatattaccaccttccgtttgggctcggcccaatctgctattgggctccctcgtcctcgtcttcccctccatccgccaccgccgccgccgccgccgccggcgatcttctcaaggttcgatcccctccaccctctcccctcccctccgccgctccggcttgccgtactaacccgcccttccttccttcgcagtgccgccgccggtggttcgattctttctttctttctttctttcttttttccccaatccgttcgtccgccctccacctccgacgcggcggcggcggcatgaagcggcaccagatggagtcggtgccgaggacggtctcgacggtggtgcccaacacggcggaggccacccacgtgttcgacatcgtggggtacagccagatgaaggggaggggccgcgaggagcacgtcacgtcggggaccttcgtcgtcggcggcctccactgggccatcctcctcttcccggacacccacgtcatcctcctcgacgacgaggaagacaacgtcaccgccttcctcgagctccagagccaggggggaagcaaggtgcgggcgtgctgcgacgtcaggctggtcgaccagaccaccggcctcgcctcctctgctgcgccggcgcagccggatgccaagacattcaaggtgttcaatgccgatgaatccaacagggtcagctgtctcaagatgaagaggaccgaattcgaggcgccgccgtatctcgtcgacgatcggattaccctggagtgtgtggtcactgtcaagaaggagccgagggtgtcgagagctagaccagtcccgaggatcaaggtgccgccgagcaacatgatgcagcaactcggcgatctgctggagtccaaggagggggcagatgtggtgttcgatgtcgcgggggagaccttcccggcgcacaagcttgtgctggcgatgcggtctcctgtcttcaaagcggagctatgcgggccgatgagggagagcgggacagagcctatcagcattgtggatatgcaaccggttgtgttcaaggccctgctccagttcatctatactgattggttgccgtcaattcgtgatcttgagggagacgataacagcgagatgatccggcacttgcttgtcgccgcggacagatatgctgtggacaggctgaagctgttgtgtcaaagcatcctttgcaagaatcttcgtgttggtaacgttgcaactacactggctctggctgatcaacatcattgtggcatgcttaaggatgcttgcattgaatttatgtcatgtccaaacatgttggatgatgtagtggcatcccaagggtttgtggatcttgaaaacacagctccttctctcgtcgcttaggcaaaggaaaaaatgggcaggttcaagaaaatgtcgaggatgacaaagagcaatgcaccggaagatgaacctaacagtaattcgtttagtttataagtaatatggatatctgtctacttttactggatcaggtccttgtggttactttactctctatataaatagaaataacttaaacactggtattgcttgcacctattgtgtttagaattaacttttgggtaaattcacatacctaacttgcacattagactaggttttgcaaatcagtaccgagcttgttttccagttgcaaaatttgtaacaaaacttgctccaagcgataaacttttttcaagatccaaaccaaagtggaacaaaggtagaaaaaatcaattcattgtgaaatttgctattatttttccaggaatactatttgactggagtaaattttctaggatgtctgtatgttatgcctaagaccacccttgcagtaggataccgtctgctttgggttctttattatattatctccttcgagggttttttaggatcattcaggctatatttagtctattttggcttttacttccttttctcagggaagtggttaaagacctcagaagcagatttctgctgctcattatatgtccttgttttctaagagccatgcatattgagaaatgaaggtgaaaattggaggactgagtaagtgagtatttctatttgatcagctagtgcagccccaacagtagattttttttatatatatgccaattttatgattccagcctaagaagctattgtgaaacattgaacgtgctgtgtttgtggcaacttttttcttctccaaattttgttttattaatctgagtattctactactgtatttgagttaatctattaaatgcatcaaagtgaaactggggcaagttgatgctgcctttattcgttcagcacaaatcagctattatcacctttggtcctttggtaagaattctttcaatgtttctcctggaactgtgcttaattttggggtgatgcaagtctgtaacaccattgcccttggcaaggatgaagataccaacatgtctgagcattttttttttacttaatacccattttggacaagataccaaactcttgttagttctgaaccaaattcttatattgattttctatagcaaattacctatttaaaccaattaaatcaaggttttacttaatccaaagatgctctaacaactctacttctagtactccctctgctaatgtaatcatgtttaccttatgtcacagcctactttcaggtgatcttcacttcttcagcatatcatgaacaacataataacctgaaaaagattgaaacggcatcattaatgataggaagaaataaaattagtcatatctgacgaaacatatagtatcaattcccgtgtaagaacaatatgtgcacagtagattaccatgtagcactaaataagaagattagggaaaattacgacaggaaaatcctaagcaaaacagaagactattccaataaaaaggaaaaacagaatctggcatatactgttcatttatttgtattttctcaaaaatatccgggatacaattttttttggcagaagtatgcgtcacaactattgcgcaaaaattacatggacatgaaggtggtgtttgaatccagggacttaactttagtctctgtttttagacactaatttaatttagagtattaaatatagactacttataaaactaattacataaatgaaagctaatttgcgagacaatttttttaagcctaattaatctataattagagaatatttactgtagcatcacataggctaatcatggattaattaggctcaatagattcgtctcgcgaattagtccaaaattatggatgggttttattaatagtctgtgtttaatatttataattaatatccaaacatccgatatgatagggatttaaaagtttagtcccatctaaacacaggtcgaagtctcgcataaggaaacagcgatacagaacagtgtcgcataaagaaaaagcgatagaatgtcttgtccaacggtgccgcttaattagtgattaattatcctaattaaattaattaataataattagttattaattagttgctaatcaatgtgattaaacattaaccattgcccctgttggtgagttgggcagccatgccgtgcggtctcgcaaatgggctgtgcgagaccgtacgctcccacccaagctgcgcgtcgtcactaaagtttacaaaccgtgcggttatcacgtgcgataattttcttaatttttgaaactatgatatatctcacggtaatcatacggttttcacgataattatgtggtaaccgccaaaccatggggtgacggtatccactcaaaaacggtttagagaaccctagtcatcagtcgtcaccccatcattctcacgcaatgggtcagcaataccatattgctttcgtcagcgacgaaggtatagttgtgctaaaaattttcatcccgaatatttctgagaaaaaaaataaacaatatatttttaaatttaattcgcctttataaccgtaaggcctttttccttttctgaatggggttaagttcatgggccgcctaattgggtcggcattaggccatccaaactaggcccaaaaaagggcaaaaggcatcgtgttggtccgtctccgagttgtttccctatttgggccttctctcgtctccgtcgccgccgccttctccaaatccccttcgcattcgatcccctcccctcgccgccgtctcctccacctccgccgctcgccgcccgatcccctcccatcccctccgccccgccgccccgcacctagatatgccgtcgtcgtcgtcggcggcggcggcggcgtgcgggcccccggagttcacgccggggtggaagacggtgtcgacgtgcgccccggacgtcgtcggcgagggcgtccacgtgttcgacatcttcgggtacagcgaccacaaggggatgggcgcccacgagcccatcaggtcgggggccttctccgtcgccggcctcgactgggtcgcctgcctctacgccgacggctacggcgtcgccggcatcgacgacgtctccgcctacctcaggctcctcggcgacgcgcccaccccgcgcgtgtgggtctcctgcgaggtcaagctcgtcgaccagcgcaccggggtggcctccacgccgcagcccttcctcaggtacgccctggcgttcggcgacaagtgcaaggccctccactgtatgatgatccccaggggccagatcgaggtggagccctacctcgtggatgatcgcctcaccatggagttccatgtcgtcgtcaggagagacccccgggtgtcgaggaccgcccggttcccgcgcatcttggtgccgccgcccgacatcaagcggcagtttgccaacctgctgcagagcaaggagggcgcagatgtcaccttcgatgtcgcgggggagccgttctccgtgcacaagctcgtgctcgcgatgcggtcgccagtgttcaaggcggagctctgcgggctgctgagggagccgggaacacagcctattaccatcgttgatatgcagcccgccgtcttcagggccctgctgcaattcatctataccgatcagttccccgtgacgcgcggtttcgagagacgcgacaattgtgaaatgatccggcacctgctcgttgctgcggacagatacgccgtggataggctaaagctgctatgccaaggtatcctttgcaagaatcttaatgttcacaatgtcgcgactacgctggcactggctgatcagcatcaatgcgacaagctgaaggatgcttgcatcgaatttatgtcatgttcaaagaagatgaagggtgtagtggcgagcaaagggtatgaggatctccaaagaatggcaccttctgtcttggcggatgccgtggcgcagatgtcgaagctcaacaaaatgtcaaggggtagtgttccacaagatgagtctaagagctgttagcttaatttataagggatatgggtattctttcttctcttcctaaatcaggtaccgtagtcagtttactctttacattttgggagcacctttgtggtgcttatctgtttatatgatagataggtttattttatctctttgcaagctttgtttccattaactgacatataacctgttgtccttccgcaaaatttattttgtgcgcccttgatcaaaatttggatactgaagataatcctacattaacataactctgatggcctgctccgttgcaatggaacagcatcaacataacaaaatcgcggtgttgagggagcatagtggcatcaatagcaataacattgacttagtttagtattgtcggtgactattgtggttccttgaaaattaacttgccaggaattgtatttggcaagagtttgtatgttttgactacaacctcatatttatttttcctaatccatgttttagaaacctaaatgaacttccagtaggaccaggggcggatccaggaacaaaaaattggaggggactcaattacacagtttcttcaatctccagccatttagggacctttaatttatcatttatggtgaaaaaattgaaggaggtgctccgggggtatccatgggtcttatgggtgtatgggggactcgagtccccctgcacccacgttggatccgcccctgagtaggactgagtgcttctctttgatcaaccagagcagcatgtttttatttttctcatgtccctgaatcaggggccctgaccatagccaatttgcgatttgagccaatttgtcatggaaccaaaaagagggcatcaagatgcaatagtatatcagcgtgacgttgtgctcagtttgtactgataatagtaggaagcactatatttctggaggcaggacgttgtgctcagtttgtactgataattatagtactatgtcaaattaattttttataacaaaatagtatatcaagatgcaatagtatatcaagatgcaatagtaggaagcactatatttctggaggcaggacgttgtgctcagtttgtactgataattatagtactatgtcaaattaatttttttttgttgtaatatatgattagaatggaggaagtgtttgtcaggtggttctgtgattgacagtatacctctctgcttctgtccctattttcagaatgattgttctgggccttctcttaacagaaggttaaaggcaacccagattatttatcccctattctgaaatttattctaaattactggtatgcagcgcttttcatggtcatgtattgtgcttcactttgttataaacagtttgtccaaaattcaggatgctgtcgcattgttactgaagtgcaagcaatatttatgtatgtctaaatttgtagctaggagttggattattttgggatggagggagtattccatagatagttgtttgcttgtcttttacttcctctattttacaatgtaagtcattctaccatttctcacattcattttgatgttaatgaatctagatagatatatatatctagatttattaatatcaatatgaatgtgggaaatactataaagaattacattgtgaaacggagggagtatgagatttgataggccgaagtacgaaggtagactgcatttttatctagaatccgacacatatatatggtagtcctcgatagttagaaggctgaagaattcgaattcctattcgtagacctcgatagttagaaggctgaagaattcctagtggtagtcctaactaagctgaagaattttctgaagcaaatgcgtcgataaaatcaaccatgtagattggaggcgcctccaaatcgggtggccagatcctctaaaaaaaaatcggtgcccgatcctctcaaaaaaaaattgatcggtcaaatattgtagttgaccatcaatgaatcaaacattaaattatacatagtgaaaaaaaaatcagccacttacattttttttgaaacacttgtaaagacacgttgaaacaaattactgtcacgtatgaaacattgcattgagtattaatggactgaaacatatatttttttccactagaacataattatgtaataccttattgtgaagatttaattacaacgaacaacgttagatttaattataacgaatacaataatgttattggaacatagattagagaggagagacaataggggcaaaaagaaagtcggtcaaatgttgcagttgacacctagtgaaacattaggttatacatagtgaaacgataaaatcagtcactgcaacatt

SEQ ID NO: 6096 - DNA, 6915 bp, Oryza sativa
tggagccccattttttctcttcaaatcgggcctctcgctgtagatttcttgaaaaataaatcttattgccagtgccaactgccaaggataaggtataccttctatagatggggtcatggaatacattaatactatatactacaatataatgtattagagttctagtcgcggaagataagatcctttaattaagtaaatatgtagataaaaaaggttaattaaggaaatatggtagataaagaagtaaattatcttttcggaataagaaggtattagaatcctagttgggaaagataaggtattctatatctcctagttttacttggaaaggaaaatgatcttcggtataaatacaagactcctgaggagaaaggacatgccaagccagattcaagccaatatagatctagacaaaccaaatgtgggagccaaagatgccgacgtaagggatctagagctatctccaatctcgccgaattcatattcgaggacaaagactgcactagccgttggctatttgtgagagctccatgccaccatgctactagattagattatctaaaatattgtacttgtgtgatactgatatataaaggcaaaacaccggtttcggccaacaggagttgggttattacatgtcatttaaggggcctgaatctatataaacatctttgtcttctatctcttttactacaatctcgcgtatatcctggttccaacgatccccaaactctacaaatattgtatgggtatagtccgtcaaaagtggtgcgctaggtagggggacttggtgcttcaaggtttcgatgcgatgggtttcaatagacggattctttcgataacaaactcctcgatgacttcgactttgggagatatgacctgatcgaaatgcgttctcctataaagcaggacccttattatctctatctttctcaagagatcgtcattgtgggtttttcgatgagggacacttcaacaactttggctctgctatatatgacccaactagagtatgtcaccgccaacaaccagatctatcaagatcaaccaagtttcaagacgtcgcaaccgtggagaacaatagttcaatgttgtcgacaacgaggccccagctcggatcaactacttccatcctaacattgcatccaaaatttgattggatcagaccggcccaaaggcacgaccagcccatcgacaatagcagcagcaggctgagcactatggtcgacgacatcagcggctgccaaagcggtggcctccgtgccaatgctagtagaggcgtagctaacgggggatggccccaagaatacggagatccgaggcggattcatggatctcctatctctccacccctctaccctctcggttctcactctcacaagtagagcggtggaggaggaggtgaggaggatgaggagaggagagaaaagccgagccgacaaccaagtaggtcgtgccgtgctgggcatggcccaacggccaggctaggccaacatgagcccaacaacagtcgggccgtgccgttcttggactaggtcaaattctagtgccatgtgccgggccatcgggctgcgggccttttggcaaactatacctgtagcaaaatttaccaaaagaaaatgtagcagaattttccaagccggacaatagcttaaaaaaatattgtaaatgatgatcagtcgattcagtaaatatacgaacaatcgtttcagtaaagtaataataatagtaaattgcatcgccggtatacaaacttgtcaggtgggtataatttagtgcacgaacttgtgaaatgctcgttttggtgcatgaacttgtcttgtgcatgcggaggaaggcgaaaaggacactacattactaatcttattgatttagggcatatctcttagaagtttgctattagacatacacttcttcaataaagaatagaatatgatatagtgatagtagaaaaagaataaaaagacaagcaatggtacaaaggttagaaatatatgaaattcatcatttccatggtgaagaataaaatggagaccaaatttataaatattgaatatcctatagatactcactacacgtatgcaagtcacattctaatcaacatcacttcataaaattaacattgtcaagttattttggtcctcgttcgcaccaactaggcaagttcgtgtactgaaatgaacattttacaagtttatatactaaggccctgtttgattcagcttaggattattataatctggattattagaaataagctaaaacaaacggatagcttattatgatagattattacaatctataaaccagattactataatctcaactctaaaggtgctttttagattattgggtggctaacaactaacaagccgcttataatctaggaaaacaaacagctcacagcttattttatgccaacttatcataattcaaattatagtaatctagttcaataatctagattaatcttaagctcgaacaaaaatggcgagaatgcttctcattgggtgtccgggccgacgcaaaaaatcggatggtagtaaccctcttcacccgagacaacagaagtcctcacgtgcacgcagggagttagtacacatcagcacacgtcaagtgcatgcgtccatgcatattcaaatattcaaaatttaaatacatgtttctctacaattatttatccacctacgatttaattataccattagattcattataattacatctttatataaagatcttgcatggttatatcagacagcggcgagcggcggcggacgggcagacagcgcacaggggcggcggcacgcgggggtggacgggcggtagcatgcgggcacgcgcggtgcgaggcgaggcggcggcccgtggctcatggagagcagctcgttcgccgtcggcatgaacgcccggcatgtctccggttacatggcgtagctcgtggaagatggtgacgacgatgaggtcgttggccatgaccaccagggtggtcggtgcagacggcgatgctcggagtggcacgcacgacagcaggcaggcctctagctgccgcctccgccaccagcccgtcccccctatcccgagcctcgcctccagcctcctccgccaccagccgccgcccccatcccgagcgccatcccaacggcgaagaagaagaccggaccgcggcgtcgaacgcctacctgccgccgtccgcgccgccgtgccgtgcgtgctgccctgcctaccgtcgcccaccgccactcccatccagacgacgaagaagaagaccggaccttcccctctgcgtcttgcgccgccgttgctccctcccggcggaggagttcgctgtcgctgcctttgtgtcccgcgcggacgccgcctctatatcccgcgccgtcgctactccctcctggactgcggcacagaacacctgcctcgccgaccacccacacccactacccgtccccacactgccgtgcgcgctacgagagaggaacaacaagagagaggaagagcgagagatagaagggagaggggaagaggggtatgacatgtgggtcccacattttttaataaataaaatgctgattggattgccataagtacgctacgttggacaaaaccgctttggattgggtcgagaggggtaatttgtctggtattaaaagttcagggtgaacgatgattggttttcgggtttagggggtaattcggtcgaccgcgctagtttagggggtaattcgtactttttcctaatttttttagtgttgcacatagtgttatttagatgtttcacaaaatatttgctaatgttgcacgtggtattttttcggatgtttcaaaaaatatatttttatgtttcaataattacaactcaatgtttcatgcatgatataaaaacatttcaacaaaatcaaatatatgaaaatatattgtatgtttcatataatttttttatgtttcattcgttaggacttaatgtgtcatgtaacagttgttattgttgtaatcaatattttttatatgttgcatctctatgaaatatatttcattaagtaagttgaaacatttgcacaaatagtgaaacatttttttttcagtaaatagtgcaacaatgattgatttttaggaaaaacatatatatttttcatcaaaatacggggccacctacgaatcaggcgcccgattttttttttcaaaaatcggggttccaccaagtagatcagaattgtttcactaagtagatcgaaaatgtttcaattgtttaaaaagctgaaacacaaccaaatcacctcattaaacattttgctacagcgtatgaaacaaagggtttcctaaaaaatcgggcgatgttttaccttatataaaaacaatgtttcagcaaatagcaaaagaatgtttcaattcactgcaacatttgatccatatgtagtgaaacattataagtacactaggtgaaacatttttggtggaacaaaaaaaaatgaaacggcttcccttaatagagagtttctgtaatattgggtgatttgttgcaaaagaatataggtagagttagcggtgtttacaccggtgtcatgtgtacgggggtacgtgtattgagaaaaaaggccgagaaggcctgttttcgaagctagaacataggttcagtgaggtttaggtactttgacacctaaaccgatttgaaatgcgtaatatcgcatttctataagcatagtattgtccctcgttgtgcatgcgcacgtgcacacatgtgtgatgtgcgcatgcgtatgcgcacgttctaatggtacacgcgggaagccttttccctttcagatccaagagtcaagaccctaaacaagaagcagcttgttctttcgcgctactgcgctcaattcgtggcttgttcctttcctttggatttattatcataggtagtgttcgagatcgcctctgtgcggtgaacgctcgaattaattcactgcaacttttgatctatacatagtaaaacatcataagtatactagctgaaatatttcttgtggaacaaaaaaatggaccagatccccctaatagggcgtttccgtaatatgtgggtgatttgttgcaacggtggggcgggtggtggggatacgtggtggaggcgtgggaggcgtggaagggtaggggccgatcttttctccccccgtcgggcacctatggggaggatttccgtcaaaatacaaatgtgtgtgagatcttgttttaaagatttaattgcaacgaatgtaatgatgtagtcaaatcatagatcaaataattaatttataagaaaacatatttattttcgaaaaacaagttgctagttgcactactatatgtattgtgatgagtgagagagcactgagatactacatgccaatgccatgcagtagcagtgccagcgtatagcacacgttacactaggagcatgaaccttgcgtgtgctagttgttgatttgctattagttattggatggatatcgtaaggctaacatggcctaaattgcatccacctaatatgtttgtataccaccaatataataatttactcgtaataataatatcccaatggagcagtcgagcgcggagcctagtattgacgtggaaatttccaggccgtccgatgggaagctaacgcacgggataaaccctacactgatgagagaataacgaaccatccgcctcccacgatctcgtctcctcccccaaaaacgccgcccctctcccctctcatcctcctcgacctcttcggtgattccgcctccgcgaggtgctctgcttgatcgagccgcctccacctctgccgccgtcgatcctcgacgccggtctccagcttgcaggtacgaacgtcctcttcgcctcgggtctagttacttttacatctggatgtataggatagttctcccttgcgaattatggattttatttttgttgttcttttatacatgcgcgacatatctaatgtacagattcagatccatggatatctagtttgtgttcaattcaattgatgtgtagttggtaatctttttttttaatctatactcttgtgtgtaattaaaataggggaaattcggtctatgacatcgcatcaacctgaaattaagagagaaattaggtcagccaacattggatgggctcttgtatgaattgattgaccgtgccgatcaagaatttctttgttttcctttttgttgttgttgttattcataagatttaagttttttgtttggctagagaggaataggaggattttccaaaacgtgtcttgctccgttagcgaagtagcctatttgataaagcaggacttagatttgcgaaagacggcctttaaacctccctgaggttctttagtttcgtctgaacttctatcccttcaatgggattgtaaatacttttggttttttcctcctttcaattaaattccggcagttcttctgccgtcgtttctgctcaaaaaaaaagatttaagtttttttttaatccgagtgggcattcaagacaatactcgcaatcgatatatgcatgtgttgttcatatactcctccatttctaaatatttgacgccgttgactttttttaaatatgtttaaccgttcatcttattcaaaaaatttaagtaattattaattcttttcctatcatttgattcattattaaatatactacttatatgcatacatatagttttacatatatcacaaaagtttttgaataagaccaacggttaaacatgtgctaaaaagtcaacgatgtcaaatatttagaaacggagagagtatattctttagaaggtagtaataacttaggcagactttttcctgcaagaattaattctttgcattgtactgtttgctttgtattgtaccatacctgtatgagagaataaacataacacatgcaccatggatagtaacctaattttaaccc

SEQ ID NO: 6097 - DNA, 15928 bp, Oryza sativa
aaccatttccttccaaaaaatactggtgaacactcgatcacgatcagaaatgatggcctgcggtagtgcatgtatagaatgaattctgtccatgaataattgcgccacagacacagcagtgaaaggatgggataaaggcaggaagtgagcaaacttagtgaacttatccacaatcaccaaaatactattataagaggctgaacggggcaatccttcaataaaatccattgatatgacttgccaagcatgttcaggtatttgaactggttgtagtaaccctgggtaaggcacatgttcaggtttagcttgttgacagactgcacaactttgcacaaaatcctgcacagtttgccttaaacctggccaagcaaacagctgcttaactcgctgataggttacttgaattccagaatggccccctagagcagcagtgtgcaaatttgccagaacttgctgctgaagctgcctattattgcccacccaaacacgtttcttgaaataaagaataccattctgcaactcaaaatgagtagaatgagatgtgccttccttaaaagaatgcaaaagctgaagagcttcgggatcagacttataacccaaaacaacatcctgtaaccaatccggtaaaccaacagataatgcacttaaaattggaagaccatcagaagatctacgagataaatcatctgcggctccattctccaatccttcttgtacacaatacgataacgaagacccaacaacttagtcattgctttatgttgccaagagatggttaatcgttggttatcaagaaaggccagactgcggtgatcagtgcgaattaaaaattcatcatgttgtaaatacgggcgccaatgatcaacagcgagaataatagccagactttccttttcataagtggaaagaacttgagtccgaggtcctaaagccttactcaaaaatgccaccggatgctgatcttgcataagcacagcaccaatacctcggtcagaagcattagtctccaccacaaacattttctggaaatcgggcatgaccaacaccggtgctgatatcagactctgtttcaaagtgtcaaaagcttcttgatggtgttgtgtccagataaaaggctgccctttacgcaataactcagttaatggtttactaatgatgccaaaatgtcggacaaacttgcaataataccctgccaaacctagaaagctacgcacatctttaacagatacaggaactggccattgccgaaccacctgaatcttttctggatctgttgaaactccatcagcactaatgatgtgccctagataagacagttgagtttgtgcaaaagaacatttagacaatttgactcgtaactgatgcttactcagagtctcaaacacctgacgcaggtgattcttgtgctcctccaaagtgcgactgtataccaagatgtcatcaacaaagatcaagacattttgacgcaattgatcagctaaaactgtattcatcacaccctggaaggtagctggagcactcgtaagtccgaagggaagcaccttgaattcaaaatgaccattgtgagttttaaaagctgtcttagcctcctcaccaactgccatccgaatttgatggtaccccgaacgcaaatcaagcttagaaaaccagcaagcaccagccaattcatccattaactcatcaattattggaagaggatacttgtttttgacagtgatagcattaagatggcgataatccacacaaaacctccatgtgccatctttctttttgactaacaaaacaggtgaagaaaaaggactagcacttggctgaataattcctttttgtaacatatccttaacctgtttttcgatctcatctttttgggcaggtgtataatggtaaggcctcacattaactggcacagccccaggaattagaggaattgtatggtcataatctcgagcaggaggtaatccactgggttcctcaaatagatgagagaattcctgtaccaaagactggacagcatctggaattgaggataactggtctgtagagtcactgagggtagcacataattgaaccaaacctgccactgagtcgatactgtgcagatgctgtaagtgctgactagaaatcaaggcacaatcagaagtattggactgtaccccatgcaacaaaacctcatgacccataactgtcaagtgaatagacttatgctgccaatcaatttgcattggactatacttagttaaccaatccatgcctaagattgcatcataacctcccaaggccaccactttaaatgtggtcaagaacttctgaccactaacaaaccattcatctgaaggcatttctttctgacaattgcaacacctctccattggccactttaacagacagaggatgagctaagaactgaactccagtaagacggtcagccaattgatcactgacaaagctagccgaaccaccagaatctacaagcatcagtatattcaacccctgaatttttccttgtaaccgaatggtagactgagaatcagtaccctgaactgcatgaactgacgtagctaacaaggaagaatcactatcttcagaagatatgccagcctgatcctcatttgcattgtcaggaaatagtgcaaagagctcctgaatagcgtgaagctgaactgttcctgaacatttatgtgtcggcgaccacttttctgcacataagtaacacaaaccttgtgcacgacgaaacgatcgaagtgcactaaccttgtcagaaagattagtaccccgattgagctctccgcctttcttctcctcagatttcaaaaccttggttggtggcaatggtaatggatatgcatttttaaacttctgcgatccatccacaaatttcctttgctcttgattccgctcagacaactcctcctgtaatagaaccaaaaccagagcagactccaaatcctcgggacaatgtaacaaaacagctttgcgaatgtcaaaacgcaacccttctatgaaccggtgaaccaaattcaaagtgttatacataggatcatacgtcaacaactgattcatcagatcatcaaaccgttcataaaactcgctcactgaaccggtttgtttaatctgatcaagctgtcgaatcagttgccgatgttgatttctatcgaatttttggttcaccgcttcacagaatcgactccaatcgacaaaaacttcatgagcacgagatgaacgtagccaagacgttgccctccccatgaagtaaatggtggctacccgaacccacaaatttggatgagttccataaaccccaaaataatgctcacaacgcatcctccaaccctgtggatccgaaccatcaaactgagggaaatccaacttcggtagcctatgattgaacccttgctccccatgcaaatcccgatttccccgactcgaatttgcgccaaactcaaccccatgaggaacagaaaattcagtgggaatctggtacgtacccttgaccggaggtggcccgagagtatgaactacccccggtgccttcccccggtgaaaatttgtgacgcggtggccatctggaccaagatcgctcgccgctgttccggaaaacaacggcggcgtgctgggcgtaggaagcagaggagcttggtgacccccttcctccgtcacccttgacgcctgcgaggtgttcgacgaattgccgccctcctcgctctgcttctccaacttgaggacatgcagcttcagctcctacatgtcgtgctacaacccttgtacagcagcatcaacttgaggtcgccatcccgccacagatttgtccagtttgagcagcatctcttgtgtctctccttgcttgacgaccatggttccaattgccgcttgaatctccaacagagtcttctcgaatccctcgttttgcttcgccatgtcgtcgacttggatctgaagacgagttttgaactgaggtttctccaggattgcggctctgataccaaatgttaccaacttggaagagaagtaagatattttcagagaatcagagaaagtttgagaggaatagaggaagagaagcagagagaaagacagagttgtagagagagattgagtttgtattgagttgggaattctgtctttacatgtcctccctcccgattctctctctctcctttatatacagctagttaacccagtttccacccttatacttcgggttgggcctagttacacgaacaggccgttgctgggccgtacttagaatggagccagcgaccttagacacttgttcctgttcgtcatcagttgtgccggatgtaatatctgtgaatttccatcggatcgtgtcatcggtatttgttggaggtgcaccatgtgcagaaaggccaaagatagacaaattcatggaaatgctgcaaagtggtgaagagtagggattgtaactccgcgacccatctattgctggccggtgagtgtatctttgactatcatgtactcccccccgccatcaacacttggaagagagttggtactacaactgagggtttgaatgtctatatacttggcaccatttctgaagtgatctctattgcaacattaaagagtgcaatgtcttcatcacacagaactggtaaccctagccatggtttgttcggctatgtccattcgtaccaaagacatctgacatgtagggcacaagagaagagttgcaagtcgagcaatcctagctcttttggtctacagacccattccagttcactttgtattttccacataacatgttctctcctcgagcccataggaactgggtatcaaccgatacatcgggtctcagcactcagctagtcagtgggattgaattatatccatgtggaaattaaaatagtgtaagtcttgctcaatgtgtttataatgattaaacaaatcacaacaaataaataataattatatattttttcaataagacgaatggacaaatttaattatctataaaagtcaacggtgtcaaacattaaaaaacgggagagtagaattctactcttaaatctaccaaggatattgaatcatactactacagaatttcatcatctcaacaccaagcatactgattcatattgctacagaatattgtcatcgcaacaccaagcatatcaattcatacttcagaatctcactatctcaacatgtattagatggtatagatgataattaggctggttcacagaccagaacaggttcagataaagtaccaagtccaagtatctcacaaattccgtgcaaaagtactaactagttataaagggtgtatcaacctttaagttttgttagaggggatagcatttaacagtaactccaaaaaagaaaaacgaagtactgatacatgtttgtgttttcataagatattaatgtaaaatgtgttctcaacgcatgaatgtacaatgatgcttaaaaaaccacataactgtacaacaagaggcgtgctccttattaagtcatgaaacagtgtattgcagggttcaaatatcaaaacttcaaaaattcaattctgaaatacaatagaaacataggcttaagataataacaatatgcacaggcctaagagctaaacagggccctcagttaacatcatttatcccttcaacattgtcaactaagaccatggagctcaagtatttcatattacagctggtaactttgtgattgctgatgtagaatatttgcctaacgctacaagctatttttaagttagtctctgtattggacgatacccatcttctccctctaagaactctctgaggttgttgatcacataattcataaccaatcggaatggtgaaaatgaatttccaccaaaatacaatcaccccagtgacagcaccaacataattccaatttatttagtattccatatccactaaacaactgcatcctatattattcttgactctgttttgttgatgtgcatgagaccataacagtgtaaaacactaaatctacatccgatttagaccatctggactgtgatatgcagtattaagcatgggaataaacaggaacaaatatgttgcatataatattataagaaaaaagttatataattggaacatagacctttcacagaagcaaaacgattcatatgttcagttcatcaacagataaaaccagtaagatttacccaaaaattattgatcaaactagccattagaactcttgtacgagtttatctaagaagagagcatgctttaaaactcttgtagccagtaaaatctgataggtaatcttataatgaggctcctcatccatgtgttcaattcaggatgagctgctctagcaaaaggtagatcactgatgatgaggctcctcatcatgcatttaagaacccaagctgatcactgatgatgccacaagaaaagattgtctgctctctagaaatcaaagactagcaatctactcattcaggtcaaaaactaaactaaccagagacagtctaagatagagttgtgccgctcatgcgttataacatttgattctttcctccaatacatcaactaagacagaagtgtatcttttttttcttgagattcttataaccttgtgttgccaacacagtatctatcaccgctgaagcggtcataaaattcaaggcaaacatccttaagcttgtcatagttgtactgatcagctaaaggctaacttcaaaactaagaagaaatcctagtgggaaaacatcaagcttgtagggaagtagacatttaatatatatattcatctcatcaagtcctcagcagataaatatgtagcaaggtgttcatgcaaatactaaactaaccgttaatagctttagcttttgatgacctgaggtcctgactaccttgaaaactcactcctaataaataaacaggttcattaaacaggaagctgctagtctaccttttgttgagcatactcatgttcacaaatgcatccaccaagactgaaggacaatttgttttgagatctacaaacccctgtgtcgccacaatatcatccattgaagaagaggacataaactcaatgcaagcatccctgagtgacgcacaatgatgttgatcagctagagccaaggtagctgccacagtctgcacattaagattctcacagaggtcactttcacatatcagcttcagcctctccatggcgtaacgatccgcggccacgagcaagtgccgaatcatttcaccacggtcatctcccacaagatcatcaatgatagacaatgaatcagtgtagatgaaatggagcagggccttgaaaacatcaggctgaatgtctttgatgggtaagacctgtgcccccgcctccctcatcgggccaaagagctccgccttgaagaccggtgatcgcatcgcgagcacgaccttgtgcgccgcaaaggtatcctccccgacatagaatgtgacatcggccgcctccttcgattccagcagcttgccaagatgcgccgcgatgtctgacggcggcaccgcgactttgggggaagatttggtctgagacacccgtggctctttcatgacagtgacaacacactcgatgtcgaggcgatcgtcgcggagatacgccgatgcctcgaccaattagccaatgaagcaaaactactggaatcatagcagcttaacactttgggcaatgtctttgtcactgaagtagacaggccggtggtgtggtcgagcagcctcaggtcggaggacgcgtgcacctcgacacctctgttgaggagatcgaggtagacgtggatgtaatcggagctcccatggccgtcggagtagaagcggatggcctagtcatggccgccgacggagaaggcgccggaccggacgcacttgccgacgcccatccccctcttctggctgtactcggtgatgctgaacacgtggcttccctccgccgtctccgtgatgcacttcgacaccgtctttgcgcgcgccatctggtgaggcggcggcggcgagggtggattgccggtggggagggaatcaagaagcaacggcaacatgtcagggtggggtgagagaaaaaagagaaagcacatttggagcaagaagtagtggggagtggaggggaagccatgggagcgagcgaaccttcggaggatggccggagaatggggcggcggcggcggcgatgacgacggcgatgagaccgcagcggagttgttttcgtctttttttttttcgtttttacctctttctgattatttttatctgactgatagatgggcttttttaagtgggccgggctaggcccatggattttgagaactactacaccacaggattctgtttcaacgggagatcaattataacgctgacatcacctcccctgcttctagcgcttcgtcattccaatctcccatttccaaccatgtcattaaacaatatactcgtacaggtctcctacgatgtgtgatgcacatatgcctcgtaagtattaggtaccgtatatgattcatctatgtactgtacatgatacttagatattagacatacatgttacctaaattctaaattctagacatggtacatatgagtaccaggtctaatatttactcaggtaactggtctggtatctatatgtatgaggtctgatatttagatactgggcctgatactcatgtatcggatttgacgcatataggtatcgggtttcatatctttatgtatcgggtctgatacttagataccggatctgatactcaggtactggatctggtacatataggtatcggacgtgatatctatatgtatcgggtctaatactcaggtattggatctgggtacatataggtaccaggcctaatatttatatgtatcggatctaatatttagatatcgggtctgatacgtgatactcacgtattggatctgatatttataggtatcgaataaaaagaaaaaaatagtgtgtattacacgattattataattatgctaatgcaatttttctgttccatactaaatcttaaaagcatcacaaccaaaaataaaataaaattaaaaacaaagcgagaaaaaagggaaaaaaagttttaaaaaaagtcacatgaacggtccaggtatagatgaattgtagttaggccaacagattcacatgcccaaacggtccacatgggccggagacctgtttgtaaaaatcttgtgcaagaaaaggaaaaacacatgcatagtgccggcactctgtgaaaatcatgcgcgcatcgtctttctgatcgaaatagcgtttaccattagtgacttaagtcatcccgttcccacggaatagtgttctctatattttctcatggatttttaggttggattgctatttgtgatgcaaagcgagatagaaaagaaaatcaaaatgtggtataagcctataaggtggaattacttgtatgaatctaaattcagattttgtaaaacagacggattctataaattggtgtgtggctacattggtaaacaccaatgatcctatttttttactctcactgaggtatgttgtcggtgtacggggcattgtgttcatcagttgcctagtacctttattgttttttttagaaacatggtataatttaggcactcatatactcacgcgcatactcatccttataaacgtgcacacactcatcgtatccttttgagcacctttgagagattgggtttgtgtcatcacatccacatacgcctcactattcagtgacgaatctattgcccagcaaccccaagcagttgcccgggctcgtcggtggataatccactaaaatttcatataattaggaaaattgagatagaatttctatagtaaataatagctttagtgaagttagcccaggctctaaaataattctagattcgctacagtcactatactattgattggtacatcgcttatcactaaaaagaataattaggtgaatacaaacatcccctgccaaatgaaaagattttccctacagctaacacattactctcagtaaaatagccaaaacaacaaaatgaggggaatagccttttggtgactgctatacagtcactaaataacttgtgacggcttgccgtcaccaaatattggatttcgtgaccaatcaagtgtgataggcgttttgtgatggcatactgtcaacaaagttcttggggacggcattctaacttttcgtgacagtaaggggtagtcaccaaagatccgatcactggtggtgtaccggatctgatgaagctgccgccccccatgcccttgtgccggctgtaccccaggacctccaacacgtgcacgccttgctttgtcttcacggcggacatcgacttggtcctcctcggcaccgccatgcttgccgctgcaagagggggagcatggtgtttcagaaattggagaggaggaggaggggaggagggggaagtgacggaccagacgaacattgcggtgatggccgccagcggtggcggcggacgaggaggaggagaagacggtgaggaaggcaaggcgacctatttgtttcgaacctacaaatgcaacgcccacaaggccagaatgcacaagtggcccaatggagtgctgctgaaattcagtcacatgaaattactcattgtagaatgtaagtgtttttttttctctgttataggtggtttttgttttattttttaatctaaatttgacctttctgcatgcaattttgtaagtttttatgagctataagttaattttcatataatatatttaaaatttgtgtatgttagaccctttggaacaaaggaagaggattgtaagattcgtatggattgcttccctacatccctccataagaaatttaacatgagctcatatctcatgtttcatttttcctatgctagctaagtccaatgcacattatctcttcccccccccctctctctcttctcttctctctctctctctctcccacacacacataggatttcctgtaaaattgctgtgtttcaattctaaattcttatgcaccagctaacacgatattacttctattgttcctatgttttgagatcatgtagtattgcaatctatttccacgtttttcctattccgtgttaaaatcttgcattcaaatgttgaattattagtgctcactggattgaaaatattgaaatagtccagctttgttatcaattattttatttgatcataaaaggtcttactctacgttctttcaccatagtaacgatatatacgaattgacgtggtttgcccgtcagggcacacttttgggttcccgcaatattgaaatcccgctgaataaatacattccgcaccaccactttcacttcgggcaccaactatttttccaccgcacacactttgactagtcagggcatttgaggggagaaaagaaaagaaaataacccataccactcacctctcttccagatatcttctccaaatccaccaccatgaccccccaaaatccaccattgcgagtgctctcactacaatctctggctaccctcccacccatctccggcgttcgtcaaccctccaccaactagggtgtctgtttcgatattggtggaccggtggcggctgtctccagcgagatctgaggttgtagcctccggtgagcgcttgatgttaaaatagatagcacgcatggatttcttatcgtagctaagtagcaacaggcagacactttggtgaatgatcccataaacattttggactgctggttccttcagccgtcttgtacttatccacataccagcgcatgaggcttagccttctgaaaaatatatagcatattctattctaatttttcctttcacaataatatataggattattgtgcagtggaagctttttctatgataaagggaggatataataaaggcccagctagctttcatcaacaaattagccagataactagcttgaacaaagcaaaggggttttttcttcgaactagagttattgctacaagaaagaaaatgtaattaatattggtacgtactgatgaacattttagatcaaatccataatcaatactacagcacagagtttcccaacagttgaacaacacaaaactactttttgtagataaagaaaatggtttatcggcaaaaaaaaactaaatatttgattaagcaaaaatattttgcagacaactatggagtactatatttgtgaataagcaaggatcaccaaacaaaaacatgttttggatttcatactagaaatttataattaaagaaaggtactgtttgaccactctaagatcaaatccattatcaaaagtacaccaaacattcatagcataaacaaattattaagtaccagtacatgattcagatcatatgctacaaaggcacatatatataagatttcgttctgtatcatgcagaattgcagattgaccatgcaccacccatgagctggttcagttcaccgcagcggcaccaccggcggctggaggcggaggcggaggcggagagtcgccgccattgctatcgccgccgtcgtcgttctgctgctgctgcaggtaacgggatatcagctttgccctcaaagcttccatcttttcaatcctaaaccttatcaccagcgtcgacccatgtccttcagagacaagcctgtagcattcatcctctagctccctgatacgaccatcaatcctgctgatctgcacatatatataagccatccataaaataccatcacgatctgctcattaacgcatgaacatctatcacaagaaatggatgaaatcgatccatcaaatcggaacaaggatatatatataaacctcatgctccaggcgtctcgggagctggtccagcagcggttgccgtcgcagtggcggcctcggtggctgcggcggcagcggaggcggcgccgccggagctgcagcctggttgttgttcccctgaggcgccgccatggattagagcttgcttgctagggatagaagataagttgggtggatgagagaagagggatctgtgttggggtgttcatataggacggaaatcgagatggctgcattaactcatgattggctgtcaccactcgccaaaagataagcattaattgtattacaaatttgagaatcaccagtcattatcttcctgttttggaatttatatttaaattagacttaaaaaaaaatactcggaagttacaatgggtaaagacaatatgagagcttagtttcagtttacaatgtgtaggcaatataagagctttgagttttatcgagcggaacaagagctattatgggttaattattaaattgaaatattaggatcgctatatatacgctagctataatttttctttggttttctttttctacatatacaaattgctgctattgtaatcaaatctcatatcgcgtgggaaacttatactatcataattgtattgtgttttgtgtggaaagcacaatatagttgggaaagttggaagaggaactatcaaaatagaaaattaccagtatcaatgggtagccgattgatctatgaatagccgataattcatgatggaaacattgcataggagcactatacatgcatacgtttgcagttagttacttagcataacaacatatataaaagctctaattttgattgatttttaactaacaataaggatgatactagaaatttttttaaatccgatgagattagaaattagaatacgggaaataaacatatgatcacaaaataagtttttccatctcatcttatctggtgacatcgatgggatgcaatctccagcggcggaaggggcatctcatctgcatctctatcccctaatccctcatgccatgttcggttaatcctcgtgaggaaaggattagagtggattaattttacacctattgtggtgtggaattattttccttcaatcccctccaaactgaataaggccttatggagagtacgtagaagctaccatccaacggctgctgttagttgtctatactctataccagcaaatgacacatcattaatttggtttcagattgacaagcagcaaccaccagctagatctgttaccgaattaaacaatggttgaggcccacgatgatcaggtatttttttccgaatgactcgcaccagatagtgcgaagtttatattgataaagcaggaaaaaaaaacaagattacaaccttgggaggtcataaccaggaatgcgaagaaaaataaccaccactcacgcaacaagccaacgacagcacgaacacaaagaccccaagaaggctagctagcatcgaactaaacgccgctaagcatgaccatccgccgctaggccaataaaggaactataactgagatcacccaaaggaactacagacgatgatcaggtatttggattgaatctatccattgatcttgctatccttctcagtatagttctcctaatcagagtacacgaaggaaggcaaagaaaaatcgggaatagacgtactcgggaacatgcgcgtgatgccgggaagcaatgtacgaagaaaagtagttggaagtggattttgtgttttttaagtactatcttgatcgggtgggcacaatccttgtgtgggatggacaatagaattggagcgcttaaatgagtggtggtatattcgcaggtggctagtacatataatttgtaaatgcatttacataattacaccgatggatcttgacatatatactccctcctctcccttgagccaaacttatcacatgagtctgaaataatgctagtcgactacatacaaagaggaggattggggagtggggggcaccatttgctccgctgtcaaaaaaaaaaacatttaggttgaatatgcataaaaacagttgaaaaagttttgttacgaatataatctcgtaatgctgcattctaacttataccgtaggcatccattgaattgagcaggtatttgctatgtccgtcaattacataactcattaatgattttacaatataattaaatatagtttcagtacaaactgaagtaccaatattcattttgtggttatttatggggaaataaatactaaggtcatcatgaaatacacacctgcacaaatattgaaagaatttactgcgcacacgtggggaaacatattatacagttagtatgtgttcaataattatgaagttatttttagaaactgagtatagtcagtgctcggtttaccttgttttcgtcgatagagctggggacgaaagagatgctaggtaagtgaggttcacagtagtgagagtacagcagagaaaaattaagcaaaatgcagaaatttagacaatgtgtctatactagatctcctgtgttataggtgattatgctaaacagaaagaggtgtttatttgtcccagggattcatcaagttcttgctcctcaatctttcccgtgattaattttacctggcatattgttatttcattttgaaaaattcttgcatttctgtctaccctaacctcctgtactgccaccaaaatgacgatgtatggaacccattccagatccttgtttgtttgttgtgtaacgaatcttccataccaaaatgctcccatactaaaaaaccagagaatatgcaagtacaatattatgaagtttaaccaatgcaagaaaatttttcatcgaacaaaataatgcttttgattattgatactggaaattgaaatcaattttgcaactaaagagagatatagcaaggtatactgcatgaccattttggatcaaatccataataactactacagcacagagcacattaaataaagatatatgccaagtattccattaagcaaaatattttgtagagaattatggagtacaacatttctcagtttgaagaagcaagtaagtttcatcgaacaaaatatatgtttcagattattactcatacgagaaatttatagctaaagaagggtactgtttgaccactctaagatcaaacaatccccctgtcg

SEQ ID NO: 6098 - DNA, 7765 bp, Oryza sativa
  unsure (1)..(7765): unsure at all n locations
atttggggatttgaatccgccgggtgtgtattgatctgacgatcaggttgtctcatatatgccccctagagggcctcctgcccaccttatataggatggggggcaggattacaagatagaaaccttaaccaatacggtatcggtttcctaaatcaggactttaggccgttccgtaatatacaaggaaacataacacccaagtcatgatctgttacatattacatagatataagttatcccctataactagtcggataaccatgccgtgtgggtatggggtacccataatctccacagtagcccctgagaccttcacagtcggaaagataaccttctctcgaactagattactccaaagccgagtgcttcaatcatcttcgtcatggtctcccgagtacttttaccaaatctgaagactgtggagggctgaaaaatatagtcaggtgcatcgactagatgcacctaataggtgtaacccccgactatgtggttaatcgaacaaaccaaacatatagtcaaggaataaataatccaaccaaccgagtggttttgataattatagtcaaccaagcgatttaatattaatatgtagcatatgcggtgtgaatccctgaataatatgatccaagtgatataccgactgctttgtaaaatatgatgagtgtaacctaaagttggctacattattgaaaattcacatagcaaaatagctataaagaagcttgtatgttgtgaataaagaaatttccaaagtattgggcatacgccatgcgcacactgctttaacagacgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggcaaaaaaatatgccttcgataccctttaaaggatgacgcatataacatgctcccgagtaacaaatcttccgggtaatatagaccaagcgtagctcatatgaatagcttctgatctgagtggttatcccttatgggatactccaaaatagatgtaacaatcgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagctgactatgatgatgaagtttcccatcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggatgattaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagaatttgccagtgccgaagataataaagatgaagtcgctccaccatgatgacaaagttgcatcgccgtgatgaagtgaacacaagtcggcggcaacagaagcaaactggtagcgaagacgcgcagttgtgaagataaaagcactagtcggcggcggcataaccagtcggcaacggaagacgatgatgtccatcagtagtggtagctgtataaaccagacgtagaggtgagggcactagtcagcagcagacgagacgaccggcggtgaagaagataaggccaatcaacactggcagaatcatgcagccatggaagtgaagaaaccagtcggcagccatggcaaacgtaggcagcttgtgttgaagatactgatgcctattagtagtgacagcaatgtagccagccgtgaagaaggtagcatcagttggtgttataacaggccagccgtgcaggcagtgacaccagtcagcggcggatgcggcggccggtcggtgaagacgtagacgcccaacaacggcagcataataggccagccgtgcaggtggaaacaccagtcggcagcgggaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcagcataataggccagccgtgcaggcggaaacaccagtcggcggcggtcgaggcggccggtcggtgaagacgtagacgcccaacaacggcagcataataggccagccgtgcaggcggaagcaccagtcggcggcggacgaggcggccggtcggtgaagacatagacgcccaacaacggcggcataaaggccagccgtgcaggcggaaacaccaatcggcggcggtcgaggcgagccggtggtgatgttctgactgatccattcctgtagcgtaagagataagcttaaagccatgaatcccttttatgcatatctggatctggatcctgcagaacaaacatataggatgagtagtatctgatataaatataatactcgagaaaaattcaagcagtttaaaatatgtatttcttctcttgttaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttggcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaatgaaataaatgatgacttagctttgtcgtattccctcgatgacagcagaagtagccgatgtgggaataaagcagtccatcaatggtgacaaaaacaccagtcagcgctagtggaaccaagccagtggtgtagatgatgaagcccattaacagcggcggagtccgccaaccgtataggcaaaaacaccagtcagtggcggcagaggcaggccggcggtgaagtcgtagacgcccaacagcggcggcataataggccagccgtgtaggcggagacaccagtcggcggcgacggaggcaggccggcggtgaagtcgtagacgcccaacagcggcggcataataggccagccgtgtagacggaggcaccactcggcggcgacggaggcaggccggcggtgaagtcgttgttgttatcagcaatggcggtggcgaagacaagccgacagagtggactcgcggccgatcgaccggaaagctgagacgcctcgactccatgaccagcattaatcgcctcaatagtgccgcgtaattatatgcgaacaacaacaaaaaatagcaagagattaatctgagattaaaaatcaatatgataaataatgataaaaatcagattgagtttccccctgactgatttggatcaagtcagagaagaggagcttgaagaagtggtcgacggaaaggaagtgaaaactcccgaagcgaaaacgaagtcggcgactcatgaagttaattccatcgtgctcgttgataggaaactcgacgcaacccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgggtgtgtattgatctgacgatcaggttgtctcatatatgccccctagagggcctcctgcccaccttatataggatggggggcaggattacaagatagaaaccttaaccaatacggtatcggtttcctaaatcaggactttaggccgttccgtaatatacaaggaaacataacacccaagtcatgatctgttacatattacatagatataagttatcccctataactagtcggataaccatgccgtgtgggtatggggtacccataatctccacacccccttatcacaagaacaccaaacgttcataaacaagttaaaatctagtacacacttcgttctgcatcatgcatgtattgatcagatcaactgtcctgttggttcagtttatcgcagcagctgcagcacctgctggtggtggaggcggaggcggtggcggaggtggagcctctccgccattgctgccatctctgtgtgcatgctgctgcacatacaatggaatatcacttgtgcccgttccagctttcctcttttcaactgggcaacatatcctatgcacacacctaaccttctgcactcatgcactcggctgttataaaccctccgatcctgatctgacggacacgatgtaggtggggtgttctttttagaaaaacgcccgcatcctctatacagatttccagatgaccccttaccttgtttcctcttctccgtgctccttcctagatcgatccccatccccaaatcttctccctctccattgacgaaccatgcagtgagcagcaggccggccgcatcaccggcgcatgtagtatgttcatcgaatcatgcagctaactagacattaaactgggcggaactcaagcagggtcagagtccggctggcctataggcaacggtggggtagcgctcaggtcaggcccaagctgccttgatgccgtccttcaccaccggcacggccgtactgctgctcactgcctggttcgtcgctagctatagatcgaatccatgttatggtggtcgccgcgatggcaagcctcccgctggccgcattggatgcactcggagcatttctccattcttttcgttcaaaaacttctccattcaagtatttgtgctttgtgttaactgattgcaaaattatccgtgattgcaaaaggcacttaaagttgaataatgagttgtgtccatttcttaatttatctcgttattttcattaattggacatgacctacctagcttattgtaggcatggccgctgtcgtgccatgtttttttcctcaatcaggcactgctgctgcttgcatgccaggctctacgtgccggagaagagagacccgctagccgcgataggaaacggtaggcacgtcagtgggagacgattcttcctgccgcacggagaggttgaaggtttggggatgggtgttaacgccaaaatggtgtaagcccgaaatcatcatcggcttagtcactatcagcttcggcatctcggaatcagccgatgagaattatcaagtcgccaacagtcggattcttggaggattcggttaaggaaacttatctagaagagaccgagttcaaggaggatgtaacatgacaagttatctattaattaggaatagtttgttagtttccttttatctttagaaaagtatgtttagtgtccgataaggactttgtgttttccttttatctttaggaaagtttctttcttgtcctacaaggaagagtatctacccatgggtataaatatgtacacccggggtcattgtaaagtatctctcgatcaatataactactctcggcgcatcaccactctcttttccgaagtttttacttatcaaccggcggaatttggcacctgacgcggggctgcgtcagttcagttcgatctccggcgaaggggtaagtcatacgttccgctggccttggtgaatctatcggctacgttggtgttgttcaaggctgcatcgcttcgatctcttggatcgctctggtttggatgatatatttgcctacctgatttatgaactctatctctaattgcattgtgtttagagacgcatcagtttagttaggactgtcttagttaggtccgatcttctgtcttagccgatatatctctagaatcacaatgttgttctaaatagatttgttatatccatcatattagatagatctatcggctcatcgagtattaaattatcatatacaatttcgtgctgtgtcggttaggttcgaccttctagattgttgttgataatatagatcttgttaagccgataggtttatgctagtgttttatcggggtgttagccgataagttatctggacattgcatcggcttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6099 - DNA, 827 bp, Oryza sativa
aaggccaatcaacactggcagaatcatgcagccatggaagtgaagaaaccagtcggcagccatggcaaacgtaggcagcttgtgttgaagatactgatgcctattagtagtgacagcaatgtagccagccgtgaagaaggtagcatcagttggtgttataacaggccagccgtgcaggcagtgacaccagtcagcggcggatgcggcggccggtcggtgaagacgtagacgcccaacaacggcagcataataggccagccgtgcaggtggaaacaccagtcggcagcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcgggaacaccagtcggcggcggcgaaggcaagccggtcggtgaagacgtagacgcccaacaacggcggcataataggccagccgtgcaggcggaagcatcagtcggcggcggacgaggcggccggtcggtgaagacgtagacgcccaacaacggcggcataaaggccagccgtgcaggcggaaacacaagtcggcagcgggaag

SEQ ID NO: 6100 - DNA, 699 bp, Oryza sativa
caaattctgacgatttaagataatggttagtaaggaaaattctgacatttaataaaaatgtagtaaggacaattcacaaatttaaggtaatggttagttgcacacagtgccttattccccataaaagagcaattagcagctaactatgatgtacggtgtttgtttttgaaatgaacatattcatgaacttttttggtgagcaccttctggaatcaaatcgacgaagcaaggggtgtaaaagaatgacttctccatgcccctattgtactcatttaagcgattacaacctaagtactgaaccttggagctcctcagatggtaagctaccacctcatctaaatccatcaagtagatgacctccttgtatggatgaaaccccagcaagtcaacgctaccaaatgtccacatgctcatctcctcttctttgttcttgctaaggtctccgataatgttgatgttatcatcatcagagttccattcagcactgtcttggtcttcctcctcatcgtcatcgtcatcagattcatctaggatccacattttgttgatctttgcatgatgccatcagaacaaaccttctattagcttggttaagggacaaaggttcacatcatacttgaccacccactttgtcagctcatgtgattcgtcgagtgcccacacccgaagttgaaaattctgacgttttgcatagtatat

SEQ ID NO: 6101 - DNA, 741 bp, Oryza sativa
cctcccaatcttcatatagttcagcatacctctttcgcctccacactaatgctgtgactgctgctcccacaagtaggatgactgtggtgatgactatcggtaggactatcttcaaagttttagaccggacttttgggccaaatcgaggtaactttggtaacttgatgatatctattgtcggagcaggactgttcattccaaagctccagccaagaacataattcaatgcaccgacattattagcaccggaagagaagccaatatatgatacaccttcatctaaaattgttgagatgttgaggattgctgacagcgttggtctcaaaggtttggttagcttgagaggagctatggtcacattcatctgtgtggcctctccatcatagtccacccatatttgcactgccttgccgccaacaaggggcaagtcattgaaaatgccgttcttgtcatcatagaagccagcaggatgggtctctagcggtctgctgaaactactgttgatagaaatgctgatgtcgttctcgttgttctccagaaaccttttgtcttggcaacttaaaaaattaactgcaagattgctctccctctgatcattcttgaggcccttgctcggaaatatcatgaaagccatgctgtcgggacatctaatagaaggagccatgaagagcacaaagttgactgagaaggactgtaatggtaccttcagaaattgccatggagtcgggtagagggcgtagc

SEQ ID NO: 6102 - DNA, 1150 bp, Oryza sativa
  unsure (1)..(1150): unsure at all n locations
tcccccaattttttaatattactattttcttatcatttgattcattgttaaatatacttttatgtatacatatagttttacatatttcacaaaagtttttgaataagacgaacggtcaaacatattttaaaaaatcaacggcgtcaaatatttagggacggagggagtatatataagcaatatgtatcatacatgtacaatactatacagtgtgtaagcgcctggtatagctgtttgttcattttccatgcaacttcatatacatatatatatatatatatatatatacactcatcatacagctccttgtcattggagctagccggcacacatttttgttgaggtttgctgcacagcatataaaaatgaactgcaccggtaaactgaaaaacggacatatcttgttggttcgttggttggcaagtgtgcgtagcctgctaaaacggcccagcctagagcccacgtactatatgacgggcttagtagatgaagcccactaacttgaaaagcctagttcaccggcggaaaaagtgcaccgaaggtccctcaacttatcatcgggatacaaaaacatcctcgagccgcaaaactagatacgcggggtcccttaactatacaaaaccggtcacccgagatccttgggtggttttagccccggttatggtctacgtggcggctgagtcagtgtgggacccatgtgggccccacatgtcagtgtgatacacgtcatctctctttccacttttttttctcttcttttttttactccatccnnncttttctcttctagcttgccgacgacctgggcgtcgtgctgcacgccatgcttgtttttttgaggagctgaccgcggtcggcaacaacgggtccgatccctgcaagaggctgcggatcggggccgacacgggggcggtggcctcgggacccggcggcgacgcggccgatatggcgcagagcagaggcatcgtgccgttcccgtgctctgctggcggcgctgccatcggagtcgtgctgggtgccgcccatggacgaggacgactactcgtcgctgtccccgtggatgatcctgtcgaccaccaagtccgtcaagtacatcgacacggcgcactacgcggtgccgggcggcgcccgcgtggttgagttggtgacc

SEQ ID NO: 6103 - DNA, 707 bp, Oryza sativa
tggatccccccaactttttccgtttcaacttttccgtcacatcgaactttcctacacatacaaacttccaacttttccgtcacatcattccaatttcttcaaacttccaattttgacgtggaactaaacacagccgtagcttccattcctgtttcgatggaattcggactggctagcatattgtgtcctgctcggtataaaagtagttacacgcacaaataaagcgtatctttaagtctaaatgaaaccgcaaaataataaaatcacaaaatatatatatcgaggccgatcttcccgtgtgttcactgaactaaaaacctctgttcgggtctgctctggctcaaattacctaaatctcttcttaatttaatccatatcaagatttctcttctccttggtatcggctaattaaactctagttgttgacacttgacagtatcatctcccaccagagagaccggttatactcgtttgcaccgacagatactgtcttaataagggattctcatcaagctgatcaccttcaacctgcatctcactgaaactccggatgctccggtaactctccggcatcgccggtaacagcacatcgccgcacaaatattgcatcacaagcctcatgcttggccttgaagctggcgacgggtgcgagcagagaagcccaagcttgagcactagctctgcctcctccgtcacaaactctcctt

SEQ ID NO: 6104 - DNA, 754 bp, Oryza sativa
aggttcgcgcccctaaattatcaggtaatatccctacatcctgttggccgaagccgatattgctcttattcatcataatcacaccaatacaatatttgggatagcctatctaattgttgtcgatatggcggtctgaaggtctgactcatagtcgacaacagggtagtattcctcctcgagttcgtgcccggcgtgatcagagacagcgcaatgtctctcctatcagtatcttgagacaccgtaggggactagccgtgcctatctctgaagtcgatatccggcgtcttgtcttggtgtatgttggcttgtatgtcgatcttctgtcttgatctattgttccgcgtcgtctatggtgggtgttgattgaggtggtcgtcctctcctcctaggaggtctcgtatttatacccataggtgtccccttgtcaaattagaactagagaaaccaatatggatacaatccgagtagtccttgtcatttccatatagaactctagttgtctttccttatccggaactccctcaatatctgaaggttgtttccgtaaaggacatggtatgtgatgggtcctgccgagatttagtcaactactattaggtatgtggtatccataaccctgacacacatattgtagaaaccctctattaagggaattcgttttaatttttgttccacaaaaaatgtttcacctagtgtacttataatgtttcactatgtatggattaaatgttgcagtgaattgaaacattctttc

SEQ ID NO: 6105 - DNA, 736 bp, Oryza sativa
  unsure (1)..(736): unsure at all n locations
ttgtcatgattatagaggggagcgtcaggatctccgaatccccatgatgttcctgtgacttccatgtcgctcgccctagctgtgccagcctgtgcgcgcgggggctccccggccgcttctcgcttgtgttgccgccgccagcgaggccgccggtgatggtagtgctggcgacggcggcggctccctacctcttcccgtctccttcttcatcctttctcttctctccctccctccttttctccagatctggggtgtccggcggcttgcctcctccacccagcgccagtggccttcgtcctcgggctagcggcgtctcctctcccggttcgacgacgagggccgcgcggggaaccggnntcggatctggccgcgtaggcccagatccggcacctctcctgcagctccgcaggtcctggcgtgaggccagtgcaaaccgacggtggtggagttcgggtggcgccggcaagctccgccggtccggcgtggtggctgagcaggtcgtcaacaatgtgcaggtggttgtgtgcatataacagataccttcgatgtgcaagtggcatttggtggcttccattgcggttactttgtttggatgagactccaaggtgaaagccttactcggcttgctgatgctaacaacggtgacgctctcatgcaccgttcaccttcttgaaggcattgctattggagccctcattcaactccacatcaaggggtttctccgggtgaaaatcct

SEQ ID NO: 6106 - DNA, 719 bp, Oryza sativa
aaccctagaacccctttttattggtgaggacacggagaacacactccgcaatgttttagaggtaaaatttatttagcactttgcattacttgagttatgcctaacaaacttcttttttttttgaaatgcagaaagttcgtcaaaggtgccggaaacttgtagcaagattaggttgcaggtcggttggattggacgacgtgtaccaaccgtggagactaccaccaccactacctcaatccgcgcgtccaagtactgctcgacactccatcaggatagaagagcgtgaagaagttggtggctcatcatcgtcacgcattccgcaagggaggggaaaggggaaggcgccggctccacctagcgacgacgatgacgatgacgacgacgacgacgaggatgaggactacgtcgcaccagacactgaggagatagacatgtcgtagcttcccgacgcacctcaggggacgcaacccacgcaatacaacttgcgatctactcgggcagcgaaaaagaggtaaaatgagcttaccattctaaaatgttatttgatttccctcattttgtttttaatatgttttaaacattgtattttcaaatgtaggtacactccgggctcgcaagcaattcggcgccaatggaagaagtgatttgtatgaagttaatctatttgttggtagtatgacatatgtggtgcactatgtgatataaaaggtgatggacta

SEQ ID NO: 6107 - DNA, 733 bp, Oryza sativa
aaagcattgtattcggcttgattatttgtgcaataatattccaaacgaaccgatacctcataacacatgccattaggtgaaattaaaacgacccctatgccttgaccttctttgcaagaagaaccatcaaaataaatcttccaaggtataacttcaactaagcaaacctctccctcataagcaacatctatatgatggtccactataaaatcacatacaatttggccctttataatttttaatgattcataagtcaaatcatattctatcaaagcatatgcccacttgccaattctcccatttagaattggcctttgcaacatgtgtttaataacatcggcttgacaagtaactatgcatgtactagacaacaaataatgcctcaacttggtacaagcatagtataagcatagacaaagtctctctataaaaacataccttgtttcggcatccaaaagacggcggctcaaatatgtaatgatatattccttgccatcttcctcttgcgtcaaaacgggaccaatgactttgtcctcggaggcaatatataaccgaaaaggctttccggctttaggcgctcgcacaacaggtggagtagataaatacttcttcaactcttcaaacgcctcttgttgttttgccccccaagtgaaatcggcttcttttttcaaacgaagtatagaaaaaaaagcatcgattttacccgctaggttagaaataaacctcctcaaat

SEQ ID NO: 6108 - DNA, 13326 bp, Oryza sativa
ttaattggaagccgaggctcaacaagctcacggctaagacccggcatctcatggtattcccatgcaaagcaatcaacatactctttaagtaactcgattaccttaaccttataatcggctttcatgtttttgtttacaaaagtcggccttggtttaattccatcacctatgtctacttcctctaatggatcggccgatgtaaacccttgtccaagcttctctacctcatcaaaatctctaacagtttctccaatatcgttctttgtagaccgatattcttgcaccctttttttaaccactctaaactagcctctttactcattatacaagtttatatggcttagccgtgctacactagccggctttacagagataggtacaaatttgccatcggagatactaataaaatcatagctagaaaaatccctccccgataagtattagatattcccatggcgccactcaaaagtagcatcggccatcgcaacctctgccgatgtatccgcttgcacaatttcaacatcatcgccgtcccattggattaaacattgatgcaaggtagaaggcacacaacaattggcatgaatcgaacaacgacccaaaataacattgtagttaccttgcacatcgacgatgaagaaagcggttggtagcgtcttgtttcccacggtgagctccgctgaaacgatacccctcgcctccgttggttaaccgttgaagccattgagaatcatgttagtcttcttcaactcatcatcctcgtgccccaacttcttgaataacgagtacgacatcaagttcacagcagcacctatatccaatagcatcctagagaccggcttcccatcaacatggcctttgaggtagagaagcttcatgtgacggtttgattcatcgggcttctaaaaaaccgtgtctttaggacctaatgagaattgagcaacctcggcttcatccatagcacaaaactccataggcaacatacacaccatgttgatatccatgtcttcctatggagacgattttccttcgtcaaccgattgttcttccttctcctcaacatcaatcggttttgccttctctatggacttaggcctccataccggtggtggtcgcaactcattgaactttttatccctttgttctttcgcctttttctctcttagttcttgggtccgaagacgttgcaaccttctcttttgtgtagccgttaaatctttaggcatccacctaggatttggctctgttccaggaggtaaataatgtcctctattaaccttgctcgaagacgatgaaaccctcacatcgccctttgtagccctctcatcaaaccggcgctggagcccagtcagaccggtcgtagaccaccggtcagaccggtcgtagaccaccggtcagaccggccagacgcgccggtcagaccggcctgaagcctcggtcggaccgctgtctagtcggcggtcagaccggcctgattgcccggtcagaccggctacatggccgtggtcagaccggccgactgcgatgagctggtaccggcttcggattttttgtttggggacttttcaactccatctccagaaggtataggcacatcatgggatcctattttgatagtaatcacctccgaagtcctttcctccaccttggtgcgctttccttccctcttttcttcattaacccgatttttaccataaaattggcttttgtttggtgaagataagcgctcatggattggcctccgtggtcgtccccacccttggttgaattgcattggaggcatatggttgtacattggcggcgttgccccccatgacatgaagtaaggataagaataacccggcggcggcattggataagaacccaatgacatgtcttgtggatgaaagtatggaggtgaacgcaaccgtcttagtgaatgaccaaatcgccccttaggaggtgatcttggtcttttccatttgtcgtgattcctctcaccaccttgcttctcatacttctccaaaagcatatcaaaggtcactttggttttcctaggagccttagaagtcgaagcttcacccttattctccttccaaacaccaacctccggcttctttggcaccatcatcttaggccttggctcaccaatgaccacttcctttcccttagtagattcggcttgctccggccgaatcaacaccttcttattattgaaattaattgtatttactggaaaaggatcatgatcaagcttcatcttggagccatcggtgaatttcaatcgtccttcatctatggccgattgaacctgtcgttgaaacacattgcaatcattagtagagtgagaatgagaatcatgccacttacaatatgcccgacgttttaactcttcttgtgatggtatgacatggcctttaggtaatctaatttgtttctcttgtaaaagataatcaaaaatcttatcacacttggccacatcaaaactatacttaacttcactttgccgatctttacgaggagtcggcattaaattagaacaaacaaaaggtttatttttgttggtccatgaccattcggcaacataaatatcatgatcaccctcctcttcactatcactagcatcagagtaatcaactacattaacattaggctttttgttgaatggtctagcaaattttttattatccttaacccggcattcctgagccagagccctttgcataagttgactaacatcaagaaattattggccatctagtttctctctaagaggagcaacaaaaccattaaaagcaagcccggccaaatctctatcagttatattcaaagtataacatcggtttctaacatctctaaatctcttaatataatcaacaacagatttattatatttttgtcgcgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttactggaattttcagagcacaaataataattattaagaaataaacaaagttaaaatgattttataaaaagaaaaaccctaaaaagtcccctttccctccccctctccctcttgggccggttcggcccagctccctccctctccctcctcctccccgcggcccatccggcctctccctgcgcgcgcgccgctgacgggcgggcccgcccaccaacctcgctgacgggtggggcccacccgtcatccccttcctcctgccgctcccgccgcctcgcccgcgccctagcgccgccgccgccgcgaatcccgccgcctcccgccgtccccgcgcgcaataaagtggggggaattattccccgggatcccatccccctttccccccatttttccctccctctctccctcggattcatttggaaacctctcccctaacctcgccggcgccattaatggcggccaggtctcccgcgcccatttccccctcctccggccgccctctctcactcccaaccctatataaaccctccccgagctccccaccgccgtttccgccactcaccgccctcttcccccgccggaatcgagctcgcgccgtcgctctctctctccgccgtcgccgccgagctccggtccaccgccgtcgtcgccccggaccacctcccacctcggcgccgcctccttcggcttcgccgcatcctcaccgacctcgtccacctctccgtttcggtcgccgaccgccggagcaccgtcgaccccgtccacccgagccgcgccgccgccttcctccgctccggtcgccgtttccatcgtcaccgtcgacccggggtgagccgtggaccgccgcttcgtttccccctttccctcccttccctcggccgccgctccgccgtgcctatggccgccgccggcgaccataggggcgcgggcgcgccacctcccgccggccgcaccgccgaggccgtcttcaggcacgcctagcggctgccgcgtggggcccggccgtcagccgcccgcgccctcgggtgcggctgacgcgtggggcccacggcgccggccggtgtgagccgggtgcacccggtccaccgtgggccgtgagactgccgcgtgggtcccactcccgtggacccggtccgcgcgccccctcccccggctgacgcaataaatccatttttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgagcatattgaatcccagtttataaagttattttgatttaaattattgcattgtcgctttacttaaattcccgcattatcactgttttatttagccatgcctacttacctttgttatgaccttattattgctattgttattatttccttgttcaccctagaataaacaaaaccccaactagtggacactctactcatggtaccactagtatgattttaggtagatgcttcgctaattaattaggcaacattaggtggttttacaactctagactttgggaatattcatatcacctggacactatggaatggttggattattgtggaattggattcacacctcccactctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcggcggtcgatggacatctctaggacaaatgaaggctacacgagctgcggcccggtagtcgagatgtcatggcacagtaccggtgtcctgctgctaggggctcagtcctgcctacctgtcccgggggttccggccgtaggtggggttgggtcggtactcttgtctatggctaggatgggttggaaactatgtcatgtcttccgtccatatgccgtggtggtatgtggcacgtggttacacgtgaggaagacgtgtcttatgggtaaagatgtacacctctgatcagagtaaaacctattcgaatagccgcgccctcggttaggggcaagccgagcaatgtacccaagttagcgttttaattcttaaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctaggatcatgtttacaaaataactttgagcaactaagtgtcttttaatgctgtttactgcaaatcctaaccccctatattatggcttccttgtacccccttgcatttattctgcacttgtgggtgtgtcttgttgagtacagtggttgtactcagtcttgctcaatttttcccaaacccagaagaggaggccctggaagatgaaggctttggtgtctagctcgtgcctgtcgtcaagcgcctgtggtcgtcgccctagtcttccgttgtttcccgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccattgggttaattccggtcgtgacaatttttgcttaaccgatgttaaatcacataacctaagctcagtttctccagtatagaaataatcatgaaattgttcctctaattgagcccaagtatgaattgaatttgccggtaaagaagtaaaccatataaaagcattaccggataaagataaagaaaacaagcgcaatttaaaagtatcactattagcctcaccacattgcgctaaaaattgacctatatgctcccatgtggtcttaccatcctcaccactaaattttgtaaattcgggaactctataatttctagggaacgacacattatcataataatccggatatggttttttgtaaggcctatcacgattcctagtttcgatcccgaatttagtcctcataatatcactaatcatgttctccatgttattaggtccttgtggatttggtggtgggtttggtggcctaataggtttggtttgtggcgcaatatgattatattggccttgactagtatcgggaggatatcctctagaaacatcattgtaggcattagggatatgtgggggaatttgaggactagtggtggcagtagatacagggggatcaaatgttctaaagtggtacgaataactagcattagtcattggatcaattccctgtatcggcacaattgcgccggtctgaccggcccagggcccggtctgaccggcgtcatgttgcatggtcggaccagcctgagggccggtctgaccggtgggataatacccggtcggaccggccatctggccggtcggaccgacggcataatacccggtctgaccggccgtctggccggtctgaccgacggctgtgtcgcggtctgaccggccgtcaggcccgatcgaaccggtcacgaacgccgctccgttggttttggaccctattggatctataggaggttgatcagcagtggtataggctttatcttttaatgtgtaatcatccataaaagagcctagcctactccttaaaaacccatcaactttttccttaaacatcacatctaatctatctttaaaattagccatagatgaatctattgtatttgcaatttgttggtcgatagattgtgatacctcgtcattacttaccacgtcgggagcgagcttaggacgtggcccgggcttgatgatcacgccttgacgagtcctagtagtcaacctcatcaacgcctcccgtgtgagctcggtgatgtattcctggacatctttgcgatcctctccttcaaagtcatctaatgtgaccggtatcacatgagatggctccacctccgtcttagatgatggcttcgtcatggcgaagtcgaagttgagttgacgatgaacggatctcttccccattggagtcgccaaaaatcgtgttggcaacttttttgacaagttgacaagcacgatcgtagcaccttaagccttgcggtgattctaaagtcgccaaccacctcgatctagcaaagagctaaacctagatgggttttgataactaaaccggctagcggagccgatttctagataactacccgtctcgtgggcaaacggaaggttttcaagacaaacctacaaagagatgtcgcactctcgcagcggtagcggacggtttacggcgcaaaccgacaaagatggacaaactaagagaaaactaaaagcaatataaaaagaatgattcgattgattgatagtagattgattttaacaatgaaccagccttgtcccttatataggggttggtcttgccctctacaggcccttctccatgtccaactcggggtaaaaaccaaaggaaacccgaaacatgccttccaaagcaaggaaacctcgaaacccgacgcaacagaatcggactcgggcctgtcggtcagaccggccacataccgccggtctgaccggccttcaaccggcggtctgaccgcccaacacacggcggtcagaccggcctacctcgaaggaaaccggtagacttccaaattttggcaatatttcctattttaagcctaggtgccaaatttgggtgtaaacaaatacttccgtacgtcggttggcaaaaccatccgggcataaaactaggtgccactgccaggttcccaaacttgtaccatacaatcaaatcaattcttgacattgttatactcactggctcactggtagagagaatctttaccaccggttaaaaacccctttattttttttatttttggttgttgcagccgaaactaataaatcgtgactaaacatctcgatctaaaatacatactaaatcaaaaaaaatatatgggatatggattttgaactcaatatctctcaccttagccctcatacgtcctatctactacacacatctaatttagatggagatgctttctttctagctaaagaggtatatttagtaactgttggtgttccaacagtactaaaaatatctttagtacagattagtgttaccaaacagtactaaagatgcattttaaagatgcattttagtatagttagtaacacacaccacaaccaaagatgtttgtaggaacttgacttttataaccgatattaaagtatctctaactgatatatttgtgttttgggccctacggtaaaatatatcgtttctttggtagtgacccagctcttggggatgaaatacccaaaaggttcacgaaaagcatccatttaattacctctttgctaatcagaatgcttagcaaatcattttattaaaatgtttgctacaaagcggtgatggtttttttccggggatgtttttttttcctgtcaaccaaaaagtacttatgaaaaaattgaaaatataaattatatgcgtgggtgatatatcactttacaaatgcacgtcttttccttaaaatcacactagattaaatcaaacatattacaagcaaatgaagaagaaaattttaactgtaaatagtacaagtattagcaagagtaatttatttttttcttcgatctatggatcaaatttaacttgcatgtttgtatagtaatatatctatattaatgagaaaattaacaccatttcactcttctaaattatttcattgaagtacttagcccataaactagtttttagctcattctacaccctaaactattgaaaatgttttacatactttacacacagatgctatttcttttttttctttctatataagtcataatttacactcaacttttggtaggacgatagatgcattacaaagtacctctcgacttatttttagaattattctcactatttacataggttggaggcagatgttaaattctggattgaaattttagttctgtgttggcccacctggcagaatattctttccagcattttttttcaggtcagaagaaaacaatgtttaaattcttaaaatttatgtccgagactggagttctgtttccgccattacgcgtaatattaaggccctctttggcacaactctgaatccaaaatttctcggagctggatattcctaggttcacaaattcatggatctagatctatgattacattgataacatttagataaagtttttgtgcatattgcagatgaaacttaaatttttaaagcaactgtaattgaatgtataaacttcaagtctattatgggtctaaaatctggagtagtcccaaacaggacctaaatccctgtgaaattaatatgctgtaatttgaaatgttgtaagctaaaacatgaactcaagaacactcattccatatgattttgagaagagagatttcttcaaggaaattagttaactactaattaactagattcacttggagattgtggaataggagagttttaggaaatacagctgtgtcagaagcaactgggatcccacatattcccgcatatgatagtgatcctcatgtggtgatataatatatagttgtacaaacaattgatatttatagatcagtgcgttacttttagtccctttagtttgtttctattaggtggctagcaaaagcacagtgcatacctattactagcttagaatagcgcaaatgatttaaaatgttgatcatcatgctagcatgcactccagcatattagccttttggtgaatgaaattgtagaagcgcatgcaataacataacgatcggcagtatatttgccggaaatgttaaaaccgaaacctagctattgtgcgttttccacccaaaacgcgcatccatggcacaccatcggctagaaccggtacctttgttgagagatagggtccgctttaaataaaaaccgttacctataatatgttttaggtcctggtttttcaagaaccgataactatatttatattgtaggtttgtttttataaaaaaaatggcacttgttaagaaaaccgacagactgagtagaataagccgaatcacgacttgtttccacctatatctctcccttttgatcgcccctcactcactctttttattacccccctctctcccccttatcctctccgcctcctccctatccctctctctccaccgcaccacccggcggtagcgccctcccctcccctctcattgcttgtgttgttgatgttcttgtgttattagtgttcttgcattttcttggattaaatgtaattaaaagtgtaatcagatctggttggggtgaaggggacttattcgatgcatgcatcgagccggtctcttttttttttcattcctaggaccttaaaccggcacatttgagagaactcaaaaaggttcctgttgccaaattcggcacccatatgtggttggcaaccgacacatatccttttctgtagtagtgcctataaatccttgatggggtaccagcattgttaattaaacacacaattattcaagtggtgtacatcttgtttactgctgtccaagcactggtagcttgaaactgatatccaagcttgataagggtaccattcagacgtatagttcacgagtgacgattaaccaggaaatcaatctaacgccataaaattcagactcgaaggggtaggtaagtctcgtacgcgtgggtttacgtaattagttcatttagctttgagtactctgcatctcttgattgggtaggaaagtcttgattgtttaggttaatctctagagggctgctacaaaacgggatcccattgtaatggaatagacatattaactattctcttgcacgagtatcacaggtatcaggtcctatatatcacaaaggattccttgtggctcccgcagctattgtgactaattttccctaaactcaagaggcatctttaacctgggagaaggccaatataatgttatgtttggcatatcactcataaatattaagattatcatccctgttagtgtcaggggagaattttgagaagtttgtcaagactaatgcttagtacaaatttagtgcctatgcacatttgccgccataatttaaaaggtagcacaaaaaaattgcgtggcgtgcaaacatagtgggatggacatcacacatttcatatgcgccacttgtccatttcatatgattcttctcccattaggctacggtcattttcagagttgtaatactaagacaaagtggaccataattgacttggttcatcattccacaaatcaataagaaatatagaagactaagaggcaaactatgtaagatcctattaatcttgtcatttgatggaaaagatgaagctttactaaggggttgtagcaactccaaatttaataataataaagctcactttcctctcaaggggaaataaaattgcctctatgtcctatgtatgctactcttgaaattttcttctgtaagttctttgcaagcaatagggacatgcttaatgtcctgatttaagaaagtagttaaataagaagattaatggcattattttgggttgaatcattatgagacattgtcgaaattatggcattatttttcggccacatttctaggggagaatatacgtctcattaaggtcgagacacttcacccttagaaatttctgacatctattattacttagataaagctaaagtaaatcaagtgattcaagttcataaggtattatgcttccattacataaataataaaataagtgggagctcatcaagagctctaataagagaagattattctacctcatttatgactcatagctccattatgtggatgttataattttgtgacttgcacaattaaatatacataacatagcttgagggttttgttatggaaagacaagtcacatatggggtgcatacttaagaaatccatttgtggacttaatcaagcattgatgatgttttaaattctgctgcatcattagtgaactaagcttaaataagaatgaggacaataattattctataatgatggaagtaagacgtcattgaaattgtgtcattgtcgcttatgtcacatacctaggggagtttggaacgtctaatgagatagagatattctttcccttagattttaatggcattgtttagctttaagtgaaaatttcactaagttaagaaattagccaacaaatgattatttatggctatgtttacccataagcgacctccgatttcctttaagaaatgtaagacactaatgctaaaatcaaatgaagttatgagatctgattatggtggtaaacactaaataaagcttgttcaccttataagacattaaaaataagcattcatccaaatggttttccaaccatctaagaataaattgagatggatgaacaaaataagacattaaagtgttcatctaaatggtttttgaaccatacaagaataattgagattgatgaacaaaataaagaattttgtagaagtttctgaatgagtcaaaatactgggccatttaagtgggttaataaaattaagcctgactctaatggaaatttcgaacaattcaagtgaggtggacaagtgcatgaaaattaaaggtgggaatttcattcaccggtactctatactaatgacattttattgtcaagcaatgcatattgctgttagaaaccgacaaaatttttccctgagttattttggtctgaaggagtactggcttatatcaataagtcatatattgacataaagaaataatttgagagaatttagttatagttagtcaagctaaaattaaattataaagataatcatttatgattcagcagagagaagcttgagattagctcaaatctggatgcatacagatttggcatatatttttactgggaatcttggcagtatttaattaaatccagactagaccactggtattaagaatgttttgcattatttgcatgacaat

SEQ ID NO: 6109 - DNA, 13587 bp, Oryza sativa
ctaacactttgatatagttgtgaaagatatgtcctgggatcgaattattattaagctaagcttttgctcatggatccatactttaaaggctcataaagttaagattaattaagatatgttctggccaatacatgtataaataagagcctaactaagatcctagatgagggggacttaattttcaatcaacacccactaagttaagcttgagtttatttggatactatagtgaactgtatgtcttgttgtctcggtgacgcataatgttgttgaaaacacatcgcttggggagctattttatttgataaactcgtcagctagtctcaaaatcaaggggagaatgttggttaattttatcggctaatgccggttagttaggataaggataaaatcccaccgattttcctatcctaacaagaaataaactaagagataaatctgttttgtgtgatcggtacaaaatagattcgaattttagattgagaaaacccccgagccccaccagtgtcgcttatataaagaaagagaaggagggaggctgagtgactacttaactctctccaagcataaaccctaattcaatcgtccgatcgattagacactagaaggggttcgtgaggtatctcagtacagaagaaacaaagaagaagaaagaagagaagcaatggcttcatctcacgtcagttagatcaattaatttccgcataagcagaagatgaccatgtttaggctaagattcaattaattagttggattaaagctagggccaccatcatgccgtgcaatcaccgccgctagcttcgccaccgcgggagctacctcggccaccacttcgccctcatagaccgacagccaaatcattacctccaccgcgaaattcaatcgccgtctcttccactgtctctagctgctccccgacggcgaggcaaggctcgtccggtcgtgcttccaccgccaacggctttgccgcgctgtgcagcacctcggccgcctcctcgccttcgacatccatcgccggagtccgcttttgccgccgcctcgtgcctctccttcctcgtctaatccctccattctctttattagatcgagggcaagcccgtccgcctcttccagggcgccgcccatcaccggagcgctgctgccttccttcgccctgagctctgccagccacctccctccatctccgtgcccctcggtgagcacccatctcctttttctcggttccttccgccgctccccgtgccgccactcacagccggtgttgccgccggtggtcgtcaggctggcgccgccaccgcccagtcgggttggctagcgagccaacccacccttccgccgtgcaccgccactgtggactcggtccacggtcgactagcacctttggctccgctgactagtggggcctgccctttgtggatgtggtccacacctctccccttgctgacatcagcaatcggcttttccctttgtaaaataattattaattgcgtcataaatcgataataattccagaaatccatttaaatggctcaaaatttctaaaattcatatatagttcatatgaataacgaattgagccattcaacttgcaaaattcatctaaaattgatccctgttgacggtcgttatagaccaatttcgaccgctaatataactaaaataatagagaattggttatgctcataatgcatattttgttttgaaataatttagttccacttgtacttggagaataatttgttgcatgtactgagcaaataaaatgagaagaaatgaggaaaactcactcctaagcaagcatatggataagatgggcccacatgataggtgtaaccgtcctgaaaactgcatcaactaccataaccatcatgaggacccacctgtcagccactctactgtacttgggggcctgctgggccgacccaggttcggccgaacccctggcagctgtggctccggctggccctacacatggtcatccaggatcacttgccaatgacggttcaggggcagaaaggacattttgccttctccataaccgtcataccgaccctataaaaggaggagctcacttcacttctcaacacagtcaagcaagctcaagatttctctctacactttatttagtagtttttgtgctaactaaagtagaatagaatagttttcggagtcctcggagtcttcgaaagagttcgggtatggctctagtatcttttctatcggcttttgtaagacttccagcattaatgaaatattcttctttatatactttcggtactttgtttagtctgagtatcggctttactttacatttgtgtcgtattaattgtatggttagcttcccagagtggtatttattaatgtaaacgaggtacttagattaataagtatcattatctgggcatatatgctacggatctgtagaggtgggccgctgatgatgatagctcagtacaggtcttcctccacgatagtatatattcctaagacaaattcctccgtatttagccccggttggacggccatgacaggttgtcgtaaggaattcggcaacccagggtggtctctcgaaacaccaggagggcactattaggggatattggccacatgattgtatactagcaattgtagactaaagattgagtgtatattagaagtataggaattgagttcttttctatttctccttctacttagtttaggatcattattagagggaatctaaaagcgactacttagtttaggatcattattagagggaatctaaaagcttcgcttcgtgtcactctacccatatgctgaattaacccctactaggctttgatgaaggcaagtaatatatatgtatataatcattagcatggttctctctttcaatatcttcccttagaattaaataaatacgataccctggaatactcccgggtgaaatgctataatggtatatccgtatgcttgtggattttttctgtaaccaaccaggactaaagatctatttttgtcccggttgtttaacaaccaggaagaaaaacgtccacccacacgcgcgcaccaagtctccggcgcttctctctgcatcctgtgcatgcacagcccctctctctctccatctcccatccttatcaatttttcttctcctcccttatctccatcctgtgcatgcatcctctccatccttctccttccatactccccttgctcttctctcaccctctctccagctcccctcccctcccctccctctctccctcctcccctccactccctctccccctccacccctcccctcccctccggcaggccgcgacagaagcagaggcggccggcggcgggatggaggctgagtgtgggccggtggcagccgggcgcgagccaacggtagggaggccggccggcgggatgcaggaagagcgcgggccggcaacggccgggcgagggccagtgggatggaggccggccggcggtggcccggcgcgggccggaggcctcgccctcccctccccagatccggacggagaagaagctgcgggatgggggtgatttgatttttttgagtttttttatctttttttttatgatttgtggatgttgtgatttgtgaatgttttgaatgaatatgtgaatcgatattgtgaatgaatctgcgatgttgtgaatgagtctgtgaatcgttgttgtgaatgaatctgtgaatcaatattgtgaacgtatttgtgatgttgtgaatgaatctatgaatggatattgtgaatgaatttgtgatgtatttgtgatgaatctgtgaatcgtctgtgaatgaaaagatatgaaaggaggaaaaataaaagaaaaagccgaaggagaaaaaaaaattagtcctcccggttggtaacactaaccgggactaaagatgcaaccgtcttttgtcccggttggtgttaccaaccgggactaaggatccatctttagtaccgcttatttcaagcgggactaaagatgggcatctttagtcccggattcctcctcccggttggaaacttaggagtaaaggggttaccaactgggagtacaaatggtttctccaccagtgtgtaagtattttacgatttatttacatttggatctgtatattaatttatcattttgtaccctagctgattcctagacagggatttaatacacaaaatagtctgaaaatttaggctaaatttctggacgtaacatgaaaatagccaaattggcctcactagtcagacctcttagaaacctgtagcctgaccgaagttcattgtccacttttaccatctaaacacgtgcggtgagaccgtcttttgcctgaatgttctgaaccacttctatatttaatctaaatttgacctattgtcaaatttggatgtcagcccatacaaattgcattccttagatttgaactttgaaataaccaatggttgatagttgacagtgtctcgagatcgatttttactgtagtgcacgaatcttggtgtattcctagccatttaaaagtcaatatgtgtacattttcatgtagctgaaaactagacaatcccacagctggaaaatattttgtcagccagacgatgctcggcaggtgatgttggaagcgcgatgccgccaaaacaaggtgaggaagaagacgagagtacctacagaacagagctcaaattgaatgataaggaactcgataacacatcgggtgtaaattaaacagcatttgccatccagctgaaaccactacaagaaaacataatgttttcggcggccatacgatttcttcggtcaaaaatgggctgccaatattagtctttaaccctcgtttcctgattaagtgattatacccctatatatactcccttcggactgataatattagtcgttttgaataagggtaaagtcaaactttaaaatctttaactataaataatttttaaaatatttatcttgcaaatatgaaaactatatgtatagattagtcttaaaaagtacttcaataaaatcacatatttattgatatttcaatataaattataatagaaaatagttgtaaaagttatttttggagaccgtgctcttgtccaaaacgaaaagtattatcaacgaaaagtattatcaacccggagggagtacatctaaaactaaataataagatctggcctagacaagcatatatatttccatccatacacataaaatatcatactaatattcatttgtagtaaattcatgcgaatcaaattagcgaagtcgacggaggacgacgacgaccctaacgtatgtaatattatagtgaactttagtttcttgcattatatattatcaacaacaacaaaattagcatcacgaaaatactttcctatatgaatcaaatgatttgacaggcataatattaaataatacaatttacaagtatccacttttttaaaaataaaatgttctgttttattttggggcggagcgggggtatattgacggagatagtaacgcatgaaattgagaaaacgacggcagataaaccaagtctttggcggctgacggagatagtacctcgtgacttgctcaatgtgcctgcatgtgacggcagcgggtaaatgttgttaactaataacatgcgccaaaagctagtttcgttcaactatatatggcaacttttctgttaaatttccaaggatcccagatcgaagtcggcccaatcagctggcaacttcaagaatacatgaaaaagaaatgttgatttggcagagtgccaccaaatgtagtttcgttcaactatatatggctacttttcgctgaaaaattaaatgtccatactaattaaagctgctaatattgaatttcttcttcctcagatatatatatttcacatctatagcttgcgattatcgaagtctaagtaatgtaattgttcacgtttaaaactttgctaattacttgttttaattaactaacctttgcatccattcgaaatttcattaatcttacagaaacttttgtcccgggctcccggcacggtaattccttgtgcatacattgataacgctgcaaatacaaagtgagttacactggaaaacaaaatatcgagatggagtcctaaacaatttgctgcagttaaaaatacactagtacgaaatacgaaatatgatacgccagcatgttagtaggaaaagaactcttcaggctttttctttttgccatccctgtgatcaatgcgaaatacgccagcatgttcattgaggatccagaggatggttgtgagctcgccgccacaggcgagctgcttggcatgggaatcccttgtgcatcggaccgacgcaaacatcagaagacgcacccatgccatgaagatatgttccagcatttccgacatagagaagtcctccttgtcccattttttcagttcaggaatcaactgcttaagtcttttatacctatcgaagccaggggattcggagctgaaggttttgggcgtcgtaatgttggacttttctcctgggattttcattacccgacttagcagcgccaaggcgaagctagttccgtcagagagaattatattctggtcgaaaagagcacttgcgagttctggcctcgacttgtgggtactatatcctggcctccagttgctgatattcatcggcctcatgggtttgggctgtttctccttgtctattaggagttgggcgagattcttctttccttccacgctgttattaacagaagattgtaattggttgcccttaatttcgttcagtgctttgagggcaccttcgtacaggctgcgtagcttaaggcctggtagcatgcttgggcgcaccacgacgaggaacaccatgtaattcgacagtgccttgatcgcccgtacatgccgcaacgatgatgcatattcaccactgatcaagaggaagatgtctgtggtgatgtgcaagataaggatggtctcttggaatgcaggtgcaaagtccagagcctcttctagttcccgatgcattgctgcttgcggttccgccaacaccgccgctacttgttctggtaattccaatgcgggcaccatgggcggctgcttgtcaggaataataggcgggtacgctgacttgagacattcccatatactttcgaacataaggttcctaacatctgatgactgatagcataacatatgaaagcccaacgagttgtggtatctgtactccatccaacggtcatccagtgaaactaattccaacactgatttccacatcttcaacttccatgttatgtcacgagtgcactcgtcaaacaagttgtattgcccaatgattcctagccacctcctatagctagttgttggatgatccttggaaaagaacctcgacggatccagggagacgatggaacggcgaatcatgcgccatttccctgagcacagaagggaatggtgaagccaggagcgtggcctatcatgcaagaaggaataggtccatgtcgaggccactgctctgaggagccatttgatatccaggatgacgatgccacccagtacgatataggtgatcaaaacgtcaggctgctgcagaccttccttgctctgagaccaaaacagcaagaacattgcagatgtgatgaaatgggaggagaaacggatggcatagccaccccatgtgtggaccatggctgccttggtgtacaagatgtcatacatgagggagagctccatgtccaccacatcgtacaacatctcattctcattccaggtttcagggcggacaatctcttgtttgtcgacatcatgctcgtaagccatattgtcgatgaaggcgcccttggtgatatggagcatgtcatgagccgccagcaggatttgctcgttattgtccatcttcctgcggcctatacgccttaagtttcggatgctattgcttagttttattggcttcttctgctcggcctccttttggcttgaacttcgcatcttctctagcttggcgcgccgcagagcgaatgctctctccccatacttgacaatgcccatgatgaacatgactgatgaggacacccggacaatcgtgccgccgctactgaagaatacattcttgtacagtatatagattgttcccaacacctgcatgaaaaaccctatcatgtcgcgccatgataggatgttgtcttccaaggagtaggaggtgatgttgtccggaccaccagcatggaacatcagcaatgcggcccagatcgtcaccagctgcaccgactgggacgacggtgtgctgccgccgatggaggacagcttgccaagcgcgaacgtcggggcccaattagccaactggtacgccagccacaggaccaacgtctccatgcctgtggctttacggcggcgaacatcggcgaggaagacgaggaggagttgtgccacgaagctggagagtattgccaaccggatcatccacgcattccagaagagctgcaagccaatcatccatccaggcatcgccgaccctgctatagtgaatgggtacatgttagtccacaaggacaaaagattaacgcaaattacatgttaagagatcaaggacaacaactgatccaggatatataaaactgaatgaatatccgttacacctcccagtataatcactgatcaactacgcacctgattgatatcccagtcaagcttggaagctacaaactgctatgatagcagggagttataacaagacgtagaacttgcgcccatctaggatttatgcctctgttgcatgcgctctacatttctatattattagcccaaaggtttaatgcatgtcacagtggatgccagcgtgatcaaaccttttcaatcatccgccttattctaagttacaaggagcgcactgcatgcatgtgcttttgtagccatgtaatagaaacaaactatgggaattaagtaaaggtaacgtacactcatctataattgttttgtacaactatatctgagcaccacatgagcatcactaccattccagggacatgcactctacatttctatattattagcccaaaggtttaatgcatgtcacagtgatcaaaccttttcaatcatccgccttattctaagttacaagcatatactagctaggtacgcactgcatgcatgtgcttttgtagccatgtaatagaaacaaactatgggaattaattaaaggtaacgcactctcatatataattgttttgtacaactatatctgagcaccacatgagcatcactaccattccagggaatgggatagatccccagttgcttctgctacatctggatttgctaaaagtgctatagctcttccacatgctccaaattaatgaccagttggttttgccacagctggatttactaaaagtgctatggctcttccacatgctccaaatgaatgtaggtagttactccctccattttaggctataaaaagttttgcctttggttaaagtcaaactgtttcaagttgattaagtttatatacaaatatagtaatatttataatactaaattagtttcatcaaatcaataattgaatatattttcataataaatttgtcttaggttgaaaattttactacttttttctacaagcttgatcaaacttaaagtagtttgactttgaccaaaatcaaaacgtcttataacctaaaacagagggagtaatttccattgaaagatgccatcttcataagatgacactacaccatgtcctaaaagcaccaacagaacatctgtcggcagaggccagctttcacgtcatcttatctgtcggaaaagacctttaccgatagaaagagtgtgtccctgagtagcctgtcgttaatggaatccaccgacagacagtatgacctagatatgttagctttcccgacagacctatctatagtgagatacaacaaacagtcagacaacaatatcaatcattgcagtataattagtattttgattatttgatagcatgggcgagaaccatttgtgtacttttgtcatccccaaataactctagaaccggatgtccatcaacctgcgccccatccggtgtccactccgcctagctgccttcgcctggccgcaactccgcaccaatctgtgcggatgcaccccaccgtgcctctctgccctcgaaaggccaccgaacgccagataggagatgaggaggaggtcgccgacgagctgctgtctaacggcgcgtggaagaaagctagtgaggcggcggcggcttgaagaatcaagaggagctaggctggatctagggtccaggtgacgagcagttatataccaacagatagtgggttggaaggtctttccaacagacagtttgacacgagattaacaatcagcgacagaaagtttgcccctagaaaaccatagagttcccgacagatggtatgtcacaagcttttaccgacagacagaaggttagatgttgattctctatttttacccacacacatctgtgggcaattctttgacatggtgtagtgtgataatagcaaagaaaatacaagtataagaaaatattgttcttgatttcatatacattgttttattaattatatcgtagcattttaagttatgccatcttaattgacaccaggctgtattcagtattgaaaaaaaaattgaaaacattacaagggggtcaagaaatagaactgaattttccacgcacaaaaaaaaagaaatctgaacatattttactccctccattccaaaatataaggcacaaccacccttaacccaaagaccaagaaataattattatcatcttgtagtttgtactaaatataatgcatgcatactaatattcatttgtagtaaattcatgcgaatcaaattagcgaagtcgactgaggacgacgacgaccctaacgtatgtagtgaagtcataatttatattatttgggttaacctgccctccgtcaaagggaagtccactagatgattcgtcttcttttgcttttatagttgtgtgtagataagtactagcctataactaaggggatgcctaacgtacaattattgtctgacaagttgggataaagaaatgagtaagcatgcccgtaattgaataattaaagctagctttcgtattaaatttattagtgatctccatgaaaccaccactggtggagaaatcgtttgtagtcccggttcgtaacccccctttatatatatatatatatatatatatatgcatgtatatagaatacatatatatatatgcgtatgtatatatgtataaatacatatattacacacatatttataatttaaagcacttaacattttaacattttatgtacatatatgttaccaaaatatatattaacactaaagtaaatgtacgtacatatataaatatatatatatatatatacatgcatgtatagtacaatccatttgctcgctagctatagctacgacttcgtcgcctgcgttacgtcagaagaggaaggaccgacgttacaaattgtcgatccgtcgtagtagaattcaccatcgggattaaggacttcttcgttgatgaaccccatcagttgttcttgaacagccgtgataaaatccttgtgtgggagtttttccctcatgtgaatacgctatcattcgaaaaataatgacatatcaatatatgaaattaataaacaacttaacaaatcaatacgcaatgaaattttgaatggtttatgtatacatacatcgagctctcgtttggtgtatatttggtttgataggcagtgggcatactcgcgtacgtagtagcgcataagttagttcccttgtcctgctttgcacactacatgagaaacgatgagagatttaatatactctttatattaactgtaactagagattcaattcaatataattttggatcatgcatgtactcactggaaaatgaaacctctgtccaagtttttctttccaagtcccgcggaccaattgacggaactgatcccaagccctacatgtgcagttgcaagctatgattaattaaatattacccaacatcaacataatagcaacagagtcccgcgactttggaatagatggcattatattacctgtctatcagttggaagaccttgtcaaaaaccttctcctctttattcattgagtcgtacacagtgactctgcatgcggccaagtcaaaaaagaacaggacccagtggaaactggaatatgcgtgagataagataaatatcagaatgtatatgttatatgtatgggaatgaaatttgttcgaacgacaataaaaattcactctgtgttgtacggcaatagtatgaacgtcttgtaatgctgctgtgttaggagatggacgagattgtcctctgtatctttctcgtacttgtcgagcatttcggtgttgattttccgagggtcgatgaacccagtatcgtaaaccccccgccgtcgggccctttgaatctccattctacaacaatgaaaggaaattattattgcttacatatatgccaggagctaattatttgtaacaccctaaaattcgaccaataaaaattaaattctaaaaatgcggaccttcgaaaactttataaataaattgcatcatgccgattttgttcaatgattttattggattttgatctcggagttcatcgattacaaatagaggaaaaattaattaggaattaaccctgaaattaggttggttaaagaaataaataaattataatttaaaataaagattaggtgtggattgaaataaataaaatattaccacgaccatatttgtatcaattaaatttaaatgcgatggaataagaattaaccctaattaaaaattcaaataaattatataaataaaatatgggtaatattagtctagggtgaattcattagttaagataacacaaatattgagtaaaatccatatatgcaaaaaattaggaatggtggaatcaaatttataaaagaaatagactaaaatgagaaaaataggaaaatgcactgttcatttcactctaggtgctcgacgtggtccccctaacccagccccctcctctgccgtcgtcatcaccgtcgccgtcacgccgcgtaccgtcgtgtccccgtgcatcgcatttcctagccctagcccctcctctgccaagctgcctcgcgccccgcgcgccgcgcgctgcctcgcctcccctctgccgtcgccgacgcgtcttgccgccaccgctgcgccgcgcaccatcgccatcgccgctgccgcgccacgccgccgtcgcatcgcctcgcgccgcgcgctcaccgccccgcgccccgtgccctgtcacgcgtcgccgtgccgctgtcccgtcgccgtcgtgtcgccgtcccgcgcctcgcgccgcgagccgccgcgcgccgtcgctgcctgtcgcgtcgccgttgtcaccgtcgccgtcgacgtcccgtcgccacgcgcgcgtcccatcgccgccacgtgccccgcgccccgccacgccgctctcccgccgcgtcgccgcccgtcgcgtcgccgctgtcgccgtcgacgtccagtcgccgcgcgcgcgtcccatcgccgcctcgcgccacgcgccgccgtgccgccgtcgcgtccccgccacatctctcttccctctcccctt

SEQ ID NO: 6110 - DNA, 6453 bp, Oryza sativa
ccgtcgttgtgccgccgcgccgccgccgcaaagccaatgcgccgtgccgcgacttgcgctgccgtcgccatcgtcgccgccgccgccgctggtgagccgtcttcacccccctctcgcgtccaccgccgtcaccgcccgggtgagcaagagccgggagagagagagagatagaaagaagccgagagggaggagagaaagagaaaagaaaggaaagggagaaaaagaatagaaaggaaaaagagaaaaagaaaagaaaagaaaagaggaaaaaaaacaaaagaaagaaaaggaaaaataaaaaaaaaggaatttgaaggaggttaaggaagtttagaaaatttaaataaatagaatttaattatagattaattatagtcgtagaattgcaaaacttaatatagttatagattatatttggtaatctctataagtaatcaattcacggtagaaattcggatttaattactagtaattttagccgtgtattatatttagtcgtttagtcatagactaaattaaatcgtacaatattatataattcgaggatttcgtccgatacttagccgcgatagaaatttttaacctattacatgcatataatattcgggttgattaaattaaagacttgtgctaataaaatatttatacccacgaaatagtttaggatggataaattaagatcagattagctctattccacaaacaaaaatagataatgtaagaaaccgacttccgcactcgatgtcttcttgaatttacttggatctttatttgaattctaaccggattcaaatcgtttcctcgcacgtaattttagagcccgagggagttgcggatccgagcaaggatcaagacccgcaggactacgagcaaggcaagtcatcattattccttgaacatgttgatcccaattgcgaaattgttttgcttacaaataaaattgcatgcaatgatgaacatcctacttgcgattatgccatgccttgattattgtttaccccttattccttcgtaaacatgtttacgtatgagtccctagtcaactatgacaaatgcttagaaatgctattctagaatcatgcatactcatatttatcaaatgctatatgcttgggcaattgcctttgggaaggtaattgagatgcggcatgtggagacatgagcaccacattgccatgatattgatgacatgatttgcgaaaggagaaataaaactaaacaactgttttcgactggggcggacggaggatttgggtggtatatggaaaaggctagtaccgtccccggtcaattaagcaccgagccatgaagttaagcatgaaacgacccccgcacaaccgcacttctcgtatgggtatagacctagcggagtagatagccgagcggaggcagtatccctgcatagatggttcacccctaagcgaggcaggtgcgctatggtgggacagccgttgaggtagggccgagaggcgtgccctacatcagtgtcgccattgtttggactgccatgagtgtgtgtgagagagaacttaacttgaaccataatttaatatgtgtgtgagacttctctttcctgggagagccagaactcctctcactgctagaaacatggaggcctagagtgcgtgaggatttaggttcatggagcgggtactgccaatgcaaggttatcgaaaagctttgccgtgacgagtctcatgtgttgggacgaggctcatgtgttgggcagtcgcggagtgcaggtaaagtgtacatccactgcagtgtgagtaaaccaaatctattcgaatagccgtgctcgcggttattgagcaccgggacatgtattacacttggctagactctaaattcttaacttgtatgggatgggatattgcataatgatttctatactgatggaggcacttcctgagaggcgggaaggtggacgtcctcagaaaactatgacgattcaatggcgggaagctatccttgggatcacaatggatggtggacagaaccgtcgttgtctaatgcgaacactagtattaaaatttgatcaatgcatgctaggtcttaggcttgtgaaaagaattacaaaacttgctttgtgcaaaagaaccatagccattccttgaataccctttatcatgtgcattgttgctgtggtggcttgctgggtacggttgatactcacccttgcaacatacaaacttaatcagaggtcggagatgaagcttcagaggacccctacgcttactaccaggagggtgatgaagacgatggcactcagtaggtcttagttacggtcgttgcctgtggcaatggcgtgccgctgccttaactccgctgccctatctacttctgtttttgggatgtattccagactgctcggtccgatgatttaaaactatgcctgcgggcttatgatgtaataattcgtactagacactcgtgtatgtgtatttggtatttcagctatgaattcgtgtgtaccagactacttgatccagcgaaatggtactgtttacatgattgattcctgttataaaaacgggggtccacattattgaacgaaacaaatcgaactcaaagatacttacaaaatccatgcgctcagaagagagacgtcgagggcgtcccgatggtacagatcgaagacatccttgaaatggatccatagaacatcttctccttgcaagaagtcggggtttctgatcttcgctccgaacatctctctaccattggcgcttatttctatgtaccattcatggaatttgtacatttgtgtcggtagggactgcagctgctcaggcctgacaagcggtttaccgagttcaaacttgtatgccacttccgccttcgggattggtgcacctccaaccaactgagccatggttagaccggtgtccgaaatgaaatccgttatgccaaagtcttcgccggtcaccaacggctcgaccacttggtgtggttgttctccaagctgaggaactggtttggatttcctgtaataggctttcctaagtgttcggtcatagtccgattgctttaaggcctccttgtttgcggtggacattcccttgaagaaattcttcacgctcgggtcgataggtatcttcttttcaggactccgaggcttgagttgcctcttcacttctcctgccacataagcgtcaagctcctcttgactgcaaccgtacggcggctccttgtttttggtggtgtcaactttggccttcttcgttgcccttgtgctggcaggaggtggagcttggcgagaccttgtcttgggaggtgcaggcggacacggtggaggaggaggcggaggagccggaggagatggtgcaggaggaggtggcggaggagccagaggagatggtgcaggaggagatgtctaccgtcattattgctttccttccgagagtcccctttccctgtagtctcccttcatggcgtgattcaggtaccccgattgggcgaaggtcttcaataaattctacgtagaattcaatgacctcctctgttccataccccttggcgatgcttgcctctggacgagcacggttacgaacatacttcttcagaacgcccatgtacctctcgaaaggaaacatgttgtgtaggaacacaggcccgagaataccgatctcgttcactaggtgacaaagcagatgcgtcattatattgaaaaatgaaggtggaaatatcaactcaaagctgacaagacattgcaccacatcattctgaagggcttctaacctatccggatcgatgaccttctgcgaaattgcgttcatgaaagaacatagcttttttattgttgcccggacattgtctgggaggataccccttattataactggtagcagctgtgtcatcaacacgtgatagtcatgagactttaggtttgtgaatttcttctccttcatccttattattcgctttatattcgtggagtatccagacggtaccttgatgccctccaagcattgaaacatactttccttctctgccttgccaagagtgtagctggctggactcaagtaatggcttcctttctcctctggttccgggtgaaggtcgccgcgttgttccatatgcttcagattattacgtgcttccagtgtatctttcgactttccatatacacctaggaagccaagaaggtttacgcaaaggttcttagtgaggtgcatcacgtcgattgcgtggcggatgtccaagaattcccagttgggtaactcccaaaatatggagttttttttccacatcgccgcgtgaccatcttcgctttctataggctggctgccaggcccctttccaaacactactttaagatctttaaccatagcaaacactgttttcccgctgcgatgtttaggcttcgtacggtggtccaccgtatgttcaaaatgcttgcctttcttctgtaccgggtggtttgctgcaaggaattgacgatgacccatgtacacaaccttcctacagtgcataagatacgtacttgctgtttcatccatacagtgcgtgcaagctttgtaccccttgttggactgcccggataggttgctaagtgcaggccaatcgttgatggttacgaacagcaacgctcgtaggttaaacttctactgtttgtcctcgtcccacatggggacacattccgtcttccacaacaatttaaaatcttcgaccagtggtcttaggtacacatcgatgttgttaccaggttgcttggggccttgaataataatcggcatcattatgtacttcctcttcatgcatagccaaggggggaggttgtagatacacatcgtaacaggccaagtgctatggccgctgcttatctctccaaaaggattcatgccatccgtacttaaaccaaaccgtatgtttcgtgcgtcctttccaaagtctttaaattttctatcgatgtttcgccactacgaaccatctgcggggtgtctcagcatcccgtcctgttgacgttcttcagcgtgccaacgcatcattctagcattccccttattcctgaacaaacgccttagccgtggtattatagggaaataccacatcaccttagcaggaattctcttcttcgttagctgcccgtcaacctcacctggatcatctcctctaatcttgtatcgtagtgctttacaaacagggcatgcttctaggctatcgtactcctcaccgtgatataggatgcaatcatttggacatgcgtgaatcttctgaacttccagtcctagagggcagactatcttcttagcctcgtacgttgtctcgggcaatttgtttccctccggaagaatgttcttgacgagtttcaataaatcgccaatgccttgtcactaataccattttttgccttccattgcaagaactccagagtggtatccaacttgttgtgcccctgctcgcaacctgggtacaatgacgttctgtggtcctctaacatcttgtccaatttatgggcccccttttcactttcgcagtcctttttgttatcttgcaacatctgaccaagatcatccgcaacgtcgttataatcagcatctatgtcctcctcgcctgtttgatttccttcaaatccagcgtactgagcaaagtctggaatattgtcgtcttccacttcatcttcttccatttcaaccccttgctctccgtgggatgtccaacaattatagcttggcatgaaccccgactcaaacaagtgaaaatgaatagtcctggatgcagaatactccttctgattcttacacttattgcatggacaacaaataagacccttctgcttgttagcttcggccactcttaaaaaaataatgcacgccgtcaataaactctttggaccaccggtcagcgtacatctattgccgatccatctacatgaaatgaaaaaaaatcgtacacaaataatcattcgtacaataatgacagtcatacaataatgataaaataatcacaaactctttcaataatcatacaataatgacatatcattattcatacaaaaattataaaatattccaccaaataattcttatttattattttttaagttttaaattcttttaattttcaatttagtttgatttcttttatttaaaattaactttcactatattttcctactcaactattttataaaaccttatttagcaaataaacaaaatttgtatatattctttcttttccacacaaattttctctctcatcaacttacaacaaaattttggaggcaaaaaagtgtgcaaaacatagctccaaatgtaatatgaccaaaaaaaacattggaggataaagttgctaaccttttaggcacctccgatttgtatataatcaccaaagtaaattcactataaattttggcatgacctcccctcttttttgaagaaattttgaagcttgctcgggctggaggaggaagaagatatatataaaggggtgggactttagtcccggttg

SEQ ID NO: 6111 - DNA, 9528 bp, Oryza sativa
  unsure (1)..(9528): unsure at all n locations
tctttagtaccggttggtaacaccaaccgggactaaagattccgggggggcctgacaagccctgacagcatttgaaccaggactaaagataatttttagtgccggttggtattaccaaccgggactaaagatcagatatgcccgttaccctttttaaccgggactaaagatcaggtttttgtttcaaccgggactatcgtggaattcggtcgaccgacgaaagatggtttctccagcagtgcttgctcaatgtgccagcatgtgacggcagctggttaatgttgttaactaacatgcgccaaaagctacaagtctgttaaatttccaaggttattcccagatcgaactcggcccaatcagctcgcagcttcaagaatacagtacatgaaaaagaaatgatgatttggcagagtgccaccaaatgtagtttcgtcctactatatatggcaacttttctgttaaatttccaaggatcccagatcgaagtcggcccaatcagctggcaacttcaagaatacatgaaaaagaaatgttgatttggcagagtgccaccaaatgtagtttcgttcaactatatatggctacttttcgctgaaaaattaaatgtccatactaattaaagctgctaatattgaatttcttcttcctcagatatatatatttcacatctatagcttgcgattatcaaagtctaagtaatgtaattgttcacgtttaaaactttgctaattacttgttttaattaactaacctttgcatccattcgaaatttcattaatcttacagaaacttttgtcccgggctcccggcacggtaattccttgtgcatacattgataacgctgcaaatacaaagtgagttacactggaaaacaaaagatcgagatggggtcctaaacaatttgctgcagttaaaaatacatgacaatacgctagcatgttaattagtaggaaaaaaaactcttgaggtttattgttgttgccatccctgtgaatgcgaaatacgccagcatgttcattgaggatccagaggattgttgtgagctcgctgccacaggcgagctgcttggcatcggaatcccttgtgcatcggaccgacgcaaacatcagaagacgcacccgtgccatgaagatatgttccagcatgtccgacatagagaagtcctcattgtcccgttctttcaatactggaatcaattccttataccggatccgaaggttttcggtgtagtaatgctgatcctttctctgtatcggtttctcattacccgacttagcgggcaccaaggtgaagctagttctgtcagagagaattatattctggtagaaaagatcacttgcgaattctggcctcgacttgtgggtactatatcctggcctccnnnnnnnnnnnnnnnnnnnnatcattggtttgggctgttcctccttgtctattaggagttgggcgagattcttctttcctccatgcacttaacagaagattgtaattggttgcccttaatttcgttcagagctttgagggcaccttcgtacaggctgcgtagcttaaggcctggtagcatgcttgggcgcaccacgacgaggaacaccatgtaatttgacagcgccttgatctcccgtacatgtcacgacgatgatgcatattcaccactgatcaagaggaagatgtctgtggtgatgtgcaatataaggatggtcctttggaatgcaggtgcgaagtccagagcctcttctagtacccgatgtattgctggttgcggtttcaccaccgacaccgccgctgctggtagttccccttccaatgcaggcgccatgggcagcaccttgtcataaataggtgggtacgctgacttgatacattcccatatacattcgaacaaaaggttcctgacatctgatgaccggtagcataacatatgaaagcccatcgagttgtggtatctgtactccatccaatggtcatccagtgaaactaattccaacattgatttgaatgtcttcgacttccatgtcatgtcacgagtgcactcgtcaaacaagttgtattgcccactgattcctagccacctcctgtagctagttgttggatccttggaaaagaacctcgatggatctagagagaggatggaacggtgaatcatgcgccatttccctaagcacagaagggaatggtgaagacaggagcgtggcctatcatccaagaaggaataggtccatgtcgaggccactgctctgagaagccatttgatatccaggatgacggtgccacccagtacgatatatgtgatcaaaacgtcaggctgctgcggaccttccctgctctgagaccaaaacagcaagaacattgcagatgtgacgaaatgggaggtgaaacagatggcataaccaccccatgtgtggaccttgactgcctgtcacgcccggaaattcactagtaatttccgaactaatttgtgcataaaatcctcgtccaggaatcagccgaggtacacaaaccgacaatttaatataccaatccatcttaataataacgttacatacttacaaagaaaagaaaacagcagcggaattaacggtctagcgatggcttcagctccattcccacaggcagctcaactggggtataagccaaacgtcttctccttctgggtcctttatcttcaactgcggtttgatgattattgcaagaatgagcatatgacatactcaacaagccacacagcaagtatgcaagtgcacaaggataccaaaggatggcataatataggctcatttgcaaaagcagcatttagcaaagatttaagagtagtaaaacagtagagtaattaatcaccacttttaatcaacactgaacagcacacccatgctgctcaggcccaaccaaacctgaacaaccaaccccggtcgtacagatcaaacctccaaactaggaattatccattccaaaccaggagtcaaattaattctcacattattaacattgatgagtagtgtgaaactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaataccctttccacaacacaactcaaaacagtgcaccattcctggatcataatcacccccttataaacaaggcacggactccccagcgacccccgtggacttctcgccacttctcagtctggcgcactataatgaatcaccctatacaaaagataaaaccgttgcccacgctggcttgtggttggcacggttaatgtctcacaacagtagctcgcgaactggtccttaattgtcatgagcacaaccatcaaaaccatatgctcacaacccaccttaaccagattttaattatcaattaattaacatcacacgattaatcatcgtgagctaccattaaatataaccataattaataagaattatataatttagatttaacccctttagttagcttatgtttctaagcatggctaagcaaacatatatatagcatttagctgaaccaatccaatatataaggttcatgctaatcaatttattacccaaggtatcaaggaatagggcattcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcgatcttcaattaaccttcttgatcacttccaacgcactcacgaaccttcgcaacgacggaaacaacaagctaacacgcaaaacgaagaaaaagactaataaaaaccaaataaacaatacatataaagtaaacaaacatgtagatcatgattttagatgaattatgagacttgaacggccttattctgactccaaatgaatttattatgaattttacaagattaaatctaattaaagcccatttaaaaagaattaaataaatttaattcaatttatggacaattttaatatgtagatctttattttagaaaaatttagcaacttgaaccacctgaaacggagctacggttatttagttatgattttccgaagatttaatctattaaaagaaattggaaaagaggaatcatgacgtcatgctgacgtcatcatcgtcggcatgacacgggcgacgacctcgccggcgatagagagatcggccaggctatgcaagggcacctacgcgtagaggacgacgagacgaatccgatggtgctcacctatgcgtccaacgacgaccgacgacggccgacgacgagaggaggcgacggcggcggcttggacctcgccggcggcgagatacggcggtcggcggcgacggggaggaggcggccgggcttccccaccaccgtgcgtatgcaaaggcggcgacagcaagcggcggcgacagcaagcggcggcgacggtggacgcggcggcgcggcgtggccgaaggatggccggcgacggcggcgggttgggcgacgaggcggcggcgctacggagcactagagaccacgggagagggggcaaacgaaagagggcgacgaggtggtcctatttatagccttggattgaagagatcggactcctcccgcaagaaatcgatccgagaaaatcaaaactcggttttggagataaactcgaaaacgagtttgattcggataaaatacccaacgatttgctccgattcttgaggggaaagatagaggaggatgtggggataaaaacccctcaaaaatccagaagaaacggggccggattggagcggatttgagaggagaagggggcggctcgggctcgactaggccggccggccggaggttgaagaagcaaccgacatgtgggtcccacatgtcggtgacccgaggaggagggggtgggcggcgtcggctgggccggcttgggccggttcggccgcgcgaggaagagaagagttgggccgaaatcggcccaacgacttaggggaggatttaaaaacttttccaattaaaataatttgtgaaatgatgtttcatttattaaaaatacttcccttgctcaaacaattcccataaaattctagaaaatagaggaacaagcaaagtatttaataaaattttatctagctcatttttatattgagatttaacaaattaaaattagatcttctcttttaagcttttaaaatcatttctaataattccttttaaacaacaatttataatttaaggattttaaacaagaaaagcacttaacaattataattagaccatttaatgattaatttaatatgtgggtaattactgaaatgctctttgtatgattaaaattaggaattgagctccgaaaaatccgagaatattccagagagtataattaaccatggagaatttaataaaaattaaatccatccatgctttatatttaggaaattttatttcccacatttaacttcacttgtaaactaatgaacatttaatataaattctattaataatttattaaataatttataaatcctaagacgaaaatcagggtgtgacactgccttggtgtacaagatgtcgtacgtgagggagagctccatgtccaccacatcgtacagcatctcattctcattccaggtttcagggcgaacaatctcttgtttgtcgacatcatgctcgtgcaccaaattgtcgatgaaggcgccctgatttttatcttacaccaattatttctatatattcgtggagcttaactttacctataagctattattatgaagatgctattaaaggatttgtaaatttatatttgcttaatatttggtgagaggtggtgttgttagacttgatccttatgtcttcatgaatacttcctaaaggtatttggaagtttgtatgtgtttaggtttgtgtccaactgggtaaagcttaaggtagaattgagttaatatgttttacttatcttttatattcatgagacctattatggaatgcattcaaaatccaaaaacacacaaaggactcatggcacatcagtacattatgcaaatgcaagcactcacgaagttttagctttatcagtaggttggtaaggaaaaggttttaaattattcacaaatttatttatgaaaactagtcataaatttggaaacacatttttattattttaacgaaatcaaaatttgaaaatcgaaatttgggtatgttacaatttctctcatagcaacatactcaccatacaaccaattacttccatgtcctggatagagactcccattttagtgcagtttatctcatgaaatattttcatatttaaaagcctaccaccggatcttccatgggtagctatatcctaacatctgaagcaattatattgccatatgttttagttcattttgtgctaatgttatatatgtgtgtgatggagtcaataaaatattaactttaagaataacacagaaaaaataatatatgctatggattgattgatattttgtgtttgcaggtaaggcatgtaaataggccctgtttgtgcatttgacaaaaaaaattctgggttgtgtgccccatcaagatcttattattctctttcaaaattgtcaatgtatcagtagacaaaccagcagatgtttaggtgttcggttataatctaaatgcctgtaatgcttattttggattgtaacattttttacagcatgtatattgtacattaaatctactgtaatatattgaacagaatttgtatgtgttgcatgtcatgagctcatttcgattctatccatgtccacacgcagcgtagcgcgtgtctcttgctagttagtactgatccataacggctagaatcactacacgatggtctaatttaccaaccgacttttgttggcaaaaggtcagtttagacaacacatcaactgtaggcaaatatgtataacaacgccaacgcactatgtgtcacaccccaatctggtaccgccgaacaacggcacctgactggagcgtgtcgtaggaaaaactgcgcgaaccgcttcctatgagaccgcgatatcggtaccagtccaggatatagcgcttatatccacggggacaataataaatcattgcaatccttaaattaaatagatgacttatttaccttaacttgagttgcaactctcgggaaactgacaatgcaatagatgacacgaaagcagcaatagcagaagcagaggcaactgagaccaacaaactaatacccaacaccacaggcaacagcaaggaaccaggatgaaaccctaatcttcacttcacttgaacttcaccttcggagcaggcaaaactatatatagagatcaagggtgagtacttacgtattcagcaagccaggggaacttaggtggttaatgcaagtttcaagggaaggctgctattttgcaatcggttttttaatacccaaaaaattcgaccaataaaagaaattctaaaaatgcggaccttcgaaaactttataaataaattgcatcatgccgattttgttcgatgattttattagattttgatctcggagttcatagaggaaaaattaattaggaattaaccctgaaattagcttggttaaagaaataaataaattataatttaaaataaagattaggtgtggattgaaataaataaaatattaccacgaccatatttgtatcaattaaatttaaatgcgatggaataagaattaaccctaattaaaaattcaaataaattatataaataaaatatgggtaatattagtctagggtgaattcattagttaagataacacaaatattgagtaaaatccatatatgcaaaaactaggaattgtggaatcaaatttataaaagaaatagactaaaatgagaaaaataggaaaatgcactgttcattgcactctaggtggtcgacgtggtccccctaacccagccccctcctctgccgtcgtcatcaccgtcgccgtcgcgccgcgcaccatcgtgttgccgcgcatctcgttccctagccctagcccctcctctaccaagctacctcgcgccccgtgcgccgcgcgccgctccgcctcccctctgccgtcgccgacgcgtcttgccgccactgtgacaaatgcttagaaatgctattctagaatcatgcatactcatatttatcaaatgctatatgcttgggcaattgcctttgggaaggtaattgagatgcggcatgtggagacatgagcaccacattgccatgatattgatgacatgatttgcgaaaggagaaataaaactaaacaactgttttcgactggggcggacggaggatttgggtggtatatggaaaaggctagtaccgtccccggtcaattaaggaccgagccatgaagttaagcatgaaacgacccccgtacaaccgcacttctcgtatgggtatagacctagtggattagatagccgagcggaggcagtatctctgcatagatggttcacccctgagtgaggcaggtgcgctacggtgggacagccgttgaggtagggccgagaggcgtgccctacatcggtgtcgccattgttaggactgccatgagtgtgtgtgagagagaacttaacttgaaccataatttaatatgtgtgtgagacttctctttcccgggagagccagaactcctctcactgctagaaacatggacgcctagagtgcatgaggatttaggttcatggagcgggtactgccattgcaaggttatcgaaaagctttgccgtgacgagtctcatgtgttgggacgaggctcatgtgttgggcagtcgtggagtgtgggtaaagtgtacatccactgcagtgtgaatatcctcttagcattaccggtaagccgagcaagcgtgatcagcgcttctcaaggatcatgaataaagatccaaattgcactcccatggctacgcatggttcttgaataatgtaaacagaacatccggaataatgaaacatgaataacgtcatgagtttgaatatgggtcgaaacacgaataagtagcataacgtcatagccatacaatcagtaataacaagcaattgaataataattatgcaagtaaagccaaacaaaacaactcagttttgtccatcacataagttcgtcttgtacttgccttaactcattcgatactccgactcaactcctccaacgttggaaccctccacacctgtggagcaaaactacacataaaccactatattcaactaacgatggttacaggggatatttactaaaatcgaaacctataacatataaaccttttaccgatttgtattaaataacctatagctgttccattactgttttatgagtaactcacaaaccgtctaacggaaactagcaaataatacaacttcggacatctagacaaaattgtctacaactttcatgctgagcacaaaaacagataaagcctctgaaaat

SEQ ID NO: 6112 - DNA, 2810 bp, Oryza sativa
aaaaaccggaaacagatcgtcttaaatataaattagaaacaactatagactaaaacggattacctagcagtactaatgtataaggaaaacgaagaatttggaaatattcaccaaattccccaaatttcccttctatcaaatttccccttctttccttccttcctgttcttctctgccttctctccctccttcctgttcgttgcaggccaacagcagcagcagcagaaacgaatatcggcagcaacagcaagccgtgcaccaccagcaaggaagagatcagatcggcaacagcagggttcggcagcagcagggaaattaacagaaacaacagtagctcacccacgaaccggctgcggacgacgacggctgtggcgaccggcgacggctgcaccagcggcggcgccggcgaagagaggaacagcagcggtggcggcagagcgcaggaggtgcggcggctagggctacaggagaatcgctcctgtttcttttttttttcgtttgttttttttttggtttgttatataaagagactaaataagatctaacggctcacatctattcaatcctcgggacttcgttcggactccgattactataaatttatagtctattttgcactactcggcgagctctaggcatccacggttcccgatcgcctatacgaacaatggtttaaaagttgaacttttacgcgtttgctctaatattccgcaagatatattaatttaaaactcggggtattacattcttccccccttcgatcgaattcgccctcaaattcgcccaatcatactctagaacacgggatattacattcctccgtccttcaatcgaattcgccctcgaattcgtccagttatacctcggacaagtatagaaaggaactcataggtaggacttatataactcaccagacgtgaataactctggatacttctcccgcatctgtgactcaagttcccatgtggcctctcgctcggtctggtgcgtccagagaaccttgacatacttgatagttctatgcctgagcaccctctcagattcctctaatattcttacaggatgagactcaaatgtcaaatcttgctcaatggtcatcggctctacggcaacatgatgttcagggtctctcaaatattttctcaacatggaaatatggaatacatcatgtacacctttcatggactctggtaactcaaggcgatacgctaggattccaactctttccactatcgagaatggaccaatatacttagggctgagtttgcctttcgttccaaatctcacaacacctttggttggagatacctttagaagtacttgatcgcccacttcaaactctaattctcgtcttctgacatcggcgtagctcttctgcctactttgagctgcaagcatgtgttgtcgtatttctactatccgttctgtggtctgttgtacccaatcgggtcctaaaatagttctctcccctatggaatcccaacacaatggggatcgacactttcttccataaagtgcctcatatggtgccatttgaatgctagcatggaaactattgttgtaagcaaattctacaagcggcaaatgatcctcccaactgcctttccatgaaaggatacatgatctcaacatatcctctaaagtttgaatagtccgctcagattgaccatcagtctgagggtgaaaagccgtactgaatttcaattgagtatcaaatgcctcttgcacagattcccagaacttagaagaaaacttagcatccctatcataaacaatcgagcgaggcacaccatgtaacctcactacctcgcgtgtatagatcggtgccaagtcactcgcagaataagtggtgcggataggaatgaaatgtgccaccttactcagacgatctacaaccacccagatggcgtcctttgctcatggagttcgaggtagcccaactacgaaatccatagcaatatcatcccaagtccatacaggaacttccaatgattgcaactttccagcaggactcttatgttcagcctttactcgctgacataccccacatgacgccacgtacttggccacatccactttcatcctcttccaccaatagatcttcttcagatcatgatacatcttgttctccccaggatgcacagtatatggtgttcggtgtgcttctcgcaaaatctcttccttgactttagctttttgtggaacacataaacgcccatggaatcgcacagctcccgaggaatccaaagtgaaatctccagtttttccttactttacacgtttcttaacttgttgcagcaaccgatcgtgttgttgggcctctagcactcgttggggtatggcggactcaagaatgactcgtgactcggtacttgccactccaacataacaataggagatatccatccgttcaaaatcagttatcaaacaacccatagttggaggaacgaccttatggcttagagcatctgcaaccacattcgccttacccggtgtgtattgaatgttaagatcatagtctttaatcaactctagccacctcctctgccttaagttcaaatccttctgagtgaagatatatttcagactcttatgatcagtgaaaatatcacaagattctccatacaggtagtgcctccaaattttgagagcaaagaccactgctgcaagctcaagatcatgagtggggtaattctgctcatgcttctttaactgcctagatgcataagctataacattgccctcttgcataagaacacaaccaaggcctactcgtgaagcatcggaatagacagtgaaacgtttaccag

SEQ ID NO: 6113 - DNA, 11733 bp, Oryza sativa
taccccgccatacccaaaaactcctcacatccttaacattagtcggcctttcccatccgacaacagttaaaactttgcttggatcaatcgagataccttgctgattaattacatgccctaggaaagccacttcaggaagccagaactcacacttcttcagtttagcatagaacttgttttctcgtagggtccctagtaccatcctcagatcacgctcatgctcctctacatctttggagtaaatcagaatatcatcaataaacaccaccacgaaattatctagaaaactatgcaacatgctattcatcgcctccataaaataggccggagcattggtcagcccaaaggacattactctatactcataatgcccatacctcgtggaaaatgcagtcttctcaatatcctcttctcgcactcgaatttggttataaccagattgcaagtcaattttagagaacaccttcgctccctttaactgatcaaacaaatcttcaatacgaggcaatgggtacttgttcttgattgtcgcagcatttaaggcccgatagtccacacacatacgccaactttcatccttcttctcagtaaaaataacaggtgcgccccatggcgacacactccatcggattaacttcttagataatagatcatctaattgtttcttcaactcttcttggaaaggacgagctaaccggtacggggctttggagataggttgtgtaccaggaacaagatcaatacggaactctacatcacgctcaggtggcatccctggcaattctgcgggaaaaacatcaggataatctcgcactacaggaacatcttcaatcactaaaggcttggatgacttctcggctaaggcccataataaccccgtctttacagcacgctgcccaggaaataaccttgacatcacgaaaagagaatgcggaggcgcgctcccttggaaaaccatatcctcgcctgatggagcttccaaggtaatagtcttccagaaacaagagattacagcacgatatcggttcaaccaatccatgcccaagatcacatcaaagagcggtaagggaatcacaattagatttgccacaaattcctccccatcaatagagattgcacaacctagacatactactgaactagagattataccccctagagagctgacttggacagatcgagagacctcttgactaaatagattagctctttttgcaaactcgattgaaacaaaagaaaatgtagcaccagaatcaaacagaactagggcatcatgcgaatcaacttaaagtgtacctgtaacgacatccgggcgaccaagggatgaagctgcaggcatgttgtagactccagccatagctggggtagtagaggctgagacctgctggtgaggtggagctgaagcagaaggatgcgccataggcggtgcaggcaactggagtggagcacgtggagcaaaagattgaggcatgggccaatactgtcctggtaatggtggtggtgggtaattatgtgtgaactgctggtaaggaagtggataagttgtcatcatctgaacggcaccacggggagtactagtggatgaacctgaacctcgaggatagctagctgtcgaagaggttgctgaataggagctcggcttttgccacttgatgatagaatttgggttacgcttacataccaactccatgtgtccagctttgccacacccacgacatgccctagtaaacccacactctgctgaatggtgattctttccacacttaaagcaaattagcccttgccctggaacagggcgaatcaactgagactccgttggacgtgaagctgcattaggctgagaaccccactgcctaggtttagatgatggttgagtgacctgattttgtttgtacttcttgaaaggtggtcgctgtgagttctcacccccttcctaatgagctctcttctgctcattaccagtgacattgccagaacgattcttctgcgcagtagtaatttggagctcaacctccatccctcgagcctcctcaactgcattgaggtatatagtaggcgggtttcttcccatcacttctctataccgagcattgagccctcgaaagaacttcctagccttctcacgctcatcacttgccacgctaggcacaaagcgtacaatactgctgaactcccgttcatactcatcaacagtcttgcttccctgttggatattgtttaactcatcactcatcttgtccctaaatgattctggataatacttagctctgaactgctgaagaaaaacttcccaagtaatagcaccacgatcagggttccacgcttcaacaactccatcccaccaaatgtccgcctaaccagtcaactgaaaaggcatgaaagtaaccttctcctcaggagtcattctagatcccctcatatacttctccatcttgcataaccagtctgcagcattaacgggagtaccagacccatcaaatgtgtctaagcgcatggatgtccatctagtgagtgtcatcccccgagcagctcgaggagcatcatcagagacagcagctgagtggctaccaccctccacctcttccatgtgctcatcctccatctggttcgaggatgctgcctcattatggagacctctaccacgacctcttccacggcctccagcacggcccctaccacgacctccacgattaggaataggggattcagcaaccgagttgttcccaacctctttattatcctgagtattttcaacttcttcattatggtggcccctaccacgacctctacctccgcctctcccgcgccctctgttagccaaccgaacactcactctaggcggcatacctatatcaaacacaagcatttacacgtcattagtttaacaataggttagacaatggcatgcaaggaaacacaatcatacacatatatatgcagcagaaacataaatgctaggaatgacccatgctcccattcctattgtgcaccagtgtgtcaagtttttttagatgtttatatataacccaagttctactcttattatttcctaccctaagagaaaatatatttttttaattggttaggaactctagttcaaaattttatgttgatttatatatctcattacccagtcacttcccatggacctaccgcccgctctgataccaactgtaacaccccaggtaaccacgtacctagaatgccacaccaaattacactcaaaaactaagtcctaaaattattagaaatttcggcagagtctcccctaaaaatacggacatcacgacaggcagttataagaaaggtcaataccgatataaaccacacaatccaaaccattctagctccacaaatcccacgtgaaaaataaggatcagaaccataaatgacctttacaagttctatgcaaaacttatgctgagcaaaaattatagtctaaaactaatttcaattgtgcgcaataataatgtgtagtccaagggtgctactcccgccccgtgccgatcgatgtcattaggtacctaaaaaccaaattaaacacaagagtgagtaaagaatactcagcaagtacaatcttgaactagtaaaacatacgcatgatttatgcattaagaaaccaacatgaagggttggatttactttatttttaaaccaaagaagtcaaaagatagtagttccctcccgggcaggtgtgaatatcctcttagcattaccggtaagccgagcaagcgtgatcagcgcttctcaaggatcatgaataaagatctaaattgcactcccatggctacgcatggttcttgaataatgtaaacagaacatccggaataatgaaacatgaataacgtcatgactttgaatatgggtcgaaacacgaataagtagcataacgtcatagccatacaatcagtaataacaagcaattgaataataattatgcaagtaaagccaaacaaaacaactcagttttgtccatcacataagtccgtcttgtacttgccttaactcattcgatactccgactcaactcctccaacgttggaaccctccacacctgtggagcaaaactacgcataaaccactatattcaactaacgatggttacaagggatatttactaaaatcaaaacctagaacatataaaccttttaccgatttgtattaaataacctatagctgttccattactgttttatgagtaactcacaaaccgtctaacggaaactagcaaataatacaacttcggacatctagacaaaattgtctacaactttcatgttgagcacaaaaacagattatgcctctgaaaatcccagattaaggaaaaatgaactgctgtcctgatttcaggacccggtcagcagtactgtttttgctgtttctcctaaaccgtttaccggaatcgagtgaaactagcaccgttggaaagatattgacaatgactacaaactttatttaggacaactaacctgattcctgatggtttaataccaaatttgaaaatacggtttctgcctagcgttcgatataaaataaattcgaaaaaaccggaaacagatcgtcttaaatataaattagaaacaactatagactaaaacggattacctagcagtactaatgtataaggaaaatgaagaatttggaaatattcaccaaattccccaaatttcccttcttctatcaaatttccccttctttccttccttcctgttcttctctgccttctctccctccttcctgttcgttgcaggccaacagcagcagcagcagaaacgaatatcggcagcaacagcaagccgtgcaccaccagcaaggaagagatcagatcggcaacagcagggttcggcagcagcagggaaattaacagaaacaacagtagctcaccaacgaccggctgcggacgacgacagctgtggcgaccggcgacggctgcaccagcggcggcgcaggcgaagagaggaacagcagcggcggcggcaaagcgcaggaggtgcggcggctagggctacaggagaatcgctcctgtttctttttttttcgtttgtttttttttggttggttatataaagagactaaataagatctaacggctcacatctattcaatcctcgggacttcgttcggactccgatgactataaatttatagtctatattgcactactcggcgagctctacgcatccacggttcccgatcgcttatacgaacaatggtttaaaagttgaacttttgcgcgtttgctctaatatttcgcgagatatattaatttaaaactcggggtattacattcttccccccttcgattgaattcgccctatcatgctctagaacacgggatattacagctatcaacccctcaacggagtattcctatctcttgtgtttgagtgcagtaccgaaacctctccaagatggaggtagtttcgcaataatgcacccggccacaaatttgtcgggtaagacacacttaaggagttcgagttccttagtcatggtttgtatttcatgagcctgttcgactacagaacggttgtcagccatattgtagtcatgaaactgctccatgatatacagatcattgctagcatcagtagcaccgaatttagtattttgtgcatcccatgactccttagcgtcggtcatatgcatatacacctcgaccagacgatcgccaagcatgctaagaatgcatcccacaaagagagtagtggcctcatcgaattctttctgctgatcagcattaagaacgcccataggcttgtcagtactcacccagaagcatttcatagctgtcagccacagagtgaccttgatctgccatctcttaaagtgcacaccggtaaatttatccggccccagtgcatcggcaaaaccagccatagtaaaatcgcagcgcctataataagcagtaaaacatgaacagatcaaatatgcgcaacatgtcgaacacgtaccgaggtggcggaaagaccggttgctcggcaggaactactcgcggttgcgagcgtcgacgaaggcgcgcagcatgcgagcggagaggaaggcgagccgtcgcggacgaacagggagcagttgcgcgaagcgcttcccaaaaaccttattgccgccttctcccggtgcaggatgtcgaaggcagaggttccggagacctgctctcccgatcgccggtgcatactggcgagcgggatggagtagtctacgagcgacggtgcaacacagaggaggaggcaaaccctagattgatttcgcatgtgttgcgtgaaggcggcggctcggtttatatagagataggtcgcttgatcagggcgcccgcacgatctccacttcgcgtaaccgaaccggataaatcgcgcgtaacttatccggactccacgccgttttcacgcaccggatttttcggaatgtttcctacggtttatatagagataggtcgcttgatcagggcgcccgcacgatctccacttcgcgtaaccgaaccggataaatcgcgcgtaacttatccggactccacgccgttttcacgcaccggatttttcggaatgtttcctacaacttatccggactccaggccaggcgaggcgagcgagcgcgcgcgtgtgttccccctcttctctccaccacacatgcttcaagtggctaggagggcatcctcccttttaaggaggtccctctctcctagaataagtaaggtggtactaaactccacatgcatgccatcccatgaggtgggcttttgtgattttccaaagaattaatcttcgagtgggctaaggcccgtccattaattccaacacatcatggggacgatgcggaggatgagagtttgggactgcattctgatggagatgattatcatcgctgtcctcaacaacctctctgccaaggtccagcttctatggataaggtttgttatgttcaccttgacaaccggaatcatcatgttgctcgtgttccattagataaagggctttgtaagatgaaaatctccaggtcttctttctcaggttctcgtgattctaaggattgtctgcaatgggagatgtgttgtgataagatctttaatagtcacaactttcggaggatgagcaggtacgtgatgcacccattgaattcatatattatgctttgtcttggtggaatccattagtatgtgttggtcgtccacatacttggcaatatataaaagaggttatggcttgccattttgttcctgaacattgtactatatcattgtattcacgcttgtagcaactcaaacaaggtgattttagagtggatgcttattataaggagatggaagttaatgagccgtgttttggtaacagagaatgatgaagctattatttattgatggtctcaatgatgatgtgagagatcatgttgagatatcatattatcatataaagagtacgatgcaagcagcaactaaaaagttgtcacactagccattcccgttattttcagtgagacagtgatggatgtgttggtggtaagtcggtctatttcaagctgactactccatctagggatgtatctaaacctgctgctatttcgatgagtaaatccacatctaaaattgaatctactactgcatttggttctaaatcgcgatgtgtgaagtgttatgcttgtgggagaacaggacactatatgagaggttgtcctaatctgaaaagggtgttgatgacttcagaaggttatatttttgagagtatattagaaaattcagaaaagggaatagcttgatcatactctaactacagtatattgatatattgatgatttatcaacggatgatggtattgaacagaagaatggtttatctatggttgcacgtgcaatacaatgagatagctcttacattgatgcaaagggcaacactgcaatatttttcagtcagagtgcaaaattcagcagaagatatgtaaattaataattgatggtggtagttttactaatgctatcagtttagatttagtgcataatttctctttgtctacgtggaggcttccaatgccgcgttataatcaatgtacgaatcaagagggcacacttaaacttactcataagttaagaactacattttctatcggaaactatgttgattaagtagaggaagaccgtgcagtttgatcataatgcagcactcgagggccgaagtaatcactattcttctatgcatcgttgtgttaaacatctgccgaaaccgttacatgatagttctatcaagttagtagtatttcctatcgtaaagaagaagaacttcttttgaaaagaagaagaaagaactatctcaaattaatctaaagccaaggatggatttgttccaagggagggaggataacgtgagcaagaaaaaactaatatgtttcgttggtgttttacccgtcgtcgtgcatcaaagcatggaacatggtcaaacttcgagaactgtggaacagaacccagtaaaaagcaaaccatgtaggctactaagtatatatgtgtcggttaatttattcttgttgagttagcttagcctggtttcgagttaactagccaagggtcattagtaaggttattagcgactagattatcaaagtaattagtatattttatttttttatttgttgagtccgaaaaagacttcatctgagcctgcctgatccctttattagggttgattgactgtgtaacagaagggttcttttggtgtcattctgttgagagttctccaggaaagctgatggtgatcccatatacgaattgagattattgccgttgccgtgaaggtgcgagaagaagctatatttccttgatcttgttacttggtaaatgttagtgccctctcttctgatcatgttagaaagcacgggtagaagattattttatctaggatttgatgttcaactattgtaagcgtagctctcgattatttgatttgtttgctgctgaattctatttatatagacaagtctgatttaattcgttgagttaatgatttcacgctgcctgacaattttaaaaagttaacttgtttatttgttattggtaccacggaagagggacatattcgggtactcgctgtcggtgctcatcatctatgttctttgcaactgtaaacaaatatgggcatgcatagaatctagtaggtaaagaagtcgtatatataaaaagtgctagaccaataaggtgagtatactgatagttggattaacccagttagaaggaaaagaatgtgtgttgctaatttattgacattggtccccatgctggtggttataaaatttttggccatcccctttgttaatgggtatgttcaatcttctaatacaatgcatgcacctagggatttgaattatatcttatgcttgatcatctacgaagaggctcttgcaaacattgaacaggtaatgaatgcccaacagaacattccctagatctgcgtgcagcttctcttttctgtcctgctcaagataacgatggcgagcacttgagcgctcaaacatgaggacgatggcctcgaccaaggtagagaacacaagcagcaccctgaacttgcataatgaaagttagcaggtggcacaaccagagcctattgtcctcctaggaataatctgtggtgttgtctgggccacccaggtgaagcaataggaatgttgtccaggatgcaatcagctggtgctcacctgagctgctgctcgtggtgatggatagccggccaagcatgcagattgcagtggagcagcagatacatagcaaagccagaggaggatccttcgcagtgtgtaacctttgcgccgacggatccatgacaagcggaggacgataacttgtagagcacagcctaggatgactagtatttggatatgccactctttccaaagctagctagctctgcagccatcgcacctcggcttaactgcaaacaacatcacattaatgaaatactgaatctagaaccggccagccttgcatcattagctaaaatgctcgtttttttttgtggagctaaaacacttgttgttccctgaaaggaaagaggaacattctagtagcaattttttttaaatcaaatcaaaataaagttttgtgagctctgagcgatgtttgaaaagagaatccaagcgctaaagataaatatttccttaaaatttgaaaactttgtcaatccataatttattaaaaattttctattaataaataaaaaggatagaatctaagttgaaaaatactgtcataatgttataagtttgttataatacaaatttaactatcaaagatttaaaagctaaatattttttggctggatatataaagtactccctccatttttatattgtaagatgtttttgttatgtcctaaatcatacttagggtaattgactaagtatatagtaaaatacaataacatctaaaccattaaattaggttaattaaaatccataattgaatatgttttgataatatatttattgggtattatagaggtcatccttatgtataatatatttttctcaaaatttcagttaagttcagagttgacttaaaacatactgtaactaccttatcgtgttatcaatatatttttagaaggtgtcgctctaaagtgttactaaatgacaacatatgtccaacgaaatatatatacagcagcttgcacgagagctggtaaagtggaaaccacacacccagtggcgcgccttcgggcgatcggcttgctaaagaacaccactggtctgctaccttcctggagcacagggcccatgtatgttctcgaagtcgctctcgacgatgaagtccatgttgaagtctggtagttgaagcactagggtggtcatttgggctagctgtagtgcatggaacgcagttccgccgcctcttcctagctgaagacctccttgcggagtagtgttgtgagttgcgtggcgatggagccaaagttgcggatgaagtgacggtagtagcctacaagccctaggaagccacgcaccgcccacgccatcttggggattagccaatcctagaaggcctggattttctggtggtccatcggcacacggagcttgagatgacatggccaaggcaggcaatggtggtgaggccgattttgcacttggagcgtgcgaggtgggaatgacgatcctgcagggtttggaccatgtcgagttgtagattaggatgtcataaaaaaccaacatgaaccgtcgaaggaacagaaggagtatgttgttcatgagcgtctggatggtggcagaggcattggtgcggctgaacgccatgaccaagaactcgaagagacccagatgcatgcaaaacatcattttgtggacattgtcggggtgcacgaccacctggtggtagccgaagcgcatgcatgttgagcttggtgaagaattttgtgctgcgcagttcatcgaaaagttcttgcgccatcgggatcaggaacttgtccttgatcatcttgtcgttcggcatgtggtagtcgacgcgaaatcaccatgaactatcacacttcttgatcatcatggccagcaaagagaactccgacgcacttggacggatcacaccttggaggagcatctcgttgcattgacgctccaaatcgtccttttggatgtgggtgtactggtacgggtgcacgacgacggcgaactccatgtgctctaggcggatgctgtggcacatgtgttgttctgatgttaggccttgtggttaggcaaagatgttgatgaagtcattgagtagtttgtt

SEQ ID NO: 6114 - DNA, 1927 bp, Oryza sativa
tgccgatgtgggcagaggacgatgtgtcggctggcgcgatcgccataggcacagccacaggcgccgcagggagtgcaagcgtggtggccggcccgcccgtgtgggaatgggataagtgtggacgcattgttcgtaggcccaggctagcatgatggcgtaatccagggagcgaaaccgacagagcgcgacatctatcttgagcgggttcacaaggcctgccatgaaaagttgaacgtgttgattctccgagagcgtagcgtcgcggtacaccagcgcaaggaagctattgatgtaatcctccaccatgccaatgcgctacaacgccatgagttcgctaaggggggcatctatcattgctgggccaaaacgggtgtgcaccaattggacaaatcgccgccaggatggggcgccggagttgagctcaagcctgtaataccacaactaggcatccccgattagatacaacaacacgtatcaaaccttgcgattctctagtgtttgttggccgcggaagaacctgtcgcagcggttgagccacgggagcgaatgacccttgccgtcgtacgtcgggaattccaatttggtgtggggcaggaagttgttgtcgatagcggtgtcaccatcagcaccggtgggatgtgccaggaaggtataactgtggaagtgcgtgtcattgtccccgggcggtgggcagccatcttgcaccatgtgcgacgccgagccagaggaggcgttcgtttggggaagtggcacgcgttgggaggcctctatgtgctcgatggcgaggttgagggcacacacttgctccgaatactctaactcattatctctgtgctaccccttctgttattgccgatctaaaaatcgacaaacatactcctcctggacctcctcgatgcattctggctcatagactcatcatgctggagataaagacggtaatgttcaatcaccaacatgatagctaagctcttattttcataagtaaacacaaaccctgatgtcgtggacccagtgcacgactcagaaaggcgataagatggtcgttttgcatcagcacagccgcaatatctttatgggatgcatctgtctcaaccacaaacaactgagaaagataaggcttagggcatagctattacaggagctggaatgagttcctgttttagggcttgaaaggcctctgccactactaaaataaaatgctttttaaacaaaattattttacccctttttagatgatgaaaagattataaatattttttttgcgggaaaaaagattataaataattaaagtctataaggatgaattaagtacgatatactatgttagaaaattatagaaacaatactgataaaaaataattgtggacaaatacttttgaagtgtggtaggtgttgtctcgttaatacaccatatttataaatgtcaaaaactcatcctacaatatgatacccaaaagacccgcataaatgtatcgacgagactacgggtcgggtgcctcataaaattgaaaaagttgagcgcccttctccgtgctgcaatatctatttggtgtagccgtctctgcatgcttgcatgctgcactccttgttctctcctctcactctctctctctcctgtcttctctctcatgcgtaggtttgacgcacatccatgcaatctcttttatcaatttttaaatgatatttctcctaaattattgatctaatttacaatccgattataccattatatttattgtaattaaatccttataacaatatcccgcatgatcatattatgagtaaaaatgattatatttttaagtaaaatacttttatatactatataaaacatcgaggtgcgatggttgaaacattacgtaatatttactgaaacattcatataatacaatgtgcaacattttcaaatgaatcaataaaacat

SEQ ID NO: 6115 - DNA, 1733 bp, Oryza sativa
gctaggtgtgatacttctagagcaaatggttgggcgcaacaagcagaggttataatgtaaaaagggggttatttctgatattagaagagccggtgcttgattttaaatttttgtgcgaaattggcaaagttggggaccagaggcggtctgaccggcgttgcacggccggtctgaccggtgaccaggggcggtctgaccggccgcatgccgccggtctgaccggcgtccctgagaggtctgatcggccctgtgtggccggtctgaccggttctaggcagggtgctggagggcacgtttcaagtaattttgaggccgaattaattgtgaattcggacgtttgtgcccaagatacagaagaggattggagaattcctttgattcaatatttgaaagatcccacacataaggttgatcgaaagattcgacggcaagcattcaaatatacattgcttgatggagatttatatcgccgaaacatagatggtgtcttgttgaagtgcttagatgaagatcaatctaaagtggctaagggagaagtacatgaaggaatttgtggaactcgtcaatcggaccacaagatgaattggttgcttagaagagcggggttttattggccgaggatgattgatgattgcttcaaatattatagaggatgcgaggcttgtcaacggttcggcaatgttcaattggcgcccgccgccgtattgaaccatataatcaaaccatggccgttccgaggatgggctttggatttcattggtcaaatttatccttcgtcatcaaaagggcataggttcgtgctagtcgctacggattacttcaccaagtgggccgaagccgtgtctttgaagaatatgactcatacggaggtaattgactttattttgaagcatattattcatagattcggtattccgcaaacattaactacggaccaaggtgcttcttttatgtctaaggaagtgaagagttttaccgaatcttatgatattaaattgttgagttcttcttcttactacgctcaggctaatggacaagccgagtcgagtaataagacattgttaaagctagtaaaaaagaagattgaggaacacctgaagaggtggcatgaggtgctttccgaagcgtagtgggcgcataggatatctaaacatggtgccactaaagtcactccttttgagttggtttatggttaagaagccgttttaccggtagaggtgaatcttggttctcttcgttatatcaagcaagatgatttgtcaagtgaagattacaagacattgatgggagacaaccttgatgaagttatcgacaagcgcttgaaggcgttggaagagatagagaaagagaagaagagggtggccaaggcgtacaacaagagggtgaaagcaaaattgtttcaagttggagacttggtttggaagacaattttgcctttgggtactcgatccaaggagttcggtaagtggtctcctagttggaaaggtccttattgagttagtggcattgttcgaggaaacgcatactttttggagacactacaaggggagcgttttcaacgagcaatcaatggaaaatacttgaagaaatacttcccgagtatttggcaagacgcttaggaggtactatggccggtaattggattatcgtcctaagaccaaaaacatgttctatgcttttagattcacgttgttcatcaaaaaggcaggggggcatgtgtttacacccaaatt

SEQ ID NO: 6116 - DNA, 11965 bp, Oryza sativa
aacgccaatgggtaaggcttaaggcaaagagccaacaaaaaccgcagaagagaagactgcattaagatcacaaacttcgtattgaaactaagcagcagaggaggtgcaaatcgacagggagctgcggcaatgccgcgacgatgcaaccttcggtctcctttggcgtgcagactgcttgacaaacctgtaatccccttcagtcgcctccacagaaactgcacaaattggagatttgatgttgagccgtagattttggtgtaggcttcaccgggctcaaccagaattcaccatggagttcgccgttgaatctgaggagcttgagctcaacccgaacaacaaaccctgcatggaagctgctacaaaaagaaactacgagaatgaaggaacccaaatctagccactcaaaggaagttaaaagttcaactaatggcgaaagaactattgtcttcttgggtcaacgggcaaggttggggaagaggagacctgcaaaagagggcttgaggaatatggcttgggagggctatcaaccactgaatcttgaggagatgggtggtggaggttgagctttgggtgtatcagaggtggggtcaacaatgacatcgtcacagcagagggcgacccgagccacaatggcatcgtcacagggggcggcgagctgcaagaacgccgccgccgtcccaatctacccgaaccacaagcggatcaaacctcctccacacgggcctcctctagcttggcctccttctcattctccacgctagtctttgaggtatgcaagagattgaatatccggcagctgtaacgccccgattttcgttcgggattaaaatcatttaataatgcattttctagaatttaaataaaaattaaatcaatttaatcaagtgaattattgaggaaattaaaatttcctttaaaaatcattggctgggaatattttgtaatattctttgtgccctaatatactctctgaaattttccgcgaattttcgcagctcaagaagtaattttaatagcacaaagttcatttaatcaattaaaatataaaaaaaaccaaataaatctctccttcctcccttgggcaattttcagctcaagccctccttctctctcccgcggcccgcgtgcttccttctctcgggtcggcccagctcgctccaccctccaaatctattccccccctctcaaaccggcctctgctcttctcaggacgacaggtgggacccgtgggccccacctgtcatccccaatccccagccatcccaagcccaaccacgccatgccgccataccgcccacgacgccgccgttttcacgacctctcgcttgcgcgctcgcatccaaaccgagagcaaccgcaacccctccacctcctccacactctccccacatttcccccaaaaatcgcaccgggcgagctccatttcacccacaatttcgcccacgtcgccggccgttgccgccccaaaaccgccactcctcgacctccctgttgctccctcgcgccataaagagcctccccgtgctctcctctcgcatttcccgtcttccccgcgccctctcccgctctcccctcgccaagccgagccgccgccgcccgccggagctccccagcatcgcgtcgtcgccgcttccgccgcctctgcgttgcgccaaagtcacctctggcttcaccactccacgccgcacaccggctgccccaccgcctccctacaccatcctcgcagcaccgtttccaccgtgcacccaaggccgccgccgcgttcgttgcctctagccgcgcgactccgcctctccggttgaccccactccgcgccgccgccacctatagcgtcgcagcgcctcaccacagctcagcgtccccctcactcgagctcccatcgccagtgcctcttatgtatgtatttacgctttatttatgtttggatctgtttatcacttgttgtattgtgtaccctggttggttctggacagggatttaatacatataatagtcttgaaatatgggttaaatttctgggcgtgacagcagcgtcagcaggactgctcctcctgccactcctcttcagacttcggatctaacttgtcaacctcgtcctcaaggttcaggccgacgctgacgtcagccgaaacctggccccaaccagcaccgtcaccatcaccaactccggcaaccatgggacctagccggcaaaaacttaacatgggaaaaaccctacttgcaggaagaacctgacaacaaggaactaatctaacaacactatactagtaggtaaaggtggatggacccctcctccaagcttcgccggtggcgaactgccggaatcgaaggtggaagaggggacagaggggaggattttggagatttactgtagcaaggggaaaggggaaaggggagaagatcaaccgttgttcctctcctccaatcctctctctcttcccagaggacacgggacacgaaattgtgtgggcctagagcagtagttttgacgaggaacaagtagcatattttggctttccgtgtttggtgaatcaaccaaatgtgctgaggtggaggggaatctacgagttggccggttgaggctgaatgatacctcagtgcactgtgaatggcctaacagcaaagagagaacatatgcaacatgaaagagagaagcacgctagctagcgcacgctgcacgtgttgttacagagaaaaagagactagagagtagagtaggagagcgttcgagtttttttcaacttgcattggatcagttgaaccgatctgaagtattctcctaagtgcacaggttacttggcaagtttttttttttaaaaaaaaaggcaattacatgataaagtgacaatatgagaatgtgcactcagcactcgatcagcagctcttgtaagaaccaagcatgcgtgcgtgcttgcttacgagatattgtcgaagtgctggtcatgcatggctcattgtattgtgtcccaactcagtcgatcgtgacaagcataacactcaccctgctaccctggaatcagcagtggtgcctcatcacagtcatagcgattgcccgccgccggcgcactggaggcgtcttcctctgtcgttgatgccaaagtagtgttgacgacgatcaagctgttaaggtcaggcaacggtccgtcacgctccaggacatccatagcttgccgcatagaaggtcggtgttgagtctgcaaagcagagcaccagagccccaatacgatgacacgctctatctccctcatatcaaggccaccacccatggttaaccttgtatccgccgcctcgacaacattgccaccgcttcggtataggtcccagatttgctccctgtgcctccttgcacaggcgatctcgagaagggcaatgccgaagctgtacacgtctgagctacgcttgaatgggaccttaccatgtttcagacactgtggatcaaggtacccttccgagcctatggcagttgtcagcaacgtcgcattgtcttggtttgccatcctcgataggccaaagtcggcgagcttggcgttgaaattttcatccaggagtacattgcatggtttgatgtctctatgcaggatatgtgggtcgcactcgtgatgtaggtagagcaggcccgatccaatgtccttggctattttgtacctgtttgatcatagttagatagctacatagattggccataaacattcttagttagttaatttaatgccaacagaaaccatactttcgaagcaacatattgtagttgattttaatgttgtatttgtcgattttttaagacaagccatggtaggattgtaatttatgatttgttaataaatttgttgagtggaagctgcattatttaactttgacaaatcggtgtgtatcctatttggaaaaaaaaagaaaaagatatgattacctaaaaagttttgcatatgatttacctagacattgtaatgttagcaaaaacacacaagataattgataaacgaacaaactgagtacaactccatacatattaatttagaactttaaaaattattatattatgaggcatacttaaatatgagtggttcctaaaatcttgcatgcattaagaagtgttcctctttaataaagaagagggcacgaaaagaaaaaagtcattagcacgtgattaattaaattttaatttctataaaattgaaaaatatatttatcttacattttaaaacaatttctatacatatataatattttcacacgaaacacgtttagtaatatgacaaacgtgctaacagaatgtaaggtgcagtatgtatttgaggaaaagaacaccaatcttaggtggctggtaataagatataagggacctaagtgaacttattcctatacttattacactagaaaaacggtttttacgaacacctctaattgattgcaggtaggctaatagaacttttgtttgtaataagatttggatggtgtctagtaacaattcatcagtgaaaatgaacctatttttcacatacaggtctctagtcaggtctagtaagagatccgtaggtgaaaaccatttcagagcacacgtcctttgccatttttttcttttttaggtcctcctcactcactccctttctccctcggcttctcgtcctactccctccacctccgcctcctctctcagcccctctcctctcctccatctatccctcctaatggccaaagcgaggcgagtagtaggcggatgcagggcaacgccaagattgaagcaccggtgggtgcagggcgtgccgtgataggagaactgggtcggcgtggggtgtgccgcgacgggagcaactggccggcgagggtcaacagcttgtcaagcggatccgtcacctccggccctgtcagggtagatccatcgctgacagcgaagggttggggtggcaagggcggagggcaaccacgaggatgatggagggctcaggggcggtggggtggtgcagtccaccgcagccagatccgacgccgacagcatagaggtgggggcgatggggcgtagggcgaccaggatgacggcggagggttgtgggatggaggggcggtccttcaaagctagatccaccactgccgatggagcggcgggaatgatagggtgccccaaagatcccatgcaggcggcctcgcgatggctggatcccatggctccagcacttggactggttgatccgcgtggcaccaatgatggcatctttggggcagtgttgtatttttcttattactagagatgggatatagggtttgttggaaatgggagctagggtttgtgcattatttttttttttgaaatttattttgccaatttaagttttgcagacgggcagcataatgtactcgcgtgcgaaaatccctttttcgcacacggttgtgtaaaaaagaaaaccttttctgctaacacaagcagttgctttgcccacgtgaaaaaatgtgttcggcacgcgtggaaaaattgtttctctagtagtgttaatttcaaatgtgaaaaataatagtttaaaaagggaacttaaagcaaagacgatttgaaaagatgaaaacaacagaatatatgttaggatgaatatagtatattttctaaaatgcgccgatgtcaccttgtttgccaagaaagtacttctgatgactcgcttttgtacaagtagtcgttgaggttgccgttcgtcatcaattcatagacaaggaagagctcattgttcttcttactccagaaacagctgcacatgaaacggagaatgttccagctgtgtccccgggagcaccaaccaaaaaacttgacgagattcttgtgcttggcttcgctgatagtgcggacttcggcgaagaagtccttgtgtccttcgctggactccctcacaattttcttcacagcaacttgatggtccagcagcttcaggtgtccgctgtacactgccccaaaggcgccctgcccaagcttgcgatcctccgagaaatggtcggtcgcagctgccaaattgcggtattcgaacctcctggcgccgcctgttcccttgtcgaagacatttcgaatccttttctgctcccaacaagagagtaagaaccacaaaactagcgcaaacactagagctcctccaatgatcagttcaaccagcaaccgtgctatattgtgtgtatctgcacatgcaaatcaatagcagtatataaatttcaatcaagctaaacatattggtaagtccaaaatttcagtgctatgtttatgtgcaatttcagttttcatttgatctgcaattctgttattgtctatggttttattttgttttattataagcttgattacaactacatcatcatctaattgtttatcaattgtaaatttatttcatgcttaagttagaataatttatgctcaactttaacctaagaagaatagagtttgtttatgaagagaatgtaggatatgattagagttatttgattttgatccaatggatgagaaaaaactagtgcaattttcaaaattttcattgaacaaaaatgtggataagaaataaacattaattcaaaaataggaaataaaggggaagcagaaaaagagtaagagataagaaaatgcacattgaaaaaaaaggagaaaaaaattctagctatatagcacaaggatcccatctaaatcaactaaaaccaccaataacttagagtaccaattaattgtttccccaaaaagaactaggacttctcatcaataccacaaaactgtgtattttttctctgaattcctcatttgcccttacctcatgttcctatttgtctttcttatcccagaatggagaaagtattttggtcctcgagtgaatattctgtcgcgggatcaaaaaccgttccaacatcattataaaaaattccaaaacaatttggcaacattcattcatggtcattttaagcctaaactcaattcactcattgagattaaaaaaaaggacaattccattttatctacagtactgcgcgcgcctctctatgataggccgatgcacccccatatacaaccaccatctcactgttgatctgggcgactccgtggttgggcgtgcgtggagctcacggtcggcatgctgcttaatagtggtcacacgcacgacaatagcggcatgctggtacaagcaggatttgaaattttgaaatcagcttttctgccgaggggaggggagagggggggggggcaaaagaaccgaaatttcgaaaatttcggatttttttcgtccaaaattttttgaaattttgactggttttaaatgaatttgaataagatttgataaaattcacaaaaaaatgcaaaaaaccgaaagtttcgggcgagatgtgagcattttttggggggggggggggtgccgaaattaccgaaatttcggaaattacagaaatttcaaaccctgtgtacaagtccagtagctatccgaggcctcatggccgggcaaccatgcagtggcgctgggctcggttgacatctcttcatgcagaaattataagctgcttaatagtcgccatagaagtctccatggatctagcatggatgtaatctggtggagaataggcttagttgctttttctattttgtaagtccttccaagaaatttagccatcttaaaggagcctcattgcaaaactgcctgtacttgtacttgatatgtatctaattatttacgatcaataaaatgtagttctaaaagaagacctggtggaaacctggactagaacgaaaaaacaaaaaacaatcgatttgttgtcaagtcaaaaaaaaaaggggctgaatttagaattttcgtaatattagtcaggatttcgtcggtttatcagcggtttccgtgaaattcgttcgtgagtggtttttgattcaatatcggaattatgaaccctgagcacgatgaagaaccaaacgaggatgcttgcggctagtccaagattaatgtcatcatgtcatattttttgtgttcttggattgaggtgaaatatctgttacccatggaattctctcgacaagaaattgagcctatatattactacctccatattttaatgtatgacgccgttggttttttatccaacgtttgatcattcgtcttattcaaaaaatttatgtaattatcatttattttattataacttgattcgtcgtcaaatgttctttaagcatgacataaatattttcatatttgcacaaaaattttgaataaaacgaatggtcaaacgttggtcgaaaagtcaacggcgtcatacattaaaatacggagggagaattatcacgtaccttggtgtattagcggaaggcttgaattgaaagaccaggacagtatctggcagatctccacgcatccggcggtggctgcagaaaaccccacagcaacctgcgggccgggcggaggtgtgcccttgagatgttctgtcaggtttgcactcaccacctgagcgtgggccgcggatgatggatggtcaagaaaccgaaggtaggcgaccagcatccctgtgctgctgttgaagacgatgtcggctatcattgtcccattaagggttacgttctttggcaagtatgtggtaatggcagaatccttgacagagttgatgtcgatggcgatgtggtcggtcttttccttcgggtcattgtcaaatccgatgccgatgtcgaactcgacggcgatgaaccgatcatccggggcgatattgctagtggtcgtcttatcagtgatgagtccgaggttgcccccggccgacctgtacggcactttagaagggaaactggcgaggaagaaagccatgccatcacctctgcatgtaccgttgccttcgatgggcctgatggcgaaggtgaagctcgtggagaagctggccaccttgctaatgcggccgttggctgctaattggtaaagctgcaccggatgagcatacgacatccggccaccgcgcctgcaaacctggtcgttccaggtgcaggtgagttctaccggcgccccagctttctgcggctcgatcgcgtcgtcctggaatacgagatcttggcggtacgtggatgggtggtcggctgagaagttgaagctgaacacaggtggcgctgctgctgctccagcgatgaggtgatcagaagcatcaagcagcatggagagtaagaagaggaggaggccgaggtagccagggcggaggagctgcgacattgctacagctagcaacaagagtacgaattcggcattaatgtgattgatggtctaattagctatggcggcttggccgagggtacgtacttttataaccatagacagatggaatcccacctactctcctgtcctaaaattagttaacttggtacaaaacgtgatacactctattattatggatctgaacaggtctagtagtattagaattaacgttatatcatatactccatccgtctcaaaaaatgagcatttttataactagaaagatagcccgcgcacatgcatgggcttttaatataatgttgtttgaatttttgttaagaatatttgcacgcgggtgatttttttttcttgaaatattctttgattctattctaaacctgtttgacgtagaacttgcgcccatctaggatttatgcatctgtggcatgcactctgcatttctactatattattagcacaaaggtttaatgcatgccatagtggatgccagcgtgatcaaaccttttcaatcatccgccttattctaagttacaaggatatactagctaggtacgcactgcatgcatgtgctttaatttgtagccatgtaatagaaataaactatgggaattaattaaaggtaacgcactctcatctataattgttttgtacaactatatctgagcaccacatgagcatcactaccattccagggaatgggatagatccccagttgcttctgctacatctggatttactaaaagtgctatagctcttccacatgctccaaatgaatgtaggtagttactccttccggttcaggttataagatagtttgactttggtcaaaatcaaactgtttcaagttgattaagtttatatataaatatagtaatattcataatactaaattagtttcatcaaatcaataattgaatatattttcataataaatttgtcttggccaaacttaaagtagtttgactttgaccaaaatcaaaacgtcctataacctaaaacggagggagtaatttccattgaaagatgccatcttcataagatggcctaatagcagagaaaacacaagtataagaaaatattgttattgatttcatatacattgttttattaattatctcgtagtattttaagttatgtcatcttaattgaccccaggctgtattcagtattaaaaaaaaattgaaaacattacaagggggtcaagaaatagaactgaactttccacatacacaaaaaaagaagaaatctgaacatattttactccctccattccaaaatatgaggcacaaccacccttaacccaaagacaaaaaaataattattatcatcttgtagtttggatcatcctactaaatataatgcatgcgtccaatagaattaaataacatgagagtggaggattttaaaaaagtaataatttaatggagaaaatgtcatagttaattgcatgcttgcatgcatgccttatactatggaacatttagaaaaagtggttgtggcttatattatggaatgaggaagtataattttgtagaaatctgaaatagggagccgttataaattaggttaattagatctatgccattaaattttttttggttttgaaatataccactactatttgcgtatttgtaacgatgccactgctgcttttttttaatttgagtggtgccactaagatacgtattttacatgtattgaacaaaaataccctcatcttctacctctcttctctatcttgtccctctctctcttcccgttgcttcttgctccgccgctcgctgctgctaccgccgccacttgccaccaagccgctcgctccgccgcttgccaccgagccgctcgcttcgccgctgctgcctgctgccgctcgccgccgccgccgctgccgctgtgccgcttctgccgccgcccgctgccgcgctgctgctccacagttgccatcgaacaggaagaagggagaagaaggggagaaagaagaagatgggcaattacgttttttttatccattgcaattacgttgtttttttaagccaacattcacctcccgtgcgttgaatgaaaaaaataaacacgggaacactcattctatttcgcgccaacggtaaaatgggatgcgccaaattgagctggacgtgcctcaaagatatccgttcgtgccaatgagaaaaataatattcgtggcaacagagttcgacgcgcacagacagaacgtaggtggatttcggtgtaaccgtgagtcctctctaagacacggtatgcgcttgatgattcccgagtttattgctctacgcacggtaaattacagtgtgacacccggtattcgcatgcacacgggagccttcccttcaccattagtgttggttgcaagccgcatggcatttccaagggctcgctttacataattttgcttaaagaccggctttacgctccccttctaagccaggatttcgtctagtctaccaggatagccattggcatcgcccgcatggttcgacaatgtcttgtaagttcgcctgtaatatacttgtgaaggtcgatgccaggaaccatcgttgggtgtttcaccatgaggaacaggaggtagttgtgttggatcgtaatgggctagccaaccttgcgtgaaacgatggtgccgccggggaggagatagtcatggaattgccaatgcggagagctccttcttcggagaagaagcctatgcggctaggtggccacaccactccctgactcctctttgccagaagccttcatggcagctgttgagagaggtgctcatgcacctc

SEQ ID NO: 6117 - DNA, 5521 bp, Oryza sativa
  unsure (1)..(5521): unsure at all n locations
gtatccccatctgaggtgcatgagcacctctctcaacagctgccatgagggcttctggcaaagaggagtcagggagtgctttcttccagaaacagattgccggactagcgccggtgctggggttgccatgggcaacccttgcagcgagcaacaccacaatgaaaagatgcatgcttatcgatggtgtgtgggatttgatgagaggtgatggaggtcttgcgtttatatagcctcaagggaggttgtgggtgcaggtgatccttagcgatcatattagatcctagcttacacctccttgtcacccagtaggactaaaataattaaaggcctgcagctcaaccgtcatacttccggtatttgataatcagaaaataaagtgttggtactgtaccactgagttggcatccttatgtattgatataaaaaatgtataagtggccagctagctattgcgaaaaaataagtagatatatacaagtcattatatagctagtagtcttgttcctaacaccctattcctgctagagtttttgtgactggccgtcatagtagtgtacttctcattattatttttttaagtgatccgtgcaagacagtgcgaagtttcatattgttataccagaaaaaattataagattataatcctgaaagagacaaacaaacacacaccacctttccttgctactagcttctcacacgatgtcaaaaacaaatgaataggcacttgtacaaaaccggccactgctaagcatgaccgatcaccgcaagacctacctagctagccggctgtcgtccaagtgctgtctcctggctagcccctacaacctaacaagtcggcaccgctgcctccaactttggactgccctttgcgcctcctgccttccgtgctgcgccgtcgagggaggccttgccaagcaccatcggggaggcctagccacaggttgtccaggccgcgggagaagccacagacgcctgctgcaacactctacctgccttccggcactgccggtcaggttctgtccgccagaacaactcccgtgtcgcttggatgtgctcgagctggctacacatctatcactgccccgactttcactagtgagccaccgccttccccgtcgcagcatcgtgttgtcgtcccgaaatccttgacatctcgcatgaaccctagaggcggtggtagtggtgtggtggcaggggtgcaacggcagggattgcctcccatgtcgccgcagccctaggttcgacacgggagcttggctaaataattggtagatacccctgattgattattttcacttaatccagatggttctacgccgtcaggaaaacccattttcttgtaatgaagaagcaagcagtgttgcattagaatnnnnnnnnnnnnnnnnnnnnnnnnnnaatacgttatttgacattggaaaagtgagatgcgaagggccggatatcacttgttcgctggttaacaattctgattctgtcactagcacgtaaatgaacaagcatgggaggttttcgcagccatgagcaacgatcctctttgcacccaaaaagaatgacctggccatctgcttgcatggttttccaccagcgaaatagatgttgacagttaatgtacgtatacatttgagagtttcgtattatagagatctggatttgttaattgtccatttgccctgtaatattttttatttggcttggattggagaagaaaatacaacattttatgttcttcattggcttgctattaattgagcagtcgcaactttaattttatgatgatattaaatatatatatatatatatatatatatatatatagtaaatttgtttggtgctccatggtgcccgggcaccattgttgaaattgagtatatacccaattcaaatgagtatgaatctttttcaattacttaggtattaacattaactactttactaactaattcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattattataactaggtatatactcacaatttgaaattttgaaaattttgagtgattttatacattagataccatggtgcccgggcaccatggtgccccatatgagtgtcctatatatatatatatatatatatatatatatatatatatatatatatatatatatatatatatatatgacgaggtaactattgcacacaaaagatgtgtatatatagtagtcttactcataacacgatctttctattaaacctatcgtgacattgtctattgtactcgtgatgttttttcacttaatcccgatgttttcccgccatgagcaaaactgttttcgcgtagtgatgcagggagtgtttcatgttagaatatattatgtcaccgatgatgaaactagcagatacgatcgatatttagcattggaagagcaagatgttttcggttagtgatacaaggtttcgatttgagtttcaaagttgagaaaataaagtatatacatttatgaagcaaacaggggccgatcgatctagcatgggggtggcggggtctcaagccctcactattggcgtgaggaccatggagcccgcacgaagccctcgctaaaattgtttgctctatgcagatttaaagagagctatagctttgtttagtttgtttagatccgtcgctggaagcaaatagtgttgcgtcagaatagattatatatgcaaccgatgatgaaaattatgttatttgacattggaaaaggggatatgcagaggcctggatatcacttgtttgctggttggccaatcgatcagattctgtcactagcacgtaaatgaacaggcatggcagctttcgaagccatgagcaaggatcatctttgcacctaaaaaaagacctggccatatgcatgcatggttttccaccagaaatagatgttgacaattaatgtacgtatacatttgagagtcttgtatcatagagatctggatttattgtccatttggcttggattggacaagaaaatacaacgttgttttatgtgcttcattggcttgctattaattaaggagtagcatccttaattttatgatgatattaaataggtctatatctctgctattataaaaattaaagaaatatagatctgtgtttgagtatgtcatccgtgtttgagtcggtttttaagttcgttcgcttttagaaatatagatccgtgtttgagttggattttaagttcatttgttttttggaaatacaaaagagtcgtataagaaatctttttaaataaactcgcatgctaacttgagatgaaatatagacttctaattgaagcctatgattttcttaaaaaaaatatccaagcgaattccccctagctaaaccatataacaacagcaaaattaaaatggtatttacccgttgcaacgcgtggtattgtttctagtgtaccccctcccacctcccatccgtccccacctccctccctcccacgccccctcttcctctctccctcccgtcctcccgcgtcccctctccctcctcccatcgctcctcccctcccatcactcttcctctctctccctcctcccctcccatcgctcttctttctccctccgtcctcccacgccccctctccctcctcccgtcgctcctctctccttttcttctttttttttctctccctccttcttctcttttttaaaaaaattaaaaataaattggtgaattcaagacttgaacccatgatctcatggttcatggcgagcacttctaaccaaatcaccatatgatgatttgttaacaaatcaattatgtacctgtaataatcataccttgttactatgattcgacagtaacattatcgcagaagggtagtaacatcatatgttactgcaaaaatgtataggttgttactgtaaactttataggttgttactgcactttcagcagtaacagagaacatgcatagtaacagtggccctatagtagtaatgttttttagatctagagtattttaaatatcaatctttagagagtactaacgtacatgtcatgtcttatttttctaactcatttgcatcatggcgttcataaaaaaaaagttcttaacgaaactagaaccataataactactttttaacgttgttactgcgaaaaacagacgtgttactgcatattagccgtcgtgttaatacgctgttccagtgagacgaggactaaaaaagagataaatctcaatctttagagagcaatatctctcacatcatatcttgtatttccaatccgtttgcaccatgaagttcataaaaaaacgcttaacgaaactagatccatcatggctactttttgacgttgttactgcgataatgttgtcttgttactgcaagatgaccgtcctgttactgcacgattcctgcaagacgagagcagcaaagtggtgggtaggggagggagtggtgggcgggtttgaccggcgggaggacactttgaccaaggtgggaaaggggttttgggccctagggagggtggggaaggtgggattggcccatgggaggggggtttacaatagttattctaggggaggggtgtacaatagattcactatatatatatatatatatatatatatatatatatatatatatatatacactagcaaaagtgcccgtgcgttgcaccgggtgattacggagtgtgtatattgaccaaaattgttgtttagtttagcaaaagtgcccgtgcgttgcactgggaagcgcacagatcagtaaaaatatgcaaattaattaaaatacaaattcgctgaaatatttagtatttttaagtaggtatgtgtataattaaataaatttacaagtaaagcaagtgcgagaaataaaatgacattgttaaatttaattttattaaattctccatgattagttacgctctttggaattttattggaattttcagaacttaattgctaattttaataatacaaatatcatttaataattatttaattggaaaaagaaagaaaatccttccttttaggtttgcttagaaataaacacatttaataactataattataaatgcttctgaaaaaatgaagcactaacttctcttttttttttcggcctgagggacctaatacagacttatttctggcctgagggacctaaaatagacttatttccgtcccttccggtcggcccacggccttatcaaaaccctaaccctccccacccctcccccccgccccctccccaactcattctcctccctctcccaccgcgagtcggcgagtggcggcggcggcggcggtagcgaccggcgatctcgcggccgaggcgaggcggcggcatacctgccctaccgcgggcaacgactggtggcgggggaggcgggcgactggggggagggggagaggcgggagaggaggggagggggca

SEQ ID NO: 6118 - DNA, 6824 bp, Oryza sativa
cttcccctccccctcccctccggcggcgccgccccctctccccctccccccagccggcggcttcccccgccaccggcgccgcttcccttcccatctccctcctttctcgccggctcggcgcggcaacggcggggttcggcggagacggcgccgtcccaacggcggcgacgacggcgtccgcggcggccgcgctccctctcccccctccttcccgtctcgtcggcttggcgcagcgacggcggggtgcggcggagacggcggcgacggccgtccctccccccctctctctccccgtcggcctcgacggcgacggcgccctcccaacggctgcgatggcgtcggcttcatccgcgtgcggattcggcagcggcggctccctccggcggcagtggtggcgtcggcggccgccctttttttttttttgcaattttttccatggctattgctaaccgaataggattgtgcatggacaaaagatggacgaaaattagatgtcatatagattttttttctagatcggacttctttttttttcgcacttttttacgtccggttattttggatcggaaaaacctggtttttttcgcccggtttttttttttcaccttttttgttggatcggactttttttcgtccggtttttttgatcggacaaacttggttttttctacccggttttttttcacccggtttttttgacggacgatggaagcacctcttattttttaagtagtagtagagtagatatagatatatatatatatatatatatatatatatatatatatatatatatatataactactatatggcgctataggcgccacgtattagatggcaccacacacacaaccaaccaccctgtcccacccccacgcgcactcaatttaaacagaccatgtagttaatttttaactcagtgacccaccaccccacccatccccacgccagttattttttaactgttagcgagatagccaatgtgtgtcttgtgatccaacggtgtttgcacaatgagttattttttaactcaacgtacagactttatatagtatatatattacggatttccatcgtagaaaccgtccacccactttttcctctccgtctccacattttatggatcgttgatggcttggcgacgaggaggagcggcggtggcggcggttcggggacaagcagaaccggcgtcgtggaggagcggcggtggcacgtcaggcctgatggcgtcgcatccatggcgggcgcggcatctgcgggcggggggtggatccggcacggcacggctgcgacaaatattcaagaacagcacataccattttgcttcagctatggaatgaaacaaaaatgagaaggaagtcagagataagtgcaagattgaactagctagttctgaatatttgttctgcttcaagcacaacatctccatgtgttctgaacttaaatactgagattcctgaagaacagattctggaagacgagtgcattccatctgaatacgcggtttgcagacgtcggctcggtgacgacacatgagtcagaagcaaatcaggattcgataacgttcatgctttccttgacttgacctataaagtaacgtccttattactcccgtcaatgaatatgtatatcgtcgtattaagaagatagtgcgctgcatcatgcacctaaccggcctgatgttctttttcaatacgggtgaatccgaagagaatgatgactctctgaatagtggatgaattattagatcggagggattgtggttagggaatcttttaaaacatagacactattttacaggatttttatagaaattaggaagcaatcactacttaaaaaaagcatttttgccaacgttgggtctctttttccgcagacgggtatgaccctcggagccaaatatctgttagaaatttaatcataattcggcatattttaatccaaaataacaagataataagcatgttatttacaatgagcatgcttaacatagcatgtaatcaacatgagcatgcttaacatagcataaccatcaacaatcacataataacgcaatgttgacattgcgatgaatattaacggtacaacttctaattgaaataatgtaagatggttataccccaaaaaaggtcctccgctggagtttaaggcagtattgcctctgttggtgttgacaggagcatccttctccttgtctccagcgttgtcgttgtctttagtgttcgatatgttagtgaagacaaagtagacgttgacgaacagtcagtagtcgcaccttgcgctccccaaaaacctgatcgcccacccgtccatgcaaacgtcgtagcagtgcgtggtttcggaggcctattctctcaaagcgtgtgcacacactcgtcgggatgggattaccgtagcagcaaaagccttggaaatggatgaaagtgtgtctcacttctccttaggaagataaaatccattctcattttataggaggaatggaagatgaagagtaagagtcatggaataggaagagaaatagagtaactaattctcatcaattacccatcaaccatcctctattacacaaccatcaaccaaccatcaattaggagtaattgatgtaggttaccaacggaataggaagagcaatagaccaactaattgtcatcaactagcaactagccatgaaccattcttcactccacaagtatcaaccatccatcaatcaggagtaattgatataagttaccaattcaccaatcaaatggattaattatcaaaactcttcatcccattgatatcccattaagagaatgaatacacatgaattcctagcataatgagccttggaattaatgatttaaatgaatcaattactcaattaaatctaacaatattcacttatgaaaatgtaaaccgaggtggattttcatcattcgattgcgaaaataaatttttccaagcgaaccgcttaagaggtccgcctgcgaaaatacctttatttctatgatttttgcaggcggaaacttatgtgctccgcctaaaaaaaatcatgcctacatgaaaaaaaaaactaagtcctatcttatcttctcatcttccatcttatcctctccccaccactcattccatcaactctctctctctctcgcggttccctccggctccctcccctccgcttccttccttccggtggaggcgcaagcgaagggcgtcaccattgccggatccaccgcccccatgccaccccactgctgccgacgccaccctcctctctaggcgcaccactgtcgatgcccatccactccatcggatctaggagggaagcaagaggagagggaggggagaggtcgtgctgcctcgtccgcgctctgccggcggtccccctccggccatgcagggagggcaggaaggggaggggaggggagatagaaggagagggaggggagtggccgcgcacgctgccgtcgagagggaggcagccatcaggtttataccatgttcgctaacggtatgtaaataggttcacctaatttgtcattgtttatagaatcaactgattaaaaagatagatcaggttagcttcgaacgtgagctataagcctgttgagctaatgaaatgtaaagcacatgcatagacgctgattaaatgtaaagcacatgcataaactacactaccactaagttcagatcttgtcccgtgttgttctttcagttgtagcttccaagctgtgcatatctcaggcctagtgtccgtcagtgatcaactgcaaggcgctgcatactagccagcagattccaagagcgttcggtacgccctgtctatttcacgtactatctggttttgtgtagtttttttcattgatattaattcttgctcaactaacacacatgtgttagcatcagacgatgcctggatggatggttcgcacggtgttcttgctcaattcgtgggtaatccggacgttggtagtattcagcttcgcagcgcatgtcaccatcgtcttcttggcaggagtccgccgtcataaggctatcggcttgccgatagccatcctgtgggcggcgaaccagctgggccggtcggccgcgacgtacgcgctcagcaagctcgccctcggcagcacgccgcaggagctgcagctggtgacgctctggggggcgttcctgctgctccatgccgctggtccggacaacatcaccgcctactccttggaggacaatgttctgtcgacgcgccagaaggtagaaatgatcttgcaggtatcaggagcagcatttgccatgtacaagaatatagtcatcagaagcgggtccggtacgatggtctgggtctcctctttcatgttcatcatgggcatttttaagtattgggagagggcgaaagctatgcagctcgccaacctagaaaacttgcgaagctcaatcaagaagaagaaggagacaaggagacgacgaagcttgagaaatattaggcgtccaagcagttcaaagcatgataatgacaaggaggcactgctggttgctcatggcctgctcgacatcaccaaaggcaccttcgtcgattcttcagtcaacgagttggtatcagagcgagttctcacccccttcctgatgagctctcttctgctcattactagtgacattgccagaacgattcttctgcgcagtagtaatttggagctcaacctccatccctcgagcctcctcaactgcattgaggtatatagtaggcgggtttcttcccatcacttctctataccgagcattgagccctcgaaagaacttcctagccttctcacgctcatcacttgccacgctaggcacaaagcgtacaatactgctgaactcccgttcatactcatcaacagtcttgctcccctgttggatattgtttaactcatcactcatcttgtccctaaatgaatctggataatacttagctctgaactgctgaagaaaaacttcccaaaaaatagcaccacgatcagggttccacgcttcaacaactccatcccaccaaatgtccgcctgaccagtcaactgaaaaggcatgaaagtaaccttctcctcaggagtcattcttgatcccctcatatacttctccatcttgcgtaaccagtctgcagcattaacgggagtaccagacccatcaaatgtgtctaagcgcatggatgtccatctagtgagtgtcatcccccgaacagctcgaggagcatcatcagagacagcagctgagtggctaccaccctcctcctcttccatgtgctcatcctccatctggttcgaggatgctgcctcattatggcgacctctaccacgacctcttccacggcctccagcacggcccctaccacgacctccacgattcggaataggggattcagcaaccgagttgttcccaacctcttcattatcctgagtattttcaacttcttcattatggtggcccctaccacgacctctacctccgcttctcccgcggcctctgttagccaaccaaacactcactctaggcggcatagctatatcaaacacaagcatttagacgtcattagtttaacaataggttagacaatggcatgcaaggaaacacaatcatacacatatatatgcagcagaaacataaatgctaggaatgaaccatgctcccattcctattgtgcaccagtgtgtcaagttcttttagatgtttatatataacccaagttctactcttattatttcctaccctaagagaaagtattttttttaattggttaggaactctagttcaaaattttatgttgatttatatatctcattacccagtcaattcccatggacctaccgcccgctctgataccaactgtaacaccccaggtaaccacgtacatagaatgccacaccaaaatacactcaaaaactaagtcctaaaattattagaaatttcggcagagtctcccctaaaaatacggacatcacgacaggcagttataagaaaggtcaataccgatataaaccacacaatccaaaccatcctagtgtagacccccgattttggaaatcggaaatcttctgtgtttatccgtaccaatccctggatcagtagttggtacacacatacatagttggatcacaacatatcacgaatgaatttagactaaaagagttaaatacttacattagggccaggtaggccaacaactatcagagaacaacagcggaagacaaaataatataagggcccggttaacatgccacaggcagtcgactggggaacgagacctagaacaagaccgcactccgatcatcttgtgggatacgcaagcgtaccgacaagggcttctcttcaacactctcctaaaagatatataaatagcaagggtgagtaccaaccgtactcagcaagccaccacaacaacaatgcatatgatagagggtatttcaaggaatggcttcaggttcttttggataaagctaattttacaattcttttcacaagcctaaaacctagcatagactgatcaaattttagtaccagtgttcactttaaacaacgacggttctgtccaccatccattgtgatcccaaggatagcttcccgccattgaatcgtcatggttttctgaggatgtccaccttccctcctctcgggaagtggctccatcagcataaaattcatcatgcaatatcccattccccacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtccca

SEQ ID NO: 6119 - DNA, 606 bp, Oryza sativa
gtgtctcctccgtccgccggcctcaacaggcgacgtcatcatcatcgtggcatcaacaccgtcagtgtcgtcatcgcgtcaacgagaaggggagccagcggccggatgcgagccgtcatcatcacccgtcgtgatcggtggcggagccgcgagaaggcaagccagcggtgaagaaggcgagccgtcgtcgtcgttcgtcgtggccggcagcggagggggcgaggagcggaatcggccggcgcaggcggcgaggagggaagccggcagcggagcaggagagccgttgtcgtcgctcctagtggccggcagcggagggggcgaggagggaagcggccagcggaggtggtgaggagacgagcctacgccgccgctcgtcgcgcacacaccgctccttctcggagccgccaccgctcgttggtgtcgacggcgacgccaacgccgacgccgacgctgctgctgacgccctgccgcggccttgctgagttgagttgaagataatatgcgagatggagaggagagggtgagtggtggggcggggttgagttgaagataagattgagtacttgagtctgtgacttagatatttttcggtggaggtatgatttt

SEQ ID NO: 6120 - DNA, 716 bp, Oryza sativa
gggcgtctcaaagaagtccgcgcaccggcgcgggcgtgcaaagttgagacccgtggtgttcgaccttccccgccccagggaacgacgacgtcggggccggcgagctgtcccccggcgtgcgaaggttgccgccgcccgtgaaggggctcgacgtggggctgctcgtgaacaacgccggcgcgacgtacccgtgcgcggcgtacttccacgaggtgcccgacgcggtctggaaggcggtgctgcgggtgaacgtggtgccggcgacgaggatcgcgcgcgccctcgtgccggccatggcggcgaaggggaggggtgccgtcgtcaacgtcggctccggctcctccgtcgtcgtgccggcgttcccgctctacgccgtgtacgcagcgaccaaagcgtaagtcaatccatccttccaatcttcaaagctatcgtgtcatgctcataagtatttttttctagtttaatcctaaatttatttctaaagctgaccaaaattagcgcaacttaacaactaaccttcttaaaacaagtcttagaaaattactgatcgtttcacgtttgttctaagtcaaacattttaaatctttaacccatctactcctataaacaaatataatttaatgtaataagatttatgaaaatactttaaatatataattcaattattggtaaactacatggcctggatttgaaaaaaagtgatagtgaaagatata

SEQ ID NO: 6121 - DNA, 348 bp, Oryza sativa
gtgcggcccgttagcaacgcagcgtaatctataaatagggatcaaatgaaaggtggagataatacaggtgttagataaatacaatagttctcttgttaattaaatgtagaagctgtgaatggagatacaagttcccgcaagaatttgcgaattctattgggatctgggtgggtgtccgggacttttgtacttacgtttcatgttgcgctcttcctcttcattggcagcggcacatccaaggctacatccgtatctgaagatggagggaatacaaatagagaataagatgatgctgggcgataaggtacgaccttaaatggaatttagatagcaacaaatgcttcaaag

SEQ ID NO: 6122 - DNA, 76613 bp, Oryza sativa
gctgatcgatcttgaaaagagatcctgtagaaatctggaaatggaattttaatcctaggcaatttcccctcgttgttgcttgtatttaaatagttgtgaaagaatttgaaaaagaattagaggatatattagcacaggcacactactagtaatatatttatccacaaatatgtgggagttcaaattcagtatcagtaactcataccaaaaagaatggattacgtatacgtgtgctcacgtcatatttgtttcgctaatttgtaaaatcaaatttaaaattttatgacattaatctaacttgtcaaaatagtttttttttcagagaaaatctattctatgccattaaatttattatagttcaacagttggtcatcgaatttgtctttctctataatatatcacttctatattagttataaaaaaacttctatattatattatgtaagaagactatgtaagtaaatatatatatatatatatatatatatatatatatatatatatatatatatatatatgtatatatatcttcatgttgcttaatcaatagtcactcttgtaagtcttaaggcattttaagcatcatttttgaaaagtatcagccccaatgatatattatagaaaaagtaaagttggagatatatataccatagatggagatgaagtcaataataaatcgttgaataaattcagtggtataaaatgatttttttatataactatttagatcacacataagaaaacaagagcatattcctttgagatttaaagagtaaccaaggtaacattattgcagcaccttccgagatcttctgcacgataaacgggacgatctttccggcataggagtctcctccaacgtagaacggatttgagaggtagtgcggatactcagtgaaccactgaatcagagtcaaacgagatattaaaccaagagctagcaagaaccaagtacgctgaaaacctggaaccaatggaccaaaaaaaaccaggtagtaatgaattacctccctgagaagcttgatgagctgcatcgaagcagagacgtcgccgacgtcgtaccccttagggtcccttgagaaggagaagccggcgccgaccggcgagtcgacgaagaggatgctggcgacctttgtccacgagtaagggtggtagtgcagccgcggcaagctgccgttgtagggctcgatgaccagcttcaacggccctgcgtggtaataattgcaacgggatgaaccacgcctgacactctagacaaggaggcttgttgttgttgggttgctgaccaatctcgaagaagagggcgctgaggacggagcagcggtcgccgccggtgatccagaggaggacggggtcggtgctggggtcgccctccgactcgatgaagtagtagaacagctcggcgccgttctcctcgtcgaccgtcacgtacctgtacagagtgacaccacaggacctctcacctatactgatgcagggagcatggaaaatcgtcagagcagatgggggaatgattcttgagttgtctcacccggtctcgaggcgtgaaggcagcgcgccgtcgaaccccggcagcgtcgcgacgttcgtccgcgtcagggagccaccggcggcagcgatggtgacgaagaggaggaagcagcagcagcagagccgcacagccattgtactgtactgccttgtcctcgcacgggagaacggcaactggcaagcggtagcagctagcgaggttgcaactgccctcggcacatgggctttcagacgtggtggcccggctatctggtcaccccgcgttttcctcgcggagcacacaatatattatgtatgtgttcaaatctcaccgatgacggcatgacgcacagagacaggaggcatgtagctgctgcacggcatggcacagcgctataggctatagcagtactccctcttatataaaatttttttataattagtattttcattattgttaaatgataaaatataattaatattttatgcgtgacttatctttttaatttttttcataatttttttaaataagacggacggttaaatgttggacacggaaatcagggtttgtcttttttttaggatataggaagtatgtcaataaaaaattaaacctgataaaagataacatattttaatactataaatctaaataaaatcttatacgatggaggaaatagctctgactcatcaatagcctactagactagtggcttgatatacaaaatttcaaatcctagatttcgaaagtacaactatggagaaagacagagagaaactacaccttgggtgcctgatttctaaaaaaaaaaaaaaaaaaggagtcggactatcaaatattgcagttgaccaacaaatgaaaattaacttatatatagtgaaacgaaaaaaatagcaactgaaacatttaaaaaaattatgaaacacagtgaagatacacattgaaatatgtcgatatcacgtactccctccgtcccataatataagtgattttggaaggattttgtgtcacatccccccaaaatctcttatattcctccaaaatctcttatattatgggagctcctgtccagattcattgtcttaatatgtgtcatatccctctaaaatcttttatattatgggatgaagggagtatgaaacttaacggtttgaaacatatatttttcttttatcaaaatataattatataatttttattaaaaattttaataacaacgatatacaacgatatgatcagatcaaaataaaacatatgttcgccgtttttaggttggtgtcaggttgcgtgtaattggaagggttactgggaagaaaataatcatggttctaacagtatttttaccacgcactgtcggtctggccccacggaggaatcaataacacgcacgtctctgtggtgaagtgcacaagattataaaaccatagtcccggaaaaataatatatgaagatctttcaatagggtcaaatttctgtgtcatattttaactagcccatgattcgcatatttgcatgactctacacattccgtcatgtgatatgtgagagtgacaatttgtttttcttatgtttcttattactacgaaaaaaattggttaaaatgagtgatggtattaccctgatacagtaaatggcagtagaataacgatttttccgtacggtcggaatcggtttttgcgtgcggatctttcacccatctggaacgaggtgtctgcgagattttcgggaaaataaaaaatcgaaataaaaaaatcaaaagccgcctggaaccctaatccagccgtcgtcgtcgccgtcaccgccatcgtcgtcgtcatcgccttgcctgaggcctgccaccatcatccccacggacgcggcgatggatccggcctccccgcggtggcaggcgaaggatccggcctccccggccagcgacggatccgctccgccgccgccaccatggccgatgctgccatcgccctagccgagaccgtcgccgtcaccgggagatgggaggagtgggaggaggagggggatagggagaggaaggagtgggagaaggcgggcgatagggaaagagggaggagtgggtgtggggcggagagggcgatgggatttgagagggagatgggaggagtgggtatggggcagcgacggagggattaaaaaggtgggtggcaattttcgtgtgcgggtcacttaataggtccgcacgcgaaaataagtggcccacctgcgaatattgatttttctatgcggtcattttaatgagccgcacgtgaaaatggagcatatttttttacagacgcgaccacttacagttcgtctgcaatcaaaaatgactcccattcagaaaaatcattcctatactagtgtggcttaatatttattgtaaactttaataggtatgattcatcgtctttatatgtgtctttaccattgtatgattttttttctcctccacttatttttcatggtcataggttttgtacctttttaagaaaatattttaattttagattcatttttaattttatgtgaaagtcactaaacatatattcaggtgaggatgacctctttattggaaggaatgtacatgtctctgtagcaattttttctctaatacattaacaataattgctacaaacaaaagtaatcacataaacatacattttgaatatgccctgaatagctcaatcttgactaatgaatctttagttaaaggacgagggttttttttcccttcaattcctttctttctttctacttctagtagttacctccggaatgtgttttattaccatccataatccaatggtccaagattcattcactctcttttgtcttgtagtaaatccaacggctaatatttgtcaaatgatgtggctcattcccgtttaactttggatttcacttttcactttgttaagattagtctgttggtttctccttgaagaataattggatgcatgcataccttcaagacataccacccgcgaatgtatatttgtgaacgacctttttcacgggttacattcaattatttgtgaaatcaatgatttgattattttttatgaacaactggaaagaaagcctgcgcaaatacacagatatcttatttatttgttgttcagaaaaaaagaatgctaaaaaaaatcatatatcactatatacaccataagagacggcagattatctaacaataaaaagtaaatatctttgtggtaaaatagaggtagactttatgtaacacccaaattttttatacctaaacacactagtacagaaactgataggtgccggttgggaactagcaataggtgccggtttccctgccggcacctattgctcggcagtaatgacactaggtcattggtgccggtcgtagaaccgacacctttgctctctccctgattaaaaaaaatagagaagctggctccaagccaagcagatgcttgtgagccacaccattcaagcgaagcagatgcaatccatcacaaatcaataaaaataattttacggtcaacaacaacaatcacagatacaatccatcacatatctcctatgaacaacaaaatccatcacagatcaacaacgacaatcacaaagtcccaggtcagcaacaatccaatccatcacaaatcacagatcaataacataagtaattaagatgcacgaactcactccgtcatcgtcagtccgccgctgccagtcgtagctgggatcccttggccacccgctgctgctgtcgccgcttcccttggccaccaccgccgccgccaacccaccaaccggatctgcgcgccattggtgggaggccgacgaagagggagaggagggagaccggccggatctgcaccccgtcacctatggggaggccgcccaccacctcccttggccaccaccgccgctgcacgtcgccgccaccaacccaccagcccgaccacctcctccctagatatggctaactccggtgaggccgacggagagggagaagaagaagaggaggggacctgatttgcacatccccgtcgcccgtggtgagggcgccggtcacaggtgccgctgctcacagtttggccgtccgggagagggggacgcaaggggagggaagcggctggctggccagctaggagagggggacgcagggggagggaagcggccagccggccggctgggagaggggagcgaaggggaggctgcaggtgctagagggagaaggggagggaagggcggcggaggaggatacaggcgagacgaacgagtcgaagcgtgtcacgcccagaaatttaacccaaatttccagactattttgtgtattaaatccctgtccaagaccagccagggtacacaaaacaacaagtaatatatagttccaaacgtaaataaagcataaaatacttacagaagaggcacttagtcctcgcaccgaagcgaaagcagcagcagcggaaaaggcgatcctagcggggcttcagcttcactccacaggcaaaactcaactggggtctgagccttgatcctccaacttcgtctttagctcagaaacactatacttctgaaaaagggggaataatagtaaggctgagtacaaccaccgtactcaacaagccacaccaatgatacagacgtgcaaggggatacaaggatggcttgcggctatttgcataaaggcggttgtaaaacattttattgagcaaaacagtaaaactgttgagtaattaaggtgacattaaatctccactgatcaatgctacaccacgttgaacaggcccaaccaacccacctgaactaaccagtgcattgagtcgatttactaaggtgagactaatcatggtgaatctggttgatcgcgcataaccgcgggcatggctattcgaatagttttactctagccagaggtgcacaactgtacccacaagacacaatccaccggcatgtcaccgcgccaggcctgacacgtcaccatgtcgagtgattgtgacaagacccttcatataaccccttctgaccaagcagaccacacctcaggtttcacccccactcctcaacaggcagcgggcaatcccctctcatgcctaggcgaatcagaaagccacataggtcatcgcagtgcccatccgaactccatcatgctcacccttgcctggatgcgtcacccaaaggaaagctatacttcaagtcaggcagttacccattcccgcttgtggcaagcgttgtatgtcttccagggtgtcccgcgaaccactccttaattgccatgggtgcggctagcaaaaccatgcacccacagcccaccatcaagtcgcattttagttggataactacgaccaatgaaacatggccggatgtctcgagcacgcagctcgtcatgatactagaaagtctaatactgtaattatcccatcaactgagctagtggtaattaagcatggctaagcatatagttctagctaggtcaacataacacaagctagtcgaattatcacccaaggttcacaaaggacatatatcaagtaaacatggcacaagcgagcagataggtaaactatgatcccaattaattagcaaaacatgcatatttatttgcaaacagtaaaacatttgtaaagtaggctcaatatgctcgaggggaatttgtgacttgccttgcttctttgaaagaatcttccgaacacttttcctcgcgatcgcgaacttccgaaacggcggaatctacgcgctggcacgcaaaacaaggaaaaactctaataaaaaccaagtaagcagtacatgaaaagtaaacaaacatgtagagctcgattttagatgaattttgctagttgaatggcccaatttggagttcgaatgaattagttatgaattttttgagccattaaatgaattcctataattattaacactatttatgacgtcaccgagaggataggtggcaccggcaagcgggccctacctatcggtggctcaaaggaggcgggtgcacggtggaccgagtccacgcgcgcaccggcccgcggctagacagctccggcgagcggcggcggctcggcttggcgaggggagagtgggagagggcgcggggagctcgggaaaaattggggaaatgtgagaggagagcacggggatcgtttttatgggctcgggggagggaatccgtggtcgattggggtggcaaccggcggggaaggggcggcatcatgggggaggagagaggcgacggcacacggcgccgattcgtgcggggatagaggggaagtgggggcggttgcaggcacgaggtggaagggatgggcggcgacgtggcctgcacgagggaggcgtgaggaagccggatggggcggcgacgtggggaagaacggtggccatagcggttggacttggggagccggaggaagggaatgacaggtagggcccacggacccacctgtcagccagggagagagaaggccgagtgagggaggaaaggagtgggccgagtgggctgaaggaggggaaggggaggccggcctggccgggaaggaggagggagggagctgggccgagcctaaaaggaagaagagggaaggattaattcgttttctttttattttaattgagttaatgaactttgtattattataattacttcttgagctccaaaaattcatgggaaaatttcagagaataattagggcacaaagaatattacaaaatattcacggccaatgatttttaaaggaaaatttttaattctcccattatttcacttgattaaattgctttaacttttatttaatttctagaaaatgctttatttaatgatttttagtcccgaacaaaaatcggggcgttacaaggcgtccgcgtctcacttcgcacggataaggatagcgtggagcggataaagctaaggccggctcagctatcctggtttggctcagttttgtatgggtgtcggttttttaattaaccagcatctataatatataatatattataggtgtgtcggatctttctaaaaatcggtaccggtttttcctaataaaccgacacctatcattcttaaaggtaccggttgtatattttttcaacgtgcgaaggtaggaaaaggctcataggtgtcggttttaaatgaaccatcacctataaagccggtcctagggttttttagtagtgacacatgcaatccagtaattactaatgtaattaatccaaacaaatttgtttggaattctaattttaggcaacatgcccacgtgagcactgtgaatccagtcgaccaggaggcctatcgaagcatatcgccgatttttttaatctaagcacgtgcagctcttttactacgtatctgagcacaccatattcgtaattccatttgtaaacatgtgtacatgaccacgtcaatccctcaatctaatgccaaacaaaataaatggaccttttgcaacctcgtttctagcgataacatccacaagttagcagcccggtaatgtaaactcatttatttgtaaaatagtagcaattttttaggtctattaacttgctatataattatacttaaaaaaagtgtaacaatattttgtaaaagcaaaataacatatttttgaaccatacttaataaatatgtcaaacattaatacaaagtaacaaaactcaattcaatggcctattattttgttggacattatgttatgaaacaacgcttggacattatgttatggaacaacgcctgcacctgagcatcttgtctatggattgaaatttgggtttggcttgcttatatttggaattaaactgatgcatgtgcttacatgtaaaaaaatcggatgctacccaatacgaaacaaaaaccatgaagtcctaaattcattgagaatttcgacagtgtcccctataaatatggacattcatgatagatagttataattctattcccacagtgctatccatccatatacatccattgaaagaaactaataggtatgtaaaagattattacaagaccaacccagaatatagtttaagtgtcattttggacctaagcgatatagtttgatagtgtgcagatagatgtgtatataagggtgctacttcccgcccatgcatgctgatctcaatgtgtacctaaaaccaaataaacacaagagtaagtacgaaaatactcagcaggtacaatatgaaactagaaaacacatatacacatcatctatactaatataaataggaggagtttgcactgtgcaatcaagcggccaaatcatgagaatcttagggccatgcgcagggtcttcgcgccgcctccgcaaattcctcccctctaaacccgatgcccactcgcatctcttccccgcactccgtcaccgcatcgtcgcttccccctccctcaatcacgctgccgatagcttcctcggctcctcccccttgatctcgccatcgatgacgcaccacctacactcgattttgccatccacaaaattgctcggcctcctccccatctccaccttgttggtagtctccatcactgccagacaacctcgccggccgctttcatcgctctcctgcgtcatctgccggcatcgccacccctcatccgccacgcccctggtggtactcccgtccaccgccgggaaccattctccactcctccctccccaggtgtgctccaatccaggactccctgccatagtcctttgcccagatccaggctgccacgtcttcgattatcacatctgcacttgatcgtggtcttcggcgagggcctgcaagggagaggagacctgacagcagggattgaagcggtgcgatggagatccaccgggagggaagaccagtgcatgctcccgccaagcgtgttctcgactgtgcctcctacttcccacctcaaagaatcagttcgatttaatctaccacaggtaatgcttcacttgcaaagttacctgacaaatacaacttcttagtgcttttgaaagttagtctggtcttggatcttcttggtttggacttgatcaatgaatagtcaggtgatgtatattactgttgcatgcacacggatggaagaacccacaaataaaagcaaactgacatatctaaggccaattcaccgtgcactgtcctaggggcccacatgtcagcctctaggagaaaattggtggagagaggtggtggctttgtttctgccgaactagggttcggcttgtcaaaccaaacacggcccctcttatctccaccatccatgtgacgcttcctctggtctccccaaatgacagttatgcttgattatcttgctctcaaagcacacgcttaagaagcaatctatctatttctcatttttattactctctagattagtgaagctatatagaagactctgaaaccttcgttaggaatggctgaggaagcgccacgtgaaaggtggggatgggagtggcaaagcctagtgaagccaaaccagagccaccacctttctccaccgaccttctcctggaggctgacgtgtaggtcccagggataatgcatgatggattggtctaagatatatcggtttagtctcacttttgggcccttcagtccatgtgctctctcatgattggccggaggtgttctttgcattccggctcattttctccttcattttgtagcaattccttgcatccatagtattttacaagaacaagtggaactacattatttgaaactaatatgcatataagaaatgctagttctctaattatcagttgaaatcagtacttaacgaccgtcaataaagtgtttcctgatgtgcctataggctcaaccttcacccctacaacacttaaaaacttcaatcgatatccgaacaatgtgtctttctgccccgcctatccctgattggaactgagaatacgatcatgtgtctgcgaaagccaagactgagaacggaaacggcgtggaaaaccaaattgatgtaatgtataccgcaacaatgtcgtctcctgcaacaagatgctctggtaggttgacctcgaatgacatagagaaaagggtgtagagagaaagtatttttattttttctgtttgcttactataatgccatgccatgtataatgaagactaggttaaatgccacgcaagagtgcaaatggatcgacccacgaaccctacttatttgacctataagtgggttcgcagggtgatccacttgcgctagcttttaatgctatgaaagtgccacatcagataaaactgttaataaaccaaattaacccagttttgatagttgaaagagtatctatatctggttttgtgacagagggacaaaatcatacttggctatagattagggaggtaaaatgaacttgttttctctcggatggcatcacctagtaggcctcttgggcaagccgatgaaccctgagcagaagcccattaatcagccactctttcgagggagtctttgcgaaactcaagttattttgtgatttatattcatttagtaatgctgtatcaatatcaagtttccttcgtcagatatgtactgctaatcagcaaatttatacctgaaataattcatccaaactgctttgctatctcatgtatttgttatcaacataaaagtacattagtttattggctgacatttttattttctatggcatataagccatggcatatggtccgagtaacccaagtaaactggacactagtacggctccattcatttgtgtgttaaggctgtgttcttcccctgagatttcccaactcacctcttccctttttcacgcgcacacttttcaaactgctaaacggtgtatttttttaaaaaaatttaaatcaaagttatttaaaaaattatattaatctttttaaaaaaaatagttaatacataattaatcatgtaataatacgtatttcgttttacgtgccggtgaggaggggtccgaacgcagcctaaggggtgaacaactccctcatatattagcatgtttactaacatgctatacgttctttttatttaagaaaaaccttctatatctatgtttttaacaaacaaataaattcattttaagtttacaataattaatactcagtcagctgtcgtaccctaacaactcgcttcgttacttatgccgtcaaaaaactcatgccaattgttcattctaacctagctttaacagcatattttcttagaaacaaaatacaacaaatgtaggcgctaacgtgtgcacacataaccttataataacctttaaaaaactggcccaacatatattgagattgacgaagttaccacgggtacctcgctgtggataggtacgtcatataccactggcagaataattagttacaaatgcgagcacccatgtcaaatctaggtacccgtgtgggctagttccgccacaagaaacctaaccagttgaactacgttcactttgcttacccttaacaactttgtctttcttagaatatactcaatataaagataaaagttcgtaacaaatccaataatgttattttgtcttcctaaaatttttcaaatggaggaagaaatttttaaagtaagttagcttcgtattacttccatcgtaatactccatccgtcccatagtataagagattttggatagatgtgacacatcctagtacaatgaatcaacacatccacctaagatcccttgtactatgtggcggagggaataaatacctcaagcccctaaaggcaaaaatgatagctggcctatgacaagaaatggctctaactcgaacatttttagcaatagcccctattctaaagcacttaatgacttgatgggatcgctcccatcttttgggtataaaaattaacttagaacttcagcaacaacccaacaacccctatttctttggtcccatttctatttctgttctattttaatatacacactatatatttatgcctagtttaacactagaataattcaaacacgtagaattattcaaccatatctacagtctcatcttttcacttatacttatacttatcagccaaaatttaaattttcaaccttaaatttagagttgatcttggggttttttttcatcgaaatttatttttcagcctttgcttttagaactttaagaacatatatataaaagttttattcacaaattatttttcatttgcaaatatgacatttagcttattcctcgaataagcgaaacaatggggaccctaatttacaattttgaagaccataattcaaatttaaatttaagattttcaccatttcaaaatgcataataaaatttaattcccacagtaacacacatatgcaagttcacaagcattatataatctttttctataaaataacatattctacaatgatgaatggttcgatctggataactggcagctagcgctagatgtcaccggactttctgtgccgaggtcgcgaccagcggtgtggcagcatggagattacgtaggttgacaggcgacgtcagggtgagcagcgttgtactgtcctaggaagacggtggtcagaccatggtcagcggagcaacaaaggagaaggacaatgacggtgcagtgagggcgcaagaacaatgagaaaatcatgacaacacctttcatataaccctccctaaccaaacataaccacctcaggttgacgggcgacgtcagggtgggcagcgttggactgtgctatgaagacggtggtcagaccatggtcagcggagcaacaaaggagaagggcagtggcagtgacggtgcagtgagggcgcaagaacaacgagaaaattgtgacaaaacctttcatgtaaccctccctaaccaaacataaccacctcaggtttcacccccactcctcaacaggcagtggacagccccctctcgtgcctaggtaaatccggaaacagcagagaccaaagctagttccgaactacaccatcgcctctacccttgccacagtatatcgactagattaagttatactctagatttagcctggaacccaagctggcttgtggtaagtatgagtttatcttctaggaattctcgagaacaggtccttaattatcatgggcacgacttgcaaaaccatgcaccaacaacccaccattaaagcatattttagtttaattaaaccataaccatggtggtacatcatcaatataattaaggactaaattatagtgaatctcattgtgatctaattgatctaagtatggctaagcattcctaaatcaatcatctagtcaattatatccgaagttatcaatggcataaggtaacaaaaggctgactacgatagttctcaatcccacatgatattctaaaacaatgcaatttaatagaaagcaggggattttattatagtgaatctcattgtgatctaattgatctaagtatggctaagcattcctaaatcaatcatctagtcaattatatccgaagttatcaatggcataaggtaacaaaaggctgactacgatagttctcaatcccacatgatattctaaaacaatgcaatttaatagaaagcaggggattttataaaataggttcaacatgatcaatgttgtatgtattacttgccttgctcttgagctgacggaacctcagcaaccatttcgaaataaactagagtgtcggaactgccagaatctaaacgacaaacaaagcatacaataatacatccaataactctactgaaacagcaaaagaaaccaattttaattgattctaaatattttaacgaattcactgcaacttgaatggattaaaacggaactcagatgaattagatatgaattttagaatatgagctgtgtaattactattcaccataaaaccttagtcaattattacacatttagccaaaaagatcaatggaaatgtatcaccggtaaacaagcctcacaggatagcaactcaacgagtcaatccactgtgacacgggaccactcaaacggtcaaccgaaccggcgaacgaaccggtggcttagaacgactccgaactactaactgaacgggacttcagctatactacgtgtgaacgaatggttaacggctagcgaacgactgtggcacaaccggtagacttgactctgtttgcagcaacggataggtacggcaatcggtaggtcggtagcaactcggaagtatggctgtggctaggcaaagtggctaccgagcgacgaacagcggctaggccgtgacggtgacacgatttagaaactgcacagccgcagcaatcggcggcatgaccggcggtaagcgacggcatcgctcggcaacaagcggctgtggctagcggctgcggcggcgcggcacagcgacggcggcggcggcggcagcaggggcggcgcggcgacagctgcacagcagcggcagtggcgctcggcagcggcggcgatggtgcacagcggtggcggcggcgtgcacggcaacggtggcaacggcgcacggctgcagcaaagctagggtttggcgacggcgacgcgattaaggttacgacgacaatgtgactaggaaatttaaacctaaattgagtgaacatagatggattcctcaccaaaccaagacgatcggagaggaggaggcggcgatgacgatcggcggcaacacacggagacgacgcgatgctatacaaacgaggatataggttagattaaaccctagggagaaaacatgatggtgaaccatactggcgggagaggaggcagctcaccggcgacgcgacaacgacggcggccggcagcggcgcggctaggggaggtggctaaggctttgcgcggaggaaaaatagaaaaaaggagggggtatagggacttaaataggaggaggcggaattagagtaggtctaggttaggtggggtcgggcgcgtgaggggagaggaaggggcggcagccgggcgagagcgggaggggtggcgcgcacggcagggaggaggcggaagcgcacgggtagggtgatggggagagggattaggatacggataggagggaccagaaagaaaaggaaaggaaaaccaatgcggtgccgtttcgggaaagaaaagaaaacggaccggaaaaagaatatgacttggctcgtcatacaaaatagaactgcggtagcaaaggggttggcggatacaaagtactgtgaacagggagagtgaaccggggacggttcacgaccaaaggagagagatgaaagaattattaattcaactcctaacatttcaaattaacattagtacttcctatactctaaatattccgctgaacatcttgttagtgatttaaagtaaagagaattcaaaaaaaattctccctaacaattccaattattaaccacattattatttagagtttcctcttggttaacagagtattttctatagacgatttagcaatgatttagaaactacggaaaatgaaaaaactccaggtgtgacaatataacccgacccgatcagaaccatcgtcatccaataaattaatcttttaggattcacatagcttcgagatatcactgccaaaaatccgattattctacgcctcgttcgccgggggaggggaaaaatcggtcgctcccccccccccccgacgcgcgcgcatgtgcgccctgggccccacgatgtgtccctatctacctgctatgtgtccccaccacatactccgttgcaacaaatcatccacatattttggaaaccctccactaagggaattcgtttcattttttgttccaccaataatatttcacctagtgtactcacaattttttactatgtataggtcaaatgttgcagtgaactgaaacattcttttgcaacaaatcaccgatatattttggaaacccgttattaagggaatttgttttattttttgttcaacaaaaaaatatttcaccttgtgtactcacaatgtttcactatgtatagatctaacgttacagtgaactgaaacattcttttgctatttactgaaacattgtttttataaaaggtaaaacaatgaccggtttaaaggattgaaacattttcgatttatttagtaaaacaatttcgatatacttggtgaaacagcgtgcaatatttaaaaataattcaataataagctaaaaaaattcatcggaatatgtccatgtgtggttttgttttaaaaatttaattgtagcgaatttaatggtgtaatcggatcatgatttagataaataatttaagagaaaaaatagtttgaagtgatttttcacgtatgcatcatgctgatatgctgatatcagcatgacatcagcgctcgatttttccactccatctggcgcccgacgcctagacccctctcccaaaattctctaacgataaccggagtggacggattgttgccgggaaagacatccgagttcgttgcgctacagtgcagagaatcatgattcccgcataacgatgggcccagcagcacgatacggatcggggttgtcatcgcgtatgacatccttaacaaatcaagtaccagatacatataagcatgctggcttagagcgggtataataaccagcgataacaacaccacgtaagattttttttgtgacgtggaggagagatagttgaagagagagaactagcgggcgcccggctccacgcgcgactcgaggtcgtgggcccgctgctcgcagccatggcgcccacatgccctcatcacatgagtccgtccgccctcatcggcgaggtcgtcgcctgcggctgccgtcggggtcgtcgccgtcttccgcgtccgaatcgaccgtcgctatcttccggcttggccgccctgtcttcggcgttcaccgtcgtccagatcgaccgccgccgtcttccgcgtccgccacacggccaccggcttccgcgtccgttgcacagccaccgtcgtctgcctcggccgcctccgccttcctcgttagccgtcgcctgaatcggccgcacccgtcttccgcgtccgccgcacggccaccgtcgtccgccgtcgcccgaatcagccactgctgtcgtccggctgggccgcccccgtcttccgcgtccgtcgcacggccaccgtcgtccgcctcggccgtctccgtcttcctcgtcaaccgtcgctcgaatcggccgccgtcgtcttctgcgtccgccaacgcggccgccgccttcgtctcgcttgtctcccgtgttatctgcacgcccgacgtccggcccgaccaggcgaccaccgccatatcttgtgtctgcgcatgggcttcctcgtcatgcacggccgccggtgtcaaccgcatccgccgcatggccgccgccatttcctgcgtccacaccgccgccgagcatcaccttcactctaccggagtcagccatgtaaagaagtgaagacaggcaaggaaggggaaaggaaggagaaagcaaaaggttggagaaaatgatgggtcccactacaataataaaatatttatgtacatattagctacactagatatgacatgtctaatttttttaatttttttagagttaacagcaggctatattattgcccttgctcttacgcacgggcacggtactgctccgagtctgtatcagtaataacagaataatcaacacgtctctactatgcatgaagcttggacagacacgtgcacacacagccatgcaccaagctagagaggactacattcggagtacatcaatttccaatgtcacatacaaatcaacagatgtatttcgtatcggtaaatctaattggagagatctccctaattagttctaaccagatatattcacgtgctagtgttttagaagttttggttgctattaatctattgagcaagtaggaaaaataatcctatcatctatgcttcaaataaaattttctcttaaattactcatccgatttacaatccaattacaccgttgtgttcgtaataattaaatctttacaacaagatctcacatgattatattttgatgaaaaatcacaaattactttttcttagacatataaaagtaaatttagtaaaatataaaagtaatgtacatatattatagaagtaacttataacaaaagaaagtaactttaattaatgcctttttccattgaacaaattatcatatatatatatatatatatgagttatttttagatttgattaaaatacttcctatacattcataaatgctctgaggtgattacttttattatttttttagttaattccataatttgtgctgattaatttaatttctagataaagtcgtgtttttatctctacaacggatttacttcaaatgacatgctaaagttaccttcgttttgttctaagttacttctataatatatgtaaattaattttacgttttactgaatttacttttatatatctaagaagtaacttagtgaaatctaaaagtagtttagacatatcataaaagtaatttatgatttttcatcaaaatataatcatgtgagatcttgttgtaaagatttaatttttacgaacacaacggtgtaatcgaatcgtagatcggatgagtagtttaagagaaaaattatatttgaagtatagttggatggtgcctcttatagatggagtggttagctgtatagttacgtccatttcgtattaggtttttaaattaattaatctatatccggcatatatcaataaagttacacaacatattaaatacaatttaacggagcagtaacttaattattaaatttacctaaagcatatttcatacaaatatctattgtgcgagcgtttcgtgtattaggctaactatggtctaatactgggggctctctatttcttctatataaatcatgcttgttgctggtatttcttatggtcatagataaatccacaaacgaacggatactgctttagcattttacttaggagtattccgggagtatcatatttttcatatattcgtaattatgctataattactttatcatagtctaaacaggggttaagatgataatggtagtttaggtagtgtgacacgtaggagattcatctcaaataaagatacactagacagtggagaaggactaaagagacctaagattcatacgtacttcgttattactaatatttatttacacttaacacatacatgcttacaaggttagaatttagttctaagttacctaggtactaccgagagaccattggtagtctactagcatggttacgtcatacttggatgtggaggaatacaaaggatggatagggctttcatcacctgccacctatctcactttccgtggggcataccgcatccaatgatatttaactaacctgagcaccatgcttatattaataaataatatcactaattcccctggaactccaacccttcaaatgaataagtttgaactactgcaacccgttatgataattggaccattactgtagcataaattgactagcctaattaggtgaagcatataaataaagtatgaactatttataaaacacataaccaataggaagtatatgagctatgaacactaataagtaaacaaaataattcctttatttcaactatagtcttacaagaagagtgaagtactaaagacatacccgaatctccaagaaaatcaggtgaagcatataaataaagtatgaactatttataaaacacataaccagtaagaagtatatgaactatgaacactaataagtaaacaaaataattcctttatttcaactattgtcttacagaagagtaaagtactaaacacatacccgaatctccgagaggactagagtaccgaagactactctaaggctaactccactattactcgagagaatacaatatatggaatgagagaatggctctttgatgtgtgtattgtgaagtgagaaactctcatcattaaatagtcctgtaatgatggttgtatggtggttggaaggtggagatgtggggagctgatggcggttcagccgaacaaggggtccggccaacccctgggcgccacctttctccactgcctttcaccaaaggctgctaggtgcgtctctgtagcgattgaggatggtttggctccactttagatcagtttcatatgacttgtgggcccatcgatctgtgtactcgcacatgattcgccagaggtgtgtttatttccatgttggctcttttctccttcactttagtgtataatctttgcatacatagtaattcgccaggacaaatgaaactacattatttataactaatatacgtggatgaagtgttagttctccttttatttattgaagtagttgatggtcgaaatcggtacttaatgaccgtcaacaatacccccaaactaaacctttgctcgtactcgagtaaagataaactaggttgttgatcaggagtttctaccttgttttatgtcacaatgttgccatgagtagaatatgtctttctatatataatttgaataagttgataatagtacttttacctctcttaccttatttcccatggggcttttaccttctccttgtcttactctttattcaactttctttccggagggtttcacgaattatgcaaataaaacccaaagtttctcaaatgattctcgcatatcgttcaatgcgtataattccttaccaaggcatagtattgccttcttttttttattctatctctaaaatgtttatacgtggagctcaaggtgggagaaaataacgagacaatacttgtattacatatattgcaaaatcaaaaataggatctaatgagaaaacaaattatacaatcttattgaaagtgcatctaggacccctcatttattttggtgttaatgacaacacaattagagggtaactaatgctttttgttgagatgtatgcaaggatgaaaaaggagtggatgtcaacacaataagtattgcggcatcttttatggtaattgtcttctaatccatgtatatcttgtgttcttgagtattaggatgccgtactattaagagggatgtcatatgcatataattggtagaacactagtgctcaaaatcatttatttgaagtattcctgttttatgtctgtcggactatccgatgttgatcagactatccgatgctcagactatccgaaatttcacagaactttgctcactgtcttcggtctgagtgttggctaaaaaaatatcggactatccgatataaggtcggactatctgatacgtcggactatctgaaatttctcagaacttcactctctgttttgaaatgctttttattccttttgagtgagttttaaatcagactatccgatgtgatcggagtatccgatgatccagagactccgaaattcaatggaacttgagtctctgtgagaggatgaaattcttggttcaaaaataacggaatatccgatatgacatcggactacccgatcgatcggattgtccgaaattctccagaatttcattctctatctctggcctgcttgggagtcaaaaacatcggactatccgatgtcacctcggactttccgaggtgggatgaaaagattctctcccaacggccacattttgggggcttctataaataccccccacctaacccttttctagggttacccaactcattcattcacattcactttgggttgagcttggtgctaaagtgctttggatctttgagctctctctccctctctcaaatccctctttgttctttgtgtagtggatcttggtggttgtggatttggtgtttgagggcctagtgtgtgtttcactcgatcttgagcactagggtttgaccaagagttgtgtggtgtttgttactcttggaggttgaggactcctagacggctaggtgtcactcccgagccaccgatctacgtgtggttggccgggagaagtttgtgaaggccggatctcgtctccacaaggaaagagataccccttagtggaaggaggagtgcttagtgccacctcttaaggaaagggttagcaaagacccggctcttagtgagctcctcaacggagagtagaatcccctcaaggatttgaactccgggaacaactcggtgaactttattgttggtgatatctcttctcctattatttagctttgcttttgtgccactttagatctagtcgctgtttgcgccatactcttgtttgtgcactagatctacttgtagtcttcctttagtggatcagacagtctgatccaacatcagactatctgatattttcggatagtctgactgtggatcagactttccgaccctaactcagttttagcttccgcataaagttttaaattagcctattcacccccctctaggcttaattgaccctttcacttattaagatgtacaagtgtggctatatggtggaaggtggtatgtggttagcgtgagcacaaatttcctggaaaccgaaccgagccgagccaaacggagataatggttttttggggggtatcgttcttttttaggtgttgttttttacatagatcggagttcggtgttcggctcggtgtttagaaggtggaacctgaacataccgtataatcctaatccaaactaggctgcaatcttccttgttctctttctaattcaagcccacaccactattaaggcccatctactacaatttttcacagcccacatataggaagtccacggctgctagcccatctagccgcagtcgctgaagccattgcgcccaggccatcgcgatccaactctagcacgctcccctctgcacagaaagagctaattggcgaccagtagcgcgcaccctccccgcgtgactggacacgtgtcgcccgcgtgactagacatgtgtcgcgcgcggagggcgctgtcggcgcccgtgcgagtgatttttgttttggtttttctgttttagttttttttcgtttctcttcctttctgttttggtttttccggtttttttctcttccttttttcggttttttaagatgtacgtataccaagttttgtatttgtacgtataccaaattttgtatttgtacgcatacaaagtttgtattcgtgttttttttctctcggtttttaatatatacatatacaaagtttgtatatgcatatgtaaagtttatatacacatatgcaaagtttgtatatatgtatattttttatacgttaatattttggtacacataaaaattatatatactttgtatacacatgtaaaaaatttatattttatcaatataaagtttatataaagtatatacatatgtatatatacacgtatagtattgttatagtagtagtactactactgtagtagactagtagcagcagcgcacgccagtagtagtagcaggagcagagcagcactagcggtaggagcagcggtaggagcagtaggaggaggagtagtagtactactagaagagcagtatagcaccagcggtagtaggagcgaactcaggggcggagctagagaaaagacgaggggtttctacttttctttacgtaataatgacaactacagttatagagcgatattatactaaatagttgcataccaataaatataagcattatttcttcatttgaagataatataccacaagaaatacataaaaaagagttaaaaaatacgtaccctaataaagaaatcaactaataatatttgtaaagttgataatggttcaaccattgacaaagacctccattaacaaaatcttatgaatatatcatgcgaatgtcaacgtcttcattcctccataggacaatgactttgaaaatatagtttaattctcaacagaaaataagttatgaaatgatttggtacaaaataaaacaaatttcttcatattgttcgtactatccggtgctatatagcaatctattaagaccaaataaaaattttcaagtttattttggcacaaaactacaaactaaggataagaaaaattgagagaaagagttcacttattcagttgctctcagggcaagtactataatgctccatatgctgcccctaaatgtgccacattggattgagtgatgaggtggaggagagaagtgaggagagagatggtgaaccacccctaaatgaaaaggcaacctcaacacaaatttcaagaggggtgtgagagtataagagacattggtatttgtgtactagaggagacatagtgtataggttgcctcttaatttatgagtgaatgatgtggataaatttaattgtagtagtcatatctaccataacacttgccctcagctagtgctgctggctgcaatttttgtggggctcagagtagatcggtaagctagggcgagccggcagccggcaagctccagctattggccgttgctagcttgcagcttgccgtcgtcctcctccagtcctcctcctcctgcccctgtcatctacctctatatgcctctatagttgcaagccctagcctgatcagtgcaaaaaattggaaaaaagaggcaacctaccagggagaggctttacacatgagaaatttccccgattggggctgccgggctaggtccccggcgaggcaagggcgacctccagggagaggcgacaggtcagacgagagcgaggagagagattgagcgttgaggcgactcaggcgagaaaatcgaaactaccgctttgatatcacgtgaggcttcgatgggaagcgtcgccgcatcggccactcctgtgcgctaggcgttttagtgtctcccactgcgtaatttttggttttggggctttcttccggttgggtctttcaaggagaggggttccctgtgttgggctagggtggtgcctccatgctgtagatatgagggtaacaaggtattttaaatattgggccgggttcctgggcaccccctggttcattgggctctgcccctgagcgaactggtcgcgcgcccacgctcctgcgcgaccagtcgctcattaggagcgccctgcacccatcagcccttcgctcggttttaccgagaactgagccgaagtggtttggcttgttttggtcggtttgtttgttaggtaggtacaataacacactataagccagctataaacacatatcgagtagatgaaataaaacagataagcagcgggatacaaatttgtagccagctgcagcacgggctataagacataatgtgtgaatgataggtgggaccggatattaatagtgtagtacatatttataggtaactattgtatgaattagctactaaattggctataaacgatttggaactagtaattgactatactactaaacttgctcttatatttgaaaatttcggttcgcaactaccaaaaaggagaccatgactacgaggagagtgcgcgctcgattgtcataacaagtgacctcactctccaaagtctagattgactcatgtttttacccctagaacggatttacttctaatatcgtgacaacttaattccatttgtgctaaattacttttatgacttatgtaaattacttttatgttttattgaattttctttcataaatgtctaaaaagtaattttaaaatgcatacatattttttattagaatataatcatttgagatcttgttataaagattttgttgcaatgaatacaacagtccaaccagataggaaatcggataagtattttaacagaaaattctataagaagtaaaaaagacatgtatgacctgatagcaaattatagatgtatagtactagttctctcacatatgatcggtgttactcgataggaaaaaaaaacgagagcgctatcgatttagattttacgtatcgaaaaccgacctttttcaaacaaaaaacaccgaactaagaaaactataaaaaccgaacgcccactggtactactttgccatagattctttttattcctaattggacatatgactatttttgttcaaactatatttctctcatgctgcataagaacattggtgaacatacactccttttctcctttttctttttattttcttctcataatgtttgagaatattttatatttctttttttatatcacagccatctcttttactaaatattaggagagacattttgactgacgtgaatggtgtatttagttgtggatataatgtagagacaaaacattaaccgtaagtacgaacacacgtaccaacatcaaacttttatttgaacaataaaacacaaactttcttcctaagatgacgaaacattcaatggtgtgtggacggctgcacgcagcacgcggatgatacagaccatgcagagaatgatcctaccaagaaaaatgagagacgagaaaaacgtcgcggaaaaagattaaaaaaaaagagaagaatactttaatattattcgtggctctcctcggcattgcgagcgcccatggattggacacgcgtctctctcgcctccttcccactcccaccaccaccactgcctcttcctcttctccgggagtcccaaactgcagcagcgcgcggcacaggagagcgaggaggaggaggagatggcggaggcgaagcagcagcagcagcagccgcaggcggcgacggcggcggcggcgagcggggtgtggaagacggtgaagcccttcgccaacggcggcgcctccgggatgctcgccacctgcgtcatccagcccatcgacatggtcaaggtacgaacgccgccccacgggctggggctccctgcctccgctggaggtttggtgtgagggttcgcgcgcggggctagttggtgcgctaggcttgtgcggaatggcttctaagggaaacatgagcggtgtgcggatgagctgtttgatgcattgccgacgtctccatctgttgaacatttttgtttcattgcttggttagagacaggattcttaacgattttcgtactggaatcgggagtgtgatattgagttactgattgtctctgaggtattttctatttgttcctgatgtacccgcgacgaatggctgtcgatttgaggaattttatcgtttgggttcagtttttgcattcgttagtatagaaggttttccctcttcaagattttagtgctggccccgaatgctagttcgactgtttagctcaacatcgagaagatgatgtcttgtaatatttttcatggctgaggagttagcacagttggaaaggaggtcccttgtagttgtacatctcgtgggagattccttactccctcgaggcctcgattcggataagaatgtcattttggagtttttaaattcagtaagacatagctttggctgcttaattctttttcataaatctaaaatagttacgctagtgtaatattataatgtttcctcataacaaacttgaccatgtcattttttcaaacttatgttataaacaaattttatggtcaaagtcaatttatgtggactacacggcctctaaaacagcattattccgtggccggagggggtactattattactgccaagaccttctaaccttcatcggttgctttcgttgagaccttcttgctctgaattagcagttgaatctgggtttgcagctgagctcacgtttgtgggacaatgtttttctgttttatgatccaagcagttactgatttgttgatgcttgtgcaggtgaggatccagttgggtgagggctcggcggcttctgtcaccaagaaaatgcttgcaaatgagggaattagtgccttctacaaggttcgttgtcttgaggccgtggtttaaaaattccagtatttgcgttgtgcactaacccagtactgtagcatgttacacacgtacggaacctgcagttacatcatctggatggaaccccgtagtcttgtaccacttgactattacatggtctccataattgtcctttgactgctaatatctattgtaacatagttctaaattattctaaatcatcagctttcttgtcactcaaactgttattgcttaaattctttgtgtccagggcttgtctgctggtttgctcaggcaagcaacatacacaaccgctcgtctcggatcctttaggtttgtacgtactacttagcccataatatcttttgctagtaagttaaagtgactgtcaaataattaacagctttgacttgacatcctgttcttttcagctgaataataaatcagcagtatgcaatattatcttgtattgaaatgaaaacctgtggttttggttgataaaatacaacagcaaagtgcaatactatcttggatcttataactgtcctgtagatgcatatatttgtttttgaagcaatgacacttcatacctagcaaactcagcctaagtgcattaccgcccgatacccctactagcaggtattcagctaaagagtatcaaacaaaccaagtgtagtgcacctctgaaggactcctcttgtagtaaccatttaatctatcgatggttttgtttcaggattatgtcatgttgaacagtttgtcaagcagggtcactaatgtagataaagttacattgccttaattccgtaagttgcagcaaaatataactgttggattcttgagagaatcaataatagaaccttctgtcctgttgtcgggaggtgtttaacctcctacccagctggattcaatgtcctagtacaagtgtcggtgcccatcaactcttgttgtgaataatagaagtaacctttggcaaattttcaagaaagaatgctgcaatagtcaagttttctgacattgctctatgccaagcaggaaaggttaactgttaggctttaccataaccatgaatatcaatctggaaagtcacttatgcaatgttttcagctgttttgatctgatcttcccttcctatactttggttgtgttatttggttgagtttcttcacactgtattccctcagggttctaacaaacaaagcggttgaagcaaatgatgggaagccactgcctctagtccagaaagctggtattggtctcaccgcaggagcaattggagcctgtgttggtagtcctgcggatttggcactcattaggatgcaggctgattcaacgttgccagcagcccaaagtcgcaattataagaatgcttttcatgcactttatcgtattgctgctgatgaaggtgttctagcactttggaagggcgcaggtccaactgtagtgagagctatgtcgctaaatatgggcatgcttgcctcctatgatcagagtgtggagttatttagagacacacttggtgctggagaagtcactactgtacttggtaagataatactcatttgaatttcggtttcatgcaatctttctgatttacctgttctctatcaaacatttctcaagcgtttgaggatgtggatccagagtgacttaatgcttgcaactttctataggtcgacttccagacatatatatcaacttgtgggcacaaaagaacaaagttgatcaattaaaaatttcagatgtcttcatatagttccactaatatttttatattttgttcatgatctctacctttgttatgctctttggacttaaactctacttacctgttgaaaataagcacatgatagtaggcctgctaaaagtctcctatcatgtgcttagtgtgtgcaacaaatgtgttgagtagtgccaacctaaatattatttgcatgtcaaaattgattttatattttgattgcaggggccagtgctgtttcagggttatgtgcgtctgcttgcagtttaccctttgattatgtgaagacacagattcaaaagatgcagcctgatgcctccgggaagtatccatacactgggtctcttgattgtgccatgaagaccttgaagagtggaggcccatttaagttctacactggctttcctgtgtactgtgtcaggattgcaccacatgccatggtaatgcaattatcacacatttcttccttgcttagcagaaaacatcacatctgcatgttctaccattcttaactaatgacatcttttgtgcagatgacttggatattcctaaatgagatccagaagctcgagaagcgtttaggcctctaagagctggttggttcggtcatgctgtccttacctaagacataacaacagtccaggtgtacatagtcgagcaattgcttctgataaacaaaatctttagcctatatgcttccttggtgctttgagccattgacaccaaatgatcacctcatttattgttctttggatcatttcttggtaaattttgggcttacatactgttatcagtttaacacgactaccaagtaccatgagaacaatacgttgttgaatgttgattactggtttgccatttgtttgacactgttattacgttgctttatctaatcttttctttagttttgttgagagagagagagagagagagagagagagagagagagttgcttgattttgttttttgttctgtcgtgcactgaaaggaagcatgaatatagcagtaaatccttacaaaatataatcatttgtgatttgatatgatcggtcgttctttgtctccacatatgtaggtttattctccaattcaccatggaccttatatgcccatgaaagcttaacgcaacccatctattgtgttaggtattacatttaggtgctatctgagaattccattcggttcagccacccacatccataaattttgtgctatttccatttccaagcgccccctaaatcatcatatcattttacttttaggtacgtgaattacctaaaacttaacaaatcacatggatgagggttgcggcaaggagacccgctctcgccactcctcttcatccttgcgatcgtcccgttgcaacggctgcttgacaacgccacggatttgaagctgcttagtaagctgggaggtcgatctgcacgccttcgaatcttgctttatgcagacggtgcaacagttttcatcaaacctgtcaaaagtgaagtgcaagctttcttcaacctgctatgcaaactcggccaagcaactggtctctccaccaacattcagaaatcccaggtaaaagtaatcagatgtgagagcatagatctgaataacgtgctacagaaaacactagtcttgagagcatccctgccaatgacatacctagggctacctcttgctgtcggtcgttgcgtaagttgtacttacaacctcttttcgaaaaaaccttgggtagaatggcaacttggcgcgggagaaacatgaggctaaccggacgcactacgttggtcaagtcaatgctctcctcgcagcccgtttaccttttgacatcaatagaggtcactaaggaatctctagaagtgcttgacaagcagagaaagagcttcctctgggtgggtatgggcaacataacgggtggaaaatgcaaatcaaatggaaaagaacatgctcgccaacaacctatggtggcctttcattaccattggggatgggtccacaacccgattctgggatttagtcgggatgaatgggctatgaccaaaagatgccatgccgcaagcatatgcaatatccaaacgaataaacagaaccttgtgggatgtgatcgcggataatacttggtgcatggcctaaacctcacaaccagacaacctatggagctctattagtcgagctacactggtttagttactcatagatatgattgtaccatgtattatgtttataaattaataataaagtgttccttgaaatagataattcattgttgaccaatgagtgtgtgacttattcctgagaatctttatgtgatattacttgttattttcataagatcaacgagtgtctatcatatatggaaaaatatgattccaacatcagcataggtattaattgataatcttgtctcatgtgtataatatagagatgccaaatcgtccacaagttgtagaccatattattggatacacagaacataagacattctaaggattataaattgtcatcggttgatctcaagtagttttggtgtagaatccttgtagctcaaagtaagtcactttggggctaccaaatgcactccgtaattggtagttagggtttttcatgaagtatgtagtgggatgtgaataaatgagatgggatttcccttttagttaatgggagatacatcttctaagcccctcgattttatagacttcgaaaatgcatggtcattgtcacgtcctgataaattcattccaaattaaaaatcattttttaaaagtaataatataatttattaaaatcctaaaagaaattggcaacattaaaatgcgtacaagaaaaatgcgaatgtggtccagagtatttttcttaaattctccatgatctaaaaagagccctcaaattttacttgaataatttctaccgtcaatattacccaattaatgaagactggagctccgcgttttccggaagggtggtgaggtgattgtgaggcgatcttggtgatcgggctcctctccggtgatggtgagcccagggccgccgggagggtgggacttctccctggatgatcacattggggatgaggtcctctccaggttacattctccggtgcatttttcccggtttttctctcgtcgtccgttcatcctagtggtggatttccctcgttcttcattccgtttatgttcttcatctgctgctcttgctttgcgtgcttgcattggtggttctccgggtgatcttcatgttatagtttcttattgtgttcaaagaaagttgggctttgggtttacaccctccaatctttctcctgcaaagattatgaagctcagtttttcctttggagagacagtgatccaaattggcgcaaagagtatgagatttggtcaactgatttggaggcagagtggaccgtagtccaatgaaagaaaaaaaagatgtcacaggtttttaaccacaaatcaggaatctgtgtactcagcagcattctagtagcaaattttttttttcaaatcaaatcaaagtaaagtttcgtgagctctgagcgatgtttgaaaagataatcaaagtaaaatcaaagtagaaaaatcataaaaaaaataagatgaaatattgccacccattgtaggtgtagtaggtgctggtccccgcatgaccgaaggattttcttagagctcactctagtgttcgaatgggcaattctcttattccggttaagtttgtttttgattggctttcttcttcttttccggcgatcaccgtcggtggtaagggtctcaatcattctgctgtcgacggcgtgattcatgcaggcggggttaatgcaggatcatcaagtatttcaatttcaaagtctaatttcaagggagtgattgatgctggttcttcggataagtctaaaggtaagggcgtggtttttgctgactctgttgataattcaaattcaaaagtgttgaatccgccttcctctaaaaagaaagcaaaccccactgggcctccttgtcccaagtgtttaaaattgggccacttggagtctgaatgtattagtagagtgcgttgtgcctcttgctacaaactggatcaccaggctttggtctgttggaataaaaagaataagagccaatcttgggtccacaaggcccaacccacttcgcagcccagttttttggagattgtctcagtggctccgaagttatctcatgtggccgtaaataaaaatattttaatcagctcttgtccgattacttgcctcgattctaggcagtttccgtccaccgcttcttcttccttgcttcttgctcccagtccaatctacagtgcctaagattctccaatggcgaatgttaatccagacccaaccctgttcgtgcccctgcaatagccatcaatgatgcttggatgcatcgcctccctcgtgcggatttgattatcacagatgatcccccgaagaggcatgaagatgcttcttgcccccttcgctgcttgaactctatgcccagttcatccagatgatagtagattatgttcagaatactcttggattccatgttttggatactagtaggcatgcttcggagtttgcttatgttcacttagcttctgttgttttaagagatgccctagttcttaggggggcctatttggtcaattatcagtttgtactaaggttctcctaccatgacaacacttctacttgtcgtaattctcctccaattagtcaaagttgggtgatgtttctggattttcctttggatcttcaaactgaccgcattatagacaaggcagtaggcacatttggtcgattgcttagatggtctaacgacccgaggttcagaggcagagttctggctaaagtcatcttctccatggtagaagaagtcccctccaagatagtgattaaaaagtacactagttttgggggagttgggcgatcctggactatttctatttttgtcctgaatggggactttgctaatgctcagccggctgatgaagacctgccctagtaaaccatattccaattctggagccacaacaagttgatcaacaaggaaatgctaatttggaaaatgctgatgaagatatgggggagaacagcaataatgaagcccatgaagagcagtctcataacataagtgttgtttctcaacaatacttaggggattggcaaataattctagttttgcaaagtcatgcacctattgtttcaattcctggtagatccattgtcaataaagtgcaggatgtatctggaactattttatccttgctagtttacccccaattctggaaattgctcagtatctataggtttgttctgggtgggccaaggctgaatgctgctagtggatgtattctgggccagaccaatgctttagcccactatcagctggcagttcatcagatggtccagtttgctctgctggcctcttctttgatctgggccaaggataattggactgctcaataggctttgacagttcagcccattcaagctgtttaccctcatgctgatcctacccccttggagctcccagctaatccttttcaacaggacatatctccaaccctgcttcccaagcctagcaggggtaaaagaaatttgggaaaagtggttcttattgactctggtagaagaaggagtgcaagaatcaacaagttgacatatggcttcatgtcccctgatcccaatcagggtgtgggtaagcctaaggagaaaaacaaaggccaagagttctaagaagcttaaagctttggctgaagagagtggtattttattctcccttaatccattgcccctggaattcactgatcctcctaattctggtgatgacactgacgctgccccctttgattgttctattcagcttctacagcagataggggttgatctttgtggtcttggcaaggaggaggtgtcagctgaggccttgacttcccagactagagctgggaaacatgttgatgcttctccatgatttgcttaatgggttgaattgctgtttatttttgtgggactagacttgtaattaaagcctgtggggttgctgtcatacttttcttattcagtaccagctcctctcttgtgtctgcctggatatttggatttttttgtgtcagacatggtcactgtgggtgttatgctatgcatggacctttagttctgttctttaatcctggaatgttctttgttggaatgtaagggggttaaattctctagctagctgtcatgctgttaagcagaaaatagatgaaagcgcatgttcaattttttgcctgcaagagacaaagaaggatctctttgaccacagcttcattagatctttagccctaaaaagatttgatagctatcttttctccccctcagtgggtgcttcaggggtgtcctagttggttggtgtagttatgtcttttcgggttctcttgtggagcaaactcaacatgccctagtgataagttttacctgaaagatgaatgggttaacttgggttttagtaaatgtctatggtccttcccatggtcctggtagagatgactttgtaaattggttgcaagatctacagattgataatgactattggattgtccttggggactttaatttctactgatcagtcgagaacagaaataagccaggaggtaatatgaacgataattttatatttaatgaagtcattagctctcaagggcttctagaaattcctttgcaaggccgttcttatacatggagcaacatgcaagttgatcctcttcttgagcaacttgagtaggtttttacctaatactcatgctttggtgatggctagaagtgcctctgatcatgcttcgattaaagtccaaattgctactacaatccccaaatcaaatgtatttcgctttgaaaacttttggctgaattaggcaggttttcatgatcaagtcagaaatgtgttggagggcttcagagttactcaagatcaggcaaacataatttcggccaatttcaaaagattaagaagctctcttaaaaagtggagttcttgtttggctaaactctccaggactacagagaattgtaacaaggtgatcttgtttcttgataaactggatgaattccgcttattgaatgttccagagctaagattcaaaatgattgttaaaagccaagttgcttctcttctaagttggcagtaacaatattggaagcaaatatttaaacagaaactggttcttcttggaggggaaaacacttagttctttcatgccatggccactgaaagatttagaaataatgacatctcctttcttcaagattcaaatggcaatcaagtgagtgatcatgaaggaaagggtgccatcttttggaaagtttcaaggatagaatggggcttactgataatcctgaaatggtttttgatgtctctgagttgatagaagacaaaggggatctctcttctttatgtgcacagataaccactaaggagattgatgagactgtgaaaaaaatgcctggtgacaaagctcttgaaccagatggcttcgatgggtgtttttttaaatcttgctagggaataattgctcaagacttctgtagactttgtactgatttctggggaagtaccgttaacttatctgcaatcaaatattcttacaaaactttggtcccaaagaagcctagtcctcaatcccctaatgacttcaggctgatctccctcatgaatttctttgtaaaaattatttgtaaagtttttgctgatagactgcaaccattgatgacaacattgtcatttgtgtaccctggccggtcacattctgcttgaaattctattcgggaatttccaggcgtgacacatgcgtgcctcacgtgcccctcacgggcgctgcatgcacgcgcgcggcagcgtgtgcgctggtaggtgggacccacacgctgatcgtccccgacctccagccgccggcctcctctctctcccgaaaacctagcttctttcccgaccaaatcccccccaatccgatgcccaaattccaaattaattgggggcaattagagcatgcccatcaaccacccaatatttgattccccaaaaatctgaattaggaataccaaaataaaaattgggtccaacaatcaccccctcctccaaaaacgagggggtccacgggtaatagcaaagtgagcttgaagcactccaaatggttgttcaatgtccttcttagcagcttcttgtgctttggtaaaatatttcctcttatttccttgtggtagcttcatgctcttcacaagtgttgcccatgaaggataaataccatatgtaagatagtaacccatagtcatgccctttgatactaaaattaactttaggagcgtgctcttaagctagctttgcaaacaatggcaaccgtggaaggacattaatatcattgtgagaattaggtgaaccgaagaacgcataccaaatccatcagtcatgtgaggcaacggcttctaaaactaaagtaggaacttactctttctctttatatactagccttgccatgcggtctagtagttcttccactaccaatgcaaacaatctaaagaacccaactttcctgggagccctctttctcccccctgagcaagtaatctagctttgtcattctcgtttggtgttctcatatactcctctccataaacttcatcaacagccaccacaaaccttttaaaactctcaataacggtactacctccaatacgaacatactcatcaattgcatctgttgctattccataacataacatgcgtgatactgttgttaccttttgtaaacatgacagtccaaggataccagtcgcatttctcttctgcacaaaatattcattatgtgcttcaatagcattcattatgcgtaaaaagagaggttgtctcattctaaacctgcacagtaattaacaataataattctcgtctatatcaattttgcaaacaaagattgacaaaacaaaaggcacggctacaaacctgcgtctaaactgaacatcaaggtatgtaggttccttggaaaaataatcattatacaatctccaatgaccagtcaaattttcctgattaattactgtatgacctaaaacatatccaccaccttttgaacttcaccattgttgaactcaccgtgcactatatcaaccgccgaagaaataaattcttcgccgccatccgataaagactcctcatccaatagcatttggattggtgattcggaataagatcctctaacccaactacaacctggcccttacatggtggacattggcatgtcggtacattccacatatttccacgtactccctccgtttcaaaaaaaagaatttgggacgggatgtaacacattatagtacaataaattattacaatgaatctgaacatatgtgtatccagatttttataggatggagatagtatgagcgaccatgtcactctaattttaggtcagataattagttccatgttgattttacagcaatgatggtttctaccaagaatcatcatctaccaggggagatccttggtagtgtttacttttagccgtaacaattagtctggttttctgtactaatttaaattgctttgctatccatgaacaaatatgaataaaaggagtttagtatctatttgaaaagattctgcacagatacaatttatttaaactcatattctatcatagtaatgaaatataattgctttgcttatgacttgtacttcattatggaatttctatccccaacggagtactctagatgatcaatggtgaaatgataaatgaaatgataaagagaataatcgactcttctccaacaaatgaactatcaacctcccaaaaaaattaattaatatattagattagctatctatttttccataacaaaataactatatattaactgaataaaatattgcaatgaaaaaattatttagtaattatagaattctttagtagttaggggatctttttcttctattggtgtctattagtttgtgtttgcttagcttcgtttctgctattgtgaacttttctgtgtgacttatgtaataattgtgtgtaactctttgagtaaacgctaggatgtttcattgaaaaaagtaattataacccgcaaaaaaagaaaaaagtaattatagaattcttgtatttcttcttcgacttgaataccaaattaaataaagaaaaaaatgaagtaaagaatgcattttcaaattaattctacatatgtttttatggtaagactatatattaccgtttagtacgctgtcattttattagtctccgtaaacaaccagtatttattctccaataaccaatggagggtgtggtcatagtgcacatctgggttaaggaggaccacaaaataatgtaggtactgttttcgtatatatgctatagctcagctataaattcacagctagtccttgcttcacctaggaccagtgtgatcacgcgattactcttgtagtaagctgatcatttttataaagttttatgtcaaaaaaaagttgatcatttatattgtgtagtaagacggatgattaatcatcacaccgttatatcttctggaagtgtactataatgtttaatatatctaacttgggatatatactatgcacataaacctgtgcatgtacacacgttatacatccactaaaaatatcatcgaaaattataaatctttttggtacatgtacctttagtattgcatctatgtgtaatgtatcatcttgaatttcttcacgcttagaccttgttcggttaatccccttgagggagggattaattggaagggatttagggggtgtttggatgggggtaaaaaattttagtccctatcacatcggatgtttgtacactaattagaagtattaaatgtagactaataaaaaaaactcattacataaccctggacgacgaatctattgagtttaattaatccatgattagcatatgtgatgttacattaaacattctctaattatggattaattaggcttaaaaaatatctcgtgaattagctctcatttatataattagttttgtaagtagtctatatttaaagctctaaattagtgtccaaatatcctatatgacaaggactaaagttttgtcactgatccaaacaccaccttattccacacctattttggtgtgaaattattccctctcaatccctttcaaatcaaacaagctattagggaaaaaaagcttggtttagttcctaactttttcttcaaactttcaacttttccatcacatcaaaactttcctacacacaaacttctaatttttttattcaaacttccaatttcggcatggaactaaacacagccaaagacaattatgatagaattatactattaaagctaaaaaaacccctatatattcgtagatcgagacattactctattaaattactgtatcatattacaaacataatggagtagtgatcgaagataaaaacgatagaacaaactctcccattaaataggacacattgtacaaagtactgatcatgcaacaatagtagtactctgttgcgtgttgattacccatggaccagagtagccatcatcatcacccatgctgccaatctgccatatgcgatgtcatatgcttgcgcttgcatatgtagagagatttctctccacacggcaaagctagccatccaccacctttgcttgcattcactcgccattactgacggacctaccaactgtagggcgtaggcgcaagcaccactccactgttgcagttctcaaatgcttgcacttggcttccgctcatgctcataaaaaagaaccgctgctaacgttgcgaatgccctgatatagcaagctgttcggccgccggcgcgaagaacatggagtccgtggtggtggccggagatctggccgctgcaccggcgccggcgacgccgatgtggttcgtggcgctggtcgccgtcggcctgcacgcggcggtcgtgtgggcggggacgttcctcgcgtggctccgccgcgcgttcctccggcccgggaagggcctgtgccggcggtacggcgagtgggcggtggtcaccggcgccaccgacggcatcggacgcgcggtggcgctggagctggctcgccgcgggctccacctcgtgctcgtggggcggaaccccgggaagctgtcgggcgtctgcaaggaggtccgcgcagcggcgccggcgtgcaaggtgaggaccgtggtgttcgacctcgccgccccaggggacgacgacgtcgggggcggcgagctgtcccgcggcgtggcgagggtggcggcggccgtggaggggctcgacgtggggctgctcgtgaacaacgccggcgcgacgtacccgtgcgcggcgtacttccacgaggtgcccgacgcggtctgggaggcggtgctgcgggtgaacgtggtggcggcgacgaggatcgcgcgcgccctcgtgccggccatggcggcgaaggggaggggtgccgtcgtcaacgtcggctccggctcctccgtcgtcgtgccggcgttcccgctctacgccgtgtacgcagcgaccaaagcgtaagtcaatccatccttccaatcttcaaagctatcgtgtcatgctcataagtatttttttctagtttaatcctaaatttatttctaaagctgaccaaaattagcgcaacttaacaactaaccttcttaaaacaagtcttagaaaattactgatcgtttcacgtttgttctaagtcaaacattttaaatctttaacccatctactcctataaacaaatataatttaatgtaataagatttatgaaaatactttaaatatataattcaattattggtaaactacatggcctggatttgaaaaaagtgatagtgaaagatatatgtcttacttacaacaaacgacgagtaattaaaagaaggaaaagtgttacaaaactttcgcacgtttctttgctccaagaactttcatatttgtaactattggattgcctcgagatttatatatgcatgaaggaaaaaagtagctacaaatttcttttcacacgtcacgtgtaagatcatggtgctagccaactaaatataagttatatcatagttatatatagcttgattaaaaaaagttacagtgtagttacaattataatatagttacctttcaaagtttttcgacttttcagtcaaaaaaaaacttgtagcagttttttaagatactcccaacgtaatttgactttgttgatccatgcagaaacttgactctaattaaatgtttttctatcatcggaacaaattgtgcaatttgacatctagaaacaaccatctactggcatgtatggagtacagttctacattaatagcccatcaattggcaggatggcatgacaccaccttaagtcaacacaagtgtatcatctagtggtggcaggcgccaaaaggcacgttgcagtgctatcactattcatgcaatatgtggagtacttccttcgtctaaaataataaccaaaataataacctaatacgatatgtgatggttcgtattactataaatatatataagagcactagaatatatcatactttgtactagagatatttaattatgtgccactcttacaagtggcaattaaatatgtcactgaacctacgtgtcataaactgccaatgataaattcttaattgtcacattttaaaagtagcaaatagttaaatgcacacctatcctaggtttaattattttgaaagagagagagagtatacatcccaaacttcactgcatgcaataaaaggttaaattgatttacttttttctttatcagttgttttcaaaaaagtaaatttcagatgattgcaactatatttttattaaaaattaccaatttacaataattttatatatacattttacaaatatttggagaaatacaacaataatgtacggttatatctgaaagctataaattttatttgtttgacaacttttgggcctacttatcttacacacacgcaatatttatgttggtgtatgcaagacccatatatcatatagatcaagagggctaaaggtacgtagctgtggctctgtgataaaattgctttgctattctcttagttctgtgagataccgatgcaaaattgtagcaaatttatacttttgaaaagccaagtgattgattctcagaaaattaaatgttaatgccaatttgatttaattttttatgtgagaagaatcaatgcttaaaaagactgcatcatatgggtgcatgcatataagcaattaattaataggaagtttcgatcttaaacaacaaaaaaagtgaattatatttgcatgatcttttattgttgtagttttactttggactggttatagttgaatttagggttgttgcacttcactactagaaaaaaggttttttcaggcggcccaaaacatgtgtcgcaggtggggggaaggaccgccgctaccctatcgcctgcgaaaatagaccattttcgcaggcgggcccgtggcccgccaacgaaaatcatcttagaaaaatttttttaaaaaaaccaccaacctaaccactggcgccgccaccggcctcaccttccggccacggctctcctccgtccgccattgcctccacataggagagggaggagccgagccgccgtgtctcctccgtccgccggcctccacaggcgacgtcatcatcatcgtcgcatcaacaccgtcagtgtcgtcatcgcgtcaacgaggaggggagccagcggccggatgcgagccgtcatcatcacccgtcgtgatcggtggcggagccggcgaggagggaagccagcggtggaggaggcgagccgtcgtcgtcgttcgtcgtggccggcagcggagggggcgaggagcggaagcggccggcggaggcggcgaggagggaagccggcagcggaggaggagagccgttgtcgtcgctcctagtggccggcagcggagggggcgaggagggaagcggccagcggaggtggtgaggagacgagcctacgccgccgctcgtcgcgcacacaccgctccttctcggagccgccaccgctcgttggtgtcgacggcgacgccaacgccgacgccgacgctgctgctgacgccctgccgcggccttgctgagttgagttgaagataatatgcgagatggagaggagagggtgagtggtggggcggggttgagttgaagataagattgagtacttgagtctgtgacttagatatttttcggtggaggtatgattttctcaggcggaccacgtaaggttccgcttgtgaaaatcgatttttccaagcgggccacttaagcattccgcctgtaaaattaaaggtattttcgcagccggatcgcttaagtggtccgcctggataaatcgattttcgtaggcggatgacgaaaattcacctcagtttatatttttctaggcggatatttgggtccgatggtcatacccgcttggaaaaataaaaggccaatgttgctaaaaatcgtttttctagtagtgcttcagacctcccgaatcttttcttagttatgtccatcctatactcagacaaataacatgatatgttctgttcataggtgaaggatttcgctagcgtactagaaccgaagtggtttaggcggtacaaagtaaaaccatcataaatttagctagtggaaagtagaaagattgaactagggatggtctaacatgaaactaagtgcaattcactcttaaaaaaaggcaaaatctacagtgagaagatttgttgagcggtttggtgcaacattttgatgcagttgtttgtttaggtgtcacatgtatgtcgtcgtatatagttttttaagccacaaattctactggctattctcatgctatttctgttttaaattaactttattttttaatctatgttacaattaccaatataagatttagaagattaaaatatcttttactttattaattttcagtacttttgtctttaactttatcaagtccaagcccaccacgtttatcgccaactttaacaagtcctaatattttgattatttaaaaataaagtctttatgagttaaattggtgaaggaagagatgaagttattttgagataaaaaagtacctcgtattatttagtctcgtcatgtctaagatatggccgtggtatggcatatttcaacgttgaaccaaacttcccattataagtgcaagccaacgattgatcaccgtccaaatgcacatggcatatgaatgctcgttaatgtccgttcgtatatgacggaaaagttcatgctttgttcccccggcgaataacatggaggaccggccaataattatatattgagaaacgacataaataataaattaatatagcaatcatgcatatatccagatggtatattctcattgatatttcagagaaaacaataatcatttgaatataatgctgaaaacaaacaattgaagaaaagcacatctcaaagtaacttaaatatcatattgggtaaagtgtattgtcggcctttaaacttgtttgtctatatatatcatcaatgactaaccatatagtcgcgctttgcacaaattttgatcatgtttaagaacttttatatatgctttattagtttatcttagcttctagaaggttttaacataagttaatttatttacaaaatattcattggcctaactaattatagatttagctaagttatactatatgttcacatgaggaatcactagaaagtcttctggattttttttttcttcgttgtcttttgccccctctctctatttgtatcatgtgtccaagatgaatcaccagaaacatccataaattcccatatgcttagtcagtttgtgtttttttattaattcccatatgctctatttgtattaatgcatgcttagccaatatgttttgatgttgtgccacatcattgtgcaagaaagctgattcacttctttcactatatatatgagataagatttgtctaagtatatcatccagatctatgaacttttaaaatatatttttaaaattgtcatgacgcctcgagatcctacatgatgctcatttggaacaccgatatgatgctcatttggaacatcggtgttgagtcattctattttatctttttttcttctaattttcttctcttcttcccttctgttcgtgtggaaaaaacaaagaaaaaaatttgggaccgaaatatccgtgtggtatgccactttaatgtgcatgtcacataccaaatgagcgtcacataagagggaccgtaacaatttgggaatgttactcaatacataggggcaaacaagataatataagtttaggtacgtactaatctctaggtaattaatatgactgctctaacttaaatttcttatgagagcaagtttaatagtatagtccactactagctccaattcatctgtagccgatttaatagctaatttatacaatattgcttactatactattaatatatggtcccacatgtcatacacacattgcgtcttggagtccgtactatagctgactacagatctgtagcccgctgctcttctctctcatcttttatctcattaaaatatgtttgtagctagctaatagtctgttattgtacctgctctgataccatttttctaataccctttttttaggtatgttgaccaattgtctcgaagtctacatgttgaatacaagcatcacggagtggatgtgcaatgccaggtaacatttgttatctttttacaatgtttattgcctgaacatttatttcagcttcaaagtttaataaaacacccctttattttctttttggacgggctaaaagaagctatgtatttcgaaggtgccttgtaaagaactatgtgcgaaaattcattctcataggcagatctggaagaggcctgcatgcaaaataaaaggtttatttttatagacaggactgttaaacggcctacgtatgaattttctcacatgccggctccctctcctatattctcctccttgcgctaagtccttttctgtcatgtctactcctctccttagtgctctcgtccctcttctgttctcccctcctccctctatctgctctccttgatgaccgacaaaaggagcagccagcaggccctaacagaaggggcggtttgccacaagaggtctgcagaggagtgcggggtcggtggacagcggtgggagccactgcaacaacgggtggatccgctatcgcctggcaccttgatgggcagatccggccccaacgaccttgtgtcggctagacctagtggcggcagcaaaagggtagggaggggtggggccaaaggcattacatctggcgaggtgagaaggggcggatttggcaccaccagtcggatccggtagcttggagcagtgtggggctgttagcggcggatacacgaagacgacgacggtcgtggccatgggtgatgtggatctatcactactgtcactttcccctcctcttagctctctacctcccggcacgtgtggtggtgtaggcggcggtggatccatcggtagcggcctcggacgggtggatttgccgtctgcggctactgagagtggaggtggaggagccaagtagacgaagaccatagccttaacggcatgacgacgaccttgacatcaactgcgtgatgatgacagtggtgcccggtagtggcggtgacagcggccctaactggggtgtctagattcgttttgttttcttttagttgaacgtcctaatttggtcgcttaaaaataattttttacaggcggcctatgaaaatgggttctaacgtgcggttgtgtcgcacggttgaaaagatactgattttttttcatacaatagtgggaggcctttgcaaaaatgggttttcgacatttataaagatcatttctagagcgaggtgaaaataaaaggcagttatgagcacattatttaggctttgaaaatattgcatagctcatttttaacatattgtaaaataaaatactaaaattgctacaatattataaaaagtataaaattaacctaccgatattcttaatttcttttaacttctagaaaacttatatcttgtttccaaacatatattacataatggattgagtgttttactcttcttcagaagacatcgaaatgcactacaaattaacaccagaaaatatgtgcctctcattaccccatcacgtaaaataaaaaatccactacccatatgtacatcacatatttctccattgtcatctcaagtggtgccctaaccaattttttgtgcagataccattatatgtcgccacaaagatgtcacctgtccagggtaactcgccgtttataccatcacccgaggagtacgccaaggctgctgtccgctgcatcggttatgagccaagatgtgtcccctactggcgccactcgatccagtggttctttgcatctctactgccagattctgttctgaatctatggcgtctccaggttggaatccggaagagaaatcagatgaaggttctgcttggtgagagcgatcatggattcagttaaactgccataaatgttggttttgtgaagtgtgtgttaatctattcgaacaaaatagtatatacatcaatctgggatttgggtagtagtatatacttcgatgagttatgtgctgaatataatggaatggcatttagtgtttgttttgaactttgggtagtggttttgtttgcacctctagcactattttttattggtttgtgcgagttggaattattagtacttttccattcagtgtaatcgagaaataaacaatgtaaaatatgatgatgaatcttagtattccctccatcccacacgccctagtgtggatttggtcatctgcgtcaggtggaaatccacatcagtgtcggtgagtggcttggtcatagatcattggttagtgatgtgaaaactcatttgtgtcgggctggcagccgtcaccgataacagtcatctttgtcgggtgtaaataaaagaccatcatggataactctcatccgtaatgggtggtagttacgacctgtcgtggatgagagttattcgtgacagttcataattacaaaccttcacggataagaatttatgttttttgaattttaaatgcatagaaacccctaaaaatatcattaggatattccaaccatggtcacacatcactagataaaaattcatgatttttcaaatgatatgcatgcatgtcttaagtgggattcaaacccaagacctcttaacgaatgaaaatcaatcgtgccatctcacctatagaccacatgttgatcagggatcgatgctattttttttaactattcttatccaaatctgaaacaaaaatttgaaaccctagatgagttcaaacgagaacgctttcaactctttaatgtaggatatgtctccatccaaggttgtttggaaaattcaaaaaatattttggaaatagatcacatcacttataaacatattcggggatgaaaacaatcttaaatgaaaatattgtcaattatatttcatcaaaccctttgactttgatataggaaacgtctccatccgagatcaaggtaaaaattcaaaattatgtcttttaaaaatatatcttgccacttataatgcattcttgggcatataaactatctcatattaaaatattgtccgctttaaagttatagatctcatcgagatctataacttttatatatggtatgtctctatctaaggttatttgaaaatttcaaaaatttaaatttttcttcatccatgatggttagtaactaccatcctttacaaataatgttatccgtgaaggatggtaattaagacccatcacggatgagtgctctcatctttaatgggtcatcccattacactcgtcacggatgacattttatccgtgatgggatataattgagacccgttataagtcatatatgacgtgttagaactacaagccaataaagatgaccttatatcggtgaggggtcatccccgatagtcatatcttaaacgggatactttttgaactgttaggaatgactcatccgagtgaaggcattaggtaaagcactaaagtaaacgagtcgcactagcccgacactggtggctcatcaaggatgcccggatctatactagtgacaactgcacttattttggataggaggagtatgaagctactcatagcaactgccatagacaaattagtcacacaacatctaaaaataggagaaactgacatgagaaactggcaggtctatctcatttgcaagaacaagcaatagcttttgatgccagagtgaagataatactcccttcgttctaaaatataagggattttggttacctgtctagattcgtagtgttacgatatatcccatccagccaaaatgtcttatgtttcagaacggagggagtataccataactgcatgagcaagcgaagcactagcagaattgtccatagccttttattagtagaggtgtgttcacttgacaaagatgaagagggcgatgatataaaccattgtctagtggtgtaatctgtggggatagagattactctagagtaatttggacgagtggtgttgaagacagcccgggaataacccgtgaaatggagcagtgcttggcttcaactctgaccttggaatcttcatctcatccagaatcttcatctcatccagtgtttttgcaaacaaaatataaagcgcactgcctccaccaatgaggaccctctgaatttgattttcttgataaccgggtcaaggactaagggataccgccccgggcgagccacttggtcagaatgatccgagtggtcaaacatgattgcgaacatcgaccctcgtatgtattggggtacattcggctgaaccatattaatttcacagtcggttagcttttgcttccccttctactcatgccaaggggcctccaaaaatatggtttagctcgactcggtgatcctggaatccactcgggtccatgtggtccggtttgtccttggccttatccttgccggagctaccctcaccggctggcgcctggagttgtttggcatgatcttcagcgaatttcttgtagagcccatttagatcatatcataattgttgtgaggagggtgctgcggctggtagttcccaatagtcgctgccaattattctggcctacgcttccgatctctctccgattaaattctctgttatctcttctctcctttgggcatggagcatccggtggcttatcgtcgtgagcatcattggttgcatctgctgacttggcatatggattgtatgtctcaaatagcttcgtcacggtggtcagaaacttgccaataaggttctcatcatggagtcgcttttgaaaggtagcgataataatgtcatccatgaccattgggtctttttttttgtttcagggaaccgcgtgatgtaatcttttagggattaatttttcttctaatggatgtgctatagatcgaactgagtaccaggcctctcgtaagtacccttgaaatttgcaatgaattgctcctgaagctcgcaccaggaatcattagatccccatggaatccccaaagccagttcctctatgagtcggtgaatgttgccggtaagtagtttaccatggccttgctatctcctccagctgctctgattgctaaagtgtatactgtcaacaaggattctggcttggtcttaccatcatatttctcgatacttgtaggcttgaatccggttgccaatccactcggtgaaggttaggagtgaacgcaggaatcccttcatcggcatcatatcctgtgatccctcatagtgagtggggaattatgatagccatggtggtcatgattttcacgctcccagtgccatcagttgagctcatctctgaggtcctcattgttcctatgatcgcgtatttcttcacaatggcgtccatcgtcgtggtggttaccaatgcgatatcctccatcctgacgattaaaagcctgtccgctactgaaggagctggtcgacggtttccattttgacgtcaccttagggatgaagcggtatgtcctttgttgcctgccaccgagtggtttttcgcagagggacgcccagacagctcttggttagggtgattgccagctagagttttaggtaactcagcgacggattggaatgtaattggcttggacggcgaaaattgcaacttgatcctcctacttgctaggaagacgtcgtggtcatcatggctttgtctttgttgagggtcggagtcacctggtggtcgggtatggcttcaagtacaaggtccaacagcatgactatcgcaacaacattgtgccgtggggcgacgaacattgtggtcgtcgtggcccatttggatgatattgtcgtgagccgtgcatcctcaggttgttagatcacaatgccaatcatgacgcagacgatcttctacctccttacgaaggtattcctcttccgcttctctctagattcgagcttgttcatccttggctcctttcaaagccatgaacacctcacggagtggggtagagtcgtcggagctatagatagtattgttatcggagaaatcagagccatccaatgagtgaatcagaacctgcacctccctaggcccatgttcagacatggtagagctatgcccaagctgaacccaagggtacatagtagactcagatccaaaagttgtgacgagaagtggaggaacctgtgtagcgattggtgacaacgatgtgtagggtggtcggactagagcaactccaatcggtcagatcgatggcagtcaggtgatcagaccggcgcatctacaccagtaagacctatctccaactggtttgagggtaacttttaattttgttagaagttttcagatttttgtgttcctaccattcacccctctctggtaggcctagttcttgtttcaatcctacaacacatataactctccaacggattgattattaaaacgtctacttaattcaaaatggaaagccaatgtcggttacttattattcatggctattttttttctcttcctcttacttgagtccaatagaaggcactaaatatctcccatataagagcacgtgacaacacacaactctctattttccacgctattactatatggttttcccatcccgacgtctgcgtccatggatgttgggacagcggttcggaaccccctccccccacctccctgatcttgcaccgagaagataaggcgagtcaagtttttagaaaatacattgtgcgactgttggctgttgttcgtgaacgactacattcactaatcactatttcctcttcatcatggttggcagcgagaatgggaacaacaacggcaacggcaatgacaacgatggaaacggttctctttccattaccatcgcaatcattgaaaactactcccgcaaagggaagaaatggacaagctgcagtgtttgccttgccgagaaatattcgtttggaaactagaggaaacccgtgcgttgctgcaggacatactcaatattatgcaattggataggatgtgcatccatcctcaagttagaaaattaaagagataaataaatggactttttgatcaacatttgagccaaaacttcaaaaggatactacatacttaggtcatgagttaacatacaattcattagtgtattattcatcaaatgctgtcacgatgtagcttacatatagaaggttgcaatgtatccagtgacaatttatattgttctatcaaaggtagccaattcatttcatcgtcttctcatccaactatccacatgttatatatatatagctcttgtgatgggtgtttgactgatctaagtataaccacgaacacaataaatattatttagaaattcgcagaaaagaataatcaggtaatacaggatcagaatatatgcaaccttcagtaatagataagacgatgtgccaaacaactaatggtgatgatgtgctacagtgcttaatcagaattataaatttgatcttgtgtcaggatttctggaacaccttgaaacgtagtgataatctgctactacttgatgtcttgactgttccaactctctgcgtttaattcagacctaaaaggctgagacaaaagattgataagataagtcacaatggtaagaacaaaatgaaaaatccctacagtttacgatttcagaatgtcggtaaactcgtaaacaaccaaaaatagattttatgcaaccaatatttacatgtaaaagaaagaactgaagtaagagttaagtggacgcaaagcagataaattttgacattcgcatcaattgctggaacacctaaacacaaaccctctattactcttttggaatcacaaatatgtcatccaatgaactgtgcaggataagagaatggaaactgggggtgatggctgtatccatgaatccctacaaagcagatcaaacaaattcacttagccagtgcaaagttaatttctgcacacagtgataacaaaacatcctaacaatgtgaaagaaacttcgagcgattagacgaaattaaagcatgcttcaaaaaaaaaaggattggccgaagtattagttagagtctcagagataagacaaaagcagtgcttcatgcattagggatctactccatgaagtataactgatgaaggaacatgggccagcgagcaaaccgtagcgtgcatatctgtccatggatcgtacagctcaaacacctccgcaaacgtagcgcagcacgagtcaatcacaacctgcatcgaatgcaaaatcctcaaaactccgtaggacgacaatctgaactcctcagcttaaacaacaaatcaatcatgcacgcaccttggttccaaatttgaagaggaatgatgggtccgctaacattcagttgcggagcatcaagaatgcccggatcatcgcggctagaggccatggtgctgcctaagagatgaaaaggggactgaaaataccttctcacaaacatttttttttaccttgtcacaaacaattcttctgcaattcggattacctgcagatcgaagtggtggagcaacatgacttcccggatgctagcatccttggccgcccccatcatgtcggccgggagcgagacaccgcatgccgcggtgaggcgcagcacctcatcgaacccgagcaggggcccgaactcggcctcctcatagtcgttgtcgccgccatcgccgtcgccgccgccacccttgccgttgtttcctccggagccgctcccgcggtcccccacggccgatccttcgcctgtggtggcacgtggggcttgtgacccagagcaggagagggaatggtgtttggggggggcagtggggagaatagcctggaggagagctggtggaggggtctttgctcgtgagaggggttttgatggggaggaggaggagatcacggcggcggcagcggcgagggaggagaggggaggggaggcagcgaaggccattgtaggggcggttgaggccagcatggcgctagggctcccggcgcatatctccatctcgcgatacctgcagccgacgctacagacgcgcggctccgcggcgtggctggtgcgtgcgggatgaggaaggcagtgcgacgcggggaggagaagcgagcacatgcgcaggggagaaggagaagcgagtgcgccggctagcgggcccgctgcgcagctggcacgcacgcatgcgggcgggggaggggaagcgaccgcgtccggcggcggcagcggctgtgagcgatgcggatggggagaaaccaggaaagaaatgtgggctgggcttcacgcttgtgcgaacgttcagattagatctaacggctgacaattaaactgtcacgtggcttaaccacagggtatcgagaggtcatgttcaaatatatactacctctgtttttcaatgaatgatgttgttgactttttattactagtttaatcatttgcctttctcaaaaaaaactatttaattatagtttattttattataacttgttttattactcaaaatactttaagcatgatttatatcttatacatttacatattttttttaaaaaaaagacgaatgatcaagcatgtgtttaaaagttaatggtgtcatctattaaaaaaacgaagagagtatcactgagagatctcaggattatttgtatcctttcatattcactttagtaatcatctaaagcttgttctggtcctctgtggcatgttctaccataatgcgcctcacctgagctacctccttgcccaatgaactggccaagggatgtatcattcattagataataatcaaagcagctctcatcataactgatatacacaatcgtcaaagtgatttctctgaaatccatctcccaaacattgcaagacacctctccggctggtactctggtgcagtgtgtccaccaccctgggttaaatagcgttacagccgagttatttgcaattgtatacgtaatgcataatcatctattcttgtgcgttatgtcacattagtacgtttgtccagtaattaacaaggacactataattaagacaattcagtcttatcagaaagtcccagagagcagtaaattgacaaattttccctgccagctcaactaaagttcctctgtttttttaaaaaaagttatttgttgtgaagtttcaacgcctcatactggaaataacactagagcagtagagcccaccttaaaagcatcaaatacccaacatgcattttcttttcttgcatgtagttagggatgagggtatttgtttcttgttgaaaaaaaattgcatgtttctctttcttagttttgagagagagggagaagtaacttgtagttatgttgttacctttaccgtagcgaaggtcaagtcatttgcatatgtgattgtgaatctgcaaatcaataatactttaaaatgaaagtgtaattgtggaaaaaagtttgcatactcagataattatttcctatgccttttgttacagtaacaaactatatatctgcaagttataaattctcaccctgcagactgcccatcgatatgccaggctctccagtcatccacaattgggtagttgagtgatcttacccaggcttgtgtacccaaaaatggaaccacggaatcatggtcgccactatatgaaagacaaaaataagaagttgacaacacatagaaaaaaagaaaagaaaacaaccaatagtataaattcgaatggttatacgttagagggtctataacgttataagccgagaaatgagctgagaaatccttcccaacagttggaccttttaatctactactattggtgcttctgtctgtattagcggaagcaccaataataagagatcggttcttaattattaattgttgttaagagacatgcacataatctctaggcgtttcataatcataaaacttttgagatgtgaacatacaagaacttggttacctgtataccaagacacgatagcctctagatgtaagattttgatggtacttaatactgctctctatgtcctgagaataaggtagtccatcgtcatggcacctcacccactcatccacagttccctatatatgttatgaacatcaggagaaacaagaaaagtgtgatgtaaactgcaaaagtgaaacactaccagtcgatatggaaaaataatattaatttaaataccttttttattccaagattttcccgtgtgttgttgctgttagcccagaaatatgacaaatagttgggataggtctgttgatagaagaagtaatgtattgattcaggcaaaagttttgatggcgtagcaagatcttatatatgccacatcatccttcactaataattattacatttaaacatcatgcaagcatgctatattatctataattttataattattgaattttagttctttaaaatgcaagaatgttaaatcatcatcccgcataattcttatcttactataaagctataacccactaaattctaaaactctacatgcaatgatgacacatcatctttcactaataattattacatataaacatcgtacaagcatgctatattatctataattttattttataattattgaactttagagctttaaaatgaacgaatgttaaatcatcatcccatacacctatatagttcatcctcacttagttaatattatttctctcctctcatttagctatatcatatcaattgtttttgcccttagatgattaatctatggtccaaattatctctctccttttcttctctcacgaagccacatcatcttttacatttgaatcatcattctatatatactatttaaatttaaattaccatagactacatcaacttatgtaagcttatgttatctagctatcttacacattacttacttattgttattatactaaacttccacagcaacgtacggagtttcacctagtatagtatatactacgttctatttttggtactgggggttatccacaaataaggtatatatatataatgtaaacaatatctttttgaatgtaaggtatctcgttaactaaccaataatgctctctatatgtttgtcacctatcttcatttaacataaatattaggagccttctctctaaaggaaaaaatagagcaagatggcagtttgaatcaaagcattccaaagtatttggatggattatatataatttggaaagcaagagtatatttttaattaattaaattggtataactaaattggttctttctgaatttaaataataataatttgactccgtaaaaaaaactttgaattaatagtccctaacaaatgccagttaattaaacttattttaaataaatattagctagagaattatctttaacattaccaaccgatgcaaatgaatgaatgtttgatagcatggattatagcaccttgagtggaaaaaggtaattatatcacaggaaaattgtgtgctgttcattaagatcaacttacactacaatccattggaggacgtggtggccgatggtttcccactacaatctcctccagaatctttcttccaatagtaccatcatctggtttgggagatacatagatgcattttttatacaaaatatgtgcctctgaaacttctcccatgagctgcagcgaagcatcaattctagtcactttattaaagcataatcattttctaagaaaaaataaagcataactataccaggtcccatagtcatttaagaaaactacaaaggtaacccgcgcatctgtgcaagcactttatttgaagtgtcataaatctgttaccatcaaaatttaaatatttaattttcgttgacttttaattaaaatatcatttaattatatttgatatatctaactgtgtactatagggtgtgaaatttataaaggctgagcatgtatttatgtaatttgtagtataggttttaagattacatgtgctttaaaatagtatatgtgagttgtaaaattttctttcttaattgctatacgatttttgttcatatgcttatatattttgtgccttcatcaattatccaaaggttataaatgattcaattgcatggtatggattttgggggagaagagatataattcgcacccttgatgaatcatctaaaggctaaaaacaatttagataatgtggttttatgatatgatagagaattagtattaacatttttttagtggggatgaactttacagacatttaggtttttcataggctttcacaatttaggagctcataggacaggaagtgacttgagtggtgtccgagcggaaaaggccaatataagggcctgtttagttcccaaaaagttttttccaaaaacattaaatcgaatctttgaacacatgcatgaaccattaaatattgattttttaaaaaaaaactaattgcacagttaggggtgaaatcgcgagacaaatcttttgagcctaattagtccatgattagccataagtgctacagtaacccacatgtgctaatgacggattaattaggctcaaaagattcttctcgcggtttccaaacgagttatgaaattagtttttttattcgtgtccgaaaaccccttccgacatctggtcaaacgtccgatatgacacccaaaaattttcttttcgcgaactaaacaagccgaagtggcggcagtgtcagagatctggagtcctcgtatttagaattgtgcatatgacatgaaattgcggggaggcggcttgctgccggttggtgctgcggtacggccatatttgaagcacacgtgacctggtatctcagattagttaattatttttgggggaaaatgtgttttgtaattttttgagccataggataaggattgaagccatcatctgttttgcaagaaatgaagtgcatctttttgaaagtttcactttgggctaccttttgttagcgatgtttcactttgaaccaccctttagataatatttcactatgaactgagtaattttacctctattccactttggacaaccctgactctcttcttaagcatatgaatgattacaagttgcatcggcttctactctttaatggactcccatagctatatttagactattgctttcgcatatgacaagttaatgtagacagataaaaaagtcgagggtggtccaaagtgccataaaggtaaatttaacaggttttaagttaaaacatttattaaaaggtgatccaaaatgaaacaactctcaatcaagatttagatttcataaacttatttaccgtaaaaatttgaaattttaattttaggtgattctttatgaaatattgtttaattatattttatatattgaattgtctgctataatgggtttggaattgaagggttgaacatgtagtctataatatatggaggtcccacatgctatattatttttagcactgtaacatgggaacaccgatgtgattgctcatgttgttgatgctatagatgattctttctgtgtttttatgcatatgtgttgtggaaatctttagttctcctagttagttcggcactcttcatttagccttgttttagttttgatggcactttttaattacacatccactatacgcgtccacgaacaaattatttacattacattgactgcaaatctattgtagagctgatcaactgagcatagtatcatcgatatcccaccctagcagtgaacctccacatccttcccagcgcaatcttccctgaccagacgtgcaacatctatagatatttaagatttaccgagtgctggttggggcttaatattgtggtttgtttaaatcaatctaatctaatccaacggtttagaatattggactcacaaattaaatgtgaaaattaaaagaaggaagttttccattttttttcctcagatttttaagattttctctaaattattagacttgtggtttaacagcatttgtagtagtctcacatgatggtttgagagcgtttgtaagaggtttaataaacttttagtatataatagacagctttcttatttacctaaacataactataccaagttttgccttacattctcctaaattttcgtttaagcccctttgtgttgattccattagttggataaactatattaccccttgtttttatagaaatgctagcttaattaaagcatatttcacataacgaaaacaatgtagctctaaaacatcaaaagggacatcattatttaacccaaatttgaaaaccaaaatttatattttgaaacaacctttaattaagtttgacaaaatttaaaattgtaatttcacctctccctccctccctccctccctctctctctcgcgagatttcttcgaaattgtttgaagttgatttgaaatgaaagacaaaatggtgacttgtgtaatttctacatctgaaatttcatcaaatttaattacaattcagtgggaaatttaaatttcagttttcaaaatttggttcaagcaactttgttgtcttcattttttataaccgatgaagataataacaagttagtactcatactccagggagggataatatagtcatttcataaaaagctaacaaacaacttaaacgtaatgttagttaatggagtgagtatagtagggactaacatttaagggataacacaaaacttaagcacatgtaagggtttgagtgaaaatactcaaggtacgcaaggaattttcttccttcctttaaacaaagaccggctggtgctgtgggatgtagctactccctttttgactttaaacggttgaattaagtattttatctcgttttcaagatgttcgtttcttcttcttttttcacaatactcataccattatacttcatgttctctgtttagatattcttgttctttttgaattttagtgcacaaactgcaaactgaggaaaatgtgcagcgacacccgggaaaaacaaatctttacacaagagaattagagaatggtgcgttaggggcactagaatttatttcatggtaaataaagaatatctgacaaaactcctgaataactgcagagtattcctcaaaaacagagcataagttcaagcctgcttacctcactgaacctgttcaaagcttgagcgcaggttgcattcttgggattggcataatcctctcttccgcaatgctccagtatagtcttaatatcgattaagtgcatgccaatggagacacaaagaattaagcccgttctattggcattccacatctagttaactgctagttgctactgtttgtaaataaattgaagtagtacctcatatagttgatctgaaatgattccaactccgtgagcataaggcactttcgactcgtaatcgatgctttcgccggtacccgggttgccaaccagatagccctgaactttttcattagcagagccaatctcttgaacactgatcctttataggtacatggtgcaaatgatttaccttgagattaagcacaggcttgactccagcctcaacatctggtttaaatacagagcatcaattcataagctataaaatgcacatctgatgaatcatagccatacaagcaggggctagaacactattaccttctgagattttctgcaggagaaatgggacaagctttccagcgtaggattctccaccaacgtacaacggattcgagaggaattcgcgatgttgagagaaccacttgatttgacaagcagaaagaacagtacagttatttaattagagcggacacacacacacttggtgtaaattaactaggagatgatctgttgttagtgtttgtgatcgagcaccttgttgacaaatttggtgagctgcagcgtggaggagacgtcgccgacgtcgtaccccctggggtcccgggagaaggagaagccggcgccgaccggcgagtcgacaaagaggacgctggcgaccttggtccacgtgtaggggttgtaccgcagccgcggcacgccgccgtcgtacggctctatcgccagcttcaccggacctgcagcacagaggcgggtgagcggtggcgcgccggccggtgagcggtggtggttgaggttctcaccgatctcgaagaagagcgcgctgaggacggagcagcggttgccgccgttgatccagaggaggacggggtcggcgccggggtcgccctccgactcgatgaagtagtagaacagctcgccgccgttctcctcgtcgacggtcacgtacctgatcgatcgatcgagcacaatcctctctcagtctcagcttcggctgatgcagagcaggacaagaaaagaatcgaagcttagatttggtcgattttttttacccggtttcgaagcgggaagggagcgcgccatcgaggccagggaggctggcgacgttcgtgcgttcggcggcggagacgacgaggagggggaggaggcggcgggacgacggatgagcggcggcgaggaggaggcagtagcagaagaggagacggaaggcgagacgcagtcgcagggacatgatagacgtcgcctttgtctctgtctgcactctgcaggtgcgctaccgcacaagaagctcctcgtcggtcctctgctttttatgggcccgctccgtgtttaatttctactccctccatttcattataagttgtttaacttttttttctagctgaatttgatcaagtttatataaaaatatattagtattttgaacataaaacaaacatattatcaatatatattcaatgttagattttattttagatattggtaaattttactataaatttagttaaacttaaaaaaaatcaaacgacttataatgtaaaacgaaatagagttataataatataatcctgaggtatctctgctttttgatttattctgcactgagtagagttataatataatccttttggatagacacgtaacataacatctcaggcatgaaacttttggattaggtgaacaagtacggttggtacatatttaactaatctagatgtcacatgttttgattgtttaaggaaccttttaaaatatttcaaattagaactaaattttatagatttctaagtctattgcttggtatgttcatattatgattttgcatacgcaagacttttatttggtgaagaactaaaaaagcagcactctccagttttggtgtcacctactccctccgtcccaaaataactcaattcctgagtttctgtgtccaacgtttgactgtccgtcttatttaaaaaaaattatgaaaaaatttaaaatgataagtcacgcataaagtattattcatgttttattatctaacaacaatgaaaatagtaatcataaaaaaattttatatgagacagacggtgaaacgttggacacggaaacgcaggaattgagttattttgggacggagggagtaaagcttagggaacgcacagggcctcatcattatgttattccacgatgcagttttcttaaagaagtttgttattctattgtggtggttgggtgagtcagatgagtttcaagtttcagtggtctgctactacattttttttttttgtaattgtcactctgatatgcgtttagtgttgaaagatatattctacggtgtatcgggcagaaggatctcttggttacattttactaggactcgggccataatcaccattttttttaaatcctttcaaattgcttacccagattttaattcatgtgccatccaaatttccaaatttatgatggttgcttaggacttgatcttggaagggaggcgaaagaacgcagcaaagccatcaattaccatcttcaatgacttgggcaaaacaaggtcttattttcaattataagaattcatccgtttattattttggttgccttgtctttatacccacataacattatttttcttcggtaactttgatgaaatgtagtacgatgtcaatgacgaaattttgtaatgatctttacatgcattttgacacaatatcgatatgattttcctactaccaatttggttgatttctttacctgctatgtcacatgaattactgcttatcaatttctggttttgatagcgttttgatagctagccattcaagcgttgtcgtagcgttagctattaaatatgaaaaaaaaattactccatcattttcatattataagttgctttttttctagttaaacttttttaagtttagttaaatttatcaaaaataattgtatcatttacaacaataaattagtttcataatgtaacatttaacatattcgattatacatttgttttaaattgaaaatattgctattttttataaatttagttaaattcactataaaacaagttaagtttaaccttatatatatatgtgaagggatatatctattaatttattttattattttaaaatattcttatttagatgatattccctcagtttttcataatatttcttatagaaaatttaataacatctaaaatattaaattagtttcattaaatctaatattcgatatattttgataatatgtttgttttatgttgaaaataatattatgtttttctataaatttgatcaaacctaaagaaatttgatgaggataaaagtcaaacgatttttaatatgaaacggataaagtatataaaatttattatttaaaaaaattcttatttagatgatatataaaaaagtggtgacgtccaatcgacgatgaaaatacatgtccgtcatttattcgttgcgctaccactaccaaactaggcgtgcgtttgcactgtgtgcacatgaacgatgctcatcttttcagaagctatcttctttggcccggttttgttacagggttgaaaagtttcggtatgttcttctttaaacagaatatcttcttttaatataaatcatcggcaacagtctgactgttaaaaaaaaaagttttagcgtgtaacatcggactacagacacatatttgaagtattaaacgtagtctaataaccaaaaaaattgcatattccgactgtaaacagcgagatgaatttattaaacctaattaatccatcattagtaaatatttactgtaacaccacattgtcaaatcatggagcaattagacttaaaagattcgtctcgtaatttacacgtaatctgtgtaattagttttttttctatatttaatactctatgtatgtgtccaaataattcgatgtgatatgatgaaaagtttttgcgtgagaactgaaaatggcctttgtttgctttttatttttcatgatattttcagaagctagcagcctagcacagcgccgaacaacgcgaggccccagaacttggattggagtcaccccaggacttggattcgagagtcaagggggatatatgctgtgcatgcgtgccaccgcgccgcggcgtactctatgcaatgcatgcatatatgcggccaccgcttgggcacttgggtggtgggtgtggacgagagggatgcgtggctgcgacggctttagcaactgtgcatggacaaagacatggcaggagcgatggacggacgtactcgacgttggcacgctcacatcaggcattgttacaaggcgatggggttgtgtcgttgtgatatcgtcgaagcctgacggcgatcgacaaggacaaggccagggcggcgcgcggtggcgagatgaccatacacagggggtggaggtagaggatattagagggtaaaaaaattttagctatattttatttattttcatcatatatatatatatttttcaatacaaacttagatactcgcatcagcttaaacttgattaaagtagagtaaattaatcaagtggcaccaccctccatttcgttttagctccgcccctgaccatacatctgagagttggtgagaaggtggcgtaatagttgaagataaaacccgactgatgaagattttatagtatggtagaacaccagctctcaaatcctaattttaaattttaacatcggttggagctcttgttggatatatatatatatatatatatataaaagagcatttccagcatgaaccctaaaccaagcccccaaacaattttataagggttgaggccaaaaatctagattcagcagagatctcatttaagacctcaaaataggaaggacctcaaatccctctccatagagtcccagtcctagaggctctacccacaacatccatctacatttttttggtgcgcgcgggaggaaaattctcttcgtgcgttgccttccatcctaccgtgggcgttgtgccgccgcttctctccccgaacacacccacacagcaaatccagtgagaaccaggtaggcattgccatgttgtcggttgtcctatgacatgttccgcttcggcttatttttttggtgcgcgggggaggaaaattctctttgtgcgttgccttccatccctacggtgggcgctgatgcgccgccactgctctccccgaacacacccatgcagtatatccagtgagaacccaggcgggcattgccatgccatcggttgtctatgacatgttccactttggctaacccaacctgacgtcccccaagcacctccgctgagtcaagcttgggcatcgccaagccgctagccgtcctctggcaagtttcactctgttcgcaccctcccaacccgtgcgctacaccatcagccatggtagcctcgctcacgcaatcatgcacaaatactagcttgtattaagatcttcaccaaccacatgagtaggagaggaagtaagtttttgcagttctttactttctgcgtggcgatgtccacaaaggggctggccggtgtgggtggaggtcgaagagggtggcggcgtggaggtagttggcgttgttgctactgattcaacgacacgaagacaacgacatagaatgcttagaatgctcggagattgatctctctaggacaacaacgacaacggcagagaaaaaaaaggatcaccgccccaggagatcagaaccctcctagggatgatggcagtggaagtgtgagagaggcgctagatcgcccactctaataccaagttgaatagtacaagaaaggagatattctgaatattagacacgttgtattaaggctcaggggccggtatatatagaataatactttggtagagataaagaaagatcaaagataaggaaggagttcacacaaatcaatcgtatcctaatacatttctaactatcatatatgttagattaatgggctaggcccaattaaatcctaataaattccattggcccacattaaatgctatgggtaataataccaccttggaaatctatgtgaagaggcctcaacttaaatacggagctagtggagagtctctgttgatcgattgagatggtgcgcggacagcaggcagggcgaggcgaggcaggtagctgctctctctctctctctctctctcattttgtaacggaccgtaataaacacggagaattgatttcgtattaatgagtgcgtcggttacggaattaaacgccgtgaattgattccatattaacgagcgcgtcggttacaaaattaaacaccgcggttgatgtaacggaccgtaataaacacggagaattgatttcgtattaatgagcgcgtcggttacataattaaacgccgtgaattgattccgtattaacgagcgcatcggttacaaaattaaacaccacggttgatgtaacggaccgtaataaacatggagaattgatttcgtattaatgagcgcgtcggttacggaattaaacgccgtgaattgattccgtattaacgagcgcgtcggttacaaaattaaacaccgcggttgatgactccgaatgttactctcgcgatcacatatatatactcggcagcgaccagaaggatatggagaagttcttcccgacgtctcttgtgcttcgagttcctcctcctctgttcttgcgctgcagaatccttccctggttctgttcacctgcgcgcacaggtgtacgggatgagcaggtgcctccggaattccgtccgcttgagaacctgtacgggtaggcgggcgatcaagtttttgggtagcacttcaagcgcgactgctccggttcttcgacgacaacgttgcatcttcctctgcttctgcttcaccatagcttctactggagagaacaaaggagacaacatcaacagaggcaatacgaattcctcaacatcttctgcaccgttctctgggtataagattgtaactttatttgattttcttcttattatttacatgttcacaatgttatccataggatttcaatcctatgtgaatatcaacgatgtctatacttattttaccttaaacatctcatcaccagatcgtttctcattgtgtatgccatatttattgtcataatattttggattaaaatataccgaattatgaccaaattttcaacaatatactctaacaaaaacacctctagcagttctggtttctcatttgaaggcccaactctacctactacccttcagcagggcccatatccaagccaacaaacccactaacttttttaaacttttaattttaaaaatcgatcatctcaatacttatttttatttttagatctaaacattttttttctatttcactccgcctgatgtgtggcgaacaacattgtcacgtcattagtaattcatgtcacggttttatcgtgccagttttatcttgtcacactagtacaaatgacatggtaagacaatactaccacgtcagccaaaatgacatggtaaaataacactgccacgccttcctcctcctgcgcgtggttcaaccactcgagctgcgacatgacagcgccagggatcttcaccttatcagcctcacaccgtcagtccgcggatccaagaattttcttaagcgtgaacaagcttaatagtagataattactaataactactagcccctctagttctcagcccaggtttccagtgctccaaacaactccacccaaatcactccaaaggacgacgcgccgccctcgctctcgtgtttcatagcctccgcactccttgtcgcacatccccgcgggcatgcccgttgctgcgggcgcagctcaatttaagggtattcaggtgaatatctaagatttttgaaaaaaaaatatatttgtatgagatatatgtctcatatgaatatgaaaaatatagaaaagaggcctattaatcgaaagaaaagcccaataagaaagcctggcctcctctcctcattatgcaggcccagtagccaagaaggccccaaaattaagtcaccctagaccacctcctggtcccaacttcgccccgctgaaacaccgcggccgcgccgccaatcgccatcgcggggaggtgttgttttttttttttttatcccttcccattttgaatacccaacctaaaaattctaagcgcgcccctagcggcgacgagcaccgcagggcacagccgcgcagggtataaggattcaggactcaatcaggagctctcaggttgcagacttgcagaatctcctggttctctaatggcagctttggctgcgcccgcgctgcgccgtctccgctcgccgcggctctgccttgccgccacggtcaattgcatcagcaacaatgccgccccggccgcatccgctggggtcaaccatgtgcaggactcgaactggcgcgtcgcggagctggccgcggccgggcgagtctcggacgcccgcaggctgttcgacggaatgcccgaccgggacgtggtgtcgtggacggcgatggtcgccgcgtacgcgcgccggggcatgctccaggaggcgcgggtgctgttcgaccgccctgatgcgcgccggaacgtggtcacctggacggcgctgctctccggctacgcgcgcgcacgccgcgttgacgaggccgaggccctcttcgagggcatggcggagaggaacgtcgtctcttggaacacgatgctggaggcgtataccgcagttggccgcgtcgaggatgcgtctgcccttttcaatcgcatgccggtgagggatgctggctcttggaacattcttctgtgtggacttgtgcggtcagggagtttggagagggctcgtaagatgtttgagagaatgccagtgagggatgtcatgtcatggaccacaatgatttctggccttgcacggaatggaagcgttgacgacgcttgggttctgtttgatgccatgccagagaggaatgttgtttcttggaatgccatgatctctgggtatgcacgaaaccacaggattgaggaagcacttgatttgttcacgaagatgcctattagggatgttgcttcttggaacattatgatcactggctttatccagaacaaagacttgaagagtgcacggcaactttttgatgagatgcctaaaaggaatgtgatcacttggaccaccatgatgaatggttacttacaatgcatgcagagtgaaatggcactaaaattatttaactgtatgcttgttcaaggaatccaaccaaatcaagtgacatttctaggttctcttgatgcgtgcagcaaccttgctgcactctgtgaagggcagcaggttcatcagatgatatgcaaaacaccatctcagtttgatacttttgtggaatccactctaatgaacttatatgccaagtgtggtgaaattaggctggcaagaaatgtgtttgatttctcaatggagaaggacttaatctcatggaatgggataatcgcagcatatgcacatcatgggtttggcatagaagcaatgcatttgtacaaaaatatgcaagaaaatggttataagcctaatgatgctacctatgtgggattgctctcagcatgtagccacgccggtttagtggatgaagggcttaagatctttgaatccatggtaaaggataactccattgtagtgcgtgatgaacattacacttgcttggttgatctttgtagccgagctggacggcttgaggatgctaaaagattaattagctggttcaagattaaacctacatcaagtaccgtttggagtgcccttctaggtggatgcaattcacatggaaatgaaagtattggtgatttagcggctaaacatctcttggaagcagaacctgataatgctggaacttatactctcttgtgtaacatttatgcttcagctggtaaatggaaagaagcagcagaaattaggtcagagatgaatgttcgagggctaaagaaacagccagggtgtagttggatcgaggtggcaaataaggttcatgtatttgtttcccgtgataaatcccacagtgaatctgacttgatcaatgatctgctgcaggatattcatcgcattatgagaatggctggtactgttcccagggaccatatgcttattgatgtggagctagtggggatttaaaagtaaataaaatgatgaatgtccgattaattttccagcacaagaattagcatagcttttagaggagtttggacctgtgcggacagtggtaccttgacacctcccctagcacagcccaatcctttatttgcattcttagcagcatgcgcatgtgctctgttctggttattcatcaatctgggtgatatatgtgaggtaggtctttgcagaagccttaaccttaccaatttgttatgtgtaccttacctctgggacaaggaataatgcactcacaaacggaatatagtggtctatattccggcgtgacataattcttggattctactttgctgattcagtggtagctgttttttgttgtctgacagcacctgctttcccaagtatgttatttaccagaataccaattgaaagtttactcctgtaatatcatctattctgtttctttgtttagaattatttcataagtctaagttttgtctatcctgctcctttcccattactgcttggacgaatggttcaatcgcagaattaacttcttttttttaaggatccttcatatttaaaactgtaactgcaactagattctttaaattggccactgaactaatataaatggcaatcaatcattttcattgtgtgaatcaaaacaagattaaggcaatgtattgtttatagatatcaagtgagaaattgtcaaaaataacatttctgatggagaaattctacgatacatggataatcaatatgtatcagatagagtaaattccctatgtacccatgaaaactcacttaatccctttcatacccctgaaatttacccgatccattctatgcccctgaaattttagcttgatctcttccatgcccctgctgttacattttccttcttttcattgttatgtttggttgcaaatgtctgttgtgcccttgatgattaatttagatttgaatataagcttgaaaaacgattaaagtttttgtttgagtgcacagtatgtgaattttatgaaactaatgagactatattattagagcaaaaaattttgaaaataaaacaaatgtaataaattaaaaattgtgtttgaaattttaataggataatggattttttttgatcgggagtattcataaaaacaatatcgtgagcattggtagtcatatctctgtatgaatgctcctcattttttatgttttttttaaaaataaataaataaatattttttatttcattatctaaaaataaattgtcataaataatgtatcgcacagtaaactcataactatagtaatctcatgtggcaaacatttacatttttaataatgtaattcgtaaacttttatgttcatccaaatggtaaaatgaacatttttatagaaattagacggttaactgacaggagggacatggtagggatcaaaaatcaaattttagggtatacaagaaagtaagcaaaatttagaggcatagaagggattagctaaaatttcggaggtatacaagggattttctctatcaggtattatggtacatggatcatctacatgtatctgtatttataagcatgattatccttgacttgttaataggtcatgaatttgtttattgctcttaaggagtcatcaattatttctgtatggtagatttcgaatgcatgactgcttttgtatgctgatttattaaaattttgtctttcatgggcaacgtgcatgtgcaggaaagtcggatcattttagttttacgactttggaagccatgtgctccaggactccgccaccattgaaaatctgcacagcagcaggtgttgtgctctttgaattaaaatatgttattctcaacgcggcaatgagctgtgccatggagggaaacctaaggctggatcatggtgagacccaacatgaaagaggagtgcaatggtgactagtgcatttatccagatctcaaatggcttagttgattcctt

SEQ ID NO: 6123 - DNA, 28598 bp, Oryza sativa
  unsure (1)..(28598): unsure at all n locations
attattttttgggcttatacaagttgcataagattaaggttatggtttatgttatcagttttccttgatctgttcatgaagaatcaaatgggcttacacaagttgtacaagattaagctgcatgttttctgtggtcgctttccctttatctgttcctggagaatcaagacgatttttctagcagtagttaaaaatatatgagtcctctacctcctattaactcctaagtgattgtatttcattttgttggatgttaattttatatactatagtgtggttcctaacctatatggttgtccctatgctactatacagaccaaaatggtggataataagtccaaagacatgtcacacttgtatatgaaaaaaaatgcaaaaaaatgtaagacgaaacaagtatagctatgatttttttgttaagattttcaagttaaatgtgcttaattctgtccatattgacatgtccaaagtatgcagctgttatttttcacggaaaggccggaatcataataatcctgaaatcttgtaagtattcctttttcagtttgttctctggaacgggtaatgagtaatgaccacaaggaaatggcgccggtaatgctgtactcaccagatatttttttccttggtgtcaaggaaattactcccaaaaacaatggcacctgttgggacccaaggtcatgaataaaatagggatatgcgagaaaatgttttcccctgctactcgataaagtgtttgtcacagttactgtttcagtaaaaatataatacgtgttgctacagaatcaggctgggttttatcgccacagtatattcatgcaaaattacattaattgtaattttgcaaaattatatccttgaagaattggaaacgttagtcagacagtacaatcagatggctccataaatcactagtgcatgtaagagcggttggaatggtcttccagcatcttctatgagagtattcttaccggtaacatagccgctaagtttcgccttcatccttcacgtaccatccactcttccgttccgtacagtggcagttataccgcccagccagcgcgggcaactgcccgactccatgtacgctacccatggatcgagtgattgctttgcgttaaaatccatcattttccatcatttttctgacttccttatcagctagtcatgcagctcttttgcatgatgcaattaggccatagccaccagttgctcactgactctttcacgattcatgtgtttttcctgtggactaatcaaacgatcattcttgtgtttttcaattatctgttttacacttcaattcctatcagaatcctgtatttttcctattcctccgttttttcaaccctgcaattcaaaggggcccttagattacaaggaaagtcaacacttgagttgatgtctcttaagtcttttaggctgtgttcgcaggaggcaatctctaacccaaacaccgtgcacggaaaacggagcgatccattagcacgtgattaattaagtatttgctaaaaaatttcaaaaatggattaatttgatttttttaagcaactttcgtatagaaacttttttaaaaaatataccgtttaacggtttgaaaagcgtgcgcacggaaaacgaataggaggggttgggaaagggggcatccgaacacagctatacacaggagtggttggagatccaccttaaaaagatgtctaaagtagtcatcgtggctgtatggtcttcaaacatgacaccatcttgacatgtacccccaaccccccccccccctcctctcgcctttcaatttattgctccttttgtaacctcctagcctgaggctattgtacagttttccccctacttaacacaaatacaccatgttgggtttcgtaaaaaaaaatatgacaccatctgcttccaaatgtgccagggatgaatataacaccttgtctacaaagttggtggtaatataagcctgtttagctgagaaaagcatgtttatctaacaactaaccaacacatgctacccctccatttcatttcatattataataatgagacgttttgatttatttttaagtgaaatttatttaattttaatcaaatttatagaaaacatagcaatattttaaaaaaaatatatagtataatatactcggttagatataatgaaactagtttgtgttatagatattgctacgtattcctataaatatgatcaagaaaaagtcaaaatatcttataatataaaataaaatatagagattacatagtaattcatggcaacccacgttatttgccattatggtttttcggactctttgcttcttacccatcgcatccatagctatataagatactacggtaaataccatcggttgctatagaagatacggtgaaaaacagtagttttgagagaggttgcgtcatccatctatcatgaggttgtataagtaagcttgaaacttatacaaagctgggcctatcttttcaacttattcatcggattattaaaatagataattccacactttgaaaaacttttttcttaaagattatttcttataattttaaatttatcactataattgagtgatttgtggtaataacttgctcaacaataaattatcaaaatcaaactagcccgttacttaccaggacttgtttaaaatatatatgattgaattaagataaaaaaaagtgaatattaggaaaggacctaatatcaaataattagaaggggcgagatttcgaacctaggtcgtctagcccaccaccttatggagctagccggaaaacccctgggcatttctctatgattgaattaagattaacgcgcgtcctccgcaaattaagatagcgtggtacaagggaaaagtagctttagttataatcaactagttgggtggcccgcgtaattgcgcagctagcacccaaacaaaatcatatatttttcagtataattttacttaaaatttattaaatagatatattgttgtcctaagactttgaaaggccaaatcttatcatcctcatatttctaattaaatagtttttaaaagtcacatcagttactaccccttacttatgtcatatcttacttctgtcatatccttctttatttgctttgctcgatctactactattattcattctccttagaacctttaaaaattagatcttatagttttagagtttattgtctcgttgggttttgtttttataatttctagaagttatgtcaaacgctgccattatacttctctacggcccgtccactgtcgtttctctttattgtcattgggattttaaaaatcgaacataattatcgttcgggttcttttttactttctagaagtcccgccaaaccgtcagcggctttaccattgtactcctttatggcatgcccgctgcctcccttctttattgtcattaagattttaaaatcaaatatgattatcatcggtttttttttttactttttagaagtttcgaacctttaaaaattggaccttttagtttttagagtttattgtcttgttgggtttctttttttataatttttagaagtcccgtcaaacaataccactatactcctctacggcccatctgccacctactctttattgtcattgggattctaaaaatcgaacataactattgttggaattcaattttttattttctagacgtcccgccaaccgtcggcagctctgcaactatacttctatacaccccgcctgctgcttctcctttttattgtcattgagattttaaaaatcgaatattattatcgatgttttttttactttctagaagtctcggcaaccgccttgcctgtttgcttcatggcctgcctgtcttccctctttttaatagtcattaggattctatttggtgttttattaacagtttttatacgtcgtatcaaccatcaccactctactcctttacaggcatgttacttaatttttcattatgatattttctatttataaattattttcttacttgaactcctataattatttttctgtttttctaaatttattttatttgtttttcaaaatttattttattttcggaattattttgttgctgtctagggtaggcagtaacaggccgcatgtacgttccaactttgatgcccttttatcaatcatcaatcaactaaattaataatatatattctcagtccaccatatatatatttatccataaacgtgtatgcatatgaggccttgtgttactattgtatccatggtgtccgtatacgtgtattatatatattattaaggaaaacgtatgctatagaaagaaatacatggagtagtagtgagaccttgtctgattgggtggttggacataattccaacatgatttttgttttgttgtgtagagtagcaattgttttttacctagtctagtaggattaatttctctagatagtttcctttactatagatatctaatcaatctcgaccgttataatacaggctcatcatgatttaacggttcagatttttctatttttcttcgattaatgtgggaatttctagtccccacagcgaatatggtgtctcctttcaaagctgttttaatatacatactaagcttaatcatcattagtgatgaggacacaactagctcggatataaccatgactaccttatgtattaatcaaccaaaggtgcatatgttctacattagatttacttgttatatatttgaacaaacattgctacacaatgagtttcatgtgtttttgtttgcagaggtacttgcttgggcgaaagaaaagagaccgagcgtaaggaatgcatagatgattgaagaagttgattgggaaccaaaccaagaccttcttcaagtcttatttcatctcaccacgtcacttttggtccatagaagacaagagataaagttatacacgttttgaatttagattcgggtctcctgacagcatcaacttcaaatagatctagccgctgttctagaaggaatttcggggcccatgagtacttgttggaaagcttatggagtctactttcagatggatttggtcccacatcaaaattcctaccaagctgccgggaaactgcaaaacaagccacgtatctcatccagtccgaatctgatttgcgttttgggccttgtaactgtgtcgtgggcttagcccaagggggtgtgcgccctagggcaaccctaggacgtccttaatcatatttattcattagccgtcatcgtttagagtcgggttttgcttaaattattttatcaagaacagtttcgccgctagatcgatttgtgaaaccccaaatccgagtgcttaatcattcatatgtaatttggttgcaatctatcttgttctttcttgtgttcttcgattcgcatgcagggattagccttctcggcgaggtcaaccgggtttcggcacggttgataaccagaggagacgtggtgctgcgattgcggggctcagtagcgtgttcgttcagaagccggatcgagttgtatcgcaactccgcccaaattaactgtttatcaatacctatcggaagatcgggacctaactccctcatcagttagtgggtaccagttataaagcatacaaccttttgcttatgttataaaccaaaattttaatttcaaattcgaatttttattttttttcatactagtttaatgtacagtatttttattttaaaaccaatataagcacacattatatttttctttcgctaataaaccgatctttacgaatattggattgacgaaacatcactctctcccgggcgccgccccatcccatcccccatccatgttccactgccagcccgggcccaccgcgtcggtgttctcctcattcctctctgccactgccgtccgagccacggaaaggcgagcggcgcgacgcggcgacgccctatggcgacccaccacgcccgccgcctccccgccgccgccgccgtcctcctgctcgtcctcctcgccggcggctccgcggccgacgacgcctccagcgacgacgacgcgggcgtcccgccgtcgcccggctgctccaacaagttccagctggtaacgcgcgccccacaccccccccccccgccgcccccaatccgttcccgtttttctcttcctgattttggtcagggtttggtggttggtggtggtagggtgcttagcctgctggttggcttatgggggtgacctagtggggaagggatggggatctctctttggttgtggagggggggatttgtggatctgctgcctccgtgagtgctggttagtaatggcagaggaccttgagaatttggttgagttgttcccagatggattgtgatgctgggtaaggagaggaggaatttccgagctgcacgctttagttgtgtactggaattatggatccagttggactgtgatttcgtttcattatggagttccatttagttcatttctgatagcttgaactaaaaatgatagttgatcatgtgccctgtagagatagcattgatttcttgccactttttggttgacttagctgattatctctagaaatagccactttagaccgaattggtctatttcttttttttcattttatatttttggaaaagcaccaaacgatgtacctgttttgcgcctgctgtccatgacgtatcatgtacttggtccggcttgaaccatcgaacagctgaacccgttcccctcctgcaggaaccattgaacaactttctcaaatgatgagaaaaaaacgaatagattttacaagaagcaaggaagatagtaacagaacatgttaccaggcggacagtggcatgacccatggcaacaacggttatggtggcgaaggatacaaggaggcagtacagaaataacaagcgttgggctgggctgcagtggtgtgtacttgtcctcgctctggtcctccaggcggtcctgcttcgttgacatggtgctgccactgaatcgccttgtagattagagagatgagatgggctcagctgcttgatggtttgagccggacaagcatatgatgcattgtgtctagcaagactgcaagaggataacggatgcaccacctggtgcttagcttagcaaagaaaagggggcaaaatgatgtatttcggattttcggtgaaaagtggcaatgtgttaaaccaactaagaagtggtaagaaaacaattggcctccagagaatggcaaatcctagagtgcaatctctgaacagtggcatatgatcgattatcccaactaaaatgtatttttcagttgcatggtcacttctcacttcaggtggcattggtacagagtaatgcagtggcattgtctggaggcaacacagtgactacatgtggtacacagaagcaggggcaactgctgcatatagacatcttcacatgactagtcgtgaaccatgaaccaagaagataaaacaagatattttcttgaacaatttttgtcaccatagtagttatcttgtcccggtggattgaactgtgtagggcttaccctttaacctttcacccttttcatttaaatgttccacagcgtacttgtgaaatttcaccatgggtcaagctctcagttctattcctggtgtttgcaaacaaagacccaagtaaaatattgaatttaaaaactaacaatatagttcttatttactgttgatgccgttctgtcatataaggctaccaagtgcacatgccaatctctttctagtaatggaattttgataggcttggatagttcaagggtgccatttaggccatctcattgttttgggggtttaagtagacagacaaccaacaatgttgagggagttaaacaatctttttccttctagtgatgtctatggtagtcattttgcatgagactcatatacttgcatgtaccctgttggtgcgcaataaaagttacaaagaaaattacctatacttttagggccccttttatttgaacggaaaatgtaggaattttagaggactccaatcctatgggaaaaaaaaatcctatgaaagcctttgaagtaaaggattgaatcctatcctatcctttaaattttttatggaatgggtagtcctatagagattttggaggaaagttagcaagaggtccaacctcttggaaaaaaaatcctttgagtctaactctctcatctgattcctacgtttttcttgtggttcaatcaaacggtcattcatgtgttttttctattcctctgtttttccattcctgtgattcaaaggggtccttaagtttttccacaagggttctcatccttgagattttatccaggttaaggtgaagaattgggtaaatggaactgaaggtacaattgttgttgggttgagtgcaagatttggagcctccgtgcctcgagatattcatgaagctcagaaaacatttgctgtccttgcaaatccacttgattgttgttccaattcgacatcaaaggtttgattttaacatcaactataataaacttattagcaagtttggttctttgaatgactgctgtaaatattttctaaactaattctcgcttttgcagctaacaaattatattgctatagcacaacgtggagaatgcgctttcactgctaaagcaaagattgcacagactggaggtgcagttggtttactagttatcaatgataatgaaggtatgaaaaggttaatatgaaatatattattatatatatcctgttaatatagtcgtatttatctgttaaacttcattctttcagaactttacaagatggtttgcagtgacaacgatacttccattaatgttacaatacctgttgtaatgataccacagtcagctggaaaaaagatgaagggcctcttggatcagggagcaaggcgtaagtcagttagttacacattcttaattatcctcagtaatgctaagcttcattcatatttcttttttcctgcttatgttgccaattggtagggtttagttacttaaacatctcaagccttttacttccatggttccatctactgtgatggccaattgcatttttcatcaggtatatgttgtctgactaaaaacagaattaatgttggtttgaattcattctaacttatatttttatatttatccagtatggcaaagaaacatgatgcaataaaccatattgtaagaaaatcctcttggcaatacatcaattagagtactgagcgcttaatattccaatattgtactaagttatcaactgtacaaggcaattatctgtgttgactgttgaagttttaatctctcgagcatgccgtcccgtgctctcttgagcgagttagtgcctgcagatgagctgatcttcaggtgtattggaaaaaaaaaaggaaaggaagaaatcggctttaagtagagtttgctgggaccattttgcagattataaatggaagaattttggcatactagttaaatgcctgtgctttactatgtataaaaggaaaaaaaatcataatattgcctaaaataaataaaaacatattttttattaaatatgttgcccacccttttgcttttgggatactcaccttaattttgggtatccatttagatttagttgtcatataatattaagaagttcaaggtgtattatgtaaaaactacaatgggagtaggtggggtagcatattcactgccatcaccattggagtacttttaaaggagtctagagatattcgctcatcaggttcgtgaatcctgaccctggatctttctttgaagttctacttttaatgtcatctaacttatatcccaaacttcaaatatgtcaaaaccaacattttctaaacaaagatcatatgaaaaagaaagacaaattgctgatatgacagcttttcactgataactaaaactgtgtgcatcctgttttgcatttggttctgggttttaaaacctttatccataccaatggagtgaacaatttctgcagtctaatttattgctagtaaaggttgacacctagtatctaggtaggcgagtagcaaacacggaaggagcaatgtggagggatcttgaagcaaagcagcagctggcttgaaatagagcgacctgcttgaagcagaataatcagcattccaacaatatggtggactggcaggcagagctggtggtggagaaactcatggctatgctagatctccaagctggtgacggtgcagcttcctctctagaagtcctggtgccttatttgctctccagaaatcctgcacgctaccttttgagataacaaaatgggcaagcttcccacctggacctgtgtggacacatgcatgcacgctcacacaagcaaagtcgctcagttgactccctgtataaattggaaatctttgtgttgggtgctgtgattgcataaatgttgactagttgaagtgaaattgtacttttgaattagtagtttatggtaatacaaagtatgcatgctaacaagaatgttcttttgctgcagtggaggtgcagctatattcaccaaatcgaccagttgtagacctttcagcatgcttcttgtggataatggctataggaaccatagtttgtgcttcactctggactgaatttgttgcatgcgagcaagttgatgagcgttataatcagttgacacggaaggttttgacttttgtgctttacctttctatccaaattatgtcattttaattttatattttcacacacatatggtagcacattcatacccattttctcttggtaccactctacaatttttattcttacgatgtgaatagttttttttaccaccttaagtccttaagtgaaatggcttgaatactttgcacaagtggcaaaatatgtgatgcagactgcagtgccactaaacaatgcatcacatatagaaaatagataagttattgataaaacatgcaatatataattgaagcatataaagaccaatttcaactctatgatgtcttcggaaaattttgctgtgagttcactatttaatggaatcatgttacaatatgccttgtgttcaattttggttttcatgtattcttttaaaaaataaaatcacatgtcttccaagtatattcttttcaatcattggatgttgtttttatgtaacctgcctttcagcatttcaaaatacaacaacttatcttgttgccttgccaagaacgtccttgctgcttagaacatatctaggttctgttatatcatatttttgtagttcgtcactggattatgttttactgacagatttgttccttttcgtgctaaacaggatgggcctaattctggaacaaccaacagagaagataaagaaatcttcgagatcagtgccaaggggctattgtttttattttagtagcttcagttttcctcctcctcctcttctacttcatgtcttcttggttcgtctggctgctaattgtattattctgcangggggggggggtttttaaaaatttntttgggnaagngtattttctcatacatttgttatgtgcattgtgctatttcttattggtaccatcttaacacttctttcccttttgttttcattgaatgttgaagtataccttttttttttttttcattttcctttgttgagagattcagctatgagactgactatgaattttacagggtatgcatgtttgcttggtcacacttctcactaggtaacaaatgaactaatttggatataggaatttggtcaccgctgttcactttatttgcctttcttttcttatttgatgtacttcacctaacaggatttgcaaggattgtggacagaagactgtacaactccccttttttggggaggtgttgaccctttctgttctgattgtaccattttgcactatctttgcaattctttgggctgtctatcggcatgcttcttttgcttggataggccaagacatccttgtaagactaatttatcttcattcttgtgtggtctttctatattttatatatgaccttgtatggtgtgcttctcactaggaggtgcatttttttttctatattttgcttcagtaccattcaaaagtatgcaactaactgtacatgccttcagaggtaccagcaagcaagtctggattcacataatataagtatattacaatatactgtaaaggctaacatagtgttacttctgaaatcaatctggatccaagttgtatatttccagtgggtcagctaacatgtctccttgtaaaatttgcgcactgtaacgtggtttgttcctttcaaaaatatttggtttgaagattttttttgcataaatatccaataattaacattgcttttacaaaaaaaaaatatatattagcctgattgtttggttccttgcaaaatgtagacaccactatgctcgtttcacactattctgactggttttggataagataccatagctggatattgtataccatagtttctaagctggatattgtataccacagtttccaagttggatattgtatcaacatttcatgcatgtgtcaaaatttatgttgtctggttgttccattttatttttatttttgagatgattttattttgaagtgtggaatagtcttataacaaatctatgttttagttgcacatttgtaataattcatacgtgagatgttaaatttcttgccttctgtgttttgagacatgtgagcagagcctttgcaaaatcaattagatattattaaccatggggtttgtttattgtcctcagggaatctgcctgatgataactgtgcttcaaatggcacgcttaccaaatatcagggtattgccatgtctttaagtttaatgtagtcgtgcaaaacctatatgtttcatatgtgtatcagaattattcatcatgactataactttgcaggttgcatcagctcttcttagtgctgcatttgtgtatgatgttttctgggtgttcatttcacctcttatattccatgaaagtgtcatgattgcagtaagtgcatgatttttatttttttgcaacaatctttttattacttactgtttagtactgtggatttatccagtggtgataatagtaccataatatgctgcatacgtggctcatgaatctactagtttccatgttattttcaaaaccagatagtagcacatgcttactaatagtaatagcgtactattttgttagtttgttctatgtttcaatctaattcgaaagcattcacttggaggttagaaaatttggtgataagacaattcatataagtttgatatgtgtatcttcagttagatctgtcctgtaagatataccttttatctattatgaagtgttatagtgttagatatgattctatccatactgcacaggttgctcgtggtgataactctggggaagcaattccgatgctcttaagaatacctcgtttctttgatccatggggtggctatgacatgataggctttggtgacattattttccctggattgctagttgcattcagctacaggtattatactatatatattgctgcaatataagttgtaacttctcttttgatgccttggtttcactggacgctaaagtgtcggtaggttggtaaatatactgttgatgaggaaaacataatcccaaatcaaaacagtgaagttgtaaaccatctgaaaactttaggaacacttaccgtagggtgtagttttatttaaaatcaaatgatactgagaatgttagcagaaaatggaattcaccaatcaccatatgaaagcaatatgctaattggctcctgaaagttcctatcacgtttcatgatttgtttgattgctaattaagttagtgtaccatggtaccaagatgttacgtggtggaaaagaggatcaaacaccatgtttctgtttgaattaatgacctttgattttacactgttctgtcatcaaggaacataaaggcaatgagccagtggttgattccaaaatttgccttaccaaaaatattggtaatgccaatagtaccactggtcttgccaatggaatcagagtctatttggattatcagagttatacattacctatacaaccttaccaaaattttgatttcgccaacacattggtggtattcttgttggtaggacaacaaatacaccttatatcaccattttttttttgttaatgttgaaactcaactttaaggcataaaaacctctcccaatggtttcgtactgttggctaatttagtcctttatttggtatgttggaaataaagtatgttctgttgtaatcaattcatcatgctataatttgacttgtcaagcagaatataattaactgtttaggattccgaagttagaaatacctgtttttatgtggtaatcgattcatgttgtaattgattttacctgtttttattttcatccttgcataatggatttcactcttgttaacatagaaaattggggccaggcatcttattatatatgccggcgtttgtttgatggtttcattatttctctgtgaggtttaattagccctttccatatctgttgtgtttacttatgactatttcaattatatatattcaatcatgtttacccccatacatcaatttgataccgtgtagatttgatagagcaagcaaaaggggcctcttcaatgggtattttctatggctgacggtgggatatgctgttggtaagctgttcattcttttttttttacacttttatattttacctatgttctatgctctatatcgtgtgtactgtgacattgaattttttttccttgtgcagtttgcctaatagttacttgactatgaactacataagtctgaacaaacatagaaagtattaattaatggtcatggttttcacaccatcttaggactagttgaagccatatgttactggtagcatcgtttccagctgtaaaactatactccctccatccacaaaagttacacctattacttttatcatcaagaccaagaagaaattaaatcatcttggatattacaaaatcaaggattgaatgtaagcatacaaccaatgagtatttagtgttggataagtctttgtggtccttggtcgtgattcttctttttgcttttgggtagtttcaccttttcaggacagcatctacccctttagcatatttttcagttgctaggatagctgcggttagtaggacagcagcagttagcatctcctttatgcctcctttatgctttattcagtttggatgccctctaggacagcatcccattcaaattttgaattttagactaggagggtgcagcaataggctagcagccagctatggctatatatatgtatccaacctccctcgggtaggtatggcttttgagtttgtgaatgaagaaaaccagaaaattgccccactctgagtgccatcctcttctcaatgagagtaaccattgaagttctaacatctagatgactcctttggttctaatcaaacatttaatttatctcttcatttaagtcttgaatgcataaagactacaaataagaacaacttatttggaaaaactcaaatgtgaagtatgtctaacttttgtggatggagggagtaccaatcaacgagggagaatgttactgttccattgcaggaattatctttgttttcttccccttctttttagaatgaaattgacaatggctaacttgtttattttgaatgttttttattttgattttgattttttttttttttgcaaaatggattcatgtgtacatgcatgtcattgtgttatggcatgaacacatgtttgtggagaccttggatatgtcgtaatgggattacattttttttttcatgtaggccttttccttacctatcttgcgctcttcctgatggacgggcatggtcaacctgcgctgctgtaccttgttccatgtacattaggtaagtatatgcatcgttcctttagcacacaatcatggattgtttttattcttttctttccatatgactcttaagtcattgcaagtgacgactcccatgtatttctcgttccagggcttattgttatacttggttggtttagaggtgaacttcatgatctatggaattatggtagaagtcaaacagaaaatttagtcgacgaaccatagaagaatctgcggacaattgagatactaattgcccagtggatctcctggaacaatatcagaaatgtacacagtttactttttgcaagaaaagttagatgcaatgtgatttgcttacctgcagtatatagttttagtaatgtagtactattcagtgctgcattgtactaacataagtgttgctctttatttttattttttaaaataagcatattcactatacagtctatatccgtgcctctaccatttcttttcttgtctgtagacaaggagcagctggaagttattttttatatattatgggcatgtttgacatggctccaaccgctatcttgtccgaggagctggagcctggagccggagtgggtggatctgccctataaaatacatactctctgtcctaaaatatagcaacctagtatgtccacattcgttatactaggatatgtcccatccagtactaggttgctatattttgggacggagggagtacctttttccagcttcacaagtttagcttcatatcaggtttggagcctgtgataatttgaaaataaaccagtgtaataatgtctttagttttgaaccttgtgatgataccacactgacatgccggtataatactgccaaatagagtgaccgggcttgcaacaaacatacttcgagaagtcggtagcttctgccatcccgtatgatccgagaggttcacacacgaacaacgttggtgtcgtaccgcgcggacaccatgcaaggggagataaagagcactaaaatggttcatattctatttgcgtgcagtaaagatctaaattccagatgtctgcagaaagattattctatgttctctcttcagtttaaagaacacaagaagagataagcgtgggagctaagaggagcagaggttacagatcagaccaggccggataaatgggtgtccctcacccaaccttgagcaggcgacaacgacacgctcaggggaaggaagcagctggtggtgacccgcgtagagcggcgaagctatcgagggactacggatacaggaggacgccccttccccttaggcagcggaggttggatggtggcgtcctgagcacagaggtcgggggaggacaccaaagatgcggatgatgtagaagaggagttggggcggcgtgcaaggggcagggtcccatcggcaaggcttggggatggctgcagggcagcaccagcggcctaacggcgactctcggcctgcgtagaggttggggaagagcaaggtcctagtaggatgagtccctcagtgcgccggcggtggagaaggtgtcggggtggcggggtagacaggcgctagtgctaggtggcggcaacatggtaggagaggtcagcgtgaggatcttggtgaagatgacttaagcagaggaagttgaggtggaggaaccgatgcccctggtggtagccatgccgaagcttgtcctgtgtcggcgacggcctaggcaaaagtggaggcaaatcttggcagcaaccacggaggaacagatgggcattgggagcatccgtgaggattggttcgcaagcgcgagttggcagcgtgctcaggtgatgctggccggaccagagtttcataaagaaaaatccaccgaagccttccgtaattttttaagtacagatatagaaataaaaaccacgtactcgtacactgatattctatcggaataggaataggatgtcgtaccaaaaattttgtgcagaagtagagaagagatgtttataacactacagtttactcagttccgtaaagaacacaaattatcattactctgtttcagccgagaacgtagggcgttcagaacttcaaatataaaccccacatcgataactacccttaccctcccgtaccctactcgatctcccctccccgtctcctcgcgagttcgatcgcccaccgcctgagccgatccatctcgcgcgatcccgcgagctgcgtcgccgtagccgcctcctcctcctccatcatcatggacttgctagtgtcgctcgtcgacctcctcttcccccccagccaccctccggccatgtactccataaccgccgcgccggcgacggtgtcccacctcgtcaggatcgacggctactcccgcaccaagaacctccgcaggggaaggttcatcgaggccatgaacttcaccgtcggcggccaccgctggttcatccggttctaccccaacggccacggcccccgcgatgtcggcgtcgtctccgtctacgtcggcatcgcgggcgcctaccgccgcggcggcggcgacgccaagccggtcatcgccgacgccaggttcagcctcgtggaccgcgacgggaggccggcgccgccgtcgttcgtccagggcatgcccgccgtcgacttctccgggaacgacttcgggatgaacatcaagagggcggagctcgagacgtcggggtttctcaaggacgacggcttcctcgtccgctgcgaactcggattcgtcaacagcgccggcgacggcgacggccgcagaggggttcagatcaaggaggggatcaaggtgccaccgcccaacctgcaccgccacctcgccgatctcctctggaagaaccaatccagcggcgacgtcttcatcgaggtccaggggaagacgttcacggcgcaccggtggatgctcgcggcgagatcgccggtcatggcggccgagctctcgtcatccgactccgacgacgcggcctacaccgacgccgacgccaccaagaacacaatgatgacgctgcgcgtcgacgacgacatggacgccgagacgttcagggcgctgctccacttcatctacaccgacgcgctgccgccgccgccccagccccgcgcccgcgacacgaaggagaaggaggacgaggcggcggcggccgaggcggcgaggcggctgcacgcggcggcggcgaggtacgggatggagaggctgcagctgatgtgcgaggacgcgctgtgcaggagcctgagcgtcctcacggtggcgtcgacgctggtgttcgcggagaagcacggatgccgcgtgctcaaggcggcgtgcctggacttcctctcgtgcaagaggaagctgaggcaggtgacgaggctggacgatgacttccgtctgctcaccaccacttgcccttccgttatcaaggagctcttcgcgcaggtcttgaagtagacaagacacataacataatataacataatatgagatttgctccggttaataaaaaatatctcgagatatcgatacctcacctcacggtataaaattatttctgattgttggatctagctacgtataatgtgcattgttagattcaacgatcggaaatgatttggtataatgagataccggtatctcaatatatatttttttttgaaccggagtaaatctcaaataatataggtttccattggtatcttggaattaaatatatgctggaggtatgatttataagttattaatactagaaactgttggtagttttcgtattcgttacatatgctggaggtatgatttataagttattaatactagaaactgttggtagttttcgtattcgtttattataacgtggagagtataatgacaaaaaagtttctctcaattgtggttcgcaaaactatgttttcctgtttttgtgagtctagcttgattgttcaaatgggctcttggctctgtgctatgttcagatatgcattttttaagttaggatgaggggtgaacacataaactttcaggtatacacactgccaacacttactaacaaatattactaacatttctatatagaaatactactttcgtcccaaaatataacaattttttgttggatggaatatatttctatccatattcatagtgttaggatatgtctcatccacccaaaaaatactatattttagaatggagggagtacatatgcttaaattttagaacataagagtaaaaaccaaaatatgtgcttcgatataacattttgcatcaatttttggagcatttaaaaattttattccaaaatggtgaaacctactttggtcagctaccgctcccatcagttggcttccactcaccactgttatctcttcccagaaaaaattatgggcagtttggtttgaggcctaaattaggcttgccaattttttggcaacctcaacaataattgtgtatgtttggattgaaaccaaattttagcatacctatataacataggccatttcaatagccaaattagtttaatttggcttcaatctaaacacatgttggcgttaccaaaaattagcatgccaaattttggtaaggccaacattggtcacaaaccaaacttatagtacaaaccaaatatgtagcgaaaatacatatgattcagagtagaagtaaaacttttacttatggttaaatatgggagtaaaagttacactcatgatgatatggataaatatatcatacgcctctttttaaatgctatattagtttttaggtttctattatatattatacgtggttgcactacctctattacctcgatcttctcttccagtgactagcatgtacgtacgccagtctctttccttttcagatcaactcggtcagctgtttctttgagcctattcagatggagatgtaatcactattgttggattaggtttcttcgatgattgtagcccctacgtctcaaaattacttatactaaacacacattgttatattttaactattaattttatgaactatgtaatatcaattagattcaccataaaaaaaatactttcataataacctacatgttgtcaaactacatgaatttctaaaaattaattatcaaacataaacatgttccacttatgataaatactttaaaaaaatagttctgatctgattttttttaatgacagccgaccattgcaagcttatttttttatataatatataatattgtgcttcaaggagaaatgatgcagaatcctatatgttcatccccactaagaattagttaatgttatttctctcttttctcactaagccacatcaccccaattatttatagtttttgggtgatagatctttggttcaaatcatctcttttttcttctctcataaaacatgcaatatcaattatttttggacttaaaattcataagtatcaatttgttttagttttaataatcatattgtatttgatttatacatattatgcaacttaatttcccgcagcaatgtgatgagatattaattaaggaaaaccgactgaaaatcatagctacaaggactcacaaccaactatcctaaactgcccggccaagccatacatggaagcatgataaccaagctcaacgcgaaaaactatacaagcttgaagggcattgctagtcaaaactccattggccatctatctcttcacctgttctaatatgacttatttcttcattttttgttcttcaactgaagggctataaaaaaaacccatatcaaagatctttacaacccatgaatctttacactgcggtctatggtggagagacactacaatggctatggccttcctcaacaagtcactttcatcaagaactagccaaattatgtcacaagtagtgtctgactcctttatagtagctgcttgatgtagcacgttgagcctaacagaccacaacccaccctagatgtccgccccagcacaagtccatgacaccacatgttgttagtgagtccaaggaccatattagaccacaagacaaactttggggacaagtttatacataatgaaatgctaaggatcatattatctcaaagcgaatttcagggacgttattctcccttcatattagatgcaatattagaattagtaggagtattgtccaggctcctatggttctttgtgcagaatagtccaatagttattggtaacgataattactagatgacgtccgcgctttgctgcgagatatatgtagatactggagaaatgatgaaatgatttggattgaaatattatgaaaatgatttgagaatgatgatttagcatgcgtatgtttacttttagaatgaaataaatatgggagtgtttacgtttcaggtgactaaaattttcgaaaatttcagtcacttttctcatcactcctctctctttattagatagaaggttaaatctattttcttcacgttaataatacttgttgttttggataagactattatcaaactttaaaaactttgtcttaaagtattttcataaaataatatattatttttttggctggataaaataatatattattgatatattgtaaggcgagagagtatgccaagttttttttttaaaaagacaaattttgctataggacatcgcgacttcgtggttttagctgtgagacaccgcacgaagtcacttttggggaagacactatcaaaatatggttatttgctaatggacaccgcagacaataaaatattaatttctggttcaataggagagataaacagtgtaaaaggtcaaaaatgcccttgggcctacttgtcatattgtacccacacaactaactccctctcacactttggccatagcaccacctccggtcaccgcaagcgaccaccccggacctccctccttgccttcctcctaccccccatttagcgctgctcttcctccccaccctcccactgctggcgtcgttctctctttccacctccgctcgaaggcaactctgggccggtgctgctcgaaggcggtgactcttggtgacggagcgaatgagcaagaagacgacgccacacgcagctgcttcgtcgtcggggtcatcgccattgaggacgtcgccctgagcacatcctttaccaaggccaccggatcggaagaggtgacgaggaggaggaaaacatgaatgaagccgccaaatctgagcggtggaggaggccttcttgaccgccgccaaagagctcgattgctcgaccgcggctgcaactcccgctccgcgctgccgccgggtaggtggacaacctgcccccaccgccccacgcctggcaagatccggtggctaccgccgatctcgtggccatgggaggggataagacgtcgtcgctgttgctgcttgaggttgccccgcccgaccgtagctctgctcgacgcttgccggagacgagctcgatgactccgcgtcggggccgttttgcccaacgccgagctcgtcgctcgtggccgtgtgtggggagaggatgtcgtagccggtggaggtagaggaggcaaggagggaggttcggggtggtcgccggtagcaactagaggtggtgctatggccagagtgtgagagaaagttagttgtgggggaagaatatgacaagtgggcccaggggcattttttttttacctttttacactatttatctctcccattgaaccagaaattaatatttttattgtatgcggtgtccattagcaaataacaatattttgagagcgtcttcccccaaaaataacttcttacggtgtatgtactgtagcaaaaatttgccaaaaaaaaataccgaaccacgtgaaataaatttaaacttaaagagtcgcaaaattacatgtaaaaattattcaaaatcagacaaaaataaagtaaaaccatattaaaaaaaagcaaaatctcatattccatagtgttgcaattttagtccgaaaaatgtgtaattttgaagtcactaaaatgtcacagatcttcatgcgtttgaaatatagcaatacccattaaatattataaagttacaattttaaataaataaaacatttttgttaaataaaatcacgtataagtttttaccgaaatcacatcgtgtaggagccgcaatctgatacggaaaccgaacacatcatccgtctcggagagacctcgccaagtcggcaagtcgccacgaaacgcatccaaccatcgcacgccagcttggcgggctcgccaccacgtccgtccgagtcgaacgcacactcgaaaagaaaaataaaaacgaaacgaaacgaaacgagccaagcctccaacaaggcaaaagccgcgacgcgacgcgagcgcgacgagagacagacaccacgcgcacctcctccgatctgctcgctccccatccccaccacctctccgaccgccgctcgccgcgccaccgcgcccaccctccatggcggccgatccctccgcggccgcggcggccgccccggacccggacggccccgacgccgtccgcctcacctggaacgcctggccgcgctccaaggtggaggcgagccgctgcgtcgtgccgctcgccgccgcgatctccccggtccgctcgcccgagtcgctcgcctcgccgccgctcccttacccgccgctccgctgcaagcccccctgctcggccctcctcaaccccttcgcccgcgtcgacttcgctgccaagatctggatctgcccgctctgcttctcccgcaaccacttcccgccccactacgccgccatctccgagtccaacgtccccgccgagctcttcccgcagtgctccaccgtcgagtacctcctcgccggcgccgccccggccgccggcgtgcccctccaccagggcggcccgcccgcgccgccgcccccggtattcctcttcgtgatcgacacctgcgtcatcgaggaggagctcgagtacgtcaagatgtccatgcggaaggccgtcgcgctcctgccggagcacgcgctcgtcggcctcgtcacgttcgggacgcaggtgcatctgcacgagctcgggttctccgatctcagcaagatctacgtcttccggggcaccaaggagatctccaaggagcagattttggatcagcttgggttggcgggtgcggggcgtccgggtttccccaagatgcctcagcagccaggggggcctcagatcaacgggatgcatcccccggcaacggccggggtgactaggttcttgctcccggtgtcagactgcgaatgcacgctcagcacggtgagaaattgtgttcatggccatttgatttcggggttttcagtacaaggaagcataagtttttgttcttttgcagctgctggacgagttgcagcctgaccagtggccggtggagaccgggaaccgtgcgatccggtgcacgggtgttgcgttgagtgtggcggctggcttgctcggggcttgtatgcctgggactggcgcaaggatcattgcgcttcttggtggtccatgcaccgagggtcctggaatggtaaagatcccactttgttgtgcacctatgcattttgacttgattttgcgataatgttgtggatagttcttaaagtacttgatgttaggtagctaaaaattagaaatttttgtgtgataatatcctggttgggagttatgactaaggcttatgaagtatccaaagcatgtttcatttgtatactttaggcacagttctattgaatgtttttcctcctttcttcaaaatgcataatactatatcagttaatttgatatctcattatacgttcaatcagtttcttgattaaagcatatacaacttaaacattatcactatgcaagttttacttttacctgcttatcaatgttgagatggataatgttggtgatgctcccccctgaattaacccgagcacgatgcaaataaactctaaaaatgaaagtgcatagttcagattgtgctatttgttagaaagtaattcgttacccctagaacatcaattgcacctttcagaattgcagaactccaaaaacttctgtttgttattctttgtccccctctaatattttctccatgcttctgttcatttttcatgatgctttgaagtcccaatttaatactttactgggcaatgcagattgtgtcgaaagatttgtcagagccagttagatcacataaggatcttgataaggatgcagctcctcacttccagaaagctgtcaaattttacgatggccttgccaaacaattggtcagtcaaggccatgtcttagatgtttttgcatctgctcttgatcaggtatgtatagtattctctttagccagcagcttgtggtcatacttaaattaaagcttctatgctcagcagagtttgcatgttgctggaatctcacaactgtacattgtttgtatccagactgttgttttggagctatgctcacaacatatgttccgaatactattgcctgtcctttcaagatactgtagaatgaatattcaaatattttaattctgggaatatccaagctacatttgttaaagaggtggaaaccctagtgaaaccaccatgctttatataacagcataaccagacatattttttggcttttccttttctgatatgagctttcgtttcattggagcaaaactaaaattcaattcatacaaatatatgtattgttgtcaactgtagaacttgatacaacatagtccatgaaaatatttattgatagttcattttgtgaggatcaagttgtctgcataccaatccagtgatcatgaaagtagattaatatttgataaacgggcatgactattttttgtttcacttctagtgaaattgttagtgccaattgagtcgtaatgactctgcttgctagttcacagttatcacttgatacattgcatacttcaattctcaatcattaggcatttcataactgctgattgtgatacacatgacctgaactcattttctgttttttctacaaaaaatggttggaacacctacaggttggccttgccgagatgaaggtcgctattgagagaacaggtggccttgttgtcttatctgaaagctttgggcattcagtatttaaggattcttttaaacgtatttttgagggaggggaacagtctctcgacctttcattcaagtaagtttgatgcttattccccctgttgggctgcattgtggtattgagctttctgcttcatgaagcataaatgctgaattatgactacaataggttttccctatcattatcttgataagaattgctctgtttataaactggtactggggtatggaggtggtgccaacattttaattcttcgtacaataaatatatcagtagacgaaaattccctgaatatttgatctttctgttgaccaattgtgcgaacaaaagatatattttgtactgtaacagcttggtttgatgtgcatggcttactgttgtatatgtttcatatactttgtttcatcagtgactgatcctttgtcttgttcattttgttaaagtggcacgcttgaaataaactgttcgaaggacattaaggttcaaggtattattggaccatgcacatctttggaaaaggtaggggtatctgttccatctagtcaatgctctaagatatttcaaattggaaaggcctattttgagacttggtttaatacatcatggcatttgtagaaaggagctctatgtgccgacacagttgttggtcaaggaaatacaacagcatggaaaatgtgtggtcttgacaggaatacttcattaacagtattttttgatgtctcaccgagtgagcggtcaagccaaccaggacatcagaatcccgatctgtatatacaatttgtaacaaggtacctttcatttttattctgttgcctccagtgtaagaatggcttgatgttataattgtgcttttgttttctctgtagttaccaacacccagaaggtcaaatgaggattagagttactaccatatgcagaaaatgggtggatggatctaccaacacagaggttggccttgaaaatctgttctttagttcctatactatgttgttgaatactgctaaactatatctcaacaatcctaattgtattatttctcatgtctgtgcgtaacaacccatgtattttatagccagcaaggacaattacgctctgctggctagacagtgaacagcatatctgaaaattttggttaaatgttaacaatgctttggaaaatatttttaagcttttacactgtttgtcgtatagctgcaaaaaaaggtgtttcttggcttgaacaatctggattccaaaacatgctgtgtcgtactgtttaatttatttaatgatagggcaagtaagggcaaatatgttgcggttttgactttaactgacatctatttgactgtaggaattagtcgagggttttgaccaggaaactgcagctgttgtgttggcgagatacatctcgttgaaaatggaaatggaggtaactttcttcatgcttcatgactccagtaattatatgtttggttccatgtatgattttatctgacatcatcaaaacctgaatgcctgatattatgtcaaactagatgcatgtgtgttgtatagcaaatctgatattatgtcttgctgtgatacttacatccacccactgtcagtgttggccaaacagtccatttcacattaaatgagctttgaatggttgatcaaagttagcatgtagttggattcctggattttgtttaatttggttttatacaatatttatgttcatgatatttcataatgtaatagttaccatctaactgctatacctccgtttc

SEQ ID NO: 6124 - DNA, 4738 bp, Oryza sativa
  unsure (1)..(4738): unsure at all n locations
ttataacctgaaacggaggaagtatattttttttatcttgttgtcaaaactctattttcatccagcaattccccccctagggtttgctgtgccacgtaatttggacaaagaattggctatatataggagtttgtgtaatgtgccaaagcattctttcttttcacttagttgctttcctgctttttttagtaaattcatgatgtcatctcagtcacttccatacaacaatgccactcttatctaccttcctatttgagcatctgaattataccacacatttctatgtgaatttttatatctttgaactgaaaatgtaacagagacattgccttcatttgtaaggtgtattactaattgacatatttatctacttgattcaattaacatttttttaaaccttgtgtgcatatcatgatgttgcttaggccttccaagttaaaaaaggaaaacataaaatttataagttcaatctgttgtcccttttgtgttgctaatgaaactatgtagatggatcgttaacgttttttgttgaccatccttgtaggaagagttcgatgcaacacggtggcttgatagatccctcatacggctttgttcaagatttggggattatcggaaggatgatccatcttcatttagcttgcattcaaatttctctttgtttcctcagtttatgtttaatctacggcgttcacaatttgttcaggtgatgtgttgcactttttttttttggttatctttaggaaatccttgccttattaatactagcattttccttgtcacaggttttcaataacagtccagatgagacagcttatttccggatgttactcaaccgtgagagtatcactaactcagttgccatgattcaaccatcattaatttcattctcttttgatttgcctccatctcctgtattcctcgatgtggcatcaatagcagcagatcgtatactgctacttgatgcatacttcagtgttgtcatcttccatggtatgacaattgctcagtggagaaacatgggttaccagaatcaacctgagcatcaggtgagcatcctttctgcatttctacccataagaacttattcctcctgtgattgacttaagggtgtattggttatatagccgtctcaattgtactgtagttatcacttcagaagaaacattggtcagacttcctaggctttggtagcagcatattctagttctagaaactggttaactacatgtttgttggtttcaccagttgctctaatgacagtgtatgctctagttatcactcagtatcaccagtcccttattatagaagaggttacagcatgcgttttgtagccattagctgtgtggacctgaaacccttgccacaatctctttcagtgacggccctttataatccatttgtctagcacaatactactgaaaacttgtatatattacataaaaactcaaagtcaacttgagatttgaaaatgcgaaccagaggacgaaaaaagctgctttctgtgttattattaatctgaactctgaactgtccagattcagtttttactgccaaaatggttttcaaaactcttctatgaagacctcgcagagacgttacatatttgataagtccgcattgttgaccacacatgtttaaatatattggatctatgttcttctatgattgtcaattgaactttttcgtgtatataggttagctgatgttttgatgcaacctattgacaagctagaacttccatgtttatgatgcttaatataactctccgtatttgtttcagcaatttgcacaattgttgcaagctcctcacgaggaggctcaaataataattaaaggacgatttcctgctccaagactagttgtctgtgaccaacatggctcacaggtatgttatcacagttgttatttttctttcttaattgttcctactaccattaatggcttgtactctccatgcagttaactggaaacaactaaatgctcatggttaagaatgagcctacatacatgtcctatcaccatctaaaaccatgaatattttataaaattataaaattgcatacatacgttcatatgccttaattgtaaaattatcttgataatagcataaatgtgtgaagttgttctcaaacttttatgtactcaatttggatagtctaaggccaaataagaaggcaacaaatggaagaactatttgtgtacaagttgtggtagataagctataaagcataaagatatgctatatccaaagcctttatgacaaataagtttgttaaaatcgcaatcctgaatcagaattgggggtctctaaccaatcacagaatcacatacataaaaattgtaaaatcgtagattctgcctactagaatcatagaatcaggcctcttgattaggatagtaaattcgtagaattgtatggaagaatcgagttacaaccttgatgataaatgcgtggaaaatttgaagtatttgatcatgtttgccatgtttacctgttttatttgaggaactgtataatttggctctccttagaattcctcacacaaaaactcaaagaaacagtaacttcattatgtgatagctaacatcaaatgctcctccgttctatgcaggcaaggttcttgttggcaaagctgaacccatcggctacatataactcagcacatgatgttcctccaggttctgacatcatattcacggatgatgttagtttccaggtcttctgtgagcatcttcaaaggctggccgttcagtcctaaggacatgtatgcaaagttgtacaccgtatctgatagctatatttactgagtttggtaggtctgagttgtgggagatttctgctttccctttttttgacctcatgtgttcttattacatcgtgtcaggttttccgacatcagacaattttttcgggaaataatcttgaaagcatgtataagttgtccccataatattatttatccatcatatatacttctttatattgacctcactgtcatcttaaggtgtatagacaagtaagatttttgtggtcggatgttgtctcattttggcttccaatgtgttctggcgtggtgttcatgtttgttttcctttgcgacacaacgtcgatctgtgacttcattgtgatattgttagccatgcatctgccatgtatcttacaaacaagttaaaaacttttgaaggggacaacaatggtacttttagaaaacaatgttccatatctacggtcttccgtagtgaaaagatgttcaaaagcttcgatctttaacagtttaatttcattaattctaatagccttaaaattttcataaaaagtcgatgttgatagataaactatgatgagaaaacatcgaatctagttttaaaatatagccgtggcgatagtgaacattgtcctgttgagaatttcattgttgattttcagactgatttggtctaaccacttcaaatgtatttctgttcaatgcatgtaattgttagggcctcatcatttgcgtcataatgtatctgccgcggttaaaatttgaaattaaagttgattttagggtatttatggctaaggataaatggtctttacaacatggggaaaaatattgttttcttaaggccttccaaaattgaccattaatataagattgaaaaatttgatcattaatatcaccccaatacttacagtgtccaatagtttgttgaaaatgaagcttgggattcatcgactcaattacaagaaaatatattatcaaaaacgtaccaagctaagttatgagctaccttattacctatcttaaacagtgcgctaccttattataccttggacaatgcgagaattcatctttctcaattttgaggatagcattagtctatataaattgcccttgcaatgccaaacgaggagtcatatcgacaacatacattcactacttccgtacaatcagatttcgcttggatttgctacatcccaagtttacagccaaataaagaccaaccaacattggcattagccgcattacctctaccatcgcagttgaagggacgtatgtggtataagaacacatggcaactaagaaattggtatgcttcatcacatagtaaaatagcggctacgcttgattattcgtccgcatgaaaagctacatcaatattaagtttcacatatccatggaaatgttccatccattgttttttaagtcctctaggattgaatattattgatcttttattttagtgttatcttttttttccttgcatgaggactatacttcctcatttcattaagaagaagaggaacaaatacacgggagaggtcgaaaggatcatctccaaaacacaacacacaacaccaccaaacctcaactaaaacacatcgtgctatcaacctcacaaggagctccagcaaagcatgcgctccaactaaacaccataactactctcatttgctatagaacatgacctaaggatgccaccattaaaaacacagtcattatggtgcttccaaatatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6125 - DNA, 378 bp, Oryza sativa
cttatacccagagaacggtgcagaagatgttgaggaattcgtattgcctctgttgatgttgtctcctttgttctctccagtagaagctatggtgaagcagaagcagaggaagatgcaacgttgtcgtcgaagaaccggagcagtcgcgcttgaagtgctacccaaaaacttgatcgcccgcctacccgtacaggttctcaagcggacggaattccggaggcacctgctcatcccgtacacctgtgcgcgcaggtgaacagaaccagggaaggattctgcagcgcaagaacagaggaggaggaactcgaagcacaagagacgtcgggaagaacttctccatatccttctggtcgctgccgagtatatatatgtgatcgc

SEQ ID NO: 6126 - DNA, 629 bp, Oryza sativa
caatttaggcagctgtgtaagttgataaatatatttcatgacattccatccttgtagtactaaacattataattaatggataagattagaaagtaatgcggtggttcgatttaataacctaaacacttgtgtatattgtctcacaaatttccattctatttctaacaagccttatgacatatattttctcttgttcatagagggccaccaaagaacagaacgaagaaaactaatgaagcaacctcagagactagtatcatggctgctccaatagttacaccaataatggcataccctcctaggttagcctatcttctttatttcattctacattggatttagatcaattagttacataacaatttatttttcacagtcaaaactttaatttcaccgaggacaataggacattgaacaatagctcaggttcaagtatatcaattaggtaagtaattagatcaattatgtcaatttgctggtattatgttgttctatgcaatatattcacaattctctttttcagatcaagatcacttactggctccaaccaacctgagccatctaacatgattgtagccttgccatgtctgggggaggaaacacctacagttgcaccaaaaatgaccaag

SEQ ID NO: 6127 - DNA, 1298 bp, Oryza sativa
ctaagcttggacaagttcacaagagctctcagattgcgatggttgtggaatgaatggagagatcctgagcaagccttgggtgggattggaaacgccttgtgatggtgtggatagggacctcttcgccgcctcaacaaagataacggtgggcaatgggaatacgacgcgcttctgggactccgcatggattgacggccaaagaccaaaagacctaatgccgttggtctatgagatctccaaaaataggaagaaatccctacgccaaaggaaagaagacgactcctaggtgcatgacctgaccctcgatgcggattcatctatcacaatcaaccttctcaatcagctagtctgcctgtgggaggcggtatggaatgtgcacttagacagcgaagagccggatcagattgtttggaaattcacaagcagcggccactatacagcttcctcggcttatcatgcccaatgtttgggggcgccaaacacaaacttcaactccctaatctggaaagtttgggcgtcggggaaatgtaaatttcatgcctggctcatcattcaaaatagagtctggacgtcggaccgactcgcgacaaggggttggcggaataacggacattgccccctatgtcgttgtgacgccgagacggccttgcacctcgtcgccatgtgtagatacacgaagagaatctagcaccttattgctacatgggcgggatatcagcagttggaaccggcccaatgggaggaagcccggtcagtccatcagtggtgggagagcctagctaatacacccggcattccaaaaaagggccttcggtcccttattcttctagtagtttgggaaatttggaaggagtgaaatcggcgaatctttgatcacaaagagatggcaacaggtgttctcctagcaaaaatcaaagaggaggccagcttgtggactttagatggggctaaaagattgcgcgaactcatcccgcactctgtatagtgtatagtctaaagatctttttgttttacccctaggggttgtattttctccttctattcaatgaaaaagcattgctgtgctgttttttccgttaaaaaaaaatctcttttcagggtttgctgagaatgtttacatagttgtaaatcttgtttggagtactacttctgtttacttttgtaaggtttgatcatagcattttgcttccgtttttatttttctgatgcagctccatcatacatcgattgcattattgaagtgtgatgaaaattatagttatcatgtggagaattttctatcatatatctttgaatga

SEQ ID NO: 6128 - DNA, 8049 bp, Oryza sativa
atgatttctttagaaaaacagttcaacacctggaatggcttgctattcttctcgagattatgagcaacttgggatatctggcagcaagacatgacaggctgatgaactgatgacatgttgcaaacctaacaagcagtacagtgaagtttgtttgtactagtagacttactaaaactattacctgccctcgaggacatatataaatctaaatcaaaccattattaattactgaaatcgaaacaatttaaaagtacagctggagtcgtgtcgtatgaatataagcagatcagctctgctaaatctcctttcagtggcggtcaatgaccgcagcaaacgcttactgcacgtgtatgtacaatctgaagactcgtttatcacttatcacttcatcagtccattttttttctacaccaaccatagaattgaaggaggtggcataactatttgaaactttaatgactcagagcgcagtaaattaattacaccgttgatggatcgatcgatcgactgctcgatcatcagattcgtcaaacttcccaggagtagaggtaacgatcgctcgttcctcccggcctgtacttgcacgccaccggcaatctctgtcagctgttcaaccatttttatgtgacagctagttcaagtacacgagattacgagctgaacaattgtaaattgtgcggattttcgcttaactgaatcggaaactgccgtggaaatcgactgctgccgatgacccatcatcacacgcagcagtggtccagtccgccgagagccggatcagctgacagcaacaagcaggcaggagctagccaaaagtggtccactggcttggctcgcagtcgcagcctcacagtgcaaatgcgtgcagaagctggcctgcatggatagccgcagcctgcagggttgccgtctcgcgcgaagactttcttccccttgccgagttgcctgcaggagctagccaaaaaaaccgtcgcgctcgatcgccctcggcgctgtgcgcgttcccggtacatggccgccgttgctccagcgatcaaacgcgactactctgctacgctctcccggggctctcggtgcaggatgcacacgtcgccgtctccacagcaagaggggcattgattgattgatcaactagggggactcgctcgtttttctttttctacgaaggcttttgaccgttcggcccgatggtgatcacgcgcacactgccgcgcccggccggcgtcccgtacgtctcgtcttcctccgccgaccgcgcgctgccgtacgcgtcgcgctgcagtggtgaggtgatactctctcgcgcgcacacgtatatatacacatgtgccgagtttacttctaaactatttcttcgaacttctaactttttcatcacattaaaatttttctacacacataaatttttaattttttcatcacatcgtttcaattttacccaaacttctaattttagctgagctaaacacacgcatggtggattggtgatacgtacgtcgttttgatgggagaaacgccaagaaatctctccctgtcgcggcagatcggcgaatcaaaactagcagctcactgctgctgccgtgttctgactttcgaccgggagattcaacgggggagggagtcgctgggtcgacatgcacacagacgcaacgcacgcctgacacgcccggtgacccgagtgacaagtctacggcatgggctgtctgtgcaaggactgcatttcaccactcagactttggagtcgattgcaacagaagtaaccatatatacgcccataccgaaatgctgtatagtatctctacaacaacatactaatagagtaatagtaagtatccccattacgcgacagataccgtattgcgtgcatactgtgacgaaattgtcggcaagcgacaatatatatatactactgcatgatcgtggctgcaacaacaagagtacacgtacgatacgcatgcgggcaggcatacgtacaaaagaaactgttgaactgctcgaccggctttactgatgcgtgcattacgtcggctatacaatacagcatcaaataggtcccatgttactttcatgtgcaaaattaattcgtccgtagtttgattgagcgaatctacaacttgtttagaaaaatatcgttttcaactgctacagtggtctagctacgtgttgtgttaagtcaacaagtcaacccaaaagggctactattaaacgtgtaaactgattgataagatgatgcggctgtggatggaacaccgttgtgatggactgatagcattgccatgtactcaaccatggaacgaaatggaaatattatttcaggccgcaaaagaaagcatttcaattttcctgcttatttggagctcaggtatccaataacttttttttaaaaaaaataatttttttgtgtatgttatcagatgccgagtagattaattctgatgcgggactcagcatataacccatttttctcatgtagcagtccttttcatcctctttcgctctctgtaaatatgatcttctaagatgcctgaatatgaagaagaacaccgcggtactcaagccaatccaacagtgacacacaccatgtcgtaagtgtagtggcactaaccagtagtcaagattcaccgtggaaaactgaaggcatcggggtccctgaaagaaacgagccagggctaacccactgtgtgctcgaatggccagtcaggcaatgggccaatgacctcgggggcacaggtcaaaaaagatgctccaatcaagctagtattgctattattccctctattataaaatatgtatgacataactataactatatttcataatataaggtgtgcatgcatatatgcaattgactagcatctcttctccactatattattgtttttcttaactatgcatatcactctcaaatatataattttattatgtgcacttattgtatttattaggatgattcaaacaataatatgataataattattttttgatccttaaattaagaataattatgccttatattttaaaatgcagatagtaatacttttggcctgtcgctagggcaaaggagagagtacggctcaagctggcttgttcgcgagtcaaaggcacgcgctggacaaaataatacgtttagcaggcccaatgttcagttggtttcccactcgatcgagacctcgtactgaactgctcaaggctctcaagcatgggtgcttggatgatccgaataatcttgattctgtaaatttcacaactacagataatactttgataaaaactatcacaactctacagatttagcatcaattttataccatcaaaatatagatttaaaatcagatcataaaaaaactacatatttatgaatttatccttctagctaggccgaccttgctccttcacgtggctgctcacttcaatacttgtggccgacttcaaggacctgtcttcctgagcctcttcgcaagggcttcgtcttcttaatcctcctggtctcctagcaattgtggaagaagcggaactttagggtgttcgattccactctctcgttggtttttgtggtcctgagagcccattcttcaggaaggtcatccgtggtcaagtgctggcaccacggtttttaggggtatgttgggagtttaggggggggttcgcctccccctccctcatttttagagttttattttttccttagcagtcttttcttctttattttcctttgacccctgacaatagccttctggctggttgcgtcgtgtaactgaaattttgttttcttccaatatattaacgtgcaatccttttgtatgttcgcaataaataattattgaatttgtcataaaactatagaatttgtgttcaaatccttaaaatatatgatttgtgatgatctagttaaagcatgcgtagttttgttatttctgattaagatatggattttacattggtttccgctaaacacgtttttcaaactactaaacagtatatttcatgcggaaactttatataaaagttgttttaaatatcaaataaagttattttttaaattaaaaataattaaaactcaatcaatcatttgctaatgtctttcttgttatatatgctcttgcttaatcttgatttgctatgttctcgactggggccttactcttcttttctttttggaggaaaagattgcaaaatacgttgatctgcatgtttgaccaaattcatatataaaaatagaataacatttcaaacccaaaacaaatatactatagaactatattttatggtggattaatttggtgttatagattatgttgctacgttttcttataaacttaatcattcaaaacgtcttttaatatggaacaatatatggaacggagaaagcaaccgcttttacgaagaacagatactatagcatgagacaagcaagtcaccgtttgctcaaccactgctttgtaaattagtgatgtgattgcaagagatgaaaaatcggtcgcattcctaattcacctgtgatagtctgatgccgagggtgttgaatttttcgtcacatcttgtccaacagacgagttaaaatggctatgctatctgaggacagatccgttccttaataaatcaacgtctcactactaataatttataagtaacaacatgttctaaccaaaacgtgcgagaggaagctaataattgtggaatacatggcataatctacacataaggttcgtttcaagcaattcaaaatttaagttcggttgaagacagtgacaaaaacaaggacccgaacccagaaatgacggtcaaaataaatcctatgtatgaaccgtacaaaattgactgcccaaatgccaatcagggtagtaaatgaaatcaccactcaccagcaaatgagaaaacctgaatacctgataatgacatgctcgatcagtttgtacttaactagtacgtagcttaattaatacgtccatttcagatcatgaaatttatatcctacacggctgcgccagcgctagatgttaaagttgacgtatgtgtgcgacaatttagacatcaaacgatacagtgacggccgcagctttaaaatttagatgggatgaagattaaaatttagatgggatgaagatcagagatgttcacttgataagagcaatcgaacaaaacacgtatcatatttatagtttaatagcatagccgcctcgaccattatttgcggcgtgctcgcgcggcgaagagatggaataatttgtttgacgttacaccttgttatacctaattttgatggcctatgactattttaaggaggcatgggagtcttagaagtgtggggcgacactggtcgtagctaggtcaatcaatccaccctgcctaatgggtagatccgcccttgaaacggtaaccatatgtgaacaaagaattggtgaaataataatgtgtatagagtttgtgtcggatatgtgtaaatcggttataattttagggattggagttgaactaggtgttaggaatagtgtaagagccgaactctatcctagactctcttaaatagagggacgaacctattgtaatagtatggcaacttagcatagcgagagggagcggctgttggcggtgtaactttgatacccgcactataatatgctggatcggggaggagcgcctgtaatcagtgtccggctaagggttgttgtaattctgatacgctgtaatacgctagatcggggtgaggagcgtctattaacaagggacaattgcattcgtgcccctactttcaactgcaattatgatttttcccttactttttagggtttgcaattttacccctatttttttgaaagcgaagcaacatgttacccttggtttggatggtcagtttgacggtgttaaatcagtggtgaaatgacatatatacccttgtttggtattgcatatttgccctacgtctctatattgaaatgtgtatctccccctgtttggataagatggagtttgacatgaaatttgcccccgttttgtactgatatttgacgaacttctagcaaccttgataatatgacaaagacaaaatggcacaaatattcatgcaaaagaagcctcacaaaatgccacaaagtaaaagcagcattcggaattaatgttttcatcaagaagctaaacaagcattccaaatttgttgctgagcactaacagtgctgccctgcttgccttcatcggctcgccacgcggagccgccggtgcctcctgcagtcctgcctcgctacgcaggctcaaaggagtcgccacctcccgtttccctcgcggagccacgccgctaccggtgctacctgctcgccttgcaactggttgctccggcgtgcccgcctgctcgcctcaccttgcctgcttgcccaaccgccttttcgccctgcaggttgcagctagctgctcccattgccaccggctcgccacgaggacttgccccgccgccgcccgtttgcctcgccgcactggcttgctagagcctccgccgctgccgcctgtcatggattggggaatggggaatggatagggaacggtagagctttaggtcagttcatgcttccaagggtaaaccggtaatctaatatatcaaaaatcatttttttttcttttcatttctaattctttacctcacaattgtgggtcccatataactgccatccattctaggggcaaacggcgatttcgttttaaaaaaataggggtaaaattgtaaaccctaaaaagtgagggcaaaatcataattacaattgaaagtaggggtacgaacgcaattgcccctaacaaatattatgtcttgatgtcgttactgtgtatggatattctatagtattttttcagtgtttggttcttgatattacttgcttgcaatagaaagtcttcgcgtaaaacatatataaagaagttgctatttatccgagaaaggcactaaggccccattcattttaaattaattataaggggatggatattatgtttggattatttgtaccatactgattcgaaaagttcgattatttttttttaaaaaaaatctaatttatccatccaatcgtccatttcaaaccagccgttagcgagaatactaaacggcccagacaaattcaagcccatcaattggacgttcgaaggttaaaagtgggccctttattatctccaggctctgtatttggtagcccatataaaggagctaatccatttagctagttgggccaaacgcccagaatccattatgttagcaggcatgataatagtagatgaattatgcatcattttttagcttttacaactttctgaacatatgttctctttatgtttaagtggtttaagccatgcagtgaatcatgttcagactttccataccttcagaaaccatatgcattttttctgtgagtacaagttgaacgtcagaaatatacaatttttccgtgggctgtgtgcgggaccgacagaaaatatactgacctacaggcttgctccaaagtgtggtagtgagtatattagtatatatgtcacacactttggcagtgctgttaagttgtttagtgagatcaggaaacaataatgcgcacccttctggttgacaaaagtttcacatagcttcgagctctcacaatgggaaaaaaaaaacataatccattcgaaagccctttgcaaaagaatggtaggagggtttctcagagaaaccagacatcacatctcatctccccttggtcatcggtcaagatgatttattaagcatctacttcgaatgatatctgatcaatcaatcccaaatcttctctccaagcatatctcaatccctgttaatgactgagaagcatatgctgtccaagccgatggttcgtaagtaaccaagattattccactgcttacatgggtaaaaaaatcatgcgacgcatccttcttccttgtcaagctgtcatcacattgtcaatgcaaatcctcctaatcaggagtaagaatatttgggctatcattaatcgctagtataccttcttgcaaccgaaagagaagcatgagccctccagttaacttctgtcgtttgtaagg

SEQ ID NO: 6129 - DNA, 1766 bp, Oryza sativa
caggttgtgagctattgttggtgcatcgtggtgctgcctgttagtactactcctacgtaatgtagcagtaggcatgcccattaccttggcaaaatggcagccctagctatatctttgttgtacacttgtgatagagagagatactagtgcagtgtgcacacacatctatcccagcaaagccctcaactagtgtagtaccgtcacaagcttcacaaacttactctaattcacaatgtgtttttgatgacctgcgacggtttctggcagtgtacgtcgcttcgatgatcgatcatatcagtgcatctcccgatccgatgaaggctcagacaccaaggaaaccggcttgattcatgtgtcattggcgccgcagccgcgggggcgtgctcaccagcaaaagtgaagtctcgtcgtggggcaaaagcaggcaaggggcaggcaggcagtatagcttagctcctgtataaatcgatcggcagctgagggcggcgaaagcgtcgtctcccaatggtgggggtgggtctccccgtgcggccggccgacagcgcgcactgcttggataaggtgccggacacaacggccggacgaaaggcgcgccgcggggctcgattccagcccaccacctgatgatggatggatgcaacctgcagatggcgtacgtcacgtcgctgagcgcagcagcaggagataccggagggtttggactttggactgcaccgggtgttccacgcggcccacgctgggaggcagggccccccccccgccggttggtgtcgcccccgtgccctggtctcgacacgagtcgatcgatcgatcgatcgaagaaaggctatagctcaacctctagcgcaagatgccggcagcgcggatggggattgagacgggcgctcgacaacttggccccctcggatatgctttgctaggtaggagtaggacgcaggacgaccacgatatatctcggcgacgtcgctggctgccggtggtgcgcgcgcgggcgcggaggcgaaggcgaaggctttttccgcgggcgcgctgggctggctggccgctttctgtcgcttcgtggccttatcttgcactccgtctttgcaggaatgggccgcgcgcgcgcgctcatgatgagatcgatcgtttggctttggttggatcagcgcgggcggtgcgtcgctaggcggtttaggctttagccctgccgcgcgcacgttcatgagcgctcgtagcggtacgtggtttttgtcgatggatcggtcggtttcatcgtaaatctggtggacgtggccgtaggggttggtttctttctcgtaagctgggtgggggccgcggcgcccggtccagtcgaaagtcgaaaccgtcaaatcggccgagagcagtcgcaatcggcacacgtcgatcgctttcgcgtgcgagcgttgtttcatgcctcgtcaagatgacgtcgtcccgtgtatagttggccatatgggtcgcccggcacggcacggcccaggcacgaccgggcctgggccgaggtcagtcgggccggcacggcacgacaaacatgccggcccgacaaacaagccgtgccagcccacgggctacaaccacggccccagtagcctcgggccgtgccgggctggcccgacggcccggccagcccatcgtgcccgtgccggcccaggcacgccctggcaaaaaaccccttcaaaagttcaattcaacacaacaaattgacataacacctcaaattcaagaaattcacatgtaattcatcaaataactcagggctgcag

SEQ ID NO: 6130 - DNA, 555 bp, Oryza sativa
gaagccacgcgacgacgccggcgagatctcggccgtgtacacgggcgcgatcatgatcgcgtaccccacgccgacgcccgccacgaagcggccgaccatgagagtggcgtagtcaccggagaaccccatgagtagagctctggcgaagaagaaggcggcagcgaagacgacggtgaaccgccggccgatccagtccgccgtcctccccgcggcgaaggagccgacgagcgagtagatgttcaggatgcccatcaggatctccacctgcacgtcagtgatcttcaggtctttcttgatgtacagcgatggccgctcatcaccccgatgtctgcaaaattttggcgcgaacttgaacagtcagtgctcgctgacagtacactacacttctgaaaacaaattcagaccacatctgaagatttttctttttttttttttttgagatgatgtgaatacgattgtactacgagtaccatagccgagaatgatggaggccatggaggcgaggatggcgcaggtgaatgcatagctggcgttcttcttcttggggtcgacagc

SEQ ID NO: 6131 - DNA, 684 bp, Oryza sativa
attattaagtccctcattgtaagttcactgtcgtatgtattcttacgtaaagaccctctataggaccgcgctctgaaacagtgcaagtaaggatgttttctgagaaatagaacaccctatccccccattcccccgaaaccctaccactaccctaccagtactgttcccccatccctcctcttcctttgccctgccctgccctagcgccgccgccgcttttccttccctccccggcttctcttcgccggcgacgacgatgcggtgcggtgtctccggctcagattctcaagaattctcgagctctccatgtcaagtagagggagtggacggtgcggtctgttccccgaaaccctagccaccactattcccccacccttctctcgctctctcccctgacctttgcgacggcgcagcctgacctcgacttgccctcctcttctcaacgccgccgccgccagccttcctcgcatgccctcctctgacctaccccatatcctggagctctccctaccaatgctcccttctctctctctctctctctctctctctctctctctttctcccctcagttgagctagctccggggaatgtggtgatggagatcaatggtgagggggatcaatccgctagcccggtgcttgatttggtggataggcgcactcaatcttgaatccggtggtgttg

SEQ ID NO: 6132 - DNA, 20046 bp, Oryza sativa
gaaattcagctgcatctgaatttagtactactacactttcacaatttgtactgtgcttaactgacctaccgcatgttataagaagacaaatacatatactaatgtatatacattagtacagtacaataaaattgtcacacttcaagcgccagttcgttaaaaaaaaggtgaggtacagcactcgagagtcgagatgtgctatgagatactgtaacaagtatatacgggttaaggataagattcagctttttgctaatccatgcgtgggcatataaaagtctttgcagtatgcacttttggggggagactttttccactcttcttggacactaatcccagaaaaaagattgtgcagtacttgctctatgaaaaagcaagcagattgatcaaacaatgatagagctttatgatttgttaatggttgctgcattaccaaatgcagcttgtcaaaaagagccgttgtcccatttcagccatatcggcgccagaagttgataatcacatccacctactctcggaaaaaaaagggggggggggggggggtccagcgacgtgtgagtgacccgaaggaatcactagtactttattttgtcttggcctaggaagcttaatcatgtagtaccgataattttataaggcaggaggtggctaagcaagtactccctccgtttaatttgtttattataccagcactcagttaagatacttactcccttcgtcacagaatataaatatttttagaattagacataattattaagaaagttggtataattaaatggggaagtgttgtgattggagtagaagtaaaggtagataggaaaattaaatgatggagggttgtgattggttaagaagagaatattggtagataacttattatattttgagacaaattataaatactagaagttgttatattttgatacggattgatggagtatcttcttactaccttctaaaacatatgagatatatcttccccttctcaccattcatccagcggttatactagtactaatactcttataataaaatgtaatacttactctaaaagagctaattagaatagagttaatgacggtagtaatgtaatttgtcaacacattctaatttagggtacgatttgatgaaatgaaactaaaatgaaaggtgatgaagtaaggtgatcactgttatatgggacccataactattgagcccacatgtcggccaccacgtccaattcccggcggctatgcaacggccggggacaggtcatacctgggcccaccttaccagaggctgtcaagatgggcccacacgccattcggattgtagtcggagggctcggaggtgatccgaccctgctgcctcctcgcctcgcgccgtctataaatgctggccgatttccactgactcctctgccacacagaaggcgagctctcgaccgccactactgtacacggcccagagcgagcctcctcctcctctgcaccaccggagatggcttccgccgcgctgccggaggccgtcgcgccgaagaagaagggcaacgtccggttcgccttcgcctgcgccatcctcgcctccatgacctccatcctcctcggctacggtaactaatcaaagcgcattcacttcccgcccagcacagcacgagctgctgcttctccccagcatgggcgctcatggcgatgtgcatgtgaccttgcagatatcggggtgatgagcggggcgtcgctgtacatcaagaaggacttcaacatcagtgacgggaaggtggaggttctcatgggcatactgaacctctactcgctcatcggctccttcgcggcggggcggacgtcggactggatcggccggcggtacaccatcgtgttcgccgccgtcatattcttcgcgggggcgttcctcatggggttcgccgtcaactacgccatgctcatgttcggccgcttcgtggccggcatcggcgtgggctacgcgctcatgatcgcgccggtgtacaccgccgaggtgtcgccggcgtcggcgcgtggcttcctgacgtcgttcccggaggtgttcatcaacttcggcatcctgctcgggtacgtctcgaactatgctttctcccgcttgccgctgaacctcgggtggcgcatcatgctcggcatcggcgcggcgccgtccgtgctgctcgcgctcatggtgctcggcatgccggagtcgccgcggtggctggtcatgaagggacgcctcgcggacgccaaggtggtgctggagaagacctccgacacggcggaggaggccgcggagcgcctggccgacatcaaggccgccgccggcatccccgaggagctcgacggcgacgtggtgaccgtccccaagagagggagcggaaacgagaagcgggtgtggaaggagctcatcctgtccccgaccccggccatgcggcgcatcctgctgtcgggcatcggcatccacttcttccagcaggcgtcgggcatcgactcgtcgtgctctacagcccgcgcgtgttcaagagcgccggcatcaccgacgacaaacacctcctcggcaccacctgcgccgtcggtgtcaccaagacgctcttcatcctcgtggcgaccttcttcctcgaccgcgtcgggcggcggccgctgctgctgagcagcacgggcgggatgatcctctccctcatcggcctcggcgccgggctcaccgtcgtcggccagcaccccgacgccaagataccttgggccatcggcctaagcatcgcctccaccctcgcctacgtcgccttcttctccatcggccttggccccatcacgtgggtgtacagctcggagatcttcccgctccaggtgcgcgcgctgggctgctcgctcggcgtcgccgccaaccgcgtcaccagcggcgtcatctccatgaccttcctgtcgctgtccaaggccatcaccatcggcggcagcttcttcctctactccggcatcgccgcgctcgcctgggtgttcttctacacctacctcccggagacccgcggccggacgctggaggagatgagcaagctgttcggcgacacggccgccgcctcggaatcagacgagccagccaaggagaagaagaaggtggaaatggccgccactaactgatcaaactaaccgcaaaatcaccaaatcctaagggttttcttgcaaaaacgtgtgctgtactggctagctagcaagtagtagcagcaacgtgggaagattcgctgatccggcgttgctggagagcgacggccggcgacgacaaagctgagctccagctcgagacttcttaaaatcatcttcaagtacatggattttattttgctctttgctttgtccgtaaaagttgtactatgcgatgaagaataccagtatgtagcaaggctgaggttgtgtgtagctactagaagtgtcagtcacgttgttcttgtaagaaatgtttaactgttaattaagcagtattgttgcagtaatcaacaaccttagccagttattcctcgatcgctgcaaggggtcaagcatgactgcatgaggttagaaaaattggcggtggttcgaggattctgccgagtgagtcaagcaagagacagtaaagtgtgaagaaaaaaaaaactatctgtcccttttaaaatgttgtcacggctggttgccacggagaaataatgaagttttaaattaagttgttcgactcaatcacgggatcggaatcttgtgacgatgcataaagcagccaacgcctgatacgaagtttattattagcgctctcacggtctcactgattagactacctaatggtttacgaatgtgtcattatgctagtgagcatgcacgctgcacaagtgacaattccaattgatattttttttgtttcatgaagaagttaacaagaatgcacaatgataaatactgataattgataattccagctttgaatttttgtttcatggagaagttgccaagagtctttccctgtacgcggcggagtcctctgcttccatggccgtgtcgtccatgccgaacaccttgccgatctcctccagcgtctggccgcgcgtctccgggaggcgagtgaagaagaacacccacgcgagcgacgagatggcggcgtagaggaagaagctgccgccgatggtgatggcgctggagagcgacaggaaggtcatggagatgacgccgctggtgacgcggttgcacgccacggcgaccgcgaagcccagcgcgcgcgcccgcagcgggaagatctccgaggtgtacacgccggacatgggcccgaggccgacggagaagaaggcgacgtaggccaggatggacgcgacgcacaggccgacggcccagctgggcacctgggcgtccgggctgccgcccacgacggtgagccccgtcgcgaggccgacgagggagaagaccatcccgcccgtgctggtcagcagcagcggccgccggccggcgcggtcgagcaggaacgcggcgaccaggatgaagaccgtcttggcgaagccgacggcgcaggtggtgcccaggagctggtcgtcgccggtgatgcccgcgctctggaacacgcgcgggctgtagagcacgacggagtcgacgcccgacgcctgctggaagaagtggaggccgaccgccgcgagcacgattcgccgcatggccggggtcggggacacgacgagctccctccaaacctgcccctcctcgccgcctctcttcttggacacggtgaccacgtcgccgtcgaggtcatctgggatgccagccgccgccttgatgtcagcgagccgctccgacgcctcctccggcgtgtcagcgatcttctccagcacagccttggcgtcggcgaggcgacccttcatgacaagccaccgtggcgactccggcatgccgagcaccatgagcgcgagcagcacggatggcgccgcgccgacgccgagcatgacgcgccacccgagggagagcggcaggcgcgcgaaagcatagttggagacgtagccgaggaggataccgaggttgatggagacctccgggaacgacgtgaggaagccacgcgacgacgccggcgagatctcggccgtgtacacgggcgcgatcatgatcgcgtaccccacgccgacgcccgccacgaagcggccgaccatgagagtggcgtagtcaccggagaaccccatgagtagagctctggcgaagaagaaggcggcagcgaagacgacggtgaaccgccggccgatccagtccgccgtcctccccgcggcgaaggagccgacgagcgagtagatgttcaggatgcccatcaggatctccacctgcacgtcagtgatcttcaggtctttcttgatgtacagcgatgcgccgctcatcaccccgatgtctgcaaaattttggcgcgaacttgaacagtcagtgctcgctgacagtacactacacttctgaaaacaaattcagaccacatctgaagatttttctttttttttttttttgagatgatgtgaatacgattgtactacgagtaccatagccgagaatgatggaggccatggaggcgaggatggcgcaggtgaatgcatagctggcgttcttcttcttggggtcgacagccatggccgtgagcttggtggattcgcggcattgtagtttgcagcttttaaggaaaaagcaaacgccgttaatctgatcgaacaagcgattgaaacgttggctgatctacgcatgcatgtggaaattaaacacaacacattgaacacgaaaactgactttttaaattttgtaagcgtctgcgtgcaagcaacttcaaaaatcctaggcttatttgactcctggagtccacaatatttgcagccattttaaaacctatattaaccaactgaatgtgctcagattatcctatctccaaggaacgctgagctcagtatctccatggaacattaattgattaatacaacttgaagtagcatgtagatagaagtatagaatgggagtggattctaatccctcgagggggatatcccctcgtatatctttttcttcaaattcgatgcaaataattgtgaaaaattttgaaaaaaaatcgacaatatagagtataatgatacctagtagtccaccaaaattaatgttcaattttgatctacacatcgagaaacaaaaaagataaatttagatataaatagtacgctactattcatacgctgaatttgtcttttttatatctcgacgtgtgatttgagtttggacttaagattttgtggagttgtatatatgtgttgtatgaatgttgtcaaatttttccagaatttttcataacagtttaaatggtttttaagcaaacgagggaacatcccctcgagggattagaatagtttcccatatagaacttaacgcattgctcagaatttctttttagtaaaatttcacaaaactacatatactttaataaatttccacaaaactacaaattcaagccatagtatcacaaacttatagatttaggaacgaatttatcataaaactatatattttagccattgtatctcaaaactacaaacttagtggatttttttttcacaaaactacagatgcatccattttctcataaaactacatttttttttgcgaggataaaactacacattttaaaatttaccatggtaataggtgtatggataacacatctaaaatatgtagttttgtgaaaaaaaaagacaatactaaatttatacttttgagatataatagcttaaacatatagttttgtgataaaatcatttgtaaatctttagttttatggtactgtggcttaaatctgtagttttgtgataattttatcaaaatatctatattttagtaaattttactcttttgttttctccgattattctgccacaacaagaatatcttgatcagttgctctattttcaagtttaagaagttagatactttttaataatgaaaatggtttatatcttcgacctctgcacaaccactaagttttggtatctataatataaacttaagacaatgtgacaaactcccaactctctctagaaaaggttcaacttaaaaaaatgtctcaaaatcatattaattctaacacatcatatagtagacaccacattatctaaaataaaataaaaaactttgactattgattttttttttgaaatgataacctcagagaggatagggagtgcctgttttcatttaagaagaagagacttggtccagtttttgagggaaaaccagtcccaaaaatctcatataggcacggtttaaggggaaaaccgagcgaaacccacacaaagaacaaaccaaaaaacttgcgacaacacaactcaaggacaaaggacatcgttgccgagctcaaaagagcagctccgacttcctaactatacaccacagaccatgtagggcaggatcttcaagacaaagcctccaaggaggaaggtagcgatcaacgccaaacaacgtctgtccgaacaccggaagaaggttttcacccgaagaaatgggtaagcaaggaaacgacgccttcaagaaggaaatcggcgcccacatgcgtcgacatcgtaggctcaacccaagatggagtagggccttcgccctggctctctctctctccctgccaactacaacaacccacgctaccacagcgaagacaagacgaaagcggaagagggttatcgttgccgagcttgccacttgacaagcagctccgactcccccccccccccccccccaaatgactatcgattttaaaagtatgagtttttttgaagtcactttggagtacttctaaagttagatacagttgggccaagagtgagcccagctcaactccggcctgggatcccaacgctataagcccacgtagcagagtcagtaaacccagccggccgggccgtgtgctccaagttggagtccgagtcgtggctcttcacagaaacaggcgccgaattggaactggactcctgtactgtacatcccaagaataaatctgacacaacacggtaaacacgacccccagctaacttcaccaaaacaaccgtgtaccggcgccatcagatggcaaagcgagccaggacgctcaccggcgatcacctccgctcctcctcctcctccaaccaagccccctcttggggtgctaagcgagcacgcagcggcagcgctctccgtgatcggtcgcttcccgattcagagtggtacgtcacgtacgtgtcgaagcttctcttcgacaggtttgctcttttttttttcttccctcaatttgatccgattcgatttatggcgggagcaggagagactggtcgagcattgggaatggcccggcgtggctgatctccgagcgcgtgctcgccggcgacgatgtcgcggactacgtgagcttccgcgccgtgtgacgctcgtggcggcagtggatgaccagccctcgcgcgcacggcccgctcgacagccgcttccacccgcggcaatgggtcatgctccgcgactagctcgccgtccccgatcgccgccgcttcctgaacgtctcctccggccgctgcatccaggcggacctcccggagctccggggccaccgcgtgttcgggcccaccgcggagggcctcctcgtcctgctcgacgaggccaccttcgccgtccgcctgctgaacccactcacccggcagctcaccgacctcccgccggcgaccacggttctggacccgaccagcctaatgatttcccccgtacactacctcctccacgttctcacggtgcacggcgccggcctcgccgacggctccgcgacggtggtggtctacttcgagaacgcacgtaagctcgccgccgccaagcccggcgacgagcggtggacggtggtcgaacccgacgccagcttcgcctccgtctcgtcgttcgcgggccgcttctactgcgccacccgccacgccatccgcccggtgatcgtggaggtgaggacgacagaccaccggctgccgccgcagctggtggtggtcgccaagctggccggggtgccttccttcccgcggaactgttagaataattgggctaggcccaatttataatattaaatctcaaaggcccataataaatgttgaggataataataccacttcaggatttaagcgagaaatatctcaacctaaatagggagttattagaggctccctgttgaccagttgaggtgagggtcggaatgccacacgcgcgcgcgcgcggggcgtgggcgaggttgcggcgtcacgtcgctatccttttgtagccactaacccgagggcgaggcgtggcgcggcgcggcgtgcgtcacgtcgctatccttttgcagccactaacccacgttcccacgattccctccgcaacagcgcatccacgttctttctcctgataaataaggaggccacgagtccgatccgacttcttcgcttctttcccggtgttagtttcttcttctccgcgcctgagttgctctcgcttccccgcttctgatctcttgcgcgcacgagagattggaaggagcaatgcctccgaaaccacaccttcgcctgagatctgcaccgggtaggcgggtgatcaggtttttggggagtgcctcccgcacgactgctcatcgccatgtctggagttgctgccgccactgctggcggaggtggtacgccgccgccgacaggagctggatctggatccggagctggtgcgccaggaggaggtgccgtgaacgactacaacaacggaggcaattctgcctcaccatccagcggagagccattctcggggtataatcttctcctcctgctactgctgttagcgctattcatgttcccattgttagcgctatactatgtgcgctatgttcttgttcctgttctacatgatgcctctagcatgttatcgcgttactggtatgttcctgttcctgacattcatgatgcgcatagtatgctactggttatgttaagatcaccctacactgcttatgccatgatcattgtttcattttcttggattaaaatatgtcgattaatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaaaatagtggacgtgtacatgcacatgccttctgggaaggacatgtgggatgcacttgaggccaagttcggagtttctgacgccggcagtgagctgtatgtcatggagcagttctatgactacaagatggtcgatgaccgttctgtagtagaacaatctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtctaacccaaggctgcaaccaattttaagaagaaaggcaagggaaaggcaaagggagactgctttgtgtgtggcaagtctgggcattgggccaaggactgtcctgagcgcaaagacaggaagtctgccaacatgatcattagcgagggcggaggaacatcggggtatggtaaaatattacctacagttctctctgtttttcattcacctgattggtgggtggatactggtgctaatattcatgtatgtgctgacatttctctgttttcttcttatcaagtcgggagaggttcctccttgttgatgggaaacgggtcgcttgcggctgttcatagtgttggtatggtcgatctgaagtttacttcgggaaagaccgtgcagctgaagaacgtgcagcatgtcccttcaataaagaagaatctagttaacggctctctattgtgtagagaaggttttagacttgtgtttgagtccaataaatgtgtcgtatctaaatatgggacttttgttggaaaaggttatgacagcggaggcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagtttaattccaaaattcactttggtcaaaggttccaagtgccatacttgtgttcaatcaaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggcctgatagaggtggggagtatttttccaatgagtttgcatccttttgcgaagagtttgaaattattcatgagatgacgcctccctattcaccccaatcaaatggggtggccgaaagaaagaaccgtactctaactgagatggtgaatgccatgttagatactgcggggctttccaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagccaaaaagcagaaacttggaccaaaaactgttgattgtgtgtttcttggttatgctatccacagtgtgggttatagattcttaatagtaaactcggagtacccgacatgcatgctggtacaattcttgagtccagagatgctacattctttgagaatgaatttcctatgaaatatacacctagcacttctagtaaagaaactgtcatgccccatgagcactttgcaccgatagaacacgatgatcaaacgcctgaggaaaatcctgaggaggacaacattgtagatactcgcaagagtaagagacaaagggttgcaaaatcttttggagatgactacattgtatccctcgtggatgacaccccaagaaccatagaagaggcatattcatctcctgacgctgactactggaaggaagcagtacgcagtgaaatgaactcgattatgtctaatggtacttgggaagtcgttgagcgtccatatgggtgcaagcccgtaggatgcaaatgggttttcaagaaaaagcttaggcctgatggtacaatcgaaaagtacaaggcaaggcttgtagccaagggttatacccaaaaggaaggcgaggacttcttcgacacatactcaccagttgctcgcttgaccacgattcgagtactacttgctctggcagcctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagcaatggcataagaagtttgacaccacgcttacctctgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaggatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatatgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcatttcctaggtggaagttcaacttaacagtctccaccaaaaccctggtatatcaaacaggcacaacattgggaacatttcttatgagccttgaaatttggtggggattgttagaataattgggctaggcccaatttataatattaaatctcaaaggcccataataaatgttgaggataataataccacctcaggatttaagcgagaaatatctcaacctaaatagggagttattagaggctccctgttgaccagttgaggtgggggtcggaatgccacgcgcgtgcgcgcgcgccgggctggggcgtgggcgtgggcgagggcgaggcgtggcgtggcgtggctggcggcgtgcgtcacgtcacgtcgctatccttttgcagccactaacccatgttcccacgattccctccgcaacagcgcgtccacgttctttctcctgatagataaggaggccgcgagtccgatccgacttcttcgcttctttcccggtgttagtttctccttctccgcgcctgagttgctctcgcttccccgcttctgatctcttgcgcgcacgagagattggaaggagcagtgcctccgaaaccacaccttcgcctgagatctgcaccgggtaggcgggtgatcaggtttttggggagtgcctcccgcacgactgctcatcgccatgtctggagttgctgccgccactgctggcggaggtggtacgccaccgccgacaggagctggatctggatccggagctggtgcgccaggaggaggtgccgtgaacgactacaacagcggaggcaattctgcctcaccatccagcggaaggccattctcggggtataatcttctcctcctgctactgctgttagcgctattcctgttcccattgttagcgctatactatgtgcgctatgttcttgttcctgttctacatgatgcctctagcatgttatcgcgttactggtatgttcctgttcctgacattcatgatgcgcatagtatgctactggttatgttaagatcaccctacactgcttatgccatgatcattgtttcattttcttagattaaaatataccgattaatgactatatttccaacaggaacctgatgcccgaccccaatttctaccgtacgccgcacgacctgcacctggtcggcaatggcggcaggctgatggttgtccaccgtagccgcagctaggtctcgcactcgcacggcggcggccgcaggagcagcaagtacagcgtgcactgggtgtatttcgattcgaagaggacggtgtccatggtcgtgactcgctttcgccggcaagccctgttcatcggcgcgtaccgtgcgatttcggttaatccagaggcgttccccggtatcagcccggacaccgtctacccaggctttgattgcgatgataaaccgagctcgcagcaagttggtggtggcttggatggatccaacgtggcatttccacatacagctgttgattgtttatccctatgtataagccagcctccgcgtcgctctcacgcgggtggctcggggcgaaaccctagccgcccgcgccgccaccttccccacccgctctagccgccctcgccgccgccggagcccgccgccggaaaccgcgcggccggccaggaaggcggcggcggggaaaaccagccggcgacgatcctccccctcggcgtgggaggtggagtggcgagcgtcaggcggaagacggcgtccgaagaggtccacagggcgaatccggccacgccggaggcggattcggccccctcggcggctgatctggcctccccgtggccggatcgggagctggcgactccggtggcggcggaactcgcggggcggtgcgtcgactggcagaggaggctgacgtcatcgccaagcacgtctctgaccggcggagctcgcagcgacggagatggtagcagctggctggcggcgggaggcgcgggagaaggcagcaagtggccggcacggctggcggcggcggagggcggcatggcgcgcgcgaggaggcacgtgcggtgagaggggacacgcccggcggcaacgtaggctggcgaggaggcgcagacggcggctgtggaggctggcgcggccggcacggagggaggtgaggccagcggaaggaacgggccgttggcggaggcttggaggctgtgaggccagcgtgggcgcggtggcttcgctgagaggccggcgcggacgacggcatggaggccgtcgtggcgagtcctccagaggcggcgaccggcgaggtgcacggcgagcacggcacggtgcggcggcgagcctaccgcattgggaggtcgggtggtcagaggcggtggcgatgcgaccaagtggcccctcaagggcagcttggttgaggcggcgacggcggtaacgccatgaggtgggagttgaaggctgcggcgatcttttctccaggcgtcagtcctcttgcggtggcggcttgccgctgcaagatgaccacgttggacgggccagtgtgggggagagaggattcatccttctctctcaccctttccctttccaacccgcccgcgtggatggagccggagcgagccgaagtttgagatcctttctgatggccgaccggcggcgaggcgtcggcgcggtggccacgcgttgaagaggattagctggtggtggctgttgattctgacgagcactcgttgacgcgggggaggaggaaagcaatgggtgaaagcctagccttcgggccggcaacggcgacgcctgcggggcgttgttgcgctttcctcctttggtcctttaggtgaaaaccacatcctgttctaggacgggcgacggcggtgctctttggcgtcgcttcctccttggaggcgtcgtttagaagttccattcgtgttgtgtgcttgttgggtttctgcagtgggatcagacgtagacgcgtggtgtggttgtattttctttttcctgactgcagtctcccaggatcgtaatcttgtattttttttcttctatatcaatagaaacgtcgcaatatcttgtgctggttgtttcaaaaaaagtggtatttgaataactgttttaatttgaagagaaatgggtggaaatttgtcagccatgggaggctagtgcaccttaattaatatataaaaaataaagaactaaatatagagaaaatacgattaattaattaatctcaatgatggtaaatacattcccagtcatatgggctgtagagcctgagcgtggacctgccagagtacttaagccgcttgtggtcgtctttgtcggtctagagtaaatttagtttctgaggtactaaaattttttttatcttatagtacctcacaaaaactgtaaaattgctcacgataacatggatctgtcctcgtttttctttttcaacgagaaagaatcctcacctctccttggcgccaaggacgccgaaatacacgaggaaccacgcgaacacgatgatcgcggagcacgcgagcaagttgccgtacacggctgtaacctcgtaaacccacgcgaagctccacaggatcgccgccctgacggcccggttcacggcggccaccgcggtccgcagccaccgcggccagccactggacgacgacgcgtccgccatctgcacggggccgagcaagagccacaccagcgccatcagcgacatcagcatggtcgcggacaggctcctcgcccacttcagctgctcccgccgccgcttcatgcccatggcaacgccgccacggtgggcgtgaggcgacgacgggtggtcggccggcgccggcgcgcgcctcgggcagcagccgccggcgagcgctttcaccagcagccaggcgagctcgagcagcaccgtggagacggcgaagaaggcgaacacgacgaggccgaacgccacgagcgccctcgtcatgcgcgtgtcggacgggacgccggcgtcgcggaacgcgcgctgcacgtacaggaacatggacccgatgcccgacgcctgctggaatgccttggcgaccagcgcgctgacgatgttgcgccggaccggctccgtcggcctcgccagcagctccagccagagcgcgcgctcctccctccaccgggttcgccacgccggcgttgccaccgtgtcgtcgcagccgacgtcgtgcggctcgccgagctccgtttttgtctcgagcagacggagctcggcatcctccagtgacaacgtcctggagaggacgcgacgtgcgtggtccttggtcaagagccactgtggcaactccggcatgaggaggacggcgaagccgagcaacgccgggatggccgtgccggtggctacggtcagccgccaggcgacgcgcacggggaggttcaagaatctcggggagaagcagaggccgccgaggatgcaaccgaggcacacgaagccgtcagggtgcgaggtgaggccgcggtgcagcgacgacgggctgagctcgccggcgtaggccgggacgctcatgagcgccaggcccatgccgacgccgttgacgaagacgccggcctcgaacgccgcgaagctggtggcgagcccgcgggcaagcgcgcccgcgcagagcaccgccgccgagagcagcacggtgcagcggtcgccgacgacgcactgggctcccacggcggcgagcgcgccgaggacgcaggacgcgacggcgacgcacgccaggagcttcacgccgggcggctccggcagcgtggccgagccgcacaccatgacgaggtctgcatcgatcaccaatgcgctcgcaagatcacgccgtgcttgatggacagatcgatgcatctgcgcgcgcgcatggatgggatcgctggttcttaccgtagcccaggaggagaggcgtcgccgacgagagcacggcggtgacaaagccatatttgttcttaggacgcctcatctccggcaagaaaagaacaccgtctctattcactaatcctaccaacaaatttcgagtggtgaatgctgatgaaattctctgcaaatctgataaaaagaatactgatgcagatgagaggaagcgatttgagtggatctgtaaatcataagagcacgaacggtctcaagacgaagatggctctgaatcatacccgtcttaaacacaacgatcttcccaacacctgattttttttttcaaaggtaaatctcttctcataacactaatccaccttcagaatcattccaaggcttccttcttctcgttgaaatattggagtttcctcaactctcatccatgtgttgtgatctcccttttgaaagacgcagctgctgttgcagcgacgacgtaacaaactcctgaaaccaagtagtccacggccgaaaaactctctccaggtagttcattagtagcaacagctaaccgatttactagggagcaagtagttaggcttgaaaatgccagtcaaagccatactttccgaagataataatagtagaagatatatataacattttacatcctacaggagcaatagatagacagatttccaccgaaacatcatttgataaatctgaatacccatcctgaatcctgcatccgccacaccctatgagcgttgtacgatgttggattaaacacacaaacataagttttgctacttcttccgtttctcaaaatatagtaacacagtactaaataagacaacatagatccatactactaaattagttctcatg

SEQ ID NO: 6133 - DNA, 3553 bp, Oryza sativa
ttatccaaattcaaacagttcagaccccccacccccaccccacccccccgggcgggaatagttcagattcttacctgatttaaaaacctacaagcttcagcctaaagaaatccaagaaataaactagtagccaaaaactagaaaaacgagtttctccggattgtcaccatcttctaagaatctctagctcccaaaacatgtagttgaggaacataaatacagagcacgtcaagactggaacaaacatgaacatccagattaagcaccaagtataactgggtatatatcgatctgttatctgtatgacttaaggcacggtacaacgacaaggtaacatcatagcgaactagctatgccataagtttctccttttggagtgacgaacagctacatatatcaaccatgttcctgaaggtaaccgagactatatatataagcggccactacagttctcagaagtatccagcattttgggctgtcctgatgatctgaaagagagctgcacaaagaaaagagtagaaaacacaatgacttggtaagatgttcataaagttatgatgaaaaagatggaaactactgccaaggctgtaatgaagactgaaatagttgcaggatttttcatgcaaggagttctattttaccaacattagactgtctgttccatttgaatccttaactagggtaacatcaaaccttcctcttctattttccaaagtcttaaggagaagcatatatttttttgagaagtttataagcatataaggatttattgcctggcaacagattagtagctgatgtccatgggtgtggtagctgcagcagttaacaaccatatctggagtaaaccatgagactatttttggaattaatcagagcaggaatctagcttcttattctttgaaaaggatttgactaatctaagatcaaaacaggaaacacatagatactttcccacaaagtgataacatcctaaagcaaaactaatgatgtgtactacagctacccccatacacgactactgataatagtactagattagcactttcgcaatttagcacagtttagtcctggagagagcacagaagcaatacccataaaaacaagaactaagggtgaaaatagttaaaatctatttaggttggtaaaggcattctgagttatgaagagtatgagtgaagataaatagctcaaccattcaccacaaatatataaaaaaagaatgtaacttacatgaaccaacaaccacaaagacgaaaaatccaagcacaatgggtccaacaggataatcatttcctttcttgactgtctcaggaacagaacccctcttggtgacgttcttctcaaaccgtgccactttcctatctgagagacgccttgaggtagtctgtttcatcatcagcaaataatatcagaagatatcataaaagaacttgtttgaagaaaggaaagaaatatgcagtgtatttggacagaatcccaaggaaatgacattcatgatgccagtaaattcatacagaaactttcatctattcaggaaaaaaaatgttactcaagatgcaaagcacaatggtgccatcaccagctaactgatgcctgctaccaaatatttctgacaacatgttgatctgtccgacttgcatgttaagggagtaatttttacattaccccctagaaccagtaagcagggtttgaaagttgatcataactaaatccatcgaaattataaaatcaagcgtattgggtgagttatatgtttttgtgcctttattatatgtattagatgatactcaatggcacgtgataatgctgacaagaaaattagaaatgctttactatatcataaaaatagtaatatcctctgctcgatttggtggaccctgattccaaactactctctctgtcccataaaaaaaccaacctagtactggatgtcatcctagtactacgaatctggacatacctctatccagattcatcgtactagaatatgtcacatccagtcctagattcgtttttttcgggacagagccacagagggagtaatccctaatcttcacatcttatcctggaacacattttcgaatcaaagcataggagtcgaaaacaataaaaccatacattaaaatatatgctaaattgaagttacgcaggatcggaagcgttgtagtgtgctagacgacaaatgcaaaattgcatgggtcaattaatactcttcgtcgacatttcaaatgcgttataaagtaatctatatactaccaaatatgatggctagcccacgtaaatgcataaccaggttttctaggtctttgataggccaatccagaatatgcggttacatgaagtgatgtaatgcaagacaactagtgaatgttcgctctcggatcaggaaaatcaatctctgcgtcactgttattctaaacctgacattagttagtcagcaacaaaacttgataaacttgttaccagatcctctaaatcttgccaaaggataatattgaagcatagcctaaaaataaacatatcttttgttacgaaatgaacggtttaaactacaggtaggcacgatcatcatagaagtacactacactatctacatacaggagaaatatgaattcaaaagcaaacagatgtgcacagccacggatcttcctgcgaagattcagaagaagaggaacagaaacaagtaaaccagaaatcaacatttcgtcggttctatttcacaaaatcatcgccaggacaggggcggatccaacttgggacacccaaacttttcggggaacaaacaaactgttacttgtattaaggttaaggcactgaaattaagggaagagcttcttccagatctagaagagaagctagggttaacgaacgaacacaagcaaattccagaaccgatgggagagagagatgaatcagaaaaaggatgtgatgctcaccatgatcctctcccctgctctgctcgccagatggagatcgccgccactcccctgttcagccgcgactcgtcttggcggcgcaaggaggaggagacgagaggttttctttctgttacgccacaaagggaaggggaagacactcggagaaaaggggaaatttaactatttgccacttttaggtttaccaattatccaaatacccctcttatatttgcccttattttcttgcccctcttagcttgtagcttcttaattacttatttgccacttttgcccatgtggcatgccaacgtggcagcgcggtgcaaaattcgccgtgggacccactagtcagtagcacaactctccccttaccctctctctccgatcagccccgccgtccccttcattgccggtgaccctctctttcctggcaggtggcagcgaatcctctcggtggtagcggcggcggcgcgccggctcgcagtggacggcggagtgcggcgaggcggaggttggattcacggcgacgctcggttcctcctccggtgcactggctcgcggtggatgacgaagccctctttctccggtcagcctcccttctctccggtcaaccccgccgtccgggctgcaggaat

SEQ ID NO: 6134 - DNA, 5198 bp, Oryza sativa
ggacgctgccatcgaaacggatcgacgcaacacagcctccctcgacagggagccatgggaggaggagagggaggccccggaggagaagccgagcgccgtcgcgagttcaacttctgccttgccgcactccgccgcaaccacgacctccagtcgggaatgaaggagaggacgatggggctgaccggagagaggggaaagggagagttgtgtgactgacgagtgggtcccacggcgatttttgcactacgctgccatgttggcataccacataggcaaaagtggcaaatagttaaaagggcacaaccttagaagggcaagaaaataagggcaaatataagaagggaatttggatatttggcaaacctaaaagtggcaaatagttaaatttcccacagatatggcatatcttcacgtatgcggattgttctcgtgtacgccgaaggaatttatttcgaattatggaaaatatctctacgagtcaagtgatttccaaagtcctgcttggtggggataaagtttatgttatatcgtacaagatccgatgtctctgagttttacttggagatcaagatgatccacggtattaaggggcccaaggaggggtgcaaggcatcaaaattcatcaccaacacacccaccatagtttacgaagccagagtactcggagctaggtcaccgggagatctcgtcgggaacatcgactacgatctcgtcagtatcgtcagtttcgactactttctttgtaatctgtggttttccatcatcaatcccatataaactggagtagggctattacctgataaggggcctgaaccagtataatccttgtcttctatttgcttgatgtcatattacgtaaatccttgttccaacgtatcccaatacccaaatcatccggtctacgagtaccactcattgacagtggcacgccaggtaggggaacttggtgctcaaggttctacaaatatgacttcaagccatcccgacaacagtaccaacaccggcgtcaatcaaggagcctctacctcgacatcgctggtttggactcaagtcgggactattgtctttccggtctacaccgtcatgccgatctcgacaagcccaatcactattgggaacgagaacggcacggctatgacttcgagaaatgacgcttcgctgacaattcctcccacgcaagtggagaatggaacatcgacggccttagtacctggaaggaatcctcaagcggccgagttctgtcctctgaacaagagaccagagccgacaaggatacccatccagaaaccgaggtcttggtgtcccgtccataagacatccaagcatactctggaagattgcctcgtgatacttcacgcaaaggctgaactctacgcctgctggaaacgtgggattcaacgcacttcaccaacgggcaccacttattgcccgattcatagatcgagatcccacgatctcacaagttgcataatcttccttaggacattcaagtcgtcgcatcctccatcccacaaccacgagatcaatctcagtgcgttgtcgaggaacgagacgcagcgactttagatcggttcgtaggctttatcggtgtcaaccctagcgagccatccatgctgcacctactgaaagattacgagtcttcttcagactcaccacgagacgtgaacgtgatcaatggtgtcgagacaagtgcttccgcggccgcgagaacacctccacaacaactgcggaacctcgacgcaatattaagagagagcccctttgaccctgtcctaaaccccgatgtcgatcagtgggcggcacgactacgagagactgtgaccaacctcaacagcgcattcgtggatgcagcagtcgagcctccaccccaagatccaccgggagggaacggtgaaccagctaacgggaacgcggaagcgcaaaaccctactagggaaccaccggctcgagacccgactccatcgcgtcgtgaaaatcgtgaccttcatgaacatctagatgaccggcggagggacaggcgagattggaatgacaatgatcgtcatcagcatcgctctccctccagacgaggagagaacatcgctcacgtcaacaccgtcaccgttccctttcacgccgaggtgggaacgcggatcgaggaggccatcccaacggtgaccgagatcggcaggcccgtagcgaccaccaagacaatggagataacaattgagaacggaggcgaggcagcaacaacggacgagaacgtagctcccggtctcccgcctctaggcgagatcgaagacgtgaccaccgttcgagaagctgggctcctaaccctagtggaccaccgttcgagaagctgggctcctaaccctagtgatccctcgtcttcgtcttggtcatcttcttcatcggacaagcctcctcgacgacatcacaaccgcgggccacctttcgcccaaggaggcgtgtgcagagcgtttgcgcgcacattgcgagatgtgcgatggcccgaaaagttccggacaggggcgatcgagaagtatgacggaagcacagacatagaagaatttctgcaagtctactccacaattctctacgctgctagtgcatacgacaatgcgctggcaaactatttaccagacgcgttgaaagattccgctcgttcatgactggttcacctcccaccctactcaatctcttcatgggaagacttgtggtaacagtttgttgtcaacttccagggaacatacaagtgtcacgcgattgaggacgaccttcatgccctaactcaaaacccagatgaatcatagagggactatattcggcacttcaatgagtgcaggaatacgatccccgagatcactgacgcttctgtcatccgcacattcaagtcaggcgtccgagattgatacaccaaccaggaactggcaactcgaagaatcacatctgcttgcaaactatttgagatcattgacagatgcgctcatgcagatgacgccttgagatgaaaggaaggaaagagcagtgtaggtgaggagaagaagtcagccaacaaagacgcgccggaatcaagcaagaaaagaagtcgtaaaagtgggaagcgcaaaccctcgggagaggtcctcgccgctaagcaaacggacccacccaagcgctcgaacccccaaaacgacgactcgaagaagtaatggtgccctatacacaagactaacaatcactccatggaggattgttatgtcttcaaaaaggagctcgcgcgacaactagcactctagagagggaagcgagtacgtgttgtcgaaacggccgaagaggcggccactcccgactccaactccgcgttcccagagtacgacctccatgtcttgcacatattcggcggttctacatcgtacacctcaaaaagggagtacaaaaagatagaacacgaagtctgctccacgtcgcaggggcctaccgctaagatgagatggtcccaacacaagatcgagttctcggagacggaccacccgaagatcgcgaccacacctggtagatatctgatcgtgatcgaacccactattcggaatgtcaaggtagcacgggctctcatcgatggcagaagttccattaatctactcttcgccagcaccttagatgccatggggataccgcgaagcgagctgacgcccacagatcagcccttccatgaaatcactccagaatcatcatctaagccgctgggtaagattacattgcccgtcaccttcggacaagccgacaacttccgaacagagcagatcacctttaatgtcgcagagttcgataccacttacaataccatcattggaagaactgcactcgcgaagttcatggcagcatcccactacacttaccaagttctcaaaatgccaggaccaaaagggacaattactatccagggaaacgccaagttagcggtgcagtgcaacaagcggagcctcgacatggtcgagcatactcccaacccgcccgccacaattgagcaccccaagaaagtgagcaagcccaacaagaaaccgaagttagacggcgccatcaagattattccgttgtccaactccaaccccgacaagaccatcaagatcggggcaaagctggatgacaaataggaactcgcgttcatcaccttcctccgcaacaatgcaaacgtgttcgcttggcaactgtaacgccccgattttcgttcgggaataaaaatcaattaataatacattttctagaaattaaataaaatttaaatcaacttaatcaagtgaattattgagggaattaaaaatttcctttaaaaatcattggccgagaatattttgtaatattctttgtgccctaaaatactctccggatttttccgcaaattttcgaagctcaagaaataattttaaagtcacaaagatcatttaaccaattaaataaaaagaaaacaaataaaaatctccttccttcccttttgggcttggcccaagccttcccctcctctcccgcgggccgcgcgcctcctctctctctcggccggcccgcgccttgcgaaagtctgctttacgtcccccggtttccctcctctctctccatccggccgacaggtgggaccgtgggccccacctgtcagctcctacctctcgccggccaaccccaaccgccattgccgcccacgtcgccgcaaaatccggcgccctcccgcacccgagctcgcatccaacgacgtgggcacgatcccctccacgtcctccaccattttccccgctcgtcccacaaaaaccggcgccggccgagccaccaccaccccccgtcggcgccccactttcccgccggttgccgcccctctcggccccgtttccgccgctccgaccctataaaaacgaacccggagcatcctctctcttttcccctcctcacccgagccagccgcgctctctctccccctccccacgccgctcccgcgcaccgccgctttccggcgagctccggccgcccgccaccgctgctccacccaccgccgcgccaatccgccaccaccgtcggcttcgcggcaccgtgccgcagcccggcctctactccatttcccctctccgcctccagaacaccgccgcctcgtgcaccaccacctaccgcctccggccgcctctagccgccatcctcaaccacctcaagccgcgccactgcctcggttagatccaccaccgcaagggcaagcccgg

SEQ ID NO: 6135 - DNA, 11462 bp, Oryza sativa
  unsure (1)..(11462): unsure at all n locations
cccggccgccgccgccgccagccttgtgtgcgcgctggccaggccgcgccgcccggccgtccccagccgtccaatcggccttggccgatctaaaccgtcgggtgcgcggccgcgtggccgatcgccaccgtggactcggtccacggtgggccgtgccgctgacgtgtggggcctgccccctttgtggacgtggtccgcgcctcaccccttgctgacgtcagcgaggaccatttcctttgtaaaaataaataataattgcgcaataaatcgagtttaattctagaaattcatttaaatggcttaaaacttctaaaattcatacctaattcattcgaactccgaattgagccattcaacttgcaaaattcatctaaaattgagctctacatgtttgtttagtttttatgtactgttttcttggtttttattagagtttttcctcgttttgcgtgccagcgtgtagttcccgtcgtttcggaagatcgcgttcgcaaggataagagttcagaagatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagctggtgttactttgatgacctagctagaactatatgcttagccatgcttaattaccactagctcagtcgatgggataattgcagtattagacattctagtatcttgttgagctgcgtgctcgagacatctggccattcttcagggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggtctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacccaatacactgtagtttaggtgggttggttgggcctgttcaacgtggtgtagcgttgatcagtggagatttaaggttactttaattactcaacagttttactgtgttgctcaataaaatgttttacaaccgcctttatgcaaatagccacaaaccatccttgtatccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcatttttttttcgctgctgctgcttttgtttcggtgtgaggactaagtgcctcttctgtaagtattttacgcttattttacgtttggaactgtatattacttgtcgttttgtgtaccctggctggtcctggacagggatttaatacgcaaaatagtctggaaatttgggtgaaatttctgggcgtgacagcagccgtcagacatgtcgggagttcccagggaggcgattgagcacaaactgatggtgcaacccgacgccaagccagttaagcaaaaactatggagatttgcacctgatcgaacacaagtcatacgaattcgacaaacttctcaaaattggcttcatcaaagaagccctccatccagagtggctcgctaatccagtaatgatacatgaagccaacgggaagtggaggatgtgtgtcgacttcaccgacctcaataaggcatgccccaaggaccatttccctctccctcgaatagatcaactggtggattcaacagccggctgctagttcttaagctttctcgatgcttactccggctaccaccagatcaacatggcaaaagaggatgtggagaagacagcgttcgtcacgtccttcggtgtattctgctacaccaagatgccgtttggattaataagcgcaggcaacacatatcagtgcgggatccagggagcactaggtgatcagctcggacgaaacgccgaagcttacgtggacgacatcgtcgtcaaaaccaagacgggcgactcattgatcgacgacctaaggaaaacgttcgacaacctccgacgatatcaaacgaagctcaacccggagaagtgtacgttcagagtaccgttagggaaactactcggcttcctggtctccgggcggggaatcgaggccaaccctgagaagttcaaggcaatcgagaacatgaagtcgcccacaagactcaaggaggtccaacgattgacaggatgcatggcttcgttaagtcgtttcatccgcagggatgggagacgaggacaagctttcttcccctgctcaagagcaggacaaattcgagtggacccaaggagctgagagcgcgttgattgcgctcaaacgctacttgtcaaaccccccggactagttgccccacaaaataatgaagaattattcatttatattactgccacaccttattctatgagtacgtttatcgttgtagagagggaaagagtacaatacccagtgtctatgtcagcaaggccctccacgatgcaaaaactaaatatccacagatccaaaaactattctacgctgtgatcatgacatccagaaagctacaccacaacttccaagcccataaggtcatagtgatctcctcctcccctttgggagaagtcatcaggaataaagatgtcgtcggccgtattgctaaatgggtagtcaagctaagccattgaaatagggtggtccaaattgaaatgtaaagttagttgttctgtaaatgaaaagaatggttaaaggatgacataatatgaaaacttttaagaatacatagtacgaactgtaatttacttttttggtttagcacaattaaagatgagttgtctattacctggtactcttgtgatatactaagtcattagtacaattaaagatgagttgtccattactcaatagtcttgtgatatattaagtattgttgggtcagtgtacttggctattactaatagtctcatgatatgttgatgcatgaagatgcatacttctactaacacgagataattaattatggttatatagattcagctaaaaaaagataaaattaatgccatcaatttttctcaacaataaagcattcgactgtggtctccttttctcactgcatgatatacgattgtaggtattaccgtaattctttcatattatttttttctacatatacgttaatttggactaatattttttctcataattaaatatttaataaatcatttttcatatttctactataaaatgtgaagagggcattgtataatttgaaaattatattataagtgtatgtaatttaatgtgtaagatatgaacttatagtataagatttaactttttataaaaatgctgcatgatagtagataggtaatgaactaaacaaccataaaatatatagtgaatccattgtgtgttattgattttgtccttattctacaatatgtcactaggtttgtcaagttctaatatgccatcgcattttgcttaacttctataacataccatcgtcgtctagttagcttctgttagtattgtataattttatcataatgaccgaaatagccatgggacgaaaaatttcaaatatctcattgtaaacttccaaagtttgagatggatatcttctctgccttgtttataatattatattttggaatattctgtcaaattttggaatttctgtcccggggatatttcggtcattagaacaaaattatacagtactaacgaagtctaaatggacggcgacggtatattacagaggataagcaaaatacgatagcatattgtataacttaacaaactcagtgccatattatagaacagggacaaagtcagcggcacacagtggattctcttaaaaaataatctagtcaaaaaagtttctttattttattcaaaacaaaacattttttctaccaaacacgttaggagaacttcgaaagaagataagaaaaaaaaggaggtttagtcattagctcaaacacacgtggggaaaagctactcacatccatggtatggtatatactcacattaatcgataatatactaatattattaaaattattcttcgtcttaatacggtgtaaaactaaaactttaaccttatattcttctgttattccatcttcttctcgctttctcattcttatttatttttgataataatattgctacaatcaacactagtacttgcacatgaatactagcagctaactcatatgtgtgtgctccgtaatatatattatctatgtttttacatgagtaaacaacaattattatatttcttaatgatattgtaattatataaggtacctaactagttttctaagaactggaaagatatttttgttaaacataatctagaatgctataaagattaataatattgaacgatatataaccatataatttttttataaatgaattagagatcgactcttgttaagaatccaatgatcataatgcactatatatattgtttaagtgagttatgatattctatttaggatgtgtttgacaaatgggttatgagaggtgggattgagaaagggaaatggatgaatgattaggattaaatgaggtgtgatgaatggatagttaggatacaatactaccctttggagggtggaatattatttccctatcctatttgcaaacaaagccttactagttacatgtgtatgcattaaagtgggatctagagataaaaatcagacactgctcgcccaagaagcacgaatgcacgatataaataaaccctctaatcaccggatcaactaacacgaaaaatgatatatataaatcctctaatcaccagatcaactaacacgaaaaaacacggccctcactggcgtcgccgcgaattggggagatgacgaaatggtgtgaatgcgaagtggggtggtcgaaaccggtccgcctttatttgggttcatggagagagacccaagcaagcggcgagctcctctcgtgcttcccgtgtgctatctggctggctgcacagtggttcgtccgagcggtgagccggtgacgcgcttcggtgcttgcttctgagcttttgtgaatcgtgactttgtggctgatagataatgccataatggcacgccatggtagctttattgccattgctaacttcttgctttggctgctatgtaggcaaggcgtaaacaatttctgtaatgaagaatagtcaaaataatcaattgtgataaaatatcccgatgtaatttattatatgaaacattgtgaaaccctaacgattaaattgctattattatttacattcattttcgtggtgatttttggtgagggagattgaatgtgactatgttgaccatagggagagacgtaagcaagcttaaagcaaccagggcttttgcctacataatcacaattaggtccttttaaatcactattgaaagtttttttttgaaaaaaaagaacttaaaatctagtagttgagccctatgtgagttctaggttttggtaatttctgactccctctctgagcagcaataggttcttagtccgataacatgttttttagggtttgcatgggttagttaaaaatatatgtagactgatggatatactgccaagaaaggggagacaataaatgtaccttttttttattgttttcacaaatggcattagctttgttggatacttttattctctcgccggctcccgcgtcatgtaattgagtggtagaatccatcgttgtagtggtaagtagtcaggcataatctacttttggcatgaaatgtggttgtgagtattttacttactccatttcaaaatgactaaagttttaatattaggagaaaaagggaaataatctaaatacccctcattaaatgagaggtggttgggggtaaagcatgaagaaatttaaacgagggtggttggagaggaagatattactttcaaattacacttatttaagacaatttcaatgataaatttctaggccagaataatataatagccattaggttttgtgaggtgctatgtgtttctttttctaagtgaaaatataatattgcataaaaaggtacatcaaaggggaaaaaaggccaacgaaccaaactagcatggcatcattataatcaacaaagacacccaaattgcatacaaaagtacccataatcatcagctgcttcttatgttgacatcacagaaaacaaaatggataggatgtgcagatgcaatgcaccacactggcctacaccaaaagtctctagacatgcaaacactgatcaatggagtagtatcaacttagagcaggtataatagtaggtggtaagactttaaatattatatctgtgctgacatggaagggagaaaaggttaggaaacgcaaaggcgagcgcttcagttagcgctagctctagcacagcctccaacgcaaagtggtggggcccataagtgggagggcatggccagccaattggatggagctaagccgagtgatacgtaaagttagttgaataaaatattaaaagtaactatgactagcttaagtagtatttcttctttttatttacttttgctgaggtggattattttgcagcggctgcgctattaaccttgctcttattagtatgtcataatgaatggccacatgggtacatggcaccagtcaccctcttgtcaacagtccaaatgtccaatctctcgagtcttgagaacgacctttcactcggttcgtcatttttttttcactaacaccttgctcgttgaaaaatatacccttattaattccattattattagggagtactggagaaatctaagagattgttcaaataagcataacattaaacgctattccttctcaaggatactattaaatccccactaataaaaagatatttggccccttactcaaatcccatctaaacaatcactgaggtggcattaattaatgtgtagggttagatcaatggcaagatgaagggtgaggatagagaagcagagcaggattttgggttcggatttacccaaccctcttatccggttcgatcatgtgtttcttataagttatatgtaacatgtgtccataaactaatatatatcactcgagtgatttttaaagtaaaaaagtccatgaatataattataacgcctatattttttttacatggtcttcaataacatagtttgactagtattttatttcattctataatctcaacaaatataaaattagcatcacatgaaagtaattcaaaatatgaatctagtaatataacatgcataatacttagtatagatatagttaggccctgtttaaatcccaccccaaaatttttcaccatgtcacatcgaacgtttgaacacctgcatgaagtattaaataactgtcgacgttggatgtcgcgattccggtatttgcatagtatggggatcgttggtactaggatatacgcgagacttaggtaaaagagacggaggagaggatttttatacaggttcgggcccctgaattgtcaggtaatagccctacatcctgttggccgaaaccggtcgttgctcttattcaccataatcacaccagtacaatatttggggtagcctatctatctgttgtcgacttggcggtctgaagtgctgactcgtagtcgacaacagggtagtcttcctcctcgaatctgtgcccgacgaggtcagagatagcgctagattcctctctttggttcccgtaggtaccatattgggttttcccaggcttatctctgatgtcgatatctggcagtttgtcttggcgtatgtaggcttgtattggcctgtggctttgtggcgtctatgttgtctgtgtccctctcctcctaggcggtcttgtatttatacccataggtgtccccttgtccaagtagaactaggaaaatcagtatggatacaatccgagtagtccttgtcgttttcatatagaactctagttatctttccttatccggaactccccctatatccgaaggttgtttccgtataagacatggtatgtggtgggtcctgccgagatttagtcaactactattaggtatgtggtatccataaccctgacaataactaattacacatataggctaaaaaaataactaattacacatattgcgactaatttgcgagacgaattttttaaacctaattgattcatgatttgacaatgtagtgctatagtaaacatttgctaatgacggattaattaggcgtaataaattcgtttcgcagtttacatacggattctgtaatttgtttcattattatactacgtttaatatttcaaatgtgtgtccgtatattcaatgtgacacaccaaaattttacagccctaaatctaaataccctttagtatgattattactcaaaagctaccaagtttattttttaaaaaaaaacagggcgccctataattttgggcggcgggagtagtaaaagctatttttttttacactcaaaccagtccgtgtatgtgcgcgtagctcgcctgtctcaacgtaattaagtgaacgataaatcaaataaggcaaaatcttccaaggtcaaaatggaggaacccactatccccagattaccacgggccaaaattcggcccaacctgtgatgaagcggcccagcccaagtcggctaaacccctctcctcttctcgtgccctgcctgattccgctgcctccaccgctccacgtatccccgaaagattctcctcctcgtcctcatccatcccccaccgccgccgcggataaaaatccaaggaatcgaaggccccaacgtgtagtactacgcctacgcgccccctcccatggcgccgcctccgccgctcgccgcgctccgccccgcgccattccctctccctcgcctcctcccctgccccgcctccgccgccgcccgccgcggcgccgtcgccttctcgctgcagaccaacgtgcggctcctcaagcccaaccgccgctcccggcgatcccggtacccctactacgaccacgacgaggacgaggacgacgatgaggcggagttcgagtttgaggaaggggaggaggaggaggaagacggctacgagaccgatgtaagttccctcgtttggcagtagccgcttctagctttgctactgtcgtgagaggttgcctgagtggctgggtccttagctaaaattgcttgcgtactcaagctcgtgccatgggataagtgcaaggctgtgctatcacatgatatcatcatccaattgctgctcattatgtaattagagctccggaaggaatatcattcaactgctgctcattatgtaactagagctccggtattccttttgttttggagtacattagagatgtgataccattttattgcgtcaggctagagagtttcagaaattgaactaaccaacatctcattaggttgtaggatgtaatgttgtatgcacattgagttaaagaggcataagtttgtcaaaggaatcaacaaacattgtaggatgtaatgttgtatgcacattgagttaaaagaggcataagtttgtgaagagcgcactagtggtaaatcatcgttcctgtatttaatggtataacaccttaaccgctcatatgataaactgttttaaaagttttctgcctggctgccacagttaaacaattcttatttatatggtttatttgttccatgcatatttatgtgcttaaatactcaatggtatgctcttaaacttaggctagctgggtaacagtaggtagaggtgggcattagggtgagagactaatttgatttctgccttgggtaaaccatatccaacatacggggaccaatagaaacagcgaaactcgcttttctgctgattagtgaagacttaaaagagagagggagagagaatcagttatgtttcttctgccaccctgactatatgatctgttctgcattgagttttcaatatatagtatactgcatcactgggtgtttagtccacatgccaaaccaggcagaattgcagattattggattcaaaaggataaagttttgtgatgctaactttcattcatttctcatagaatgaaatatgagaaacttaccattggcaatattctacatttccagcattctaatatattctcttactcttttcaggatgatctatcaggtttggagtatcctggtgtactttattcaaacaatcctcgtgctccaatcaagaaaccaggtatgaaaggctgtgaaaatccctgatatccagtggttactttgtattaatactttattctccaggccgggaaaaaccagcgctgaaacaaaactgggaaggaagacaacctaaaacacgagacagatgtgacacttcaaaaaaagtcgatgctctgcatgccaagagtaaagctagcagatcaactggtcttgtggacatagataatgaagtagaggtagactactaaggttgattcagtgtgtccatgttcttgtttatgttcaatatttaacgtatgcaggataaatgattgatttattttcgcagttgaaaaatgaaagtatctctagaagcttgtttcagaaacttcaagaagaatatgactttgatgataaatggttaccactaatcgattacttgtgcacatttggactgaaggaatctcattttacaaacatgtatgagagacacatggcctgctttcaaatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6136 - DNA, 597 bp, Oryza sativa
ggcgctccctgtgacgttcgggaggcgagtgaacagatcgttcgtcgtgacccctgctcatccggctagatcctgtaccgatgatgctgaggcttggctgatgataatcatgagatcggagatgagggactcggctaccagtcggagtgcgggtgcttgcggagttggctggaaccgaggcagcgatcatggtcttcatctggttcaagatgttgacaacatgatcagcttggttgagtgcgtcttccttgaggagggtgtcgaggagagtgattgctgcaaccgcgttctgctggggggtgtgaaagaccgctgttccatcgacgtcttgttgcccaatgagctctctcgctcgccgcccagattccaaggcgcgttgtcgtcgatcttcagcctcctttgcaatctgttcgtgatcttgttgctcacgctgtagtcgttctcgctcctgtcgctgtcgctcttcctccagtcggcgacgttcagcttcttgccgtgcgcgatcttggtccgcttctcgggcttggcgctgttcctccgtttcgttgtcagccatgaatacgccgaagaagaggggcgtgtagttatcctcatagc

SEQ ID NO: 6137 - DNA, 642 bp, Oryza sativa
tgaggatgcatctgaggatgatggtgtcaatgaatccgaggatgagtcaatggcatcagatgggatgcctgacatattcctattgcaacttatgacaaaaatgacccaccaatgatcgtaggcagcgtatatccaaacattaatgaatttagattggcaatagcacaacatgcaataaaaaaggagtttgaatataacatcatccgaagtgaaccagggcaatttactgcaagttgtgctgctaaaggctgcaaatggaggattcatgcatccgtggttgctgatggtgtcactatgatggtatgtttttaatttaaatcagcatgcattctttaagtatattgtcatatgcatggagcccatacttctatgagaaacatatggcagccatacaagaagttaaaccagaagcagtagcataccttaagaagtatcacaaaaggctatggagtaggagtcagttctgtacaatttgcaaggttgattatgtgacaaataaccttgcagaaagcttcaacaacttggtgaaagattggaaagcactacatttatatgacttcttggagaggattcggcggtggttgttggtgaaatgggataagaggcaaagaataggaaagaaattcgaaggctgcattctac

SEQ ID NO: 6138 - DNA, 720 bp, Oryza sativa
acagaaaagaaactaataaaaattttcttgtgtacatagggggttcaggttgatgcaacaaattgtggcttatttagataactgtgtaggatcttccaaatatcatcccaattgccaaatcaaagcatatgttgcaccatttcaagtgatagatgacccatacctgaaggttaaagctaaaagaatacagaaatttactgagataataccaacaaaatgatgcatcatgacatttattccaaaattaaatagtattcaggcgattgtgcaacaacaaagcagataaaacatatatgatacaatgtgaaatagagtatgtcagaccttcttcgccatacttgccagcgaggtgctacttttatcagagagtttttcaccgttgctggtgggatgaggcactggagtacaatctccttctccagaatcctccctttcagttgcaggagcaaatggctgaggaacagtgtggtttgactcttcctgttcagctataccatggtttattggtgaactgggaagagaagacttctgctgatcaaccagcttcagcacatcttgatctgcaggcactccatcctggacattcccattcatatgtgagtctatagtagaaggggtttcttgccctcttgaagaatcttcatcatgcctgccactcataacttctgtatgaccagctttcccatttgggggacatataaccacacaatctgattcatc

SEQ ID NO: 6139 - DNA, 550 bp, Oryza sativa
acaggagtactcgggaagaacaggcttggggttttgaacataaaaccagtttgcgtgctagcctttatttgaggtcttgaagggcatggagaagtatttttggcttagtgttcccctgagttggaaaccagcacccccaatgatgcatggtttgatcttatttggctagggcttgaggaagaagatgcggcggaacaaggcgaaatgaggcctaatgcccagaaaagcttcgcaggcatgaataaaattggcaatatgcactatggagtttggattcagatgatgcaagctaatcccgtagaaattcagaatgccccggaaaaatcttgaggttggaagagaaaatccgccatagaagaaatgagcaaataccatgatttcgtgtgtatcgggggtcaggaatgcctcaccaaatgccggtcgccacccgatgatctcttttgctggaagaacgccgtgcgccaccatctccttcagattgtcttccgtcacatcggagggcgcccactgactctcgaagctttctctttcttccgccatgaatgtgaac

SEQ ID NO: 6140 - DNA, 727 bp, Oryza sativa
tgcagcccgtacaaagctggcacgcattgcgcagcttggcccgaacaccggccagcttgcaaacacaactccggttatcatgaagggctgcgagcctgcgactgcgagcctttttccttggtgattgatttgtaaattacaatcgtttggaatctggtatgtgatcacaaaggaaatggttgcaagaggaaatatatttatggttcaacttcatggaaaccgaaggaaatggttgtttcatattggtatatgcttactctttggctagttaatgatttgtagtaatatatatggcgacaatgagaggaaaaaaaattgtaacagtgcatgtgatggacagatattgattagaagcagaggtgcgtactgatgacaacggttggtacaatttgtactgaccaaaagaagatgatatagtactagttaaattgcatgcaccaaggtcgtacagtactcaccgatcaagctgggtttcctccatgaacacgacgccgagaagtttgattttcaactaattagtgatcagtaagacagtaacctaaccaactaatgatcccaacaactatggcggtctaaccatgtataaggaattggttaactcgggaaaaaaggttttctttgggaaaaccccaaatttttttttccaaccgaaaccttgctagtaacaattagtagtaccagttgcttttccttttcgcagtgaatattcctgtcttacctactgatc

SEQ ID NO: 6141 - DNA, 897 bp, Oryza sativa
acatctcgactaccgggccgcagctcgtgtagccttcatttgccctagagatgtccatcggaccccaactttgtccatctctatccgtgtacttttgcccacgaccagactgagccacaaagtatgccttacccactagacatgtggaagtacggtagtgctttgcaacagaggcccgaagaccggtccttatgatggccgaggtgctactattaaaaccatgcacctcgagccagcgtaaaaccattttgggggttttgaatagagggggaggtgtgtgtccaattccacataagccaaccattccataatgtccaaatgatatgagaattcccaaagtctaaagttataaatccacctaaagtttgtctaatttaaatagcgaagcttctacctaaaaatggtactagtgagaccatagtacggtaaacactagtggggttttgtttactctagggtgaacaaggtaataataacaataacaataataataagatcataacaaaggtaaatatgcatggctaaataaaacagtgataatgcgggaatttaaataaagcgataatgcattaatttaaaacaaaataattttaaagcatgggacaaaaatatgttcaaaggagatatgacttgccttactcgctttcccaaatgtcggcttcaacctcaatgtagagcggatcttcgaagctacagcgtctacacaaccaacggataaagaaaaggcttttactctaataaaatccatttaaccaaaagaaacaaatcacaaaaatgggttcttgacctcttaaggaaaaattagagacttgaatggtccaattccgagttcaaatggccaagttatggccatttgaagtttatatgctctttaaatgaatatttgcgaatttctcc

SEQ ID NO: 6142 - DNA, 508 bp, Oryza sativa
gctcacggccatggctgtcgaccccaagaagaagaacgccagctatgcattcacctgcgccatcctcgcctccatggcctccatcattctcggctatggtactcgtagtacaatcgtattcacatcatctcaaaaaaaaaaaaaaagaaaaatcttcagatgtggtctgaatttgttttcagaagtgtagtgtactgtcagcgagcactgactgttcaagttcgcgccaaaattttgcagacatcggggtgatgagcggcgcatcgctgtacatcaagaaagacctgaagatcactgacgtgcaggtggagatcctgatgggcatcctgaacatctactcgctcgtcggctccttcgccgcggggaggacggcggactggatcggccggcggttcaccgtcgtcttcgctgccgccttcttcttcgccagagctctactcatggggttctccggtgactacgccactctcatggtcggccgcttcgtggcgggcgtcggcgtggggta

SEQ ID NO: 6143 - DNA, 1374 bp, Oryza sativa
atctaccgtcgcccgccagctggaggcctgcgccgggggctggctcggaagtcggaggcgcacttcgtcggcgagggggtgtgtagaaccaatcgctcttccagtcgtcccactttttgcggaggacgcagggaatgtagcggttcggcacctgcccccgcggctggaagtagcagccaccgactaccgtcggcggtgacaccggctgtacggtgaagaaccaccggaacagccggagagatgggcgcaccccgataaacatctcgcacaggtgcgcgaaaatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgcggcgccaggcgtccctcgcccagcgcgaccacctcccggccggtggcagattccggcatgaatcggcgcggcagcccggcctgcctctcgctcacgatgcgggaaggcggcagcacgctaccctcgagcggtacggagccccgtgccatgacgccggcggaggaggagcttgagagcgagcgagtatggcaagggtagggcgcaggaaacggagagtcagagcacaagtggcgaaggcaaggggaagagtggtgagaggaaggaaacaaatcccttccttggcgtctttgtacccttgccaacgctatgcccggctcctcgcttcccgcgcccactacctcgccccctcgtttctcgcgcccacgcctccactaaccccactcgcccgtttgcggcgcacgcggcagatgtgcggtcgtggcgtttgagatggggcagatcgtgcgcgcgtttactgcgctcgccaaccgcgaaaaacgccatcatcatgtccccaggcgaaacaaaccggctcgtcccgattcgcgcgctgcttgagtaatgtagcggtcttgaagagcgcgctcattattgtcgatcggtttttcccttgccgatgcgcgcgatttgcgaccgttgggtttctgcccgcctgtggggaccggccccacctgtcaccgggcctaaggagtggcgtcacgcccgagcgcctccctcgaggggggcggtcgccctggcgtaacgccgggggctattgtcggtgacatggggccgggggtattgtgactagaggcttgggtagccgcgatcactcacgtggcccgacctcctcgggggggtcgggcccgacggtgacgtggccacccctccctctgtctccccgaggggtcgagccgctcccgtttcggccccaagggctggggcaccccgaccccccgtggtgttggcgccacgtgtgtgggttagg

SEQ ID NO: 6144 - DNA, 705 bp, Oryza sativa
cagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaagaccccggcggctcccaccggtaactggcgaggtgaggccaagcagaaggccaccgccgaggacatcgacgatggcgacgatgacctggggttccaggagcctgaggccaccgtcgccaccgtcgatgggggagcgtgcgctcacgcttctcgccggagcctcaaggccatgaagcgagagcttctggccgcggcccctacccatgaggcgacgcggcgggcgcggtggtcggaggttgccctcaccttcgaccagaccgaccacccgccgtgcgttgcccggggaggacagatcgcaatggtggtttcccccaccgtttgcaatgtgaagttggggcgtgtcctcaaagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggatttcgatgtggcggaccttagtctgcccta

SEQ ID NO: 6145 - DNA, 1768 bp, Oryza sativa
taacgcttctccgaacaacgcaacaagatctccgacatcaccgacgacgtcatcatcgccgccttcactaaaggcattcgccacgaggacctagtcggcaagttcggacgtaaacctcccaggtcggttaagcagatgttcgaaaaagccaacgagtatgtcaaagccgaagatgctattaccgcgtccaaacagtcgggcaccacttgaaagccaaagaaggatacgccgaccgcaggagagagtggaagtaacaaccacaaggatcgcaagcgtaagcccgaagaacttgtggcgaccacctctccatcttcctgacaacgttcccgcatcaacaccttcgacaagataatgaactcccaatgtccgcatcatcccaactccaaccacatggccaaagattgcttcgtctacaaccactttggagcaatacgtcaagaacgcacgtaaaccttcagacggagatcaaggcacatcaaagaagaaagatgatgaagacgatgccccgactggttttcaagatcatcgcaaataacttaatcacatcttcggtggacccctggcttatgagtctaagagaaaacagaagctaacataatgggagatcaatgcggtttagcctaacacgccccaatatcttcggtagttagaaatagcaattaagtttgaccgctcggatcatcccgaccgagtgatccacccggggcggtaccccctagtactagacccagtggttcgcaatgtcaagctccgacagactctcatcgatggtggcagcgcactcaacatcctttttgctaagaccctggactatatgcagattcctcgcacggaattgaagccgagtaatgcacccttccacggtgttatcccaggattgtcagctacaccactcagccaaatcactcttccagttaccttcggcactcgggagaattttctcacagaaaatgtttgtttcgaagttgttgatttcgagacagcatatcatgctatacttggacgaccggctttagctaaatttatggtcgtcccacactacacctacatgatgatgaagatgcctggtcctcgaggagtcatatcactacggagcgacatcaagcaggccgtcacatgtgacaaagaaagttgcgagatggcccaaacccacgagactactctcacccgcgaagagatccgactggctgcgaccacggcaagcgagggagaagtgcctgcaaccaagctgacgaagaccgaagaacgtgatgctaagacgaaaaagattcccttagatccctccgatcctgataagactactgtaataggcgctgagttaaattgtaaataggaaagcgcgctcatcacctttcttcagaataataaagatatttttgcatggaaaccatccgatatgcctggtatccccagagaggtgattgagcactctttacatgttaggaagacgccaaacccatcaagcaacgactccgccattttgcacaggacaggaaggatgcgatcaaggaggaattaaccaagctgttagcaacaggcttcattaaggaagtccttcatctcgactggctggctaacccagtcctggttcgaaaaaagacggggcaatggcacatgtgtgtcgattataccgacctcaacaaatcttgtcccaaagacccttttgggttacctcgcattgaccaggtggttgactcaacggccggctgcgagttactcagcttcttggactattactcgggatatcatcagatccgactaaaagaat

SEQ ID NO: 6146 - DNA, 4712 bp, Oryza sativa
caccactccaccagttttggcctcgccacatccacaagagccgctactgttatatgtgtcggcgacctcccaggttgtgagtacggtcctggttgtcgagcgtgaagaggaaggccatattcaaaaagtccaacgtccaatttattttgttagcgaagttttagccgactccaagacaagatatcctcaggttcaaaagttattatatggtgtcttaattaccgttaggaaattatctcactactttcaaagtaactcggtcacggtggtcacatcgtttccactcggagatatacttcacaatcgcgaagcaaatggacggattgcgaagtgggccttagagttgatgtctttggacatatcgttcaagccacgaacttcgatcaagtcacaagctttagctgatttccttgccgagtggaccgagtgccaagaagacatgccagaggaaaagatggaatattggactatgcattttgatgggtcgaagaggcttacaggcactggggctggggtcgtcttgatttccccgactggagaaagattgagctacgtattgtggatacatttttctgcgtcccataacgtggcggaatacgaggcgctactccatggattaaggattgcaatctctttaggcattcgccgattaatcgtccgtggagactctcagttggttgttaatcaagtcatgaaagagtggtcatgtctagatgataatatgaccgcttatcgacaagaggtatgcaggttggaaaataaattcgatggactcgagctcacccatgtcctccgatataacaatgaggcagccgacagactggccaattttggttcaaaacgggaagcagctccttcagatgtgttcgtcgaacatctttacgaaccgaccatgcccagaaaagagacagtcgaagccatggatacccaaggcgtaagcatgatcgaagctgactggagagaaccgtttataaaatttttgagcaaacaagaactccctcaagacaaaaatgaggccgagcggatttccaggcgcagcagactttacattatccatgagactgagctgtacaagaaaagtccatcaggaatactgcagcgctgtgtgtctttggaagaagggagacagttgttgaaggatatacattctggtatttgtggtaatcatgctgctacacggaccattgtcggcaaagcttaccggcaaggttttttctggcctatagctgtgtccgatgcggacaagattgtgcggacatgcgaaggttgtcaattttttgccagacaaactcatttgccagcccaagagttgcaaaccatcccgttgtcctggccgtttgcggtctgggggcttgacatggtcggcccgtttaaaagggcagtcggcggttacacgcatctctttgtggctatcgacaaattctccaagtggattgaggctaaaccggtcatcacgatcacagcagataaagctagagatttcttcatcaacattgtgcatcggtttggggtacctcatcggatcatcactgataatggcactcaattcactggcggagcatttaaagacttttgtgaagacttcggcattaaaatttgttacgcctccgtggcacaccctatgagtaacggacaagtcgagcgcgctaacggcatgatactccaagggatcaaagcatgagtttttgaccgactacgtccctatgctggcaagtgggtagatcagctgccgtccgtactttggtctttacgcactactcctagttgggctaccggccagtcgtcgttctttttggtttatggcgcagaagcaatgttgccgagtgaagtggaatttgaatcactacgattttggaacttcaacgaggagggctatgaagagggccgagtagacgacatcaatcgactagaaaaagcccgagaagcagctttaattcagtcgactcgatatttgcaagggttgcgccgttatcataatcggaatgttcgatcgcgagcctttttagtcggcgacctggttctgaggaaaattcaaacaacacaggatcggcataaattatctcccttatgggaaggaccgttcataattgctgaagtcactcggccgggttcttatcgactcaagggcggagacggtactctcatcaacaattcttggaatattgaacaccttcgtcgattttatgcttaggcatttcgtttgtatctttcctctttgactactaacttcaagtttttccttgaagttttcagtcagggggctactatgataataatggagtgtgatttttatcaattcaatttgcttacttgatttatcattgccatgtttggtctttcgacttagccaatgaggactaaaggtttttaatagcttttgcgggttttaggctcaataagacttgacaaaggcttttaagaaatcagaagctaagtatggaacaccaagcatagcataaattcatcagtattgtacaaattgagcctccaccgtcattgatcatcaaaatcattgttatatcaataagtatcagttttttcatcatcagacttatcagacccagtcagccgaaggtcgatatcttggaatctctcaactacatcagcagcaatcttgtcagcggctttctgcgcatcactgatgaggtcaagagcagcttcttcgctcgtcccgtttgcaaagccatcaatggcatccatatcaacccttggataaagggatttggtcatcgccaacgccagacttgctcccatacttccagcttctttgatgttcttgaaataagtatctggagcgactctcagcttgtcaaagatttcggtagcatcaagtgtactcgaaccggcgttattgaagaacatggcctggatgagtggagtagcggcattagcgactttatccctggctccttcaagcttgttgatcttgtcaactaagacatcaaactgtgcttgagacttgatcttgcggtctccatcaacagattcacattaatgaatcagcatatagaagataatggcttttgaagtattgattattggtaccttcaacctcttttaaaaccgaatccctctgtcttgccagctcagccttgtcattttccagagtttggatctgcttctctagttgagatatcttggcagcttgcactgcattaacttcggttaatcaagattacagagataatagcacaaatcagttgggcagagtttgcgcgaacctagccactcagttcgaaattggactcctggagctcagcaatccgatccctcagatcgtgttcattcttcttggcaagttctctggcctcgtgcagttgactcctggtggcttcgagggttccaagatgaggaactagtctctctagggttgcagttttcgcctcgttcctaagatgaatcctctgcggagcagtttaatcagcgctcgcgccagatggcaaacaagatggctgaggtcaggcgtcaaggaacttacatttacaatgcgagtcgcttggttgagtgcctttttcagtaggcagacctcttcgtcttctttttgccggtttattacaattccttgaggttgcaagttgtcatcccaccacttgaccagaatgggagggcacgaatcttcggctgctcgtatacgggggatttcttcttcatcaccaatcattggtcctaatgtattcactgacaaaggttagacaattgatcagagttatttgggtcaacatggtttcagataaagtgtttacccgtaatgatttctggacgaggacgagtggatttggatgcctttaaaggagatctagatctctagttattgctggcgttttgtccgcgcgggctgtctgcttgggtttcgacttctggaatctcttggcttggccttgcgtccgactggtttccagtcgggggctcctgattaactccggcttcggcttcggccgactggtttccagttgggggttgatcaccggattctacattatcggttgccggctgattgtcactcagatgatccccagcagttggcccggtttctttggacgaacttgtgttcatgttagtcgggtcagagtctttcccagacggatccatatcaaatggtttcctgcaaatttaattatcagtattattgccgcaatgggtgcgcatcaatacaagagagatcgttatatgagttgcacctagaagacttcctgatctttggcacagggcgattggatgttttcttccttggagtagcctgttttggtagtttcttggttgtctctcggtcttcaggcctcctggtggtatcatcggcttcgtcgtcacttaaaaccagcttcctctttcgataatcggactggccgactagatcagaagcacttggttgagtttcagaccgaattcttggtcctccgctcccttgcccagtttggtgacggggagatcggcgttgagcgattgggggatccgacttcatcaaagcaaattcctgggtgtaatatccttcattgttaactgattcaacaagaaaacaagatcatattttgagaaaggttgaagtgtatgaatatgtaccggtggaggaggattgaatgcattgaatggtacgactggcagcaagtgtgagtagctgacaacgatggcgtttgagaagatcttatacatcctttccttcatgaccttgaagtcaagagaatctggatcttcacggtttgggtcatgcttgccgt

SEQ ID NO: 6147 - DNA, 1763 bp, Oryza sativa
aggtcttgaagggcatggagaagtattttgggcttagtgttcccttgagttggaaaccagcacccccaatgatgcatggtttgatcttatttggctagggcttgaggaagaagatgcggcggaacaaggcgaaatgaggcctaatgcccagaaaagcttcgcaggcatgaataaaattggcaatatgcactatggagtttggattcagatgatgcaagctaatcccgtagaaattcagaatgccccggaaaaatcttgaggttggaagagaaaatccgccatagaagaaatgagcaaataccatgatttcgtgtgtatcgggggtcaggaatgcctcaccaaatgccggtcgccacccgatgatctcttttgctggaagaacgccgtgcgccaccatctccttcagattgtcttccgtcacatcggagggcgcccactgactctcgaagctttctctttcttccgccatgaatgtgaactggatggtttgatttagtttgagatacggctggaaagggatggggaatcggagcgatggatgcggggagaaatttcgtgaagtttttgagggtggatttgagcggattgatgaaccctagtttgcccggcgcagttttgcactgtagcaggaaatggggaaaatggcgagagtctcggcggggaagacgaagagacgtttttcacttcggtattattagggtatcgggagtactaatgggcctgggcctgtatagtatttcagcccaatactataatcagcgtggcctgttgtgatccctagggacttaggcactttttgctttggtaatttatgttcacaatggtgtggcctaatgctgttaaaatcctttttaacgcgatttaataattctttggaattattatgatgcacataaaaaggtgcccgacagaaaggtgttataccattttttgtaagctttattaggctggaaaagctgattgggttgatttgagatgactggtttattaatagtcattcttttagcatgttatatgcttattttggttatggtaagggtcacagcctaggctattagactcattaattaccatgattttctatcatgtttggtgggtcattctatgagatttttactcggattcctatcaaacatgtctatttttggacctttgagtgtttatcgctcggcccttcttgtattttttgtccttgatatgttcaagttgagcagcagtcagctgggtatcgtactaagtaccatgcatgcttcgctataaaactactcggttcttgactatatgtttagtttttcaactaatcacatagtcgggggctacacctaattaggtgcatctactcgatgcaccatgttttattttcgcccttcacagtttttgatttctagtactcggcaagctggagcaagttgaattgaagcactcggactactgttttttgtttcgagaaggttatttcgtcaactgcgaaggtctcgggggctactgtggagattatggataccccatatctgcatgacagttatactttagtcgaatatacggtaccaaatatagatggaatatctttatgaggactcgggttggattctaaacttgtatgtcaaggaaatacccgggatcctagtcggttacgattgtattttatctataatcccatattccgttaggatatggactgtattttgtaaagcggactccttcccctatataaggagggtccatgtgcctctcgggcgcgattcttttttccaatttataca

SEQ ID NO: 6148 - DNA, 874 bp, Oryza sativa
ggcaaattgaaataccaagaacgggcgatgccgtctagagcgagatgtattacctttgctttggtattttcgtcgccatgagccgcttcgatcgcggactcataaatggagaggaattcctttgggtcagtttcgcctgagtagcgtgggacgggtgggaacttgaactggggtgggattggacgggtcttgattcccccacttagcggtagccccttttcgccccctgccctattcacggcaccttgctgcggttacggcgaggcgaagggcgaaatcacggcttgcgcgtgaggttgggccatggcattcggttgcccggctccgattggtgatgcttgctgagctgtcatggatgggtcgaaagttggctctgaccatgtcatagcgacctggtttggtgctcggtttgctccgaagcctggcgttggtgcttgcggccaaacggttggtgcctaagcagcattgatgaagtcgaactgcggtctttgactccacggtgaagcccccagacctagctgattcgacggcaaccaactaggcgcaccttgacttgtattcccctccgggtgagccgaaggggctgtacctgaaatgttgtggggttggctgagctgctgaaggaaagcttggagctgtgcctgcagagccgaagccccttctgccattgtttgtggcacttggccaggcagttgagggtgtacttgggcagcgaccggttgagcttgcagttgcacgtgaggggccggatgcgctgctgcggtcgatggctgcccagcgaagtacattggcgcttgcacaacttgtggcggaaagggttgggtcggtacttgtggataaacttggggtgggacatagcctgccgaatactgga

SEQ ID NO: 6149 - DNA, 1055 bp, Oryza sativa
cctcccggggccgaacctgatacggtgaagtcgtcccccttcggcatatgctcttcgccttgcgtccttcgcccaggaggcctctagcttggctgcgattccctgcctctcgccatccttgctccatagtcttcgccatgggggggttcgccttgactaaccctgacgtctcgggctttaatccccattggtcgcatgctttcggcaggtttggtcgaagggtctcatgccatatcgccaacatttggttctttgcaagttttggtactaccaacaatttggtataatatcacattgatttagctataaattggcttcaatccaaacaatatcaaagcactattaaagttgccaaatgaattcgtagggcacattttggtagcaaaccaaaatggccgctagatttcaaaaaatattttattaccggaccatctattagaattattatcatctcagtcaccatcttttttcatgaaaacaaacattgagctatgtattagatattagtcagaacagctaactgtatgcccaactacttacaaattagttattcttgtttagtaaaattactccacctataatcgaagggtcatttcatataatgcttgtcaattgatgaatcatgagcatagtattagaatatttcctgcctaccatgcttcaatgctacaaaactttgaaatgccattacgtgattcttagattttgtatctcctcactcttacggtcttcgtgcaacaggagtcatataggtagtgttggaacttagaaacactggaaactgaaatggattaagcaaaatgccgactttgtctggctgaatcaaggaatggaatggaaaccctttccatcgtttggttcgaataagtgatcatccatgcaatgaacatataaacaagcaattcaccacataaatacgaaaggcaagacaacaattcagacaaaaaatcacaagaactagatctgatgtgtacgttggcactcggcagattactgatttccaaggtgggacataccagatttctatcacgctgttatttgttaccatgtatttg

SEQ ID NO: 6150 - DNA, 780 bp, Oryza sativa
ttcctgcagcccacatatgagatacaaaatacgcaggtttactaactggaaagtttgatagcatcaataaagagtgtggaaacagatcgcagagagcattaatcccagttcagtgtacatattaactataaaaaatatgtagtttataataatataattcaagtatattgatgttgtcacggtgctctggcaaggcaccgtaagcccacagagccagggtggcatccaggtcaggccatagcaatgctacggaaataaaatataaaaaggaaaggagtagcgcaacacataaacagataaactcagctccctccctctagctctcatcctagatgaggaccccaggcaagtgccacccatcaccaggacggcatatgacacagcaacaatgtgacaacattggcatattgtctttcagattcatcgctctcagtagaaaatattatatggtaagaatcagtcacctagcatattccatacatttcctccatattatattacaacaggaagtggtttcataataagtttatgaagcaaaacaactgaaaaatagttcctacacaataaactttccaagaatatgtacactccaaagagaaattaatgtcattctttacaacaagaatcatgcatcatggagtagaatcacatcaatttattaaaacactattaagagctgcatgaatttcttaccagtgcatcagaattttgatcccttgtgccctttccaatagcatcagctaatcttgtcgtcaactgataaacaaataaaaaaccatt

SEQ ID NO: 6151 - DNA, 1187 bp, Oryza sativa
gtggtgtttggttggagggactaaagtggggctaaactttagtccctctcacaaaaacataagtccctaccatagggacttaatacttttgtgagagggactaaatttagtccctagttcccaaacaccccctaaaactaaagagtacatgttatttctattttcaaatgcatatactatttaacacaaaatcctactaaaattcacgattaatacaatctacttagtcaacaatcagttcattgtaaccacctacacgtgcatttgcacgggctgttattattatgttgtaaacataaaaattctagctatgtatcaaatatattgattgttgtttgaaacagagcagcaaagaataaaaagaaatctagaaaaataataagttgagtcgaagatgtgaacaactaatatttacatgaatgacactctcagccaatgcggaattgcagatgttacatgggggtacggttttcaagacaatcaaaccaactcccactctcatccaatgcggatgttatatctgtcaaaacctctccatgacaagcagacccaactactatctcggattctcggatcccatgtgggagccacatggatcaaaacaactatcaacaggtgaagagacgaggtttacctaattttgaaagttcggacatgggttttacccagtttggagttgagggacaaaaattaaaccatgcaaagtgtagagtgattggagatgttaatcatcaaattgttgcttcggcgggaagcttcaacatgccagtagtggtggctggtgaggtatagctctacagaacaacaagagggcttcgggctaacgtggtccctatggcagtacaagacaattaaggtaggcttcaatgacagttgatgagtgctgccggcttattggattaatgtgatggattagagctcccgttgatgcttcgagctcaggtgactgattttgatcgcctgacccaccatacaaataaggtcctggaggagattcagagattcatgtctgcccagaacatgagctaggggtggatctaacatgggacattggggttcagttgaacccccaaactttttgggagcaaacagactgttcttagaattaaggttaatgcaaatttctagaagagaagctatggtaacacaaattcgagaaagcgtgggtaaagagggatgagaaagag

SEQ ID NO: 6152 - DNA, 1909 bp, Oryza sativa
acaaaatataccaactttatatacgtatatatagaaagtttgttttgcatacgtgtatacaaactttgcatacgtgtatacaaactttggatacgtatatatacaaactttctatccgtatcttttttatacatgtatacaaacattgcatacgtgtatacaaactttgcatacatacatattaaaaaaccgaaaaaactgaaaaaaaatacggatagaaaaaaaacgtgcgaaaaaaaaccgtggaaaaaacataacaaacaaaaaaggaacgggcgggaaaaaaggaaaccgaaaaaaaagaaaccgtgtgaaaaaaaaaccgcggaaaaaaaaacagaacaaacaaaaaaagaggaacgtgcgggaaaaaagaaaaccaaaaaaaaaaggaaaaccgcgccgccgcccgcgcccatctccacgtgccacgtgtccagtcgcgcgggagaggaggcgcgcgactgatcgcctattagtgttctcgtctaaacaccccctaattagtaattttgcctagcactcaatccacccggattgcttgcacaccccattcccaccctacgcaaaaggttgaaacctaaaaaatataagtactaatcgcattctccaaatgaagccccatgggactagaacactctgatgcagagagtccttcactcaccgatagcacattcctcttcctcatcatcaagcaccgctgtgacccttcactttctacttccttcatcccaagccggtgagtcccaatgaccacgtgcttagtggttgtactcatgaatagggttgaccgcgccaccatgctatcgtggtaggcctatatcgacgagcatccaccatcactttctctatctcgagctcctggcttactcaattctttcgatctcctttcctcatagctcccgcttggatgacagtttcatgactggcgactgtcagtcaccagtcatcatcgtaccgtatgggttaggccgtgttgtgctattcctaggccatgttgtgctggctcgctcatgcacttgtcgtgttgatacaccaagccaggtagcagcccaagcacggtgtggctggatcggtcgtgccagcaaaacccatagccaaacggatcatgttgttcctgagttgtctaaatgtgtgtccagacagacacagaaagacacaacccatttgacaacccttatagggggatttaagcaaatttctagctattcttatgtttcttttgatgagatcaattacgacacctcagtcgcacctaattaatttgattggtgtcgaattaaagggaacctttcaaaaaaatttaaagatgttctcttccataatagctgacggagcgtgggggctcctcaccagaagaccgcgcaggcccccctttgccggttcggccgggggcgctatgtgaggttcttcgccctcgatctgaggaatgtcagcgagaaggagcgcacaagacacgggcgacgtagacaggttcgggccgctgagaagcgtaataccctactcctgtgttctggtggatctgtgtgtgaagagagccaatacagagagctccagagcgagagagagttcagcctctttctccttcctcttttttttctcccctctttcctaggcctgggcctcctttttatctggtccggggtcaccacaagggcctcccgctacctaagaaaggaaacatgctttttacaatgagggctaatctacagccggaaatgacctctgacaagcagtacacacgcctcctgctccgctcgtcagctctcccggtggacgcccgtttcaaccttcattcaatggccagcgactttcttgccatgcttgcgctgaagcctggaatggatctgaccgggactgacataccaactccaggagtcagcacgccagctccggctagagacgagag

SEQ ID NO: 6153 - DNA, 1116 bp, Oryza sativa
ttatattacaattaggagcaatggagagcacaaagagatatttagagagggacttagaggcgtggaggaccagcaagggcgtccaagtcaagatggaggtccaaatctagttgacttcgagtacgtttcaaagtccatgaccaatctgtactaaaacgggcgcccaggtcacatacgtgctcggattggggtgttctttatatggatggaaagctaagaagataacatttccaatggttccaatcccatatccaaattctttccgagtcatcgggaatcgaccgaacaagttgacttccaaattttgttccggtgctgtgtcaccgtattttggcctttgggccgtgtatcgtgttggagcccattagggttgcgtatgttagattaatgggctagacccaattaaatcctaataaattccattggtccacattaagtgctatgggtaataataccaccttggaaatctaagtgaagaggtctcaacttaaatatggagctagtggagagtctctgttgaccggttgagatggtgggcgaacagcaacacgcgcgcgccgggccgtggcgtgggcgtgggtgagacaaggctgctttctctctcgttttgtgtcacgtcccaaaacgactctaaaatacatcctctaaattatgcctagaataattaaaatccgtgtgaaagcctccaacaattaaaaggtgcaaagttaaaagtcaaataaggcttgggggatttttgtatatttcctaaaatgcgtaaataaattttagtggaattttcagagcacaaataataattattaagaaataaacaaagttaaaatgattttgtaaaaggaaaaactctaaaaagtcccatttccctccctctccctcttgggccggctcggcccatctccctccccctctctcctcttccccgcggcccatccggcctctccccgcgcgcgccgctaacgggcgggcccgcccgccaccctcgctgacgggtggggcccacccgtcatccccttcctcccgccgctcccgcaaccaccccgcagccctagcgctgccgtcgccgcggattccgccgcatcccgccgtccccgcgtgcaataaagtgggaagaatcac

SEQ ID NO: 6154 - DNA, 3672 bp, Oryza sativa
ctgcagcccactatggaattgttggatcagtgtggaattggattcacacctccccctctattcaaaatcctcaaaatggatttaggttgggctcggggtgcatggttttgatagtagcacctcggccatataaggaccggtcttcgggcctctgttgcaaagcactaccgtacttccacatgtttagtgggtaaggcttagtttgtggctcagtctggttataaacaaaagtacacggatggagatggacgaagtcgggggtcgatggacatctctagggcaaatgaaggctacacgagctgcggctcggtagtcgagatgtcatggcacagggccggtgtcctgctgctaggggctcagtcctgcctacctgtcccggaggttccggccgtaggtggggttgggtctgtactcttgtctatggctaggatgggttggaaactatgtcacgtcttccgtccgtataccgtggtggtatgtggcacgtgtgatgaaccctgagttcctctcgacactcaaggctgttgttggcccgatctttcggtgagttgtgatatctacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccaaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatggaccccacctgggccggggtcccaaatgaagttacaagcccataggcccattataggtgatgcaacaccttgttcctgtgattctggccacacgagatagaattcagagaagaggctggatccgttaaaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcaacgtggttacatgtgaggaagatgtgtcttgtgggtaaagatgtacacatctgatcagagtataatctattcgaatagccgcgccctcggttatgggcaagccgagcaatgtacccaagttagtgtttttaattcttaaaacctgcttaacaactaaaatgtggaatggttggcctgggttggcttgggacgagctgggacccagggtcgggttgccagttcagtctgaatcatcgtaggccttgggttaaggcaggttcgtgtgggttcacggccttgattaataatattgtatagctctaggatcgtatttacaaaatagctttgagcaactaagtgtcttttaatgctgtttgctgcaaaccctaaccctttatattataacccccttgtactcccttggatttatcctgcacttgtgagtgtgtcttgttgagtacggtggttgtactcagtcttgctcaattttttcccaaacccagaagaggagcccctggataatgaaggctttggtgtctagctcgtgcctgccgtcaagcgcctgtggtcgtcgccctagtcttccgctgtttttcgtttgtctttttgtgtgctgggtcttcgccgcccatgtaataaattaattaattacgcttccgcttgttaaactctgaattgtatcaacttttggtgtaccttgcctcctgggacaaggaataatgcacgcacgtaaggaacgcccgttgggttatttctggtcgtgacattttgtaacgaacaataataaatatgggaattgatttagtatgagcgagcgcgtcggttacagaattaaacaccgtggttgatgatcccgaacattactctcgcgctcgcacatactctctcgttttgtaacggacaataataaatacgggaattgatttcgtatgagcgagcgcatcggttacagaatttaacaccacggttgatgatcccgaacattactctcgcgctcgcatgtagttcgtctcttgcacttatgttcattgtggagattatggataccccatatctgcatgacagttatactttagtcggatatacggcaccaaatatagatggaatatctttatgagaactcgggttggtttttaacttgtatgtcaagaaaatatccgggatcctagtcggttacgattgtattttatctataatcccatattctgttaggatatggactgtattttgtaaagcggactccttcccctatataaggagggtccgtgtgcctcttggggcgcgattctttttccagtttatacaatcaataacacactcggcggaatcatccccggacaggagtagggtattacttcttgaataagaaggcctgaacctgtataaaatcccttgtctccaaacccatccactttcctagcttgatagccaccccttttattattgccgaaatcttgtttcaacagttggcgtgccaggtaggggtagcgtcaagttctcgccgactaagtgcgatgggctttgtttctggcatcgacgacttcgccttccctctcgggcaggcgttccggttcggcagcctcaacttcatcaccaacgacttcggcaagatctctctccttgactcggattcaaaccagtcggggagagaccaggtccccgtgccattcggtattccgaactcggcctactctaagatcatctctcccgagtcggcttcaaaccacttggacgagatccaatccgcttttccgcgaccagatcaagacgacgggtcctatccctcaatcctgatgaaacttcctgatgatttggccgctgtcttcacagtcaagacatctcccactcgaagatctaggcgagctccggcttcggccccgatccgatctagatccagggaggttggcgttatactccaacctcttgggacagtctcgacgtatgagatttttactcggattcctatcaaacatgtctattttggacctttgagtatttatcactcaacccttcttgtattttttgtccttgatatgttcaagttgagaagcagtcggctgggtatcttactaagtaccatgcgtgcttcgctataaaaccactcggttcttgactatatgtttagttttttaactaatcacatagtcgggggctacacctaattaggtgcatcgctcgatgcaccatgttttattttcgcccttcgcagtctttgattttagcactcggcaagctggagcaagttgaattgaagcactcggattactgttttttgttttgagaaggctattactgtcaattgcgaaggtctcggggactactgtggagatgatggataccccatatctacatgacagttataatttagtcggatatatggtaccaaatatagacagaatatgggctgcaggaa

SEQ ID NO: 6155 - DNA, 2939 bp, Oryza sativa
taaagatagcgatctttagtcccggattcgtagtcccggttagataaccgggactaaaagggggttatgaaccgggagtacagagggtttctccaaaagtgtacaaatgtaatctacttatgttgttttcttatgtgacaagtttaatcaaccctaatgtgaatacagaggtataacatgacaaaaagtattttgtgcaaaacaacttgtatagttttcttatgtgacaggtttaaacatgtaacgtgatgttgaatgttacatgaagatattatgattttactccacacttgctagctactccctccatccaaaatgtaacttttgtaggaattcaaccaatcacaatcattcttatttaattcatcgacatacttttttttctcaactaatcaaaatatttcatcattcaatctcacatacttaattactttatgtaaaaacctctcgaaatgctttaaaaaattggaacaaaggtagtagttagtccctctacgaaaaggaaaaaaaatcttctaactacaatcgaacacatgagttaaacccgtaggttgattttttttttcccaggagcacacgctgcagtactcctaagtggcaaggatttttatttttcaagaaactttacatgagtgatgtgatgaatcatagtttttgcaatgtctccaataatgtttacttttcagttgtgcactgcacagattacactgtgttcattctgtcagacaaacgatgaaacaaacctgtagtaggtctgtacgatcagtcccaatagaaactcgacacgctcgttctctccttttcctttccagaggacgtcgacatgttcagtggatagaacaccgaactctgccacaacgtatactatccaccagtttgcaactgtaggacaagactacaggaaaaaatggtgaataatcacaagaacacccgatgctagacaaacacatattccgctcgaagtatatgttgtcttggatatgtttgaagaaaactttataagctttaaccatttttctgaatatttagattggatgtatgtttaaagcttacaatttatctaacttgagaagtacttttacaatatatagttttgtggggggtttgcaaatattttacaatagaaattactagtcagagttgcatcttggaaccctgatggaagtagatgatggtggccttagaaaagatatacttttaggccccaaaaattccatatggaatttagaaaaacagtttaatatatgtagaaagatagaaaatttccctattcctaaggccttattggttgtctggaacacataaatctattaacttattaaaggaatagaaaaagaaacctccacgttcgctctcacggcctagaaattctcatattaatcagagaaaaagaaaaacagagtccatatagaaatacaatttagaaatagctgaaattcgaaattaaaaataaggaatattggaagaggagactagagtccatatagaaatacaattaagaaataatagaaattcggaattaaaaataaggaatattagaagtagagtatagagtccatatagaaatttaaaactaactaaaattcggaataaacataataatattaaaagtagagtttagagttcgtataaaaatacaatttacaaataactaaaatttgaaattaaaaaaaagcatgggaagaagagtctaaagtcaatataggaatacaatttagaagtaattgaaattcaaaattaaaaattaaagaatattgaaagatgagtttagagtccacatagaaatacaattagaaataattaaaattcagaattaaaaataaataatattggaagaagagccttgagtctatatagaaatacaatttacagataacgaaaatacggaattaaagaaaaagaaatattgaaagactagtctagagtccatataggaatataatttacaaataactaaaatttgatattaaaaataattaataactaacacgtatataaatacaatatgaatattgcacattagtagtttcgtaaagttagtacaaaatttaaaattatgttgtcattttgatatatttgaataatacattgagaaaacatatattctattatatgagagaaaatataatgatgctagccgcgcaatctgcgtaggtcaccatgctagtttatatttaaaataaatttcagaaaactacaaaatttagcacctactttattacaaagctacatatttgagacggagcaccacaaaactacagattttataatcatttaccacaaaattatagattttgtgccaatttagtcacagaactacaatatttagaactccagcaaaacaatgatactaactactaaggacttaaagtctaaaatatgcagttatgtgatactccacataaaaactataattttatgataaaattgatgttaaaacgttagttttgtgatacattaccttaaatctattaaatctatagtgttgtgataatttgacctaagtatatgtagttttacgatatttactcttgtatttaaatcaccttgagaaaaaaaagaaaaataggtttgaattggaaaatttgccggtttctcattatttcaaaatctgtttggtcaagaccaccccaggacccaggaaatattgatatgctagtggactggtcatcatctctctctgtggaaagctctgttgtagctctactgtttatattcgaggatagggacggaggataatggaggatgtgattccattcttaaggttggcatgcctacaactcactgatccaagaaaaaaatctatgtcattagccatggtccgtggaatcgtggatacctttagttccggacacagcgctagctcctactagatctctgtcttcgctttggaatcaggcacacttgtgtctgcccatctgaaagcctgctagaaatgt

SEQ ID NO: 6156 - DNA, 7961 bp, Oryza sativa
atgtaacggaaaagttgaaagtttgtatataggaaagttttgatgtgatagaaaagttgaaaatttgaagaaaaagtttgaaactaaactcgaccctagtaaaatcaaatgtcatatttctattattaaaatgtatcacatccgatattaagtttagttttatgggatggaaggagaactaactgtgtgctagactgctaacaatacaaatgtcgttgtcacgggcggggaacaagagggatccagttctttggtaaaatcatttataaccgatcactgctctttccgtcgtagagaaaatcaatatgatgataatgataaatctgaacatagcctatatccagatttatatccagctttatagatagaaattggttttttctttacaaagcataacaataacataatactaggcacacatttacacaacctcgaaaaaatatgactgatcaatataaaacatagtaataacatagtaatacaaggcacataagagagtgtgttaaaaaataggtacacttgtacacaaccatgaaaaaacatttgactgatcaatactacataaagcatagtgataacatagtaatacaaggcacataagagatggtgttaaaaaaaaggcacaaaaaagatggttagtaaccatcaaacggtcatccaatcacagaacgcagggtgaaaagtagcagtactagtagtaaaagaccacaaaagtagttttttgggggcaaggatattgacccagatgatagcaacagcaaagacatctttcccatgtcaacctcaccgtcgcaatctcaccttatcttttccgaaacaatctcgcattcgagccacaggtctctcagttaagataacagcaactacttactgcccatgttaccttcatacagtttgaaaggaacaggaccagcaaaggtcaggttccaaatgaccagcagatttttccctctataacaacaataagcccttttaataattctagacagaagaaggcagaggaggagaggagaggaagcacggatgtatttacaagtctgcatcttacattgttctaggtttctctctaccaatacaggcaggtggctgaaagaatgatgctagccagagcacaaaacccaaggttattgcaaaaagaaaacctcacaggattgtgcggccgttggtctttctcttggcctcctcccatggcgcctgtgcagaccccatgtccagctctcctccaaccatcaatgccgggaggccaccatttgcagtggagccacccatggtccctccaatgccaagcccaaggaagtccagagtggcaggcttgggaccgtacagtgccgatggtcccatcatcaagtccggcaaccctgaattcccagtgtcataggtgagaccaaggccaagaccgccaggtagcatcggcccaggctccatttccatttgctggttgctcctatggtgccactgttgtacactgttatcggtgaacattcgatgtggcagcttggctggcggtggcggctgtgggacgttatccatgaaccttccttgaggcggatgaggatgcggatgtggatgtggatgtggatgagatgttgttggtgtgttaccagtagtgaacctcccttgggatagcttggatgggggagacgatgaggtggaggcggcgagcccaaactccttcaggaaagatgagcttgattgcgaagcaccaacctcagcagccttctgcaggagagcggttgcggacatgtgcggtgctggaggtggagcaaaggagcaggggtcacttgcatttgtctgtgggaagagagaagacggcgcaccaattgcaaggcagaggaatgtgggatcgacgccgatgagatcgcggagggatctgctttggggagtgctgctcgttgtgaccgacgcaaacagaccagcgaacgtgctcgtcgtcgtagctggagcgatagcattggtaacgctgcttcccgtgccgcagctggtgctgctgccatctgtgccaatggcctccgagggcgagggaaggaaacaaggcagcatcggagtgtcattatccagcaggtttgagtcctccagttcagcatctttgtatcgatccacttcctgaaagcaaacctcctcatctcgctcatcttccacctctatcttggcaatcactgctggcttagcaaccacctcttgctctgcaaatagatacaccagaataggatggaacatgttactcctcattgttcagctaaccgatcaaatgaccaaaccgaatcgggaaagaaacaaagacacatgcattgctttcttgttacagtagtaagattgactaaatgagctccaatttgccataaatctcgtctagtctatctatgggcaatatgacaaacaaacaacaaaaatgtgaaagaagcataccatccacatttggtaccactgccaccaccggctgaggatgctcctgcagtatcggaggcggcggcggcggtgatggagcgcactgctgcggcacctccgccaccgcctggctgggctgcggctcatcgacctcggccacaggtgaatcctcattctcctccagctccttctccttctccttctccttcacctcctcctccttatccttatccttatccacattctcctcggcctccaaatcaggcgggcgaggcgacggcggcgcaggcacggcgagcaccctgcccgtctcctccacgagcgcgccgcagaaggcgcgatgcgtcacgaagctgtccctcctgaacccgaccaatgaaaatcaaggcaagcaagaatggaaattctttgttgcccccaagggaccatggggatttggggtcgagggtagcaagctatacctggtgaagagggtgccgcagtcgcagcggtactcgcgggtgccgcaggtcttggtgtgcgccttgaggtcggcctgaacggcgtagcgcttgccgcagcgctggcatgtccagcgcttctcgccgtgcttgcggcagaagtgcttcttgatgccggtgaggtcgccgagggcgcgggtggggttgtggtgcacgcagccgggctccgggcagacgtacacccggcggcgcggcggcgccgcaccggggccgcgctgccgcagccgccacggcaggttgtggccgcggcggtgcagctgcaggttctggtctcgctggaaccccttcccgcacacctcgcacacgaacctgttcgtcgccagcagcgtccccggcgacagcgcgatcacctccgcgtccggatctgcccccgcgcacaccacccatcaaaccacgcctcgaagtagtagaaagcatagcacccaccaccgaaaccccaaaggaaaaaagcaaccccgcgagcgcgcgctctcacctggcgttccggggagattcctcttcttcttgaccaccggcgccgcccccgcccccgccggagccggctccaccgccggcccgggctccccctccgtccccgtcggattgggtggcatctcctctcgatctgccgccgccacagctccacccccctcacccgcagctcccccctccccctccccctccccaagaactgcgctactgcgcggcggcgggcggtggacggggcgaagaggaagggaagggaagggaaggaaaaaaaaaacttttttttctttctctctctctctctctctctcgcagtctccctttgcttctctcttctctctctaattttcgcttgcctttctattgggggagttgcggtgggagtcagagaggcatcgggatgatgaggcggaaggcccgcgccactgtgggtcacactccccccctctcgctcgctcgctggtgccaatccggcacgttgccctttccgctgcggggtggtggtgggtgggcgggctaccgtccgatcccgccccgcgattcgtgcccacgtgccacgcccttttttacaccacaccacacgccgtgtggttttcacgtacaaaaactgcgtggcgagtggacaacacacgggcagggggcacaggcacggagcggcggtgggattggattgtggattttgcatccccccggtgttgataaggccgggccgcggggggggaaaaaaaggcggcagcggcggctggcccaggccaacgcagcgcaaacgcctccgatcgggcgagcgagcgatcgatcggcgtcgccgttatccagccagccacgccacggtgcacgcgttgcgttgctatactggttttgtatagtacagggaagggaacagcgtgagctctctctctcgtgcgaagtcggcgagctgatttgctgggactgggactgggagatgagttgacacgggtggagagaaagcgatcttttttttactgtttgttgacgtgtcgtcggtgttgtggttggggatggggggttggatcgtcgtggggttcttttttttcttcttctgctgctgctgctgctgccccggtttggttttggttccgtcagaacggggtttactttgggtgtgtgctgtggagaacacgtcgctggtgaggtaagagagcggcgtggggtcgcatgtagacccgcgtcttatattgtgctggatctatcagcgcgtacggaaagagagcgcagtaagcaacgacgattgccagctgggatgtggacatggattggggtggtgcttatggtgaccatctctctttctttttcttttttttagtttttttatagctttttctagttggagatctagaggtttttcgtcctcattttttttaagtatataatcgtgtttttgtcctaagatgtgtttttttaatgaggtaggctggttacggtgacaaacacacattaaaagtctaccatcatattattacaggagttcgtatcaagtggattttttatataaaaaataaaaacagaagtttccaaattgttctctctatgtcctttgcatgtatttttgcgaatggatggattggtttgttcttttgggatgaagggagtaggcccgaacaaacacctaaaaaccgttaaaaaccttttccacgtggcctttgttgagttgtgatctaaattcatttgcacttaatgaaggccaacttctgccgtagcggagcgaaggctgatcatcatcccttttagggttccaccattatatacctcttgtaagccgtcgtgcggcgacgtaacctcacctcagatatagtgaagatattttgctggctggcgcccgtggttttttctctcctgttttgggagggttttccatattaaacctcgtgtcttttgtgattgatctattgttttttatcgtttgttcgcatatcgtttcctaacagcctttgctaagtgagtaacttcaattatgatgaatggaagttgccaaattttgatctcttcgcgtctcttttcaaatcatcgtgtctttttgcaaagtaatgcatgtctcttagcttatgacagaataactacatcactagaagccatttctatgtgacaattaacaaagcggatagttttacttgtgatctcctacaagaagtggaatttaccaaattttcgcctctcaccttctccaatgccatatctttataactcatcttgtccttttgtgagttgatgtgtgtcgcttattatgacagagcaattacaaattgtttacttgccctttcatagatagcatctcctcgaatcaacgtaagttaccaatctttcatcttttcatgccctttttcaaatcaccgtgtcatttggcaaagcgatgtgtgtctcctgagccctaatagaatacatgctactatccaaaaatgtttatacatttttttatcatataaactaataaaaagagtaaaattttctgtctctctctctaccttctgtaccacgttctattctattatttttcataaaaattattattatttatatttcttatataccactaaaccattttttcttgcttttctatgacacccaggtcttccaatgcatcacgacctaggtactactctcttcgcccctaaatataagggattttggtacgtgggttaagaggtgaatgggctcatatgttaatggtagtaaccggtgttctagtgactgcatcggatcggatagttccttatcctttgctaggctttcttattactactcgaggatcagctagagcgctgctatgagccatgttggtcaagttcgagtaccattcatatatctggagagaaggagcaaaagtttttgctattcattttgcagttcacttaaatcatgggtcaagtagaaggtggactaacaacagtgccatataaggtcaaaaaatgatatctcagtgctatataagtcaatgcatgttttcaatggcatataaagaaatttaacaattttaaattctattcaaggaattttctctaataaaaaaaacaaaataccacctctctagggaagaaatccagagcccttgtctataataaggtccacctttccaatggactaccaaatcccgaccctggcagtacaacgtttttttaccaaattttgatgaaactccacttgtgtttactgtggtaaatttgaatttctcaaataccataaaattgttcaaattttctttcctcccgtgttgaaaccttgaaattttgtggttttttaaacgatctgtatacactataaagggtgctcaagacacaatgctctcggggagcaggtcatggagaactggataccgaaagacggacaaacagtacatgcaagaaaaaatggatttattaagatcacaattcaatttattaatttgacttttgttgtccttgtaatattttcttgcccaatcggcctctaagagcatccgcaattgtaaagtaaggtgctctctataaaacatgtatatctcagtaataggctagattaatagtaaaccacatcaatagtatgtctacgtgggtatctatagctctctaatgcattgtctcgtttttctctatagactatctccaggttagtagatagatttgttctctttcttcatttaatctctttcaagtaggaaaatatgctgacatggatctcttgtagagagtctatagataaccattgtgggtgctctaacgtaaaggatttccaggcatgctttttataactagacatgtaagtaagtaccaaaatcggagacacttctaatgaacaggggggtgatgatgcggtaaaaaggttacacacttccatcttggtttgcatactttcatggttggatggtcggttctagctctcacactcctaaacagtgtgcacgtaccccgttgtgcctgtggtcctctccacggagatatcttctgttcctcgtgtgggggtgctgggtgttgccattagccaacttgccacgaggataaaaaggtagcaatagccaatggggattatagggtgaaaagtcccaatctgcacgtttggaatgctaaaaatccatggcaagtacttaactaaagttgcatctcagtagccaccaaggcagctgtgcattgagggtagctgtattattaattgaaaaaaaaggaaagtaggagtatttttttagctcaggggagtgtattaaaaaaatcagctccggaacaaaaggggaaggataaatgctaccgccaagcagaaggagacaaatggagcatatgcagcatttcaatcattcagtgggaggcgatcattgtgccccttgagtcattttcaggcaacgaaaaacataagcaacattctggccatagctaccggcacctgtagatcatactagtacaggtttagcgagagaagcgttgcacttgcacatgcccggaatcatttcagtgtcatggatatctccaaatccttctgctcgtacctcattcaggagaggtacttgttggctcaccaactctggttccattattccattacatcataatcatatacacaacctggttccgttcaccatcgaccataaatcttcatttttattaattagatccatgtatcattatgaat

SEQ ID NO: 6157 - DNA, 11365 bp, Oryza sativa
tatataaaatcggatccttgccactttgcaagcatccgacgcatttgaatcatgttatgctgccgtattttcgtatgaaccgaactacccgtgccccgatccccactattatgggaccgcatgtcactcaccctcaaccataaccttatcggagtacatgcaaatgtaagaggaaaagctacagttacaaaactgtaccgaaatacccctcgtcagttttggttggaccagagaaatccgaacaacagcaatccaaatgcccgtgaagattagactagactgcagactccgtggccgaccagagtatatcgtttgctcagtgagatcagactatcaacaagtgtccgtgcagccaccattgcaagccatcctcgcccctgatctcctaagatcagctggagattggaaacgggaagatacgtgcactgtaatctcccaagattgcattccgaaagaagccattgctccagtggctgttaagctgctaatggtcaatgacttgtagtatacctgaattacacaagcataggctatccattacgctatcagctggtcaatggtaacagagtttttttttaattaagaaaaggcaaaaggagtgtctcggataatcggatgaaaatttcggattaacgtctgcgcgaaggaagcatgttgtgattcttgacctgaaaagactagaccaataatcactataaacatgtaatagcatcgcgtatgtcggctaggcctgattggttgtttttcttgaagcttctgaggtatatgaatggaggtgtcgaagatctttcggaattactacgggattcatgacaaagaccttccacttgtgctgtaagcggcctccttttccggatggcaacctgtgataaattccttaaggataacatataatagctagatcctgaaatagccatggtgacatccacatcaggcgataaagctaccagattctgaagggacagggcaccataatgtcccttctgaaataaggatcgacaccgtgcgagacgaataaaatacagttcgtgtgctgcagtcacacgctggcagcatcataggtataccgtagaatggagtgttaacaggtgagcgtgaaaacggagctttgatgggttcaacgataagtatttgctgctagcaactcccagtacatgagaaatcatatgtacaacaacaggatggatgctacagtgaaacaccagaagttgatagctctgccctaagacctgcaagtgcggtatacctcaccacgcatcacatcaattggtccatggtcaagtgcataacgatctgggccaagatacacgcctgtcttctcaaggagagctaaaccttcctccctgccgtaccttgacgaataaagcttcaggtattcgatgtcctgcgttagaacatcagtaaggaacaactgtgagcagagtcaaccgtgaacaaattgctcgctgatggagtttcagtttttgtactatccacagccgagaactgtggttctggtaaccaaaattaaactataagactgaaagtttcatttggtatattcaatgaaatttcctgctaaattcagtgaaattggcacactctaatggcctgtttgggagagcttaaaattctgataagtagctggttggtaaccaccttttgagaatatggaaaaactaggtttttcagcttctgtcttctagttctttttctggattctacaactacatattctcagaatctgtaccaaaagcttgactgtttgggggaacttctgattctggaagaagctgcagtagctagaaactcccccaaacaggccctaagcactggtttgttcaaaagaaaaggtctcattcatgcaatattccaaatgtcattggcttcatagtttataatatggtgtactgtgaacaatcaaaggcaaaggtgggatttaaatgacagcttaagtgattcagccatgaagcctctttcagaataagtactttgcacttaatttcaatctgaatagttctaacttagcaaacatatactagcattgtggacgaattcatctttcatatagaggctggatttacttccattacttttaaaaaaaacatatactagcattttgacagaggcaaagcattccaaaaaacctcacctgcatgccactgagaatgcgctctagcctagtggacgcaaccggttcatgtgatgaagaaaacacttcaccaggatagaacagaaccccatcgccaggaggaagaccacgtcggaaacaaatctgcagtcacgccaagtaagacaatcagatgagcgtgatgcaaattgtagaggccgatctatcaagttgaattttactgtagtattcaatgtaatacaccttcatagacattggtatcacattgtattaaatggttcccgatgccacatcatacctcagcacttggaatcatagccttctcgtagcagttggtaccccaataaaggaatcctgttccaccttccttccacactctccacatcactgccctgtgctgggttccacgcatcccaagatgccagtttggttgaggatcagaaggccccatacacacatatgtccaccattcctagataagattgaaattacttcagctcatcaagatagaaaaacagtaaactataaagggctccataagtccatatgcatgcacaacagtaaacggatggcgcaccagagaacagtactgtttacatagagagcccacttttataaggcgcgggtgctattcaagattcaaacatttgtaactttttgcccacacctggtctcattatatgtaggtgtatggaaatggtagcactggatttatatttgataatatttcttgtgattttcccattttgggtagttatgacaatatatttaacggaaataataatctgagttcaattttaaagatagtgtcaagtcaaattgtgccttagaaaaagacattaaaggagagagtaacaggaaaacaggcacaacatttcataagattaccgattacgaaaccctatgtgttcttatccaactaatttttttttaattctgactaatattaatcttagaccaaaataccaacagattcaaatcaccattattcagaaaataaatgctctaagccatgagctcttccaagcacggcaacatccacgctataacctaaagcacaaattcaatgcaagtacagatgttgtagaaagaaaatgaatgttgtccatactatttaaaagaacataatttgctcttacttcaccaagatcaggtcgtagttcagcaacaatatccttcaccaagtcctctctcgtgccaagaacccattcactgtataaaaagaacactagatcaattggatatactacatctgattttgaacagtgtatgaaaatgattttatgcaccaagctaccaatacttctactggcctccatgtcgcatatccaatatccacacagtgccaaacatttccaacatgtatcagagttgtgaattccatcaaattgccaatgtcgtatcatcataatgtcagtgccttgtgagaatggaaaaaattctttcagaccggcattgataattgtatctatcttgtttatgttacaaattaggagtagtttctaatatctgaacctagctctgaatttatttgacaagataatgtaagacgtagaaaacacggtaaaaaacttaaaagttttgaaccttatgttttttttgttgtagaataaagcattacagtccatcattttagcatcagtattgagcagctatcggagtgagtccacaaatgggtaccccttgacccactagttcaactaaaaatccttttttttttctttcttgctagtgaaaaggtgcaattttagttaaactagtgcaagtcaatgggtacccgtggattagcccactcccattcctagtatagatctatgctgttgtatcagtttttttggaaaaattataagcgtagcatgctatgtcagtgtgaaacatgtgtacatattgtaaacagggatatggacaccgtatgcccacactatttcagctgtttagaacaaataagaaataccagcaggagtgcaaaccttgtgcaaaatatctgcgtatgtggacgtagaacatttggaactttcacaaaggcctcaaatgtagaaggagccagttcagaaccacttgggcctacatgagccatttgcatttaaaaataagatatatgcttaaaagaaactcaagacttgccaagtgtgatcagcttctgtaggtacataaatgttatcctgacttgaagaaaaagtaggaccaaacagggtgatagaagatctatgcatcgtaagcaggtaatccatatggtcattccatacaggatataaaaaacaccatacctaatggctaaacaataaaggaagttattttatgatacaccaatgaccaatctaaatatatgctaattacaaattcaagtagggaaggatgttgtttaacacgcaccatcactaagggagattagatggtcttactcaccacagtaataagttgtcaaaatacgcacatcaaatgcatatgaacgcaactcattagaagatgctgcccccatgcagattacatcatactgttccatattcagtggctgagaaaaataaaaataactgttagatcataaggtagctcttctttaatactgaaatgaacagtataaattgatgttggagcgtggcccaaagagtacccacgggttggtccgtgcctatccctatgttctatggagcacacatgtagctattttggttatttcaggtgtcatgctttattgagcagtgcataaactggttggtctcatcattaccacgctcacaatcatgtatctacaaaatttttgcatgtgaaagatgcagttacggttatacttgctggtttccaattttatgtgtgtgtttacgatataagaatatactggacatgggatgttcaatgtactccgtatcactttattgttcgtggtatgttacatcaggacgcattatattacaacagaagttacccttatccgattaagagaatagatctaaacatcagtaagaattaaccatatttttctattcaacaatcaacatagatgtataattaaacctgataatctaagactgctattattcataggaataatgtaggtccaactgcatatagctattagctaggcaggccataatggaacctacaaattgatatggcatcataaagaacactacaactaaggagaaacttgcattttgtgttgtagagacgtgtaactgagcaatgacacacctcatcccacaaatagaagtaagatttcgaccaatgagcctctgatttcaagatttcaacctctcttcgcagggaatttttcgcagcatcagtgctgttgtgaataaaaaaaatgagccaaaaacatatatagcaaattggtataaaacttggcagaaatttgagcaataccttgataggataggtgcatatggtacagcatatgctgctagtcttggatcagagtaatattctttcgcctttggatggtcagctataataataataaacaagtgagaaaaaaatcacactccatagcagcagattgttttaccaacaaagatggaagtgttaccaggccaagggcatgtgtatgctagaatgcgcatgctatctccccatctgcagaaaaatggactgattctgtattggaggagccacctgaagtgatgatcgagtgcatcataccaacctttggtcccatgctccaagcaaaaccgatcttcaatcacagtttcagatatctgagtatagtcaatgatgaacaaatccataaaagtacagtgaaaatgcaaattaatgatgactacaacgcaaggacagcatagacaattcagtcacaaattcccaactgtagatctacaaagtatgtgctgcacaccagaaacaagcatattgaatccttattatatcttaaattatccaaacataacagaatgaaagagaatagtgccaggatacgccaaaaacagcaggtaaagaaggtgtcagtgggagagtaaaatcccaaacagtgaggctcaacttcaaacgaactgccacattgttcataatatcttcatccatcatatctcctaatccattattctcttggcagtcctggaatgatggaagagctaacatcctcctcagtgtggttgaagcagatgtaagtctttgtacctaaaagttgtagaaaggaatattgatataaaaatgcaacatagcatgtccgagaaaatatagcatcagaataaaataccatttcctctgatgacgagtagtctctgggttcagtgatgtcaatgcaatttcttaattctttgtaaagctggtacctttcagattttgtcaaggattctcctctggacctgccaccatagttaaaagataaatgccagtcaaacgcagatgaacatatgggtagaaataaaagaaaaatatcacatggacagttgtgaccacctccaagcatcaaagtggacactggacatgcattctgaatatcgatgtttgtaacttaagctgtcttgtttcaggatgagtgtataagataaaatgattgtttcataaccccaaccacttctaaattttgcaaactatttaaagttatataagaagattacactagtttgctcacactagactctgaatttagcagctcaagacatacagtaacagtgtaacatggaaagttcaatgacttgggcaaataaaggagtctcagatttcaagacacaataggaaatataaatataaagcctctgattattacatagttttcatgggaaacatgcatacaaaacattggttttaactctgtatacaatagtgcatattacttcgaatatatgccgtgcttttactttattatatcaaccagagatacagaaagcatgcaatatggacactggtgtcaataatagaatctgatgtttctttttcatgcccaaataatactaaatactaatcagattatacaatcacttgtgacagaggcactgaaccaacttaaagcatgcaagcagcatagtcaagcttactctgcttctgccctcacagcactaataaatatttcaccctcatatagacccggctgttgtccgcaaggaacatttagtgagacccatattgcacttgtctctctgtacaaacaacagtaaattagctatcacgaaaaagagaaaatgttgctgtgcatgaatcatagttgcctaaatcacagaggcaataccctggaagcaggtttatttgtgaattgagtggatcaattggcacaagagcatctggtacacctaacataggcaccacacgtcgcaaggttacagattgaccaaccactaacctggtacagcactgtcataatcatccaatgtagaagtgtacaaatgaaggtatctctcaaagaatggatgcaagatttaaataaacaaacctgtctccagcggaagagcaaagatcagtgcactgaacctgcacagatcccgcaataccagaagtggcccatgatacctttggacgtaaagcaatttgaaaactttccctttcatttcttgctgccaaaaggttaacctaaaagaaagtaacttttaaatatttttggaatgaactgtggtcgaaaaatatgataaaatcatgtacacatcagcctataatgagtaaatgctggaagagaaaaaaacactgcatatctgatggaacagagaagtggtatggccttaaaatattctgcatattgaagtgtcaaagcaagagagttcttgcacttctagcagtgctaataaatgcaagtataacttacatgttccagaggtcgaggtgcttcttgttggctaacatttgctgtgctcggcatagaccagacatgcaaaagatctgctgagtgtatctttgtaggatcaatagcaccattacctaaactcgacgcctgtaatcctccatctacccatccataactagtccctcctccagctacaccttccacaggtggtacagaactgttctgcgtcttatctgctgcggtcagaggaaggaaaaggattaagtcactggaacttaagctccaaagatttatctctgatgcatgtaagtcaaaaactcaaaatcctaataaataaataaaatatctctctggaacataaaaaaatatgtatattaattgttatcgaccagcaattctaaagatgtagagggcttttccaagccatgtgatgtgatggattcacaacagtcctggttcttctagcctgaccgatttcttattttgcaactgtcttcctattatgcattttctcatacctaatccatcatcccgtgtgtatgtagatatgacttccaggcagacgcaatcactgcagaaactaccagaaaagtctcttcacttagctcagaactgaaactagagatgggctcaatcaattccatccatgggtgagcttgagcatctccatccaagttgtggtcactctaccgtttaacaacacagaacggccagaccaaaaaaaatctcagaaccctatccgattgccaaatgacagtctcgggttccaccgatgaccgattaaccccctacaagcaaatggcgagcagactggccacattggccccgagaaccgcacaacgcgagctcaactggagctcccgggcacctatacccccacctgcccccctacacaacccgagggagagcagcgctcccgctcagcacgggctcactcggcagcacgcgccagcagctcaagcggagaaaatgggcagaggatgatccgggcgggaggatccaattccacccccgggttggggggcgatcgggccgctgttccggacggcaatccagttcgatcgggcggggggggagagcagcgaggcgagcacgcacctgcggcggcggagttgggttggccggattccatggccacggcggcgcgggagggggagcgatcgatcgatcggggggagggcagcgacgacggcgaggggagcagcgctggagtggtagtgggagaggagaggagaggagaggatgatgaggcggaggcgagagagagagagagagagagagggagaggcggtttctgtgcgtggcccaagtcccgagaccccctcaccagtcaccacctcgcctcgcgcgcgggggccgcaccggtgaaaggcgaggcgaaggcgatcgagttggggaccccgaccccggaccccgaccccgacccgggcggccggtcgtcgcacgcacgccgcaggatcaaggtgatcaacctggcgcgcgcgcgcgtgttgtgcggccgtgtggtcgttgcctcgttgcaccgtggcatcgtggcaacgagggaaatgttaataggagaaaagaaatcgcggaggcgcggacgtgttcgcctctccagaaaactcatttcggttcgagtgtttggtttggttcagagttctttggatttgacattcgtgctggagacctggagtataaacattgcaagtatagtgtgcagttagaagatcatagtcgacacgcggctgctgcatcgcacggacacacggctgaacacctgttgtgaccttgtgaacaaacgtagccttactgcagtttgtcaggaacgttatcttgttcggctcaatcagaccattttgtttagtgcttagtacctagggcacctttttaacggaccacacaatctcatgagtaacgaaagacattagcaaaacgcatagcagccacccagaccacacactcctactctgttgtgagtagtgacacaaagatatactattagcgaacgactgctccaggccaggaaacgacaagatacattcagttctgaaatcttagctacagcactaacacagttcactgcagccacagagcaatgtttgtcagggtaactcatcttatgcataccactattcatctagaagagcaatgagtaccaataatgaaccttaaaaccaactcagctgtacgtaatactgtcgaggagtgaccctctctagcgagagatcgtgaggcctcctccctttgtgagttcggccgggggaaaaaacgcgatgatcaagagcgtacctccacctatgacctaactactgatcgctcgcaagtccgtgtggaagacaagggattacaagggttcgggcgctggaaagcgtaacacccttctcctgtgcgtgggattatgatgagttcttacaaggggtcttgagctcttggggaaatctagctgttctttctctagcgctcaagctattgagagtcgtccctttttcacagtgagcgagatcatccttttatagttcaaagggataccacatgcaccgtttatacctacccctccacgggaggggggcccacatgaccctggtcatatcactatcctttgcttcaactggaagcaatgtggttgcctcgcttcaggtggggcccagcgccgtcccccgcctgacacgggggacatccccgtcattcctcattcattgtatggagactttggcggctcaccatgcgcagggagcgctcctggcagtgtaccaatgggacggggcatacctgcccccactccacctgacacaggacggaacgtgggggcactgccacccatccaatcgcctgtgaccagtcacagaccggtcaagctcgattgatatgggtcaatcaggcagcgccgcccgcccgcccacgccgcattaaatgcagcgtggaacgattgggacgccgcgcattgaaaacgctgagcggcgctcctgctccgccgctcccctggccgagcgagggcctcggggcagcgcatgctgagggcctaaggagcgtgacatggcaccccgaggccccctggccacctcagcgttacctgatcgcccctcgagggaccgggggaaagccaggccgcgcggccacgtggccagatgggaaggtgacttccctctactgtgcgtacccccggtcctatatcaccgacaaatactctatccgtttcaaaatatttgacaccgttgactttttagcacatgtttgaccgttcgtcttattaaaaaaatttgtgaaatatgtaaaactatatgtgcatataaaagtatatttaacaataaatcaaatgatatgaaaataataaataatgacttaaattttttgaataagacgaatggtcaaacatgtacttaaaaagtcaacggtgtcaaatattttgaaatagagtgagtatcgtctaagactgcatggcattatctcctccttcacctggcacttcattgaacatgtactggctctgatactccatcaagtactgcgccgatctcttcacgtccaggcagagctggtagaccctgcttatatcctccatttccacg

SEQ ID NO: 6158 - DNA, 9374 bp, Oryza sativa
ggattgcatacctcagggccgtctccactccaatctttgtgagcaataccttggcatatgcagtaaacatttccacatcttcttcatcgcacctgatgtctaggaccttcgggatatcatcctcggtgtaaggctgtgtcgtgatgattaggagccgattaaggaagtcaggtggtatcccatgtagtgattggtagtttatcccacgtatggatgtgatccctcggttggttgcaatgactagaattggagtcacgtcattttccaatgcacggtttagaaaggagaagcattcgatatctgcatgtggacttcatcaacaaagagaacaccagggacaatctcagccttcccttcctccctccactcagcaacttttgtatcaatctgctcccgagcctctgcacgaatttcaccagtgtcaccagtgaaaagtgcaagaaaaccctgtgtcctggacagcaataacaaaaaacaaaaatgagtttgcgcaaacatagctcacttaaattttttctatggtagttagaaaaccacatctgaaagccaataatcttcgtctagtgaccaaaaaactaccaagccagttataagtaagattttttggtgattacgaaatggaatgttcaaaaagattcaccaaagaatactatttaaaacacatctgatagttgtttggttgataagatacttacagagacagagagagagagagagagagagagagagagagcacatcacaatcacgatcagttcatgtcaaactggttgaaacatattcatgtaccatcttggaacatggttcatttatgtgcacataataattgctaagttgtaccaaagtaccaataggcttgactaattttcatcaaattatacccttagcaacatcgtgcaggtccttttttcacaagagttacaagaggaggctgctctccatcattatttttctatgggccaaaagaaaaattagatcttccgttcaaaaaaaaaatctccgttcaaaaaaaaagggaaaaattagatccgatttggacggctgaattgtatttcagctccaagcccaacaagatcatatatgccatccagtagaccatcttttcttagtattagctaactgagtagatgtggcagttagtagggacaaactgatccagctagggctgtccaaatccagtttagccattttttgtcaacctgcctttgacatgtctgcaggtgaatgaatgagatggctaggtgtgatgcagttgctggaacactatggttagctatgatttggccagttttgctgatgcaggaatgctcaccccttttgatctagttctagcgccattcaataggatctgggtggggctgagaatgggtcaggggttgtacagtacaacgcagggactggcagctaggcaagattaaccaatttcaaatttattatttgattctcatcactgcatatacacatgacacataaattattttccattcaggctcggaagcaaaatacaagattacaagacagttcttaatttggatttttgagcgacaagttgacaagtgatcctttattcctttgttcagatagtaagttctagcaaacgttagaacagatttttcaagactgacaaaaaaaaaactttggtggctaagctaccacaatggtaattagcaattaaacatacaagcaagcacacagcacatatgtccagggtagctgaaagtcaatgtgaaataccagggctgatagaatttgaaatacttgagttgattgtttcagttgtatctatttttcagttgagtaatatgtgacaccaaagctcacagagtttcaccctttaatctctagtcctctactatgtcaaaactcaaaatggttcaatacttccttgtcaggtatgaaatattgctttattttatgagatatctactctagttatggaggaatttttggcaagggaatgtgaatttaccggctattgatgacatcaatttcatgtaaggttgacacaatgcacgacctcctcgcacttctggagctcgccctcagggcacttgacggacttggtctgaggacaaacagcatcgtaatcccggcatcccgcgacctcccaattgagcggccaagcttggtcaccttcccgaaggccttgtcaagagcaaccacatccatccccgctctgcaacttctctttccccagggcctcaatcatcttgccgccgagctcgtccacggtctccatgtccgtcgtcttcagcgtgagccgcccaatcttcccagccgcggcaacaccggaaggcgcggagctgccgccggagacggggcggtcgattgagatttcaacgacctcgccctcgattatctccgcctccgccttgatgcggacgccgatggagcggtggaaggcctgggtgagcgcctcctcggtcttggagaggtcgagggagaagagctcggacgcggcgacggaggcgaagggcgtctcggcgccgagggactcggcgatgcccatggcgagtgcggtcttcccggtgccgggctgcccggcgaggagcacggcgcggccggcgatcttccctgtcagccagctggatggatatatgaagacgaagacgaaaggggaaacacggagaggtgttgcatacttgcacttgtgacatataatgggctgttactagttgggccagatgcaattccaatccttttttaggcctgtttggaaccagagttttttttttttttttgaaaagtgattcttagaggtccttcttagagtcggaggtctgcaatactttggtattttgggcttgtttgtgttgatgcctaaactagccgttccaaagaattggcaatgccaataaatttggatggcatttaaatttgtttgctataaaaaagggcaattttgacaagaaaatcaagcaataatttaggcacttctaaaaatttggcatcaaacaaaaccactgccgaaaaagatggtagggtttaaaatggccatgaaccaaatagacactagctttagaggaatggaattattgtatttggattcctttgtaaaggaagcaattcctcattttcatatgaaaatgaacatctggtttgacagggaattcttttatgagtggggacaaagtaaatcattttcctctgatttttttaatcgacattcgattagcgtcgatacgtagcatgtgcgtacacgggtaactatatcaaatgcaattagtggagaatgcatctatttaagcatgtatatataggtgtgttcggcaccacatgttcccaattcttcgacctcatgttccgcgcacatgttttttaaactgataagcggtgtgtttttttgtaaaaaagtttctatacgaaagttgtttaaaaaatcatattgatccatatttttaaaaaaaaataataatacttaattaatcacgtgctaatggaccgcatcattttccacgcagaagagaggattgacgatgttggtacattgcattaagcacatttacaatggcgccacgatcagtaggtaagacaggaatattcactgcgaaaaggaaaagcaactggtactactaattgttactagcaaggtttcggtttaaatggttcagactttcagtacatcctatacatggttagaccgccatagttgttgggatcattagttggttaggttactgtcttactgatcactaattagttgaaaatcaaacttctcggcgtcgtgttcatggaggaaacccagcttgatcggtgagtactgtacgaccttggtgcatgcaatttaactagtactatatcatcttcttttggtcagtacaaattgtaccaaccgttgtcatcagtacgcacctctgcttctaatcaatatctgtccatcacatgcactgttacaattttttttcctctcattgtcgccatatatattactacaaatcattaactagccaaagagtaagcatataccaatatgaaacaaccatttccttcggtttccatgaagttgaaccataaatatatttcctcttgcaaccatttcctttgtgatcacataccagattccaaacgattgtaatttacaaatcaatcaccaaggaaaaaggctcgcagtcgcaggctcgcagcccttcatgataagcggagttgtgtttgcaagctggccggtgttcgggccaagctgcgcaatgcgtgccagcctttgtacccctttcctcccaaaatcttgccaaactcaaccggcgtctcttcgccgtgcaccaatacaccatgcgccgacgcgacacatcgttgccacggtgtgaccactgaccagggccggccgggtcggcgcccgggcgtgcatgcccttccaagatttggaacgtgacgatacgagacaaaaatccgcttgtccgctccgcgcgagaaccccaccatgtcccacgccacgcgcgcgcagcgacacacacgctgcttccgccaacggcggggggcgactgccccccccccccgggccccccatggccccatcacaccataaccgtacgtcatccacgtcccctccggcgtccgtcggtgcctccgtgccgtggattggagtatgtatagtagtactgcctacggcgaggaccgcatcaccacggcatcgttaatcacggcgacatcacgggtgagacctcggagcacccgtaatgttagagtaataagttattataaaatatgtacatctcagcagtaaactatattaataataaatcaattcaatggcatgtctacatgggtatctatagctctctaatccattgcctcttttttctctatagactatctccatgtcagtagatagctttgctctctctctttatttaatctcttccaagtagaaaaactagcatggtggcccgcgcagattgcgcggctagcatcattatattttctctcatataatagcatatagtatgttttctcattatattattcaaatatattcaaatgacaatataattttaaattttgcaataactttacaaaactattaaggtgtaatattcatattgtattttatatacgtgttagttattaattatttttaatattaaattttagttatttgtaaattatatatattcctatatggactctagactcgttttttaatatttttttttctttaattccgaattttctgtaaattgtatttctatatagactctatgcttttcttccaatattatttatttttatttttgaatttttattatttctaattgtatttctatgtggattctaaactaattttgaattttgaatttcagttacttctaaatttcttcccatgtttttcttaatttcgaattttagttatttgtaaattatatttttatacggactctaaactctacttttaattttattatgtttattccaaattttagttagttttaaattcctatttggactctataccctacttctaatattccttattttttaattccgaatttctattttttttcgtaattgtatttctatatggactctatactctacttctaatattccttatttttaattccaaatttctattattttataattgtatttctatatggactctacactctacttctaatattccttatttttaattccgaatttcagttatttcctaatcgtatttatatatggactctatactctacttctaatattccttatttttaattctgaatttcagttatttcctaattgtatttctatacggactctatactctacttctaatattctttttttttaattccaaatttcagttatttcctaattgtatttctatatggaccctagtctcctcttctaatattccttattttttaattccgaatttcaactatttctaatttgtatttctatatggactctgtttttctttttctccgattaatgtgagaatttctagaccatgagagcgaacgtagaggcttctttttctatttctttaataatataatagatagatatactgacatagatctcttgtagagagcctatagataactattgcgggtgcgattttgctatatctcactcgaaagatttcttcttatctctcactcgattttctcactcaaatttacagtgtgttttcttgtaaattacagtgtaatttatgaaacttacaccgtaacttttgtaagttacggtgtaatttttgaatcttcgcatgtaagttttgaaatttatattggatttggtctttttcttgaagatatggtaatttagtgtccattatggtgtttcttagttgctttttgcattttaatgtgtccattggattttaatctatagattaaaaatctgtgtgatatgatcataaaaatctttcgaaagatgcataggtactcccttgcgggtgcccttagtagcacttgtcactaacgataggtcgtaaccaagcaagctaccgatggctaagattttaggtttattttctgctcgtgattgggacattgtacataccgatatctgaaagtgacgggttgtgcatggttgggactttgggagggaccttctcctcctcttcttcttcctcctgttttttaatatttgggccattgactctttccacatggatcaccaaccaccgagcgtgtaacaatgaataaactgatacctaccaccgggatattccgttgccgacgttgattatgtaaatttggtgaagaaaaaaccctgttgtgctggacatgcggctatatatcggaaagcactccctctgtcctaaatccggataatcttttgtctagattcgttgtactagaaaatatcatatttttttctaaatttagttttttttggaacggagagagtagtcttgtgggcaaagatccgtgtagatgcaatcttttctctgaaattttactgattggaatcaactcttaaaaataaactagtgggagtataaataatcggcggtaggcacttttgttaaggcaagacatgcactcgacatgtatcccttaatctaccgtcatttcagttctgtatgtgtgcaacatgcatgtgagcttttgcttgattaaggaatgtgcttgccaagtcaaatgaactggccactacttcacgctgattaagctaaaatctggtcaaaaggctcacggaaatgggactcgatccgaacgaactccaaagactttgctttcgcaggttctgtaactcttgctcccgtgtacacggtcaccggcctaacaattggtgaagtgtaacgtgccagaactctcttgccgtgagagtaatggtgggccaccaccgtgtctacaattcaatcatgttggccatgcatgtacctgtcagctggccctgttgcttgacagagtgacaagtgctcccaaacgcagataattccagtactttaatttgatctcgaaagccatgtttgaattgtcgctccaatcagtccatttgtctgattggtttagatcggatgacgagatcctttcacagattagcacgcatcatatgccttcgaaatggacacccaacatccaagttcagagcccaatttgcacactttggcctggtttagttttcaattttttctttaaactttaaacttttacaatacatcaaaacttttctacacacataaacttctaacttttccgttaaatcgttctaatttcaattaaacttctaattttagcatgaacttaaacacaccctttgttaaactgaggaagccgtcgagcagggcaccgggatctcgaggggagtagggctcactatgagcaaatgctaaagtaacggaccgtctaatatatgagtatcatatgtgatgcccccttgacaagaaaagactcgagttctttccagccttgcttgccatggcaggaaaggttattcagtggcgtagtcctaagcttcctgcggactagtatgtgctacacaataacactaagtgtattatatcacacaaagcgcacgctgaatggcacatgtacaagtcatgcatgaccatgacgatgaacggatttgtctaatcgtaattactgcttggttgctggtgaaattcagtcaaatatttgctgaaaattttaatttagttcagtttttaacttagatcggtttaccaagtggtttctcgatacatactgctaaatccccgacccctagcggtataactttcaaccaaattttgattgattttactgtttcaatttaaattcttgaaaaccatctaaatttttactcagagtctacttttgtcccaatcgaaacttcaaaatttcatggtgttcgatcggtttttgtcgaaaacgtagacccaaaggcatttgtcaacttgtgtcagatgaaggtggaacccataacggttttgctatttcacttgtgacatgtttttggactcttgtattttgattttttgtccataggatcttacattaagattcgtgtttgtatagatccaacttgtagttacactcttacaaaacacttatatttggttatagagcatttacactcagttacaatgcaccaaaattagatttcacaactgcatttgtttccagatttacgattttgacatatttatcctcttcttctatttaaagcactccatccattaaaaaaaaagctaacctcacaactagtataacgaatctggacacacatcctaatacaatgaatctaaaacctagatatactttatatacagattcgttgacacatcttactaagaggttgttttttttgggacagaaggagcagactgtatccattagttgaaaattttaactcccaacctatccaaaaatcaataggtaggtgatgttcatttatcctgaagataaagatgaagattatgttttttttgcaaaacgagatggtattaatatatgattgattaagttttaaatattataaatttgaaaaataaattaatatgatattttttgagcaacttttatatagaaagtttttacacgaaacacatcgtttaacagtttaaaaaacatgacatgaaaatcttaatattcatccagcttttattggagaaaataacaggaccgtagtcacgcacaaacagtctgcagctgcattgcaccgcgtggctgataagacgaagagaggagagccttgggcccctttcacctctttaaccccagccagcagcagaaccagtcgcgggggggcctcgcgggcgctttgaattgaactggccacggggcgagaactcggcgaaatccatccacaatcccgcacggcaaaacgcgcaaaaagaggggaaactgcaatgaaaaaggggccagcatgcgcgaacgcacagcccccggccgcgcccagatcccgctctgtcgccgtcgccgctggctgccacccttccccctcccctcct

SEQ ID NO: 6159 - DNA, 14195 bp, Oryza sativa
atcaggtattgtatatttactaggttgcccatttgcctggaatgtttgtatatgccgtcttgtgctcttgtgtggctgaaggtgcgaaacctctgcaaacctgtagatctcgaaattgagcatgatcccggtggtttgcttgatggaatgggtgctcaacagcaagcactacaccaccaaggttatatcggccgtggtcgtcgtggcggcgggtgttgggatttgcacggtcacggatgtggaggtcaatgccaagggattcatctgcgcttgcgtggctgtcttctgcacgtcgcttcaacagattgtgagtttttctccccccttaatcctgatactggacctgtgctgttatgcatttcaaattcccctttaggatgttaaaaatactagttatggatactgcaattgccaactactcaagcgtttttttgttaacactataggcttgatactcttttgaaactgaatcatgttgctgaggatgaaaaaaatcagtttttttttattgaacaatggtgtagcaatgtttttgtggtggcacttgtttttcaatcttctgttaatttacttaggacattctgttgtaacactattctgaattgcgatagcattcaaactaaagtgtggatgctagaaccttgccattgagtcctcagaatacagaaaactcagaaacagccaatctaaactgtagaatagtaatgctggccatagaattgtacatggaatgtttattttcgcatcataagctgtagatttgcaattctcacgagtcgtgatagactatttttatgtaccccttcagccttgatactttacattgtggaatttacatgctagctgtgaatcactttgaagatttacgaccaagctgaagcaacttttggactatttaccagtttctaaaacttggatcaggctgtggtccaactagggcaaccggggacggctccttttaggatactactagagatattttttgggggtgaaatggactataaattattttattagattgtccagctcaggatttgacttagaatacgacctgcaagctgcaatatccatcatgggaacatgtcaataggcaaaaaccaagctgggccatcacccctctattgctaggatgggactatgggaactaaagcctatataagtgttgaacaggatcatataactatgagttgagattggattcaacataactcaagtgataataactactatattattgaaccgtagacagacagtttgaagtggcagtcggacctgtgaactggactgcaagtggttcaccggccagcttttaaaaactatgcctatgatgtttatattcctgtaatcttattgcattggacagtgataaatatttatggctcttcgtacggtaataattttgatacataagttggtttttgaaatttgtggaagatgattacttaaatctgaatgctgatggatccttctttgtaaattatatgctgagttctgacaatgcgttacttgtccttgtcccagacaattggctcctttcagaagaagtacaacatagggtcatttgaacttctcagcaaaactgcaccaatacaggctgtgtctcttattatacttggtccctttgctgactattacctcaatgggcgatggttattaaactacaacttctcaactggggcaactgtaagttctctcgcatgtgcatgtcacaattttctattcatgacagcactctttccaaatgaatgatacctttgccatgttattgtatcttctactctagatttgtgctagtactattgagtattttattggaatgtttcatcaatgatttctcccattcttcatgttgagtggacatccccgcatcagtacaccactagtaaattgtcaactttgtttcccattgaaatattatttgttttgcctaatgttcatcccaagaaaattgttgaacgattagtttctattctatgactacagcacggtgaaactggaatttactgctaaccaaacagaacagttcctatcatgcagttttcgtgctgtggtctgttttaatcattatgcacttctccttgttgctttaatactcctactgggaattcttaaaacatgttctaacaacttgctatgttaataactctgcagttcttcatattgctttcttgctccttggctgtcttctgcaacatgagccagtacctctgcatcggccggttctctgcaacttcgttccaggtcctgggccacatgaagaccgtgtgcgtgctgattcttggctggatcctgttcgactcggccctcaccgtgaagaacatcctcgggatgctgctcgccgtgatgggcatggtggtctacagctgggccgtggagaccgagaagaaggcctccgccccaatcccccggaacaagagcgacatgctggacgactccgaggacgttcccctcaaggccagggtgagcggcctcccctcgtccgacctcgaggaaggcgagatgaagagctagctaatgacatattatttattcattcttcttgttcctttcttttttgtacgtgttcaaatccatatattgcccccattctgggggaagttcttgaagctatcggcacttgtgttaattttgcctcctcccttgttcctggggttcatagatgatgatgatgctgatgaaccccagccggtctcgacgtagatgaccattttagaagccatgttcttgatggcgtgttgttattatagatgacaagacttataatggaatacaggtgtttatccgttgtaggatgattctgttgaagctgtcgatattttttttcttcttttttgcttgaggtttggctacctgtctgcttgtgctgccatggtggtggtatctttcgccatgagtgctatgcgcatcggcatcgtgcattttgtcggggttgcctgcctcacatgggagatggtgggattggacagtggcacgtggcgaaggccggcaacgaggatgtcgacggcggccggctgccggcccagcgaggaaaagccacggccaatgacgggaatactaccttcttgtctttctctgcatgtgacgtgtgaatagttttgaactttagatgtttttattatactctcggttttggtagttctttgtccaatcaactttgtagatataattggagaatattcgtaatttgatgggtaatgggttctgtggagttcgattcagttggcttcttgtaaagtataatccgcctttgggagtttgggcgtgacaagtggcgtaatcatcaaccttaaaacgtgtaaatgagtcatgtgtcatgctatacatagggttcaacctctatgagggtaggataaatttcaagtcgagttgcctaattttccagtcagggtactgggtaaccccaccttcataaacaccatgataaaaaggagtactaatcacaagaatgcacaatcacacaccagtccatgcacgctttgcactggacgatatcaccacatacatgtccccctcttttgtttgccatcaactttgtccaaactgccaccatatgcattggaaaatcccttgcctatccggttagtcttgtagactccaatcacctggctgtcttgacacggaactcggatcaagctgctgattccgaacataattaacttattttagcgaaaagtacaaaaaattaattatgtttcacaatacaattgaaatatatatacactctccgtaaaaaaaaaaaaaactagaagtgaatgtgatatgttcggatttattgtactaggatatgtcacatacagctgtaggtttgtattttttttttacggagagagtatgtttgattgaaaataatgttaatcatcatcctattgaaaataacaaaatggaaagaacttctccaatttgtttatttctaaaggaagaccccctttttgtcagcttccttccttacccttgaatgttctcatcaactgctcctacagttctactgctattatactgctaccagtacattcttgacagtctttccacccttttgcctgcatgtgttttgaaattcttcatttcttcccgggcccgtggtctgtgaagtcaaattggatcgtttagtttatctgttttacttatcattcacctgatctcctaaacactagttggtccacgcatgtatccctttaacttgcacagtcgcggcacatgatctacccactgggacttccaaatgcacacacatacatgtgctttgaaaacgaataggcgaataactaactctccacgaccacgtctaccagtacgtactacttgatgtttttttttgctttatttatttttcctcgtgtgtgataggatattgagcaatctcatcgtcggtactttgcagaaataacaaggcaatatatatatacacgccgtgtcgtacccaattgctgccgaataaaatcgttggcaatatcataaatcgatagtactcgaaaatgtgtgatgtgtggttggtggcttggtgctaccgtgctaggatgatgccaagaagtacggttttctttttttggaaatctattgttctatctgacaaatcggattaaatcaagataaattatttttccgacaattatcgcatcccacgaaatttcaactattactattttacaaataacattgcaaagtgtagcacccttacattatttcttcggtataagaagttttggccctcgatatttttttgtctttctcttagctctagttaatatatatatatatatatatattttgtcttgagtggtttggggttttgtgctattgggccacaccattaacttttttttttacatataacatcaatgatactccaaatcatttgaaattcttttcattaaggttttgtgccacgccattaagctttttttatatacatatagtcaatgttagcttatctgaaattcttttgaagtgtatcaaattataccatcatttgcaccaagtaggtataatgcgacatcaacaaaaagcaccattaaaaccatccatcatccatgcgtcaaacatggtttgatggtttaaatatctcacgggtattcaaaagtttcttaaacaatgttaccatacactatgcaaaattgcaaatgaaaccaaactatatagatttcaaccatctaaattaagctggccactcgtatactcccttcgtcgtaaaacaaaccaatagatatgatatattataatactatacagatttgtggggttagatttaataagtctcagcacagcaactgaactttcatcctttcgttcctacagttcgtcagttcgtcacttgtcgccgagggagactggaatgcaaatcaaacgcacacgccttgcacgacgcactcatgcgcacctgctccccctataaatcgagcacaaaaagcctgtctctcctccccacaggtagtggaacggagccaccgcccaactcgcccccaaagttgcccatctagataagaagaagcgtcgcaactcacggtcgcagtgccacgccccacttcatatcctttcccttccccaactgaaccaaaaaaaccaccggggaaaacttcttccttcttcttcccctttgaagccatgggtggctttcccccggttggcggcttccgggttcggattttcccttttattcccgccggcgggaaggctgggacagcaggggcggcggcggcgtcgtacgcgcagcaccggcggaggttctgcgccatcgtggcgaccgcggcggcgtcaccggtgccggccgcggcggcggcggcggcgacggggtttgattttaacgcgtatatgggtgagaaggctgcggcggtgaaccgggcgctggacgcgtcgatcccggcggacgagccgcccgcggcgctccacgaggcgatgcggtacgcgctgctggcgggcgggaagcgggtgcggcccgcgctgtgcctggcggcgtgcgcggtggtcggggggcgggaggcctgggcgatgcccgccgccgccgccgtcgagatggtgcacaccatgtcgctcgtccacgacgacctcccctgcatggacgacgacgacctccgccgcgggaagcccacctgccacgtcgtctacggggagcccatcgccgtgctcaccggcgacgcgctgctctccctctccttccaccacatggccaggttcgactcctaccctccggacatcgacgctgacaagcaccccgcccgcgtcgtccgcgccattggcgagctcgcgcgctgcataggctccgagggcctagtcgccggccaggtcatcaactcgtcattttctattcgattccttattcgagctaattaagaaaatacaaattaagcaatgcactaattatgtggatcatactctttcctaattgctatgttttgtattgctatctgcatacgttttaattagatgttgttaagcaatgcactaattatgtgaatcatactccttcctaattgcgatgttttgcattattatctgcatcgttttgactagatgttgtaaatactcttaaaatagaatgtgacttcgagttgtgtcgttgctgaaaattgtttgttaaattttggataggttgttgatcttgagatgactggatcgaccgaaactgtacctcttgaacgtcttgagtacatccatctccacaaaactgctgcattgcttgaggcatcagtggttattggggcaatcttgggaggtggctctgatgagcagattgaaagtttgcgcatgtatgcgagatcgataggattgttgttccaggttgttgatgatatacttgatgtgaccaagtcttctgaggagctcggcaagacagcagggaaggacttggcgagtgacaagacgacatacccgaaattacttgggctggagaaatcacgggagtttgcagaaaagttgctttctgatgcaagggaacaactttcaggatttgatcaagagaccgcagcaccacttctgcacctggccaattatattgcctatcggcagaactgaggtgatgggtactccattgattattgttgatttgtaactttgtaagctcattaagattcagatttgaggaatatctgaattatcttgtgatacgtgctagttgtagtttcttatcttgagaagaatatctggttgacaaatgtcaatttcctagttagtcagtcaaaacggaataatgaaaatcagcctctctgccctataccccaattgcttgattcttgacaattgaacacatcatatcataaaggaagaaaatattttatcttcattgttttgattgattatcatagttcatgttcatacctgttttagtgtttatcctacgcaattgatttcgttttatgtgattgtatcaggttcgttttacaatgagtgtcaatgtaagctttgattcagggatgagcttgtcttggaaattgttctgttgaacatgtgtttcagtgatgttcttctgtttacagcaattgggatcaatgtttctctaacagctatatatatgtatattcttggttccaagcatgcagaaaacttcaatcagagaaagtgtttagttacagtgccgtagtaaataaatcggttataattgattcctgtctataggtgtgcattcagtcttttggtcaattcgctttgtagcaaaattcagttagtcaaaactcaggaatgaattgttattgggaaaaggcaagaccgaaattcggttaatcctgtctattgctcaaaaacctatacaagcctttcatagtgaatgtagcccctgcataaggtttcctgtacaggtacagtaggaccttgactaaatgtttttcattggaataatggaatggttataagctgcacctttcttgttcttttctagcttcttgcgcaaacttattgctctatcttcttgtctttgatctcattgttttactgaaagtactgggattcaggtgatatggaaagcacaaatgggactaaatttggttccccggtccagtttggctgtccatatgtggttttagtttccaagttgtttgaactgaaaagagtagtctgaaaaatttccccatcatgcatagaagttgagctgcaagtcaaatggtcactggtcagtttgagcgtggtattctttttcctaccatgtgctgtggtggtcttctggtcactttgccagtgaccgctgtaatttgtaattttgtatcatgagctccttggcatcccagtccgagttcgctttcaagactttccagtatctttggtcggaagaagaaaacaaaatcatttgttctgacgtttcctagtactgtcttctgaatttagtaacctgatggatggaaaaatatgaataatgtgttttgacgtcgaaacatgagtcctcggcaccccaagactgaatttgcttcaagaattttagcatctcgttggaacgaaaaacgaatcatgtgtttttgacatttcctaattgctgttcttctaatttcgtaacttgatggatggacaatacgaaccatgtgttttgacatttcgtaatgctgtttcgtggaaagggcatcgtgactagacaacatcttgggagagaagtagggagtagaagcaggcaattaacacttgattgaacgttcttaatagttgacaccttgatactaagtctgaaagtctcctcagttgccctaataaatcaaagtaaaagcaaaaatttaaattcaaaattgattttaagatatttttaacataattatttttagtgctgaattttaagttgctacgaaaattatataaaaattttaccaataaatccatcatgaaacttgttcgatgtccgtatcccgaactctgtaccttaaactatttcatactctggtcgtttggtgaagttgacctactgcagcagcagcagcaccaccatttacggtgaacatactactcctacaaaagaaaactaagaagttttaggctgcttttccacccccccccctaactttcccaatttctactcacttattttctaggatatttaactttttatcattttaagatgcggcaattaaaaatttgccactcgcagtaaatgccatgttggtccagtggcaagtccttaattgtcacttgtaacagtgacaaatagttaatattcccttattttccacgggcatgctccacaaagtgttaaacggtgcatttcttttaaaaaaattgctatataaaagatgttgtaaaaaaatcatattaatttattttcaattttttaagctaatagttaattaatcattttcgtgcgaagagaaaaacttcctgcattttttctccactttcttaacttctccttcatcgtttttcacgcacacgcttttccaattgctaaactgtttcttttaaaaaaatccattggaaatttgtataaaaaattaacatataggcaaattttgctgtatgacactgtggctttatggttttaggtttaggacatgacaaaattcgatctttggggaagacattattaaaatatgattatttgctgcaagacgccgcatgtattaatatattattttttggttgaataggagagataaatagcgtgaaaagtcaaaaatgcccctaaccctacttgttatatactttctcttcctcttcctcttcctccttatttccccttcctgacatcgctgcacgggcacatcactagggacatccaagttaaaatccattaaaaggaaaacctttgaaagtctaatatttcgaagaacaaatacatggaaatctagaagaggaaaaaataacgaagcactaatctcatttaggccccaaataaacgttggatttaaagtttatatgctaaattatagtggtttaacattttatattatatctaaaataaaagcaaaatgattcatccaaatgttattaaagcaatgacacatccagatctatagatttgtgacactagaaatatccaacttcaaaataaatcctaaatcgaagttgtgacaaataggtttaccgtatctatggccatcaaggaacaaacagggtgatgagcagcactaccatcgactcggatgattggggcctgggggtactggactacatcctccctcttaccagatgaactctttccaataatgtgattgccggtgttgtatctatatccggaggctcgtgtcagatcaaagtaacctaatgctcaacatcataaaaaagaaattaaaatagtactaaaagcctttataaaacatgtggttttagaagaccatacgcggactaattggtggatgcatgaaccgacgtgtcgattttcaagtatgtataaaatcaaatggcccaactcaaaagacggcggccagaggtgcgggcggcgcgacggccttcgtggatggcggcggcggcgcatcctggcgagggcggccgggatccggcctccctaggccagatctagccgggaagctgccgggctagcggcggctgcggctggaggtggcgcagcgcggaggctgcggcgcgtcagctgcggctgcacggcgtcggcatcggcggcgctggaggtggtgcgacgtccgggcagctggacgacagcggtggtgccggtgccggatgcggtgcggtggccgcgctgctggacaccggtgccggaggcggcgaggcggccgggcggctggaggcatgaccggcgatgctgggcggcccgggtggccattggtgggcggcgaggtggcggcggagcggtggcttcggcgaggccgccattaaacctggcggcagggtagatcgcgctggcggcgaggtcgtcttccttgtgggtggctaggcgttcactgtgtttggggagctcctccccttcttcgtggggagcttttaggcacggtggaggcgttggccggcatacagggaagactcagtttgccaaagcgagcttgttcccgttccggtcccataggtcggattcgacatggaggccgacggacggcgtggcggaggtggcctgggtcagcgtgcaagggagtggaggcagggtaagggcgctggcggcggggtcgtcttccttgtggtcggccaggctaatcctgtttggggaactcctccccttctctgtggggagcttctttgcaggctggaggcggtggtcagtctacaaggaaaactcaggttgccgaggcaatgttgttccttgtctggactcccttgggccgcattcgacggggatgccggcgtgcagcgtggcggaggcggcctgggtcagcgcgctggcgaaggtgggtgctgtggcagtcttgtcattggcaggacgggaagccggccggcggaggggcgtcggtcgggtgtggcggaagccatgtgccgccgatgtttagttggtggtttcggatttggcgacggaccatggcggtaaggggttccgagcgaaagcttagcccaatttctttgggccaataatgacttcgctttcgggcgtggtaaccctcctgagggcattgttgaggtaccccttatccctcgacagggagctctgggtgaaaaccttgtcccgtttttgggacggatgacgacggagtttttggcgtcgcaaccctcgtgagggcgtcattttagagtcttcgcgttgtggtggtgttattggcccggtggcgatcggtctcgcatagcgacggccggttcggtgctcggcttccctctctgtagcgtgtgtttgggcggttggcacacgttcggggtgtgtgctctggtgcacttccttcctcgacagccaactctgtaaccttttcttccaatcttaattacattgaatgacctcctttggtcattccggcaaaaaaaaagatggtatttacttagcctcggcagcctacaaaatgttctttgaagtcatgttttcgtaagctgttttggaaggcaagagttctaggaaagtgtaaactttttatgtggttggtgagttagggaaggtgcatgcttgatggcagataatctgcagtggcgcggctggcctcaccaggccctgtgttcgttgtgccaaacggacaccgaaacctgcaatagtgcaatgtcatgggctttgagctgggagtcctaggctcaatgggaacgatatccccatccccgacgataagtacttagtggatagagttagatcactgttaggatcagattaaggagtttgttaggattaggttaaggagtcctccatcaatataaggagggatcatatcctagatcagttaggtattaaggggttgtttggtttgcaactaaatttaccacatctaaccttaggcaagccatacttttagttgatagtgtttggttcctaccacaactttatattgcctaactcttagccacctaatccacatgtcataaactctattttcttgcctaattttgtctaagcttagtttgtcattcatcttcatattgtttgtcacaaaagtgtggcaagactattagtcaccttagtaaaaaaagaatgtgtgataatattagtccccaaccaaacatactctaaatcaagatttatcttagtgtccattgaccctgccttctcggtgcgacggagagcatcgcgctgtctaggttatctgtttctttctctattataatccaatctattcccttcaccccgtctcatcctaaataatcccagcacgtgacaacatggtactaggtcgctgtgccttctcgttgcaaatttggttgagaatctgccaacggataggaacggtgatgttttcacaggagatggtctcttttgctgggtgatacgaagtccggaagaaggttcacaaagaacagagaaaactgcttgactcgatggtgatcctcgtcgcatgggagatttagaaagagcgaaatgccagggtactcattcgtatttggaaaagagttcaatacgtggaaattagctggcttaatccggtcttgaatgtatagcattagtagttaactgttctcactactaggaccggctactcctggtgatcagcttgtatatattttgttgttcgtagcacctattttgtgatgtacccttctctccttccgccgttctggcgaaaagagaaggtaacacaccatttattttcagaagttgtccatactcctttgcgaactggagcaactttatgtaatccttggaaataatatgcccactagaaaaatgttgtaccaaaaggtacgatgactgaatcacgccattcctgttcgttcctaagaaccaatatactacgacattgacaggagctccatttcatatacaacacagaaacctcaaatgagtgttatagtcaagcgatcaggtaatacgttgaattttgctgatagacgacttctgaagtttggtatataatggagagccacaggagatcacagcacatcagtatccagctttctgtttaattatatcaggtgctatctctgaagatcttttcgcctttttttttttatctttcgagtcactaagtcaagtttggtgggcggctttcttgcttgttatcctgatctgagcacatttcatcaattcatctgtgtgtctgaaagtctgaatgtctgattcgattctggagatacactgcgcagggagcaccggcgggatgcccttcaagacgggtccaacaagcacatgcgcacatgccggctgatttgccgatcaactcctggacttcgaaccgtactgccatcgaatattgttcatagccactgaccacttcagttcttcgctaagtcaaatgccagcaagtccaatcctggtcgtaggataagagaaaatgatggaactccagctctgctgttcatgttacttcacttaacgttcgctcaggaagatgaaacagcgaatcgtatgtgtttctcctgtccgttcgctcaggctttgtggacgcagatcaacgttcaaccgcaagctcaagacgtcacgcagttccatcgtttgggtccaactacgcaagttccggcgctacactggcaggtcttcttcctgctttgcatgtgggctatttggaatcatcgacacgatgttgttttccgggggaaaagcccctcactaagagcctgcctacaacgatgcatcaccgaggcagctctctgggcagagaacttaacggaagatgatcgatttgtaatctctgttgggaaacaaatcttctcctccccattacaatctatcaatcttttgtaatgaacttcgtacctctaattgcaatgacaaattcaggtgggga

SEQ ID NO: 6160 - DNA, 9002 bp, Oryza sativa
  unsure (1)..(9002): unsure at all n locations
tcccccccccccccccccctatttagtcaaaaaaaaaaaaacttcacttaacagatctgagacaagacaagtgactcattgcagaatcgttgcaattctcacacaaaggtttgcagggaaaaaaaataaaattctaggttttaaggtaagttgattggggttgcaaaattctaggttttaaggtaagttgactcgttttaattttcctttctatgtttggcagcaatggcggctgccaaggtggtcgccaacttgcagattcttggcttgtgtttgctccatctctgcctcgccgcgtccgccgccgcgtactatccggacatgttgctggagacgtcgttcatcccacgcgactacgcccgctacgccgacgagctgtcgccgttcgatcccgtcggcgccggcgtgctggctcgcgatctgtccttcgccaatggcgactggggccaggacgccggccgcgcgccgctgatgccgtcgcaaggtggcgactcgccgttcctccgcctcgcgaccttcgccgtcacgcacatcgacaccgacgcgttgcggcggcggcggcccgcgatgtccgccgtcaacgtcagcggggtgctcagcttcacaatcacccgcaactgctgctgctcgtcggagtatgcggtgccgcaccggcaagtgtcgccggagttcaagctccttcccggcgcttcgaggctcactatactgttcgagggcgtgtacaccgagacgaggtcgccgggtaacgacgacgacatcggcggcggcgagagggtgctgtgcatggtcgggaacggtgttctccccatgcgcggcggcgacagcgcggacccgtgggcctgggcgaggaatgccggcgacggcagcttcgaaccgccggtcatggccgacggcaacatggtgctcatgctacggtacccgaaggtgcacacgttaacgacccgagcggtgcgtggcgagctgacgagcacgagcgccgcctcgcacaatgcttacttcgacgcagtccggctggtgtcgcggattggccagtactccagctacctgttccggccagaacacggcgagctcgcggccaacgggtgcagcaccagcacgacgcgtcccttcgtctgtgacgacggcgtcgagggcaactgcgccggcgacctgcacggaggcgcctcgttctgtgacatcctcaccgagttatctcccggtgaccatggcgtgctcgccgtcgtcccaaactggaactgcaactccaccgacgagttctgcagccagctagggccgttccagactggcggcggagccacgaacacgacggacaggatgctcaccggcttcgccatcgcgatgcaggacctccggtgcgagccgcacggcggcgagaagccggccgcgagggtgtcggccgtgttccgtgccgtgtcgccgtgggaggaccagcagctggcggtgaggcggaccggtctgggcggcgcgacgctgtcggcggagggcgtgtggagggcgtcgacggggcagctctgcatgacggggtgcctcggcgtcatcgacgccgccgccgtcggcgacgaggcgtgccactaccgcgtctcgctccacgtcccgacgacgttctcgatccgccgccgcagcatcatcgtgggacagatcaccgccggcgacggcagccacttcccgctctcgttccaccagagcgtgcctcccaaacatccatggaaccggttcggccgctccgaggcgtcgctgcgcgtggcgtacgactacacgaaggtcgagaacgccggcgagctcctccggaggagcgagccgtccggattccggagcagctccattgcaaaagcactagtaagctatccaaggaaagccggcgccgccgccgccgccgccgatgagatgatgagtctctccgacctcgccgacgacctgagcctccacttccaacccggtccaaggctgccgttcttgccggagcagaaagtgtggccgcaatggccggcgttacacctcgatatgctctctgtcgggccgctcgtcggaagctactcgccgccgttgcggacattgcctagtacgacggtggcacgggctgagattgacggcggcgtggagcaacagcagcatcagcttctgaacgtgtccgccgtgttgagcttgtccgggaagatgttcggctggagtccggtgatgtcgctggagggcgtgtacaaccaggaggacggccgaatgtacctgatcggctgccggaacgtcgaggcgccatggcgaatcgtgtcgacgagcagagacctcgaagacggcatggactgttcgatcgaggttagggtggagtaccgccgaagacgacgcggtggctgttcagcccgacggcgacggcgtgcatctccagcacgagggacgccggcgacccgctgcatttcaacacgaccgagctgcgcacgacgccgatctcttaccgcggcgggcgccgcgacgcgccgccggacacactcacggagcagaccatcgaggggctcgtctgcatcgccatgctgtcgggcaccatcgccgccgccgtcggccagctgcgctacatcgcgtcccacccggacgtcgcgccgtacgtctccctcgtcgcgctcggcgtccaggccgtcggctacaccgcgacgctggtcaccgacgccaagatgctcccggcgtggccgacgtacaactaccggatgtacgtaggccacctccactggaacatggactccaccgtgaaggccctcaccctcgccgcgctcctcctcacgctgcgcctcgcgcagaaggtgcggcggtcgagggcccgggcgcgcgcgcggtcgccggccgagccggggcgcgtcccgagcgacggcgccgtgctcctgcgcagctccggcgtctaccttgccggcctcgtcttcgtcctcgccgtccatgccgtggccacgcacaccagctcgacgtcgaagcaggaggtgttcttcgttgaacagaaggcggcagcggcgtcgcacgcgccgccgtcgtgcatgcgcacgaggggcgccgtcgtggagcgctacgtcggcctcgtgaaggagtggttcctgctgccgcaggtgatcggcaacgccgtgtggcgcgtcaactgcaagcccctcaggaacgcgtactacggcggcgtcaccgccgtgtggatgctgccacacgtctaccgctatctccggccgccggaggtgtacatctaccggcccgaggtgcaggacgacgccatggccttctacgagaaggccaccgacgtggtggtgccggtcgttgctgtggcgctcgccttgttgatctacgtgcagcaacgctggaactacaagattgttggttggtcgttgctgagaacggaagcacgtctactgatcatgacaagaacagtggtctttgtcgctgtagattgttttaagaatcgtctagaagtaaaataattagtgactgttttttttttatcgggaatgctaggggacgggataccgttctccaacgggatagctcctctccacacgcgattcttatccatacactcacttgccgccgtcgccgtcccccaccgctgccgcgcccgtccccgtcgcctcctccgccgccgccgtgctcgtccgccgccgccgccacgcccgtcccccgtcgacgccgtcgctgtcccccgccgccgctgcggcgtccgtcccccgtcgccgccgccgtcgccgccgcgcccatcccccaccaccgtcgcgcccgtcctatgccgccgccgtcgccgtcgccgtcctcggggtgctcctcccccaacaggatgtccaactatatctagtaggaatcacctgatacctggtaggtatcatccaatacctcgcaagtatcatgtgatacatggtagaaatcatccgatacctcgcgagtatcacgtgatacgtggtaaaaatcatctgatacatgacaggtatcgcatgatacctcgtgagtatcacgcgatacgtggttgaaatcatctaatacttgacaggtttcacatgataccttgcgagtatcacgtgatacatggtagaaaatcgcatgatacctgataagtatcacatgatacttgcaggtatcacctgaaacgtgtgtagaatcgtctgatacctgataggtattacacttgatacctacttgggatcatcctgttatgtagaatcgtctgatacttgataggtatcacacctgatacctactcgggatcatcccgttcgaaaacgggataccgttatatagcagcccctttttttagaagagaattagtgactgttaacgacccaaattatgtccagatttatgcagctatagtaaccttaactttgtctccttcccacccctcacaataagccttcgtcacccttgacttgctagcgccggcaagatcacaatgtcggcctccgtccttccccctccctctccctctcccaactccttcctaacctggctgtgttcggtactaggagttgggaaccatctcctccgcacgaaaaacgaagcagtccattagcgcacgattaattaagtattagcttttttaaaaaaatagattaatttaattttttaaagtaactttcgtatataattttttaaagtaactttcgtatataattttttttaaaaaaagtaccgtttaaccgttcgaaaaacatatgcgtagaagacgattgagagggattgggaacctggtgaatcgaatgcagcctcaagcagcagtgtcaaggtgtcccttccccgctatcttcccatcttcgggcggctctcgccactagagatgccactaccaccatcacctactatattataaccatatactctgacttctgtgccaatacccaccgctctcgtctaacccaacggctctggtagggcaacgcgctctgtatttgtagtattatattacttgggggcctctgcaactctcgttccactttgattctgtctttactccaatcaatttttttttggagtgcgtatcgcgtggttgagtctttaacggccctgtttagatgggactaaaaacttttaagtccctatcacatcggatatttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaattagtctatatttaatactctaaattagtgtctaaagacagggacttaagtctgagagatcccctcataatttccccaaaacgtaaccatgtgtgaatagattttgagtaagcagggttgcagccacgagtgagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcaggacttaagttaagtccctggatgtaaacaccacctaaatattggctagagacgatcgtgcagcatgtggtcagagattgatcataactatcttcaatctcggcttaaagattcggagaagatcatatcagtagctcttctcgtttccaaggataacatgctgcagcctggagaagtcataagacagcttcaatctttcttggtgaaagatttggagcagattatgtcaatgttcatttgtaaggtgtccaattatccattgttattttcatctctcataaaccccaaaaaaaaacatcttgctgttgcagcaacaagatctccggagccgtcgatatgggcacaaatttgctgtttcttccagagttcttgctgtatacgtgcatgatggcatcatcatgttttgcttaccagttcaacccaagcgaggaagcagagcacagctatcttcgctttgccgatgtcaagcggcaatgccggtccgtgctcacctcggcgtccgagctcgccgataacgcgtaccgggtcaaacgcgtgaagcgtgagctatccttcgagaagggcgactggcgccaggacgccggcacggatccgctggtgccattcgacggcggcgacgcggcggaggatggccgccggccgccgctggacccgctccgtctcgccacgttcgtggtcacgcatgtcgacgacgatgacgagcgccgtgcgcgcaatgctgtcaacgtcagtggcctcctcgtcctcacgatctcccggacgagcgcttcaccggagatcgggtaccacgtgccggtcgtgtcctcgccggtgttcgagcttttgcccggcagcaccaagctcaggattgtgtttgaaggcgtgtacacggaggcagcgaggtccggcaatggcggcggcgagagggtgttgtgcatggtcggggccggcgttctcccaacgcgcggcgccgacggtgccgatccgtggggctgggccaagaactccggccgtgctggcttccagccgccggtcgccaccgacgagagcatgctgctcgtgctacgttacccgaaggagcttacactgacgacccgagcggtggtcggcgagatgaggagcacgcgcgccatgtcggacgccgcctacttcgacacggtgaagctcgtgtccgggcccacctggaaccgccagtacgagttccggcgccccgaggagcttgctgcggccgccgggacgtgcaggccgctcacctcgagcgacgacggcggcaaccgcgcgagggatctgtacaagggcaggcatctgtgcgacgtcctggaacgctacatccatggcgtgatcaccgcgcgcccaacctggcgccactgcaactcgacggcgacgggcgcgccgtgcccgttcgagatggaccgcgcagaggacgccgccatcgtcggcatcgtactgcacgacctccggtgcctggggtacgacctcgacatggccggcaaccccgggggcgtgaaggtgtccgtcgtgttccgcgccctgtctccacgggagcactggtacacggcggtgcagcgcacggcgctgagcggggcgacgctgtcggccgagggcgtgtggaacgcgtcggcaggggaggtgtccatggtggcatgccgcggcatcggcggcaaggcgtgccacttccgggtgtgcctgtccttcccggcgacgttctccatcaccggccgcgacatgatgctcggagagataaccaccgtcgacgtcaacgaaaccggcggcggcgcacgctcctcgctgtcgttccggcagcgcatgcctccgccacggctgcagagatgcgtctccggtatactgccagtggtatacaggtacaactacacgaaggtcaagctcgccggcgagtttctccggaggaactcgtcgccgtccgacttgagggagatcattgcgaggtctctacccttgagctatccaaactgcggcggcaatggcgatggcaagagaagcctggccgacctcgccgacaggctcacgctccggtttacggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 6161 - DNA, 1061 bp, Oryza sativa
tgtaaaactatatttatacatgtaagtatatttaacaatgaatcaaatgatagaaaaagaattaataattacttaaattttttaaacaagacgaacgatcaaacatatttaaaaaaaagtcaacggcgtcgataacaaaatcggtagtgatgattcaacttaaggcggcaagtactgtaccttttcatttctttcacgttacgactagtagccatcaaaccaatacgtttggaaaatatatagtgaaaatccatgtattactacataaccattattactgcataattactagaggtaagtataggtataaaatacatttacaccaaatcttaagtttatactcagcttcatttgatagggaaaaaaagataaattttaggtgaatagtgtcctactactattgatctgatctttttttaactccctaataaaattgagttcgaacttgagattggtgagaatatatttcatgcctacacctatccctagttattttttgcatgaatttataaaacttttaggtccaattttaatgggttttcatttatttgatggttttcaccggatatgctccgatgtaggtatttgtgcgcaaattatttagatcagtgaattcttgtaccctagattgggttcaaaccctagatgaattcttgtaccagtgtgttggtgatatgtcctagagacaattaaagagatgattatatcacatactatgtttatatatttatcatacgttgtttcttgaaatagataactcattattgattaataaatatgtgagtccttcaagagacttttatgttgtatgttgttatttataaatgatccctgatgaaatatcatatgtgtaacaaatatggtttaatgattagtacatatattgattgatgatcatgcctcatagatcgtggtattaataatgtagacatatgttggggagcatgttgctggataaactcaatatgaggcacatcaagaactatatgtgatgtgccatcagtgatctcatttagtgttagttagaaacatcagaccgagattatcatagttcccaacat

SEQ ID NO: 6162 - DNA, 4172 bp, Oryza sativa
  unsure (1)..(4172): unsure at all n locations
ccttaacgggcccaccggttattgtcgacccaattgacctttaggtttgatgggccagaatagcttctttggccctcccggggccaaacctgctacggcgaagtcgtccccctttggcatatgctcttcgccttgagtccttcgcccatgaggcctctagcttggctgcgattccctgcctctcgccgtccttgctccatagtcttcgccaggggggggggggttcgccttgactaaccctgacgtctcgggcttgaatccccatcggtcgcatgctttcggcaggtttggtcgaagggcctcatgccatatcgccaacaagcccctcacgggcaagggtgagataggagcttcggccgagaccgtgcaaaccatgtggtatggtatgtggcgccccctttcgaccggtgctcctgtcgaaacctatattgttcctacaagtaaagtttgtttgtttctacgtttacaaaaaatttctttcagaaaaatctcctcttcacgttcgttgcaaagcgtcgatgggggcttatttagtctcttttattactatgaatagtaataggccctttgggtttttccttctccgtaatcgggctttttactgttcagcaccgtcccgatgggaatttaccgtttcgtctgccctttgacacgtgtcagagctcgattggttggcaggcgaacggtctcactacagggttatatatgcccccaaaccggcctgccatttttcactctccccgtgctcttcccctttttaccgctttacacgctccgtgctctcttcgctctcctgttttttagctttttcgccatcgtcgtgctcctagcctttcggctttttacctctctttcctatgctacaagcctaatggctccccgcaagcctaccaaggccgggtcaactggcgaagatcctggaagccttggcgaaggatggtcgtgcttccttggcaaatctcttgtcaaagaggccgacttgggcgaactggtatcatccggtcttctcatagagggccaaggatcgtgtgggggcaaggctgttgttccctcgcctggggatgggcgaccggttgtcttcgccgcatacttcgctgctgggcttcgcctcccatgcgacaacttcttgccttcggtgctttcgatgtatgacgttaggcttccccaacttagcccgtcagcgttcccgaagatggcggttttcgcttggatgtgccggacctgtgggttcgcccctaccgccaagctattcgccgctctgattactgcatgcgcctcgaccaaagacgtgcaaacgccggcgggtccgaggaaaaccgttttcggctgcgtgaacttcatgctgcggccggagcgttcagatgcttggccagtgcctgcatcgatggcgaaatgggacaggaactggatgcagaaatggttctatatcagcaacccctactccaccgaaaatactcaggcaaactggctgctttttgagcgttctgccgtctgcatcaacgcgaagccaaacgtggagatcgacgggactcttgagtcccgactcattctccttcgcaaggttgcccggcggctgagcacccgggatctttgcgaggagttttgtctccttcggatttccctctcgcccgtgtgtgggacgtttctgtgaacgagggcgaagaagttcttgggcttccccgccttgttctccccgccggggtcgaaagtaaggtttttgttttcgacttaggccgcatacttccttcgtggaagcgcttttttggctaaacggttgtgttcctctcttttcgcagtgcggactttggaagacgctgagattgaggcgtcgaagatgatcggagctctaaccacagccgagttcgcccgcttgctccagcgccatgttgacggccgagtgaaccgtgtctataccggcaaattgccaagccgatcgaacccctctcgggccggcgatgacgaggctggcactttgaaaaaacgcaaacgtgcggtcgcgaaaggcggccaagtccgaactcgccgtagcgcgaaggccgccgtcgaaagtgatggggaggaggaagaggaggatgcggaggccggttctgaggaggatggctctcatggttatacccccagccctacccctgcgaaatccggggcaggctctcatgtttcgcctacgcgactgcaagatatcgtcgtagcgaacaccctcttggcgatctccagcacagccgcgaaaccggtgattaggtttaggtaaaagttcgactgttatgccggtgaagcacttttccatagaccgaacggcctccaaatacctcttcatcccttcttcttttgcctcaaaggacttgtcgatatggcccgccaccagcttagagtcggttcggattagcaggcgccgaatccccattgctttcgcctttcttaggcccagaagaatggcttcgtattctgttgcgttgttggttatgtcgaactgcagccttgtggcatactgaatcggcacaccacttggcgaagtagtactgccgcaatgcccgccccgttgtgcgaccacgaaccgtcngaatgcatcacccagggctgttcgacgggttcgggctcgggggccagtgccggtgtccattcggccacaaagtcagctagcacttgggacttgacagcagttcgggcaacaaaatgtaagtcgaaaggggatagctctgctgcccacttgctaagccggccagtaacttctttgccccggagtatttcgcccaaagggtactgcgatggcactatgactttgtgggcctgaaagtaatgcttaagcttgcgcgaagccattaccagggcgtaagcgagcttttccatctcaatgtatcttgtcttcgctccttgcaatgcttcggagacgaaatagaccggtttctggcctgaatctgtttcttggacaagggcagcactgactgccactggcgaagctgctaggtatagtagcagttcgcttcctggtgctgggctaatcaaagttggcgggctttgcaggtattgctttagctcgtcgaacgctgcttggcattcaggtgtccagttgaattttcccgcgccccggagggtcttgaagaagggcaaacctctttcggctgcctttgagaggaatcgactgagtgccgcaattcggcctgcgagcttttgtacttcacgtacgctcgacgggggcttcatttgcagaatggcatcgattttctcgggattcgcctcaatgcctctttcagaaacaaggaagcctaacaacttgcctgcgcgaacgccgaaaacgcacttctcaggattcagtttcatacccgctgcgcgcaagttgtcgaaggtctcctgtaggtcggacgcgtggtcgaaagccttgcggctttttacgacgatatcatcgacataagactccacatttcgccccaactacttgtaaaggaccttatacaccagcctggcgaaggttgctccgacattccttaggccgaaaggcatcctgaggtgacaaaacgtgccgaatggtgtgatgaaggctgtcttggggatgtcggccgggttcatgtggatctggtgatagccggaatatgcatcttgaaagctcatgagttcgcagccagctgttgaatccacgagctggtcgatccgtggcagggggaaatcgtccttcggatatgctttgtttaggtctatgaaatcgatacacatgcgccatttgccgtttgacttccgaaccagcactggattcgccagccactcaggatggtcgatctcttgaatgaccccagccttgagcaatttttggacttcgggttttgctgcttcttggcgatcaacggacatcttgcgcagcttctgtttccttggcttggcatccggcttaactgctaggtgatgcatgatgaggtctgtcgaaacacctcccacctgatcggggccccaggcgaagatatcactatttttcttgagtacttcttggatgcttgccgccacttcttcgcccatgtcgccccccagcgatacgagctttgtgggatcggcgtcatcaatctgcatcttgattatcttgccgtgaggggcaggctttggcgcgtgcttcgcccagccatgtggttcggcctcaacattatgtactgttctgttgattatggcaagatcgccttttgaagcggccg

SEQ ID NO: 6163 - DNA, 688 bp, Oryza sativa
gctgcttcacgaggtgcttcaacagctgctccctgctgcagccttggatcttgcacgttgccacgttgccgaatgtttcggcattgctccgtggtgtgcgaagagcgtccgtggaaggcgcagtagaggtcttttcggaccttgcggacaggctgctgatggttgcttgcttgctgggcgtcgaactccttgcggagggcttgcacttcttcgacagccatcacagccttgcccgcacggtcggttctgaacttcctccaggtcatgggggcttgaccttgtcttggcggttgtccttggatcgccggctgaggctggcgaacagcgagaggaggtggttcggcaacttgaacttgtgcttgggcttgggcagcggcgacgaaagccttatcatactcagcttgtattgcttgccgtcgcttggaatcctcttcgccccttgcgtacccgtcaatgatgcgaagtaggtgctcaagcgtctgtggttccttgttggcgatttttcttgtgagttcgccctcaagtagaccggccgaagcggcgtttatgacagacgcctcggttatgtcttgaacttggcaccgggcttgcgagaagcgacgcatgtactcccttatcgactcccccggcctctggcgaatgctgagtagatgctgctgcgtcttcggctcctcataggtgcctcgaa

SEQ ID NO: 6164 - DNA, 701 bp, Oryza sativa
ctgcagcctgttatgtatggatgatggaaagattatgttctgtgcatgatattgtgtgttctgtatgaatatctctattattatatatgatgctattgatgctcttattttaccataatcaatttcttgtacagaggaaccaatttcttctatagagaaaactgatgactgtacagacagtcagcttttcctgatctattatttttccaaacaaaaagttcattatattgcatttttttcagtgccacaataaatttgttatacgctcattatttagtctcataaaatacacatattgttcagttaacattttttcaattttttcaatctagctgccactcctacatctacaaggggattttagacatttggaaccacacataacgtgaaaatgaaggaaacctaacgggaggggcatggaagggatcacagcgaaatttcaggggtacacaggggattggataaaattcgggggtatagaagggattaggtgagttttggataaaattcgggggtatagaagggattaggtgagttttcatgggcacacaggggattttctctatattttagcattgcatttacatggaattagaatgaggagtattggaagaaggaagacggcggcggagcatggggcagcgtcgaggaagacaacagcaggtacattgatttctgcccatgctcccctactgcttgat

SEQ ID NO: 6165 - DNA, 1350 bp, Oryza sativa
atcgccgaaagcaagcaaaagttttgaacgatatatcactgcatctgcatggcgaacactacattattgtactactcgaaattgctcgtgaggtgctcggcctacgagaaagatggtagcggcggcggccgggtgagggtgaacggcgcggctcaccgcgtgccgctccaggtcggggctgcgctggagacgaaaatcaacaggtcgctggccgggctgatgaggccgccggtgctgtcacagccgccgacggaggaggaggccgagggcaggaggagccacggcagaacatcccgagtgagaagcagacggtggacccgttccggcaggcggtgatcgtggaggggggcgtgcggtaccggcagacggtggtggtgcggtcgtacgaggtcgggccggacaggacggcgacgctcgagacggtgctcaacctcctccaggagacggcgctcaaccacgtgtggatgtcgggcctcctcggcgacggcttcggcgccacgcacgccatgatcacgaacaacctcatctgggtcgtctccaggatgcacgtccaagtcgaccactaccccatctggtatattatattagtatttgtgttcgtccatggcgtcctgttcgttcagagaggccggggcaagaaaatttatgctcatcaggagaggttggttgcaggggagaggtgctggagatcgacacgtgggtaggctcgtcggggaagaacggcatgcggcgcgactggctcgtccgcggccgcagctccggcgccatcttcgtccgagcaaccaggtatgtcttctagagatcatccgccagtcttaataattagttatactagaaaatatgggtgccagttggcgcgccatttctaatagtagtctgtttagggtaatgtgaatattttaatgtgttttcattttttcagttagccaataacattgtttcgacttaaaatattcctcaactttttcattgatttttataccattcaattagattgacttacgaatacttgttgatttgaccggttgatcgtgagtagataaacttttagcgttattttttacataacatcataacagatacatttaaatatattaaaaatgtaataatacaacttggatgctacaaaatttgattgtttaaattagtgttgatcaaagctcagcacttcaaagtaaaaaccaacaagtattaaagtccaaagtgttttgtgtttttacccttttctgatttttctattggtgatcattagtttgtgcactgtttcctggaattttttttgctctttattgagtggattttataataattggctatagcttactggacgtaaaagataggatttattcc

SEQ ID NO: 6166 - DNA, 783 bp, Oryza sativa
gaggctcaacggatggcagcgtatgcacgggatgggcgactgattgagcccgtggtgtggcggcgaaagggaaaacgaagattggcgtggcgccgcagcaacgaagggaaggcagagaccgttacggtagtagcgaatgcatggatggaagcggctggcgggctacggtgctagagacggccagcgagattgagcgagggagaaggccgagtggttttaattgcggatggcgaaatctgagtgtaggtggcacgacatcgagggcaatatcaaggggagaaggaagagtgccatcgacgctagccgacagggaaccacgatcgccgtgatgggcaggcgaagggtagggatttcaccattgaggccatgtttagtttccaaaatttttttcccaaaaacatcacatcgaatctttggacacatgtatgaagtattaaatatagattaaaagaaaaactaattgcacagttagggaggaaatcatgagacgaatcttttgagcctaattagtccatgattagccataagtgctacagtaatccacatgtgctaatggcggattaattaggttcaaaagattcgtctcacggtttacaggcgagttatgaaattagttttctcattcatgtccaaaaaccctttccgacatccggtcaaacgtccgatgtgacacccgaaaattttcatttcgcgaactaaacaggccctgatttaacctattgaattggaaggggtaaactgaactactcctttttatactagtatagactagaaaaaataccc

SEQ ID NO: 6167 - DNA, 895 bp, Oryza sativa
gagaaaatagtagtagtagtagtagagaagagtagagaatactgagcagagatagtactagtatgttcaagcagagaaaagaatctgagtagagatagtactagtatgttcattttatttgtattggtatgatttttcttgctatgattcactcagatcaaatatatcaattaaaaaattacccgttaaaattatatctcttaaaaattatttatttcgaaattttatcgcgataaataataccgttagcatttagtcgttcaaaatatatctcttaaaagtataagattagttggaagatattaataaaatataggaggatgtgatatggatgatttgttagagtagaaagagatatgaatgaggaatcttttttaaatagctatccatatggacatatgaaggatgatatttggatgagctcccgatgctctaaacaatccctttgtattgactagggggtggggtggtacggaaaccctatcaccagggaagaggggggcgggggcgcacagcaaatttcctcctaatccgtttctcccttgggcgatggcttccatcgctatggctgcctcgttgcgaaccttcctccgccctcaccgttgccgtctcctcctccgccagagccgcagcctctccgccagcgccgccccggccggtgccgccgccgcatccacggttatccggcgcagcgtagtggaggtgctccgggagcgggggctcgtggaggccaccacttctgagtctctggggtcggcttcagcgagccctagggagctcaaggcgtactgcggcttcgaccccacggcggagagcctccacctcgggaacctcctcgggctcgtcgtgctctcctggttccgccgctgcggtcacaacgccgtcgcgctcgtcg

SEQ ID NO: 6168 - DNA, 1760 bp, Oryza sativa
tcatgtcgcactaccatcgaggaagacgtggccaaccacgtgccaccctcaaggaagttgaggtagagctctcgccatgttgcccatgccatgctgaggacgagaggcgaagctattctatgccgtgtcgagcgttgggaacgagaggcggagctcgttactttacctccatcgcatcaacaacgagagagcacatctgttggggatgagatatggagagagaagatacggataggggagcaagaggaaacgatttttgtggtgagaaatgtctccaagagatgttgggcgttcgatatttggcttgctatggacactcgatatgaagcgtttctgcaatacaagtagtaagattagataaaactttttaaactttctatcgacttttgaggtcacgactacgatatttggatggtatggagatcttcgatatttggtgtctattctgatttgtgcatcttgtgtcttggcttgtcttggtttttgttggtttgtccatttcctcctagggtgcttgtatttatacccataggtgtccccttgtccaagtagactagggagaccaatatggatacgatccaaatagactagagttgccctcagcaatcggagttcggtacccttcctagcccctagctgtttttatggaaaagccattttccacaaagacagcttaaatcttataaccaagcaagctgaagctgacaaaatcctagcccctagccatgaagttgggaaaaccaattcccgattgcacggcttagttaatacgcattcagaatagagcaaaggaacgatatgatcgacttcgagacagggcgatataagaaaagaggatcaacggacaaatattgcatatacaaacacttacagaggttgtcggagaatccatctcttgaacccatctcgtggagaccttgaagcatcaaaatccccctagcgcgccactgtcgactttttaggttacgactatggtagttgcatggtatggacatcgttggtaccagggtatatgcaagattcaggtaaaagagatagagacaagggtttttatataggttcgggccccttatctgataggtaatagccctactcctgttggccgaagccggtgttgctcttattcatctgaatcacacaagtacaatatttgggataacctatctagctgtcgtcgacttggcggcatagataaccaacacgtagtcaacgacagggtagtcttccttctcgagtacgaactcaccgagatcagagatggcgcaaatccctcttgtcggcttccgcaggcaccatattgggtatgtctaggctcatctctgatgtcaatgtctagcggcgtgtgttggtttgttctggcttgtcttggcttagtccccctcctcttaggggttttgtatttatacccatagatgtccacttgtccaagtagaactagggacaccaatatagatacaatttgagtagtccttatcatttccacatagaattctacttgtccttccttatccggaactccttttatatacgaggtatgattccatataagacttagtatatggtgggtgatgaaccctaagttccactcgagactcaaggctgttgttggcccgatctttcggtgagttgagataactacgatttgggagacacgttgacggcccaactacaaccgtacaagacattgcgttgcgccttagcaatcgatacacctctccatgggttgttgatcttgccggtacaaatcaaccttattcctg

SEQ ID NO: 6169 - DNA, 1071 bp, Oryza sativa
aatattcatggtatacttatggttacagatatgatccgcaagcgcacggatataccatttttttaatccaaagtgaagatatgataagagagtactatgctaataatttatatattacttgcgtacatcaaggtcgatgtaggggttaagtaattcaaaggttaggtgacacacagaagaaagaactatgatactctcactaaatataatccaagctaagtggaggaagaataagaaaataattcattcctatacttctaatatgcaaacatctttagtctacacttgttagtatacagtcatgcaaccaataccccctaacagtgccctcctggtgtttcgagagaccaccccgggttgccgagttccttacgacaatctgtaatggctgtccaaccggggctaaatacggaaaagtaccctccccaggaatttgtcttaggaatatatactatcatggaggaatacctgtactgagctgtcaccattagcgacccacctcgactgacccgtagcatatatgctcagatagggatacttaataatctagataccacgtctacattattaaatactactctatatcccccgagatgacatagagcaaccgagcaatcggacactaaacccacaccattgcacctctctgatagactagctacacaactatattgatacaagtataaaatgaagtcggtactcagataatataaatggaataaaataccgaagatgtataaagaaaaatattctattaattcaataagtcttacaaaagaagagaggaaagctactagagccatacccgaattctcctgaagacccgaggactaagaatactattctaattcctactccactagcactagtatactactaaacttgagagagggagagagctcttcttcttgagtgtgtggagagagtgaggatgtgaggtccttatatacggcagttatgacggttataagtatgcgaaatgtccattctgccccgcaactgccatcaggacatcatctagagcgtccaagccaaaacctggaatcaacggcagagatgggggtgccgaac

SEQ ID NO: 6170 - DNA, 939 bp, Oryza sativa
ctttccgctggcgccatgtctcaatccacaacggagtccgtcctaatccgggactaggccgcttcctagacgcactcgacggtgacgatggtgatgctggaggaagctgttgaggaggggatcctcccttctcgggatctcatcggctggcggggggccaccggggaggagttcccgaccctgaacaccgacgatatcatggtgttcctccccttctttaggtttggcctcggtcttcctgccgacgattttctccgagggctgcttcatttttacggtattgacatccaccatctcaattccaacttcatcctccaatcgccatctttatccatctatgtgaggcataatgcggtataaacccacacttcacgttctttcgttacctctatcaactcaagccatagccggggaagaagaaccccatggtggttggagggagcggcatccagatctggaccgagcggaaagcggagtttttcgatctcctgctcaggtctagcacaagggctggcactctaggtgtctactgctccaacttgttgcaggtctgcctccatataatggccatgccccgggcgtgaaggattgttggtacacactccctagccgcgatgagatggaccaagttagaggggtgctgaggggagtgcgtcttctaatcgatgctggcttgacctgcaacttcgtcacttggaggattcaaccactgaagagtcgtgttcacccagtctgggaatatttaggaaaggatgacccgaccagggagagcaatgagttgattgacaaggaccaggcttccgagaggttgaactagtttttcgagcccgagacgttggtcagcatggaagggtgctccaatcctttcaattgcagcaagaaatggccggaggtatgccctacccatgcctgcttcatatatatgtgtataaattggat

SEQ ID NO: 6171 - DNA, 977 bp, Oryza sativa
tcatattgatgttaatgaatgtgggaaatgctagaatgacttacattgtgaaacggagggagtactcaatatacccagaacaagatttcacgaacatatatatgaagctcaaatgaatcaatgaaagctcacggtcagcaactattgcatgttaagcgacttgttaaatctgtagttggtattgctatgcaaaactgtattcctaatctacagtttcattgcgttgattgttaaatctgtagcacgtatggttacaccaggaggatgcctgaagttctactaagtttcttcattcccttcgtaacattttttttctcatgatttttagcaagcagctgtccagttcccagttcaatcgcaacacttgttccagccaaggaaacggctcgctagtgagtacttgaggtaccatcggcaacataaagggagaaggataaggggcacaccaggttgaggagatgggtcctcgagggctgcgccgaggctgcccgacggcgactcctccctctgaggtgcgggcggcgagggacgctccgtctcccggccggctcccccgtcgacggcggcgcagcgaaggtgccggccgtggcgacagctgaggggctcgggcgccggggaggggaggagcggtacgcaacggaggacggagagacggtggtggtgatggtggcgaggagggaatccgccgagccccggaggcgagtgcgagagcagcgcccccgcgctccccatggtcggtcgctcctacacctccgaggaccgaggcggggcaagctggaggcggatagagtggacgatgataattatctcgctcgctagtcgcttccgtgttgcctggcgtgttgcactgttgcttgcgccgcttcacctcgtcttgctctctctgtggaagtgtggattatgctcacgcaccgagtcacacgagtcacgaccacacgacacagcaacagcaaagcagcggcgcaccgttaacgggt

SEQ ID NO: 6172 - DNA, 1676 bp, Oryza sativa
caatcaaccaaacagctgcatgtgtatctcctcaaccaggctatactcagcctggataagagagatggaccaggctagagggatgcgagcaaccaaacacacccttaagtttagcattatatacatgtaaactttttaatagacaagatgaacagatagaaaatgcaattaaaaaacaggaaaaaaacaatcattagtttcaaaaggtgtgcgcattgcacagcatcgatgcacagcatgtactcatgaatagacgaaaaaaatgaaaagaaaaaaaaaagaaaagagaaagaaagagcgccgtgttgatgagctttctccgcccacatcgccgacatccacagtgccgcgccgccgtccccaacacctgcagctcagctcacttgcagcgtcgcccctggctcgcttgcgctgccgctcaccatggagcttgctgcgcgcactccccgcggtcctagcatccaaatctggtggccgctcgtcgttcgcggcctcacccccaaaccatggtgttgccgccgctccagatctaccgcttaggagcttgtgggcaccggatccgtgcggtccagtcgctagagaaaggaggggtggagtttctggtggagaaggtggtggaggctacgacaagaagaggaggaaggcaagccccaggcaagtttttggtggagaagatggctgtgcggcgacgaagatggcgacgagccgagtagaggccaagcgagcaaatgagggggagtgaggtgaagggagcgcgacccctctcgccctcctgcatctacgcatccccgcgcctgcaccggcgcgtcacgccgcctgcacaagcgcagcctggatgggagcgaagctcaactcgggcgtttctcgcgggcctggctgcggaggccgttttgcacgtgtggatccaggccccgacgaccgtgcaggcaaccaaacagcctcctcttgcacccatacatgcgagccaccctccatgcatgtaaccaaacacgcccttagaaggaggtgtactaactgtcgaaggaggagctcatcttcctagtgccgacggtgcttgaggcttgagtccttgaggggcggcaccataggagccatctagctcggcagctctagcagcagaccaggtgaagggaagagagagatctaggcagcagcaggtctagttctagcagcatatcagggtggcggcttgagagagggcgacggcttctgagaatagtggtgacatgcagtggcggatttagtccatttctgtggggtcggctgaccccacagctttttgaaaaacatcttataaaccttgattttcatgtataaatctaaaaaaaattatagaaatgaccccacttaaatataaaccactagtaattgaccccacaggtataaaatcttggctccgccactggtgacatgccctcatgactaaaccctaaggagaatggacccagcttcacatgcagccaagacttgttgtgagatcaatataggtgctctaatcggacgattaatcgtgcctgatcgccaattaatcggacgatcaaatttctagtcaacctgattgaatgaatgcccatgatgggatgattaatcgtgattaattggacgatcagataagatttctttatagattcattaattaattgttctgaggtggatatcaatttgatagtagatca

SEQ ID NO: 6173 - DNA, 2348 bp, Oryza sativa
cgcgttcttggccacgccctccgccttaacggtgaaggacgtcggctccaggcagaacttcttcatgttgtgcttgccggccttgaaggcgaaggagtcgacgccgccctccaccgtcgggcactggttcgccgtgccggttcccttcacctccatgtacgtcttactctgaatctcgtcgaaggtaagcctcctcggcacgccctccgcgctggcgccctacaccggccggccaccacatgcacggcgttacatatatagtaattcgatcgtttccaccttggccttggccatggcgccatgcaacatactcctaaatcctaattaaggtcttaccgagacgagcagagctgaggtggcgagggcgaagccggcgagcttggcggcatcggcgcacttgttggcgacctcccggatgtcggactgcagggagcacgtgatcctgccggcggcaccggtgtcgacgccgaacgccctggcgacgtgcgaagacgggcgcgatggcagcgcggcggaggaggcccggccgccgagcttggccggctgcatcagggtggccgcggcttggagcgatgctgccatgtccgctcgctcgcctgctcagctctcagttggtgggtggtgtggccgtgtccgtgtgggttgtatcgtgaagggcgttttgtgagggcgggacagtgttatctatcgcagagcaaggggggcagaggaggataagaggattggataaggcgtggcctcccattggtggcttggggctatggtgatgctgagctggacgtcgacgtggcacgcccaggtgccactccttccccggcgtgtggtggtgggctctttcatttgtggggctggcgctgtgaagatcctacttccagccaacgaaggcttgccacgtcaggaatggaagagacaaacgaacctattctcttgaaggcacagggaacccaaagaaaatgctaaaaattaaagatctcgctcataagaccgacatttgtacgtgttagatgaaacaggaattataaaaaaaaaacattgggccttacatcgttgtagatggaaatggtcaacagctatttgtaaattttcctaactgaatcacattatatatatatatatccacaacaatagagtaatacttttctcatctatactcttctagaaatagacaaacaatagagtaatacttttctcatctatactctatggtggtggctgttggtatttgctacgcatactgataaatccgtaagcgcacaaataatgatgtagcattttctcttagagtattttaagggtatcaaaaataaagacgtgtgtgtactatctacaaacagaattcccccaaggacaacaattgatgataagattggcaagagaggattcatatggacttcactagttgacttaagttaaagatagaactctatcgtatgtttcgcaccggctatcccttaatctgttaggttgagtctggccttgagctatatgatatgcccgaacgtggagggatgcaaagtacgggcagggctgtcaccacctgctacccacctcactttgcgtggagcacacaatctctaaccttccacagaaacttccttctttatagagtcctagtactagagcagttgcaactaagcaacgaacccgcatcgatgagaatatttatcactcaagtaaactaagtaaaaaaaaactttactttgttgtgtgttgtgaagtgtgttgagctcctcctttcatagtgccaaatgatggttgtaatggtgattagtgaggttggtgcacacataacagccatagtcaatccaatggggagctgccacattgaaaggggtagccaggggcaccacggcttgttcagccgaactaggcctccgccttctggccaccgattttggacagttactgatacgtggactcttatgacggttaaagatggtttggccctatctcaaatcggttttgacagtcaggtgggccctttagttcttgtgctcgcgcttgattagtcagatgggccctttagtccttgtgctcgcgcttgattggccagagcttcatttttgtcagatgacggatgtattttttccttatttgacccgcatacttatatgtatcaaaactaatggaaatggttagtagtaaactcctaccactaagttttgatagtgtattttatttttttaacgcaggagttgatggttaaagtttatacttaacgtcaacaatggcagtgaatccgccaccacatcaactccattttattttttttatcaactactccttatgtactttatttttatctaagggacaagtgtatccataattcattcttatccattgcaaag

SEQ ID NO: 6174 - DNA, 1411 bp, Oryza sativa
aaaagacagaaaatctttctatagtgcaaacaaaaccccagctgataagcaatagagatgcatgtgatgctatatgcttggtcaggtcagtcataagacgtgaaggctatctacaactggtcttaactctgtagttatgctaaggaaatctgctctgaatatgtagttcgtacaacggtacaagtgggttccaaatctagtcgcttttgttcttaacccatctttatgatcacccattatagatgtcatttgtataatcacctgttagagttccaacattttataaaaccattgatgatctattatgcatttaattttgttttccttcacttgatagttactatttttgaaacagttatgctaaaattaagttgtcaccttatcattgtatcaggatttagtgaaccatattttgaatagcaatgctatatcagaagggccatttagtatgagaaaagctagatttttaggctctgcttcagcctttagtgttaaacaaactgagtggccatgtgctacaactgactcaaagaaatgttaccgtaagttgctaagcacgataaaacaaagtcagttaatgtgtaagcacatactttcaaaacttcaactcaaagtttgcataatatagtaacttaaacaatgaaatccatcatgcagacataattgtcatttagcataatatattttgcataatatagcataattgtcataatatccttaaatctggaagttaggtaaaaactttcatccaatccacaagccacaacagaagaacccctaagtcctatgtgtgtatgcttccaaacatccacagaagaatcagatgaaattcatcatcaacactagctgtgtcttttgtaggagtaaaggaaacaactggaagagttgaatggatgaaacttatacagttttagatttgttgtggctaaaatctttaggctcaattttctagaagtattaaagaaaaatctatgtcattgcattgtacttatcataactattttattcccattgtgtatttttctggtgataactgctacatttatattcattgtacaaaatgcccttaattagtattatacgttggtggagttcctttttagagtacttgacaactcaaatttaacttgtacagtccaaaatggatcttttggaggtatcacagaggatgaagaacagagtagcctgtacaattttctttatccgagcaaagagctacttcctgatgataaggagatgagtatatttgatcatctagaggaacttcgtgacaggatatttgtctcagtattggctgttggtgctgcgatacttggttgtttcgcttactccaaagatcttattagaattctagaagcaccagttagtgttcagggtgttcggtttctgcagctctctcctggagaatttt

SEQ ID NO: 6175 - DNA, 610 bp, Oryza sativa
ttgcataatctactcggttgccaattggtgttggaacctgtatgcttgaacaaatcattatttgatctaactgtttcaatgctcattgacttgttatctggtgctaatataatcatcaattaaatggctggtgtggaaacttctctagatgttagtgatctgaattatcagtctgatttactgccgaagataaagaaagagaataattgtagcaggaccatctcattagaatgaatatatcccctctcaaagctgaatgaacataatatcttgtatatttttatagtttccatgctattttttccaggtccctgttatccagctactgctggggcaagtcggtttggtttctagtgaccaaatgctttccatctggagatatgttgttgttggcgctgtagttgctgctgctgtgcttacaccgtcgacagatccgttgactcagatgctcttggctggtccgctgcttggcctgtacttgggtggtgcttggatggtcaagctaactggtcgataattcctactagtattttgtattaattagcatcatagtcatggcggtggttctggacaaatcgcattccccattgtaacatagttgggctgcagg

SEQ ID NO: 6176 - DNA, 689 bp, Oryza sativa
ttcctgcagcccagcttgtaatttttcttctactgtatcaatagaacttcgcaccgtcttgcatcttgtacgagttattcaaataaaagttcaagtccggaccacccaatgtcttaaaaaacagtccagaccattgaaatccctgctagctcattgcccgtcggtcactggaccagtagggatgtttagcatcattgccggttcatggcttattggcaggaaaattccctccaatgccatgaacctgcagtaagggttggctcacgttaaaccggtagtgatgaataggaagggattgctctttctgtacgagtgagtagccaaaacttaaaatcctaaatcactaatatatgaaaaactaataagatttgttttgtgaaaatagtatcagtgaattttatatgaaaagtactttaatgtagctatatttttcataaattgaatttaaaaaagaataattaaaaacatgtcgatgtcctacgataggtaaaaaagaaggaatggaatatcactcgctggacccttgaaagcagcagccggtagaattaaggagcaaggaaagaatctcaaaggtagggtgtgtgcgcatgtggagggtaaacctaacctaaggcaatatgcagccagtgtgtccactgacaagtgacaactgtagtctgtagagtagtaaagtgtagtagtgacagtgt

SEQ ID NO: 6177 - DNA, 1633 bp, Oryza sativa
atcaaatcatgcatatatcaagttagagatttacaatcacagatttacaaacaaatgaataattattcaagtcaccaattcatcaagttacagtctcacagatttacaatcagttcaaatcaattcatcaaatgcatacatcaagtcatctactattttccatcaagtccatctcagagtctcagacaatcagacttacagaaatcacataatcataaacaaacctcagaaagttagaatataaaaggggtttatataagctgtgattgtgcaatggctgcctcgttaaaaacctttataggtaaaaactcacacctcgtgagaaaaccctagaaaggaaaagagtacaacccacagctaaaatgttcacatcaattacaatcatctagttcaagggtttacatcaatttcatcatcaagatacatattctcataagcattttgaagctccacattctcagtagtatgctgaccttttgcatctgctagctcccagtccttgatcactgctagaatttccaccagcctagggtttagacgccgccgacggtcctcgatgatcctgccagttaagctaaaagtagactcggacgatatagtagaaataggaacagtcataacatctttagctaagattgaaagaacaggataagttagtttgtgttgttgccaccagctaaggatattgaagtcatcatcatattggttgacagtgtcactgtcaagatatgcagacagttcagaagaattgagattagcagttgaagaagctgcctgaagcaaagcagtagcagatgtcatcctaaataatgaaccagcaccaagcccagcacctggactgacaccagcattaccagcaccaagcccagcacctggactagcacctgcattaccagcaccaagcccagcacctagactggcacctgcattaccagaaccaaaaatcttcccccatgcagtccttttcttactagtggaagggcctagaatagtggaactacgcaatccaacagaaccaaactttctttcatacttagcaaaagtatcagacaatgaagccctaacagttgttaaataagcagagtaatcatcaccaatgagttgagccataatctgaagcactttactaaaccccctaatcttggccctagggtccaagataaatgcaaatgaataaagaattggaattttagaccagtagttcataaacttagttttcatgggaccaacaacatttgcaaggttttgaacattgccatatgtgtttagatgtccagcaatctttaaaatgtgatacatgattaatggagatgttggataataaacaccagacaaaacaacagttgaatcataaaattgttcaaggaaacacaaaacagattcagcacatgcccaatgtaagtctgtgagtaatggatggccattaacaaaaggatgttgtgtactaataaatactatgaatggttccctatgtggtatgagatgcttaagcattagataagttgaattccatctaacatccatgtccaaaccaaacatacgaggacgataacccgcagcaatgcaaacatttttatatgtagcaatacgctgattagatgcattcaagaatgaaatggcagctctaatgtca

SEQ ID NO: 6178 - DNA, 15756 bp, Oryza sativa
aattcctgcagccatgggcgtgaacttgtcaagtccagccttaacaatcaaattgatgatatgacatgcacagcgttgatgcaaaaataaatgggtaatttggaaccatgccattataatttttcaaagtttgagatatgccatcggtatctcaatgacatgtaggacccacacgagtcaatgacatgtgggtcaggatgacatatcttaaattttacaaaattataatggcatggttacaatttttccaaaataaatcaccaacataaccagacagagcaagagtaagggtttccatagctttagaatgagcaaaagcattgtctaatgtaatagagaaaaccttatcagtaataccatattcttcagcaacagcaatcacacgctcagcaatattagcaccagtatgtgactcatcaatgagcctaagacccaagaccctcttttctaattgccaatcagaattaacaaagtgagctacaacactcaaataatcttccttagcatgaccagaccatatatcagatgtcaaagcaatagagctagcagaattgagacgatcgataataacagaacgacgatccttaagcatcttgtaaaaatctctggtagatctctggtagtagtttgtctagagacaagaacaaatctagggttatgagcagccttaatatagttcacaaaagcaggagattgaccaaaactgattggaagatcctctctagcaatcaatctacacaattcaaacctagcaacttcaggactatattcccatggaataacagaaccatctgcactaaatctaagcatggactgaggcaaagcattagacccaagctttctaggtttgcatgacttaatatgcctaagcaaatgtccagtgccagcagaagaacgagcactcaaagttttatgatagtaattgcatttagcagagacttgaaccctatttccaatggtcgtttcataaagttcctcaaagtcatcccataccttggaggttttggtcttcttgttggtacaagtcgcactagagccagtcggcatcccattgccactgtcgtcgaccggcgggtcgtcatcatcgacattcacatggatcgggatgtcggaggtattgccgaacacctccacacgatcctcctccacatcatcatcgtcatcactgtgcatccccatagtcctcaactcgtagttgacggaggtaggattgtcgtccatcgcaggcactccggtccctcaacggcggctgccgctaagcaatgggcttgcaacctgcaagcagccaagaacactcaaggttagggctggaaatggagaaaaaaaaagaaaaacaatgggttccatgcttgtacctacgcagccggagcaccggagttgccgttgaagatgataggctcatggatctacgagaagaccaagggatctggcgaagaagaacaaaagggaaagagacgaagaggaaggctggatctggaagagtggaaggacgatgactcaggcgaccatgcgtggccggtggccctcatcctcatgcgcccctcatgcgagtcaggcgaggcatcgatcggagacgaagaggaaggctggatctggaagagtggaagggatgcgactcggtgagtctcaccggtgcgcgcctgaggccctgagcgagtgagcggcagatgcggagcggcggacggtggaggaggagatctggtgggcggtggaacggcgaaggcggatcggcggaggcggttgagcggtggcggctagggttagggttaggcggagaggcggagagcgagagccgagaggggactgggaatgggaggggcagcgctcgctggcttatatatgcgggcgcacgcggcgcggcctagctgtctgttcggctgggccatgctcgtgcctaccgttggtacgggccgtggtcgtgccgaccgttgggccgtgccgtgtcgggccggcccatcgtgccgacctcggtccgtgccgtgacgggctggcccaccgtgcccagccataggcctaggcacggcccaacagtcgtgccgggccagcacgggcccgactgctaccgggccgtgccgtgcttgggccgggccaaattcccgtgccgtgggccgggccatcaggccttgggccatatggccaactatagtcccatgctaaggcgccctttatggttttcggcattttccgactcgttttgttggagagaaaatgttctatcactcttgacaaaatgtttcatcgattggataaaagttttaatagatgcaacactcgaaaactactccaataaaaacataatgaaacatccaaacacaaccaagtgcaacaaaagcaaattatggattgaaacatcgtcaagctctagaaaaaaaaacaaaactaactctaccttcttctacccagccatctctcgaaactcacgtacattcctcgtcgatgagcttctcgactgtagctagttgttgcatcactttgacctcctttatccctccgaatctcctctcattgatggcggtgccggtggccaggatttgccgcctccattctctccgcgtcgccctgctgccgtcgccgccgccaccaccgtggctgccggtgatgatgactccaccatctcttctcgccgccattgtcatggtcgccggtgaccaagtctggcacctccgtcctctccccgtcaccctgccaccgccactgctatggccgtcggtgatgattgctccgccatgtcatctcgtcatcgctgctatggtcgacggcaacaatggctagctccgttcgtgtgttctctaccattgaagaaaatgtgagaacaggatgagaggataggatgggcaatacttaaatcgatagtggatctcgccttaattaagtgtcgtctgacgtttcatctcctctcaaacgttcgggtacaagcatttccgtgatgatgcacattcatcagtccaattgaccgcatgaattaatttcatatgatggacagttggacatccgatcatcggcaaattatcggaaagtatttagtaacttggcaagaattgttcaatgttttaccattcgataaaataaatatttcaatgagatgtagagcatgtttggtaggactccaactcctaaatttaacatcaggagttgggtctggagtggacttgcggagctacctaaacccaactccatctatctactttattttatgagagcactccaaccagctccactcccatttttagtgaagttgaaactgtttggttggacttcatatcatggtgaggtggagctggagctagagcatgccaaaacagggtcgtaacagttataaaaaattaattgcaacaccaataaccaacatgtgaaatatataaaagaaaactagctatacagtcgttgatagaaaaaattagcattatgatcaaattatagcaacttaaagccaaatttggtcgagcctttcccgcgaaggcctgtctggacaccgttgtgtagctggtcatactgtacaatgaaccacagtcagatcgcggttgtccggacagtcggaccggcagcacaaagtccaattagagttttgttgtgtttttttctttggtcccgggatttccttgattataaagcttcataaaatatagggggcccaaggccgattgaaacaacaatcaatcaattatcaaaatcaatctagtacctctatcatttgtattatacacctccctccctattgctatctatctccaagtctattcaccactcaatccctcaattgcttgtcattcttgtttctacagcgatagaggacatcctagttggcatgtcgagcttaggacaaaccgctgcgtgttaccctgacagggccccttctaggtgttcgttcggtggcatctgctctctcctatggcaacacgtgtccgatgccgttgcgagttgtatataacatgctcaaggtgtggtggcactattcggtgccaacaacaacaaaaaaaatatatattgctgagtaccttcaagatggtggccggagggcacgagatacgcctttaatgaagcagttcacatcatatgcaagtgtagcattcagtcgaatagaattgcactcgaacacaataaagtgcaatgtagataaacaacggatcgcaacaaaaattacccaactccaacaagagctaccatatgttttcttcctctgctccatgatcggctttgccttcttccttgctcctttgactagatttgggcttcccatgcccatagagccgaagcgtgtgctagaggcatacttgaggtcgagcatggtattgtccgggtccatgcacacggggcttcaccttggccccgagccaacagttgacatggtctgagttgaaaagcaatgtgaaagtagatgaagcatgtatgcttcatcaaagcgctccaggcatacggtcacttcttaggacagcatgcagagggaggctattggccgaggcagctggtggggcaaccgattttttctatttggctcggatacctagtggagagcattcttgtaatttgatcgacactatagtacaagatagtgatagaaatttgagagatcccgaggaaaataattaggtttccatctagcataaacaatataatgatgattctagtaaactaaaactacctttgtttaagctacttggatttcttttccttttctttaacaaaacaagatttagttacgattgaaaataattttctttatcttcttccatagatcctttactcatatttttaaaattggatacttaatacaatgcaaaattatgcttcctgactcttgtactcataatccaaatccgatttattttaaggatgcaatttccattagtctttgaatacagacttctacaattatcttatcaatcagccgtgcaacgtagccaggtgcatgcaaattatgctggacttggtagctacacaacaaaaaaaaagtgtgcaatcaagctagaatacatgtgtagaactataacagcgcaaagtgctatataccagcttcggagtctagagtgccggacttatttggaccactcacactcacacttgagacggatatggctatcgggtgacaaaatcgataaccatcttcccttgccaccttctcttgctgtcgacatacatccaagtcatgatcccacacctgcaccactattagtggtggagccgccatggtcctcttcccaaaagctcgggaggtggttccaccgttgactactatcacttccctacagtccactcatcacaatctacatcaatttgcttaaaaccctaacttctctgttgtgcactgctaaaagacaacctcttcccatattaattatatttatttactagaaactataaatattttattaattaaaccatcaaaatgaagtgcatagccttccttttcctcatatacttgattttgtattgcagtaaatagtttcaagcgcctaattttcgtacttttgaatagaatattaaatcattcatattcattttagttctcagtaaaatttccaatggatcaaactaattaagaattatgcagtggcaaactagagaactcgatcacagcatagtggatatatcacaatgatgcaccagtgactgatcaaactggcatgtttgcaaatatgaacttaatctggagttgaaatttcaaatttcaaagcttctgtttgaaatttaattaatactcactccagtccccccccccccccgggcacacaccccccccccctttgttttgcctgtaattacgatattgacacaatctccaattcagttgttcgattactgtttttttcttattgtatgtttacaaagaattaataacataaccaaatgaaagaattttcacaaattaatctactaattaatgtcatttaaaacatcatctttcttaaatagaagaaacatcttagcatgatgcatgcatgtttgccacgcttgccagctagccataataccacactatattttcacagaccttcacaatcaataaataatatatatgtgcaccaaacacccatttggtcgagtgacgaaaatgacgaacaaactagctaggctattaaaattaacttccaaaattcaaattttctgaaacaagcatgcccaatagttggtcgagtgacgaaaatgacgaacaaactatctaggctatcataagggtaaggattgagattgcccatgtggagttactgaaaagctaatgacactatgcattgtgtttttttaagtaaaatgcatgagattattgtgtggaatgcagttaatattctcttgttagaaaaggcaagttaactatttggaacttcatctcgaaagtcgaaatgcatgtgcctccttcccatctactactccccatctacatctcggagtaactaagattatcgccgagtagtacatgcatatacagtactcttcgcatcaagaatcaggactacatactaattaacactaaattctgaagcaggacacaaaatgatatgaacacacatctgatcttttttaagcgaactactaatattaatacattactagctagctggccaggttttgccattaatcactttatgtacataattaaacacacacacttagagctgaccatatcagttcgatcgatcaccatacagcttaattaacactatgactaactaaattccccgcacatgccatcatcaacttgatcttcgttagatcaatccatacaggctgaaccactcaaccacactgttatcagcgtagccgccgtactccgggacatacaccaggtcatcgtctccgaggtgatctccgccgccgaagctcggcggctggcaggtacccgtcgagaacgacgagctcgggctcccggcgacgcaggcgccgctgccgcctaagcccatgatgtctccgccttctccggaggccgtgtggctccccgccgctgatctgagccgcctcacttcctcctcggcgaccaccagcctctccttcagcctcagcacctgcatgccgccatggatggatcagaggaattgaggcagcaataagtatacatgtgtgtacatgcaaggacggacgatgtgttgttacctcgttctcgaggtggcatttgtggaggatggcggcgtcgtgggcgtgcttgagcttggagaactcctcctcgagcagcttgctcttgtggcgggcgcggcggttctggaaccagacggccacctgcttggggtcgagcccgagctcggaggcaaggtgcaccttccgcccggtctccagcttccgctcctcccggaagctcagctccagcatctccacctgctcgtcgctcagccgccgcttcttcgggtcccctccgtccacctcgccaccaccgccgccgccgccaacgcacctcgccccacgcctcctcctcctccgcgctctcggcctctcgccctgcacctcacctgaaaaaaagatcgatcgatcgtggcagcatgatcagtacacagttgacacttgccatgagatggagaggcaagaaaatggcgggagctagcaagcaaaagctaagtagcacgaaccgctggctgctaggagggaggcgtccacgtaggaggcaaacatctgctgctgctgctgcttctcgccgtatcggtccatgccgtctcgcacactagctcgatcagctcagctcagttcagcctttctctctctctctctctctctctctctctctctctctctctctctctctctctctctcttgtcaagcgtgaggtgaggacaggagggagagaggaaactgaactgaactggattgtctctggatggagaagaggaccacgcaccaccaccaccacagccactgcaaaggcacacaccagttgatgtttaagtaaggccgggtgcgtgtctcgagagagagacctacgagtaatatatatagataggagcggtacacacgcagccgctgctgtgtgcatgcctcccccgtttgttgctttctcatccagatcgatcacccaaaagctagcaacgactcacgatcaaattctgatccatcgatcgctaaaaaagacgttatgttcattgctgaacgtagtatataacgcaaggccagttgatgactgggcattgctgtttatctggttgtgatcatgagcactagtgctgctagtgttaccgtagtcatgccgaccgacaaaaagttagcttgttatccccttggaatggatactctgtctgacactgtcacacgcacacttactttggtgaagtaggggccggatgggtgcacgcatgaatgcatgtgtcagtgcataattttgggattagtgggggtagagaatgcacgacgatctaggccagcaagagcacagcacaaagagcggccggccggctcgacaaggtggcacttgcccctggaaagggctctcgctttctttgaaaagatcggggagaggaggagctttggctatagctagatgagattctcgcctgagtcggtagcatgttaattgttcgatccatggctgactgtactagtactaccactagctaactagccaactatttatcctcttttgaattgtactacctccgtcccatattacttgtctttttgaatttttgtttgtcactgtttgatcattcgtcttattcaaaaaattttagaattattatttattttatttatcatttgctttattatcaaaagtactttacatatgacttatcttttttttatatttacactaatttttcaaataaaacgaatggtcaaactttacaaataaaaagtaaaaaacatcacctattatgcgacggagagagtagaaagcttgctgctccatcgataatcggatctagtaccatcgcatataagcactattgttttgagagaggagtagagagagagagggagagagagaactgctgaattatctgagttcgagcacgtacatacgcagctttgatctgaaacatctgttcagaaaatcataccgtacgtgcactcataataaccatacgatgcggtgcgtgcactgtatctgaatttcgaattttcgatcgatcagcagtctgcacgtacggtttaccgcgtcgtcgtgtgtggtgtagcacactgcagatataaggaatatccggagcgatcatgtgtgtcatacgatgatccgatcctatgcgccgagaaccagaagaaggcagatacaaaaccgtgtactggatcagtcagaatgtaggcacacaagtaaagatagctgccatgcaatgcatgcagagagatgggatgagatggtcctggataggggttcggatcgtgcgtcttccaggtagccggaaagaaagcaacagagctagtccgcgcaagtgtgtatgcgagaggaaaggaagcgtcaggtagcgcgagaggagggccgggggcgttggtggtggcgcgcgcgtcgctgtgggtgtgggtgtggggagtagctagcccgggagacaaggggaggaggcacatgggctgcacccgcgcgcgtcccccgtccccgcgggggcgcgcacacgcgtcgagcggcgcggggcttcacaaccgcgggaccgcatgccccttcgcgccgtgacgtgtcgcccgcaccggcaccgcccccccgggcgcctctcccacacaccacccgcggatcgcgaggcgacgaagaagaattaccaccgcgcgcgctcgggtctcggctcgatcgatctcgcggctcgaccaccacacgcgcacgcagcgcctccgctccggggtgggattccgaaggcgccacctgcgctctgctatagctaacgaaaacggtcggagaactcccaaactaaccgataatctttttttcgtacgtgtaaataatatgtttccgaccatttccaatttcttttcttaaacacaataaaaaacatgagttcataatgtgtgcgtactcagctatatataaatacacacgcacagacactattcccatgagcaccttcaaaagagtggagtgatatatctaaagattgatgacgatatcaatatggatgcatcgttgtcgattaatatgtcatctaccactggaaaattagccataaatatgacgattgtttctaattctaaccatatattaaagttatgtttttttcaatttctttcaacgttgtatcagtgtcactactaaatgtttaaattgataaatatggttaattttccaagcgaccaaccgagaatcgtatcgtaagaagcgctactactgttttcatccttacctattgcagcatgctcactgttgccgagagtggatcccactatcagcagggaccatagtaaaaaatcataacaaaattttaatttttagagcttctttggacgcaggattctcaaacacatatgaatagaaaaacctgcaggattaatatgtcaatgcaatcctaagaaatggaaaacgtacacaggaaaccgtttggatgaaacacggaaaaaaaacataggatttagaagagagagatagcacaaaggaaaaaaatctatgagcttggagcttatgctagaaattctccaaaattccatgaaacatgcaatttcattgaaattttaaagaaattatagatacccaatccttttctttcaaaagggcttctacaggatttaaatcctttgaaattaatttctctatttttttctttattttaaaggggtccttaagcatttataatccctgtctcgctgacatgttggtccattttaacgaactactcctcaccgaggatggcatcgtcgtgtgagacagtatcggatcgaaggtcagtacgtgtaaaggcactgtctcctgtgaacataactgcacgctgaaggtattgtcttattggagtttcaggccatgcagtgcattttgatcatcacactgatcagacttttctccgcacaggagatcgaccaaagattacttgtaaaagctccaggcttatcgtcgattcgatcgcaaccagagcccggccggttgcttatctagtcagcaactagtcgccgccggcctatttacggtctcagccgatgccaaattctcccatctgaactgtaaaggttacagtcacaactaggccggatcttggttgatctgttcgaatccaactcatccccaggccgacggacagccgagatctgctcattcatgcacatgccacgaagcatttcttgcagcattttcccctgatttgtatctgaatcctatcagctgtcgacgttacatgcactgacgcagtgagtcatctactcccgtattaggaagctcgcggcactgttcatccgatttttgaccctggctttgcgcatttctggtaagagttatccagttgttccctgtttactttgtttagcaggtcggggcagctgagctgtgcaaaagattagccgccattggtgttcttggcaaaatgtgtaggggccttagtttgttgatgtgtatagctagctatagcagctactggtccacgagaagaaaccggagttgttgggtgcaagcaacacacagcatgtacacgttgtagagtcgtagcttgactgacttttcgatccaaacgatatcgatccatgcatgttcagtgttgtcaaacgtcttggtgtacagtgaattgcaccagtagtgaaggtgtatttggtgaggagaagaagaagctaagaaaactttgacttagctagcttagctaagcattttgctcacacatggtgttacacgaactacatgtgagataatgctgagaaaactaacttacccaatctggctagtcccttttaaattagctgttgatatccttgcaagaaagatctgtttctgcatcttcagaaactttattagtgttctggcaaatttgtaatcctaatttaatgttgttaaattatattaattaattagttaacaatgtagtgtgtatatctatctagccatcctgtgctgcacttcggtgctcacatgggtcattctgataggaaactggccaaccgtatcaagctaggttttaaaagaagagaggcaattctcggtggatatacatgcatgctggggttaaggaaggagaagttatcaatagacctcattagctgagcctagctgtattaaggctgtataatcatgatcctttacactcacatctaggctggtttcaataaagtatagcaatagtactagtattaattggttaactagagatcaaagctaagtaaggacacagttgtccaagtcagagagatcaacatgatggctaggagataaacccaaattctgatgatcatgtgctcgattccctcgcatgctccatgatctccacttgctttatgttaatgcacttactaactacaaaagctgattaaacaaatggaagaacccttactcccggacaagccatgctcctgcttcccaacttccaactaatctccttggatctgcccaaaacctgcaatgatcgtcttaaatgattgtataaagaagattatacatgagattaatcaatggcaaaatttgctgttaagcacaaattaatggccgtctttgtatgactttattcatcaagaattttatatatgctcccgtggaagttgccttaatgcggttgcaaatgcagccttggacacacatggaaagagaaaaagttagcacccattaatctgcttgtaacaaggaacataaggtcgatcattaatttctcctcccaataacagttcaagtcaaagctccatgacaagaacatagttttcacccacaactttaatctttaattactaccctcatgaagaactcatcacctttatccaaactaatctttcacctttccttgaattacgccactaaccatgtgacatgacccactaaaataacaccatttcaatgcctaagcttgataggatgcctgctaaaaaaggtgattactgattagccactagcctgcaggtagtactaagcagcagtagacagtacgttgcccatggcacggcgaaacgtggcagtcatgtagccattccctgcaatctctttgcttgagccgtaaggatgatggagcaattgatttcctttactctccgtacattttgatgttgtctaggccaatggttcagcgataagcaagcgaatcaatcgactaattaagtaattagctacactgatccatgcatacctggtgccaattggaaacctagcaaataaagttgtgtacttgtagaatctttccaataaataattatgtaagaataaccgtctgcagagccggagggcacgctgacatttgcaatgtttaaatttgacggaccatgggtgcttttgaagtgttaggctaactagctctttggagtaaagatcaaccggtgcaagaaaaaggacaggttaattatgtttttgttgaataaagttgtttgcttttagtatggcatattgcaaatactattatgatagcattggctgctataaattaaagaagagtgtttttttttaggaaaaggacccatccaaagttaaaagatagttctcacctttcatcaccatctcaagtttttctgtgaactacttattccaggaaaaaaatatttgtgaactgttcaattaattgagttgatctgctacccaacacattgttagatagaattgttttctaatgttatactgttcaatacaagcatcaaagtagctagggagagttaaaacatttcacatataattactttgaattaattcaattcatcttgtatccccattaagattttttacatggttttggaacgtcatatcatgtgatatacatggttctggattggggttttcaccaacgttaggttcccaccgtatatttacccaaaatcgaaccacttctttctttattgtactgaggaacatacatataaaagcacacaacttgtttttaatgaaattaggcacattgctagctggtactaagttcacacactacacccacacccatctggctcaaaagaaactgcaggaccacacatgaattaagctgcatgatgctactaatttgcaccaaaccaccgccaagaaaacagaccaaagaacacgcaaaacttgcggccatcaatccacatcgtcaccaatagtaaagacgaagaactgaagaagccattaagataagcgagttgcaaacctgaggataacattgattaatccgggagcttagctgtggtcgccacgcgattgattccctaacaaccgaatctttttccaaatccaaatgggtttagttaatctgaagacaaccgtgacagaatccatacatgggaatagttcaagtgacatgtgtcaggacacccgacaccgtcacagctctgggctactttgagcccaaaactaacaccgctaatttgggttttctttagctgcagcatatgggctggaacctgggagaagtttaagcctgtgggatccaaggtccatgtggagttgccgatgcattactactttcctttttttttttcagtgaagtgtagtttgggccatgttttgttacccaagtttcaccttggactatctctaaaccattttttttcctttggattggataattttattgtttttgtagtttggacaactaaggaccccctcatttcgattatgcttatgcttattagctaaaatttgaatttttaaccttaaatttgaagctgattttaaggttttttcatcgaagtttttttttcagcatttgcttttggatcgctaagaacacgcatagaaagttttattcaaaaattactattcgtttgcaaatatatcgttgctgtaactctcttttctatccatgtctaacctttattctggtaaagatatagcctacacatgatagggaagttcgcctgaacttacttgatgtcgctgatgtgtactgaaaaagttattatttgtggtggtccaaattgcaaaagtagtaaaattaccggtccaaaacaataaagattggttaatgatgatacaaagtaaaacttgagcaataaaatgtggtcaaaattactaatgcattatacaaccttaactacttagttatttaacataaactttaatatatcatttttatgtaccaaaaacatatatctataatgatttttatggtcaaagttaacttgcgttgaccatacgtattttaaagagaaaatccataaaatgccattgacaagcactctaatcccagaaattccattgacaagcataacttcctcaaaatgccatcgtacaagcgtttttctcctagaaatgccatcatagccatactgttgttaactcctctccattaagttctccattaagttgtatgaaaatacaatcttacccctgggcaaactttttgctcaaacaacatcattttgtattgtttgctcacacaatatcatttcgaattgatgcatatttaaattcacagacgtgtattattttgctatcaatcaaattatttcaaaattaaattcacaaattttgacatcaaaattatttcagaaattttgctatcaattatttcagcctggggccgacggtcgccgcccggagttgccgtgccgccgcctgggagcaccacatcgcagtcgaggtccgtcgcaccgccgcttggaatccccgcaccgtcacctgggagccccacgccgtcgcctagggccgccgcgccgccgcctgagggccgtgcgccgtcgccgggggccacggcgccgccacctgagggccgcgcgccgctgccgggggcccccacaccgcctgcaagtgccgccgcgccgccgccggggaccctagcgccggcgcccgg

SEQ ID NO: 6179 - DNA, 2656 bp, Oryza sativa
actgtgatggtatgtcagggagaaaaacacttgtacgatggcattttgagaaagttgggcttgtcaatggcatttctgggattagagtgcttgccaatagtatttcatggattttctctattttaaaatgacttgttttcaaaatcagagactgtgtttaaagaactgattattcagactcagccggtgacgcaattggtgggtgacgcgagaaaccacaggtgcacagagcctgaatattcaggctcattcaggttcagcgtaggcagaaaccacaattgcagtcactagtcactactaagatgagatgacgactggatcggataagatgtgcgaaatggattgctgggaaaatggctgcgcaaatggcaaatgtgcatgcatgcacaaggagcggcaatcagacagtcacgatcagacgtatggttccggtgtatgagtagctacagtacatgggtgctcttggttggctgcagcgctggctagcctgtgttttcagctatagcccgtcttcaatactgggccaacgtacttatttctggataagatggtgatattacttcattaactccagcatctgaccagcaagacagcaatgtactccctccattaaaaaaacaacttttatatatatgtacaaaagttttctgaatgcataacttgttcatggataaagatttccttttcctacgatgaagaaagcatgggcggatacagtgtattagcactggtacctcagggtattccagtcaactcatcctaatttatagcaagtgacaccaaaagattaagccttatgacacatgtcaatattgttttttttggctttggctacataagttgaatatagatagctacagcctacagcatcaggtgcatgtcttcctaactctttgccttccgcaagacaacgccaatgcaacgttcaactgtactccatgcttctaaaatagcgtttgtgagttattttttcttgccattaatagccaaagaaatagtcaatttccgatttgattttcatcttaattttgttctaacccatttaccaagttgtccacataattaatttcttcaaacactatgattaataaggtttttttatttgagaacaacaattacttaggctttggcctttcaagttctagagatttgagcatttgggattattctcatgacatatacttggatggcatttttttatcatttggttataagcgatgatacgttgccaagttctgtgggctgaagacttctattttgtccataatgttagcctgttaggttcttctaacaaactagtggtgctatttacttgtgcacgtgtacttttagtaactttagtttagttctttacaatttcgtttcaccaattagatcgataaatataaatatatggtgaaaatatgatatttttttaaaaaaatcaatttcatcttgttgcatagtactattctattacttttcatactcattataagtttgctagatgatgcaattgttgctatgagttaacagtgacaccctcgacctaaaatcctgaatccgctcttggaagagcgtgtatatctatatatatttatatatagatatatatatgtatacatatacatatatatctacatacatacatacatacatacatacatatgtatgtatgtatgtatgtatgtatgtatatatgtatgtatatatgtatgtatgtatatatgtatgtatatatatatatatgtatgtatatatgtatatatatatatatatatgtatgtatatatatatatatatatatatatatatatatatatatatatatatgtgtgtgtgtgtatgtgtatgtatgtatgtatgtatgcatgtatgtatgtacgtacgtacgtacgtatgtatgtatatgtacgtacgtacgtaagtatacatatgtatatgtatatatgtatgtatgtacatatgtatatgtatatatgtatgtatgtacatatatatatgtatatgtatgtatatgtatatatatatatatatatatcatatggggcaccatggtgcccgggcaccatggtatctaatgcacaaaatcactcaaattttttaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttaatatatatatatagagagagagagagagagagagagagagagagaacggttctacgtcgaattcgctaatatacgatagggacccggttcctggatggataacaagttcatctttttttaagataatgcacacagcaagttcatgatgcattgggtacacaaaatctaagataagcatatgatacctttctgcttttctttggtcaaaaacagttcgaagatactgaaacagcatggctacatcactattg

SEQ ID NO: 6180 - DNA, 256 bp, Oryza sativa
cggcttcgtccccttcaactacgagaagccgcgccgtcccagcaacggcgccgccaccgccgccgccgacgacgacgatagctggaagtttacttcgtggatttcgacccagaggacactggtggagaaaccctttgtagtcccggttcgtaaccccctttagtcccggtttccaaaccgggagtaccaatccgggactaaagatcgctatctttagtcccgggtgaaataactgggagtaaagatcgatctttag

SEQ ID NO: 6181 - DNA, 1148 bp, Oryza sativa
cgctaccaaaccacgacagatgctagcattacaagttttacaacaagcccaaaagggtttttacttaaactggtccggtctgaccaacaagaagctagagaggatgtagcacagcgtgcgcagtgttcttctgttagtcactgcgggcaggagacccgtcggcaacctggagcgggatcctggaggcgatcctgaggattgcctgggggacctccggtgcggaggggatccatcgctgtcagctggcggcgacctcctgtgaatataaatgctttcagtgtatgaccagaaacccaagaaggcatttcatgaggtaggtactacctccatcccagaattaagttaatctaatactggatgcgacatatcctagtactatgaatctggacaggtactagattaagttattctgggacggagggggtatatttttatatatatcccataagtaacgcacatacgaccaaaatgactacatgagtatgcggaaaatattcgaatgctttcccctaatccaacagcaaggcacaacagccattcaatctttactggaatatcatacactaaaagtctatcgtatgctactttcaaccatttttgaggcgagaaaagcaaaccaatgcagaacttttgcattgcaaagagcaatggaagtaagaagcactcgaacttacttttcataaccattatcagcatcacgccggtccccatctttattggcaggagaataggatctccgcttcttgtctacttcatgttcttttggctgacgcctaggagattttgcacgatgtgtgtcttttctctgtggggatgcggaatagtcatctcgtcgtcttggagcaggagagtatgacctttaaagaaaacatgtaagtgagagaatcatgaatgaagataatggcttaggaatcacatatagcaacaaaaagtaaacaggaactataattggtctaccttgaccgtggacgaccacgataacggggagagcgggaacgcgaacgtgaacgagacctccctgtaagaacagatggatgcctcagtaattcggtgtggcaacaaaataaattagaaaattacatgcatttaagaaaagaaaattaacaaaaacttgagattgaccaatagtactaatctgaaatctgaaa

SEQ ID NO: 6182 - DNA, 1296 bp, Oryza sativa
  unsure (1)..(1296): unsure at all n locations
aacgtgacatgtataattagttgcacatttcaactttgcatggtgcataagcttggttatggaaactgggatgaactgaaagctgccttccgcatgtcgcctttgttccgatttgattggtttgtcaagtccagaaccacccaggagttggctaggagatgtgatacccttatccgtctagttgagaaagagaatcaggaatatgatgagcaagaaaggcaggcaaggaaggacaaaaggatggctaaggtacctctgttcatttcaccttccaagatctttatttcattgtttgaggctttatgcactactttgtgtactgttttgtgtagtactttcttcgtttcacaatgtaagtcattttagcatttcccacattcatattgatgttaatgaatctagaatgtgggaaatactagaatgacttgcattgtgaaacggagggagtatttcttaagagttaggacatgctttggtggttgccatgcttttccacaatgttatgcctgaagtgtggcatatacaatttgtggccattaacaattattgaccacaattgtggtaacatttagcaaaacaatgtgacactggtgctaagaaagcatggcacgccacaagattggcaaggacaaaacgctagtctaatacatatagttgaaaaatggccacttcatgtgtggcaacttgtggcaccaagtcatcaccaacctaatttcctgcaaatggatatatggcttttatagggctggtgcaaagggacatttgatattatgccatccttatgatatgagtggcatacattttgtatcaatctatcttgctaatctcctaatgtatcttctgttgcagaacatgacaccgacaaagcgatctgcgttaagggtttcagaaggtgaaactactccatcgaattctttcaagaggcgacgccagtcccttatggatgactatgtgggctcggtaagctaagctatcatctagtatggtgtcgtgaaatgacaagtcatgcacgttttgcaggaattttacatggtactctgtacttaggaatgcagtgctaatcagctgtactaatattttacagggaaggcgtaagcgaggttgatcgggcgttgcctgctgctcccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6183 - DNA, 898 bp, Oryza sativa
atcccgggggggcctgacaggcgctgacagcatttgaaccgggactaaagatgatctttagtcccgattggtaacacaaaccgggactaaagatcaaatatgcccgttacccttttgaaccgggactaaagatcatctttagccccggtttttattgcatccgggactattgtggaaatcggccgaccgacaaagatggtttctccaccggtgggagagctctacaagcggagggtgaggccgctcgacttcctgcacgccacgctcagggtgttcgtcttcctcgccctcgcgttcagcgacgccgggatccagacctgcctcttcccccaggagagcgcgacgtggagggaggctctggtcaacatgccgctcggcgtcggcttcgtcgccagcttcgtgttcatgatcttcccctccaccaggaagggcgttggctaccccagggaggctcaaactggcaccgagggcggcgccgacgccgacaaagatggcaaggccgagcctcccaagaccaccaccaacggcggctccggcggcgtcgacgcggaaggtagcaagcagaagaacaacgacgactgtcccaagaccaccaccaccaatgacggcagcggcggcggcgacggcgcgggcagcagcgtgcagaagaactctgccaaccaggttgttcccattcaaccctccactaaagagatatcgaacagggctgatgagaagatagctaatattgtgtgataattaagtgtgtgtctgcatgtgtgtacgtgccggcatgcatgcatgcatgatgtttgagcacgtgcatatatggtatatatgctcgtgtattttgtttgaataacgccaggccaggagggatgaaaagaaaatacgtagtgcaaataatatatgtaatgga

SEQ ID NO: 6184 - DNA, 658 bp, Oryza sativa
tcccaaaattaaagttcctagttgcatgatgtattttccacaacccttgtatatgatatattgtcgctaactttatgttattatgtttgtctattgatgcagcgcttgaagacccttcgagtcagaggtcacacggcgcacatactgttcgacgaccggtacgtcccgtacctacggcgggcgcagctcttggcgttcgtgaccatggcgcagcgaccggtgcctctgtacaacgccgctgctctgacggccctagtggaccggtggcgtccagagacacacaccttccacctaccgtgcggggagctgacggtcactctggaggacgtcgccatgatcctgggtcttcctatccggggtcaggcggtcacaggtgacacagcgtcagggaattactaacgagtcttcgtattcatttgctaatttttttgcaattactaatgattccatttaatttccggttacaggtgacacagcgtcgggaactggagggagagggtcgaggagtaccttggtctggagcctccagtggcacctgatggtcagaggcagacgaagacatcaggggttcctttgagttggttgcgagccaacttcggtcagtgtcccgctgaggcagacgaggctacagtacagcgatacagcagggcgtacgtgc

SEQ ID NO: 6185 - DNA, 1528 bp, Oryza sativa
atattgctgcctgtaaatttctgtgatttgatgtttgcctgtgttgtgtgcaaagttttactaaagtttagcagggctgggacgtcagcgccatgctaaatggcgctgacatgtccaaactcaacgccagtgcagaggtcccagcccagccatccagaaggcttgctgggctgggccacggccgaaacggccaagtccaacctcagcgccaggtgggctggcgctgagtgtcgcacggtcagcgccattatggctggcgctgaggtccaagcccgcaagccatccagaagccttgcttgtctgggccttgggggttgcggccaagtcccacctcagcgccagtccggttggcgctgaggtagctgccacgtcagctggggatcggcccggccgccacggtggcacaatgtcagcgccagtcccgttggcgctgacacggccaacgtcagcgccaatgtgtttggcgctgaggcgacggcctatttttggatgaagtttttggcaggggttagtttcgaaataagttttccaaaagggtcaatttgtcaaaaaacctgctagttatgtggaaattcagttccaggtattgcatacatttttgttaatcgattggtgctaatgaactgccgtgtcctaattcctaaaagcctaaaattaatatatgatggaaattcagttccagatgatgcatacatttgttaatcaattgagctaatcaactgctgtgtgacgagattacttgtgaggatatgaacatgcatgaggggatagatggcagatcgcatatgcatggcaaaaacatgcatatgattgttcatctgtatccacccatggggacttaactagattggaaggtaattaaccctgtcacatgaactactttgaatccttctttgaattgaaattcaggaaactattaccccttcgcaggtacgtatatagagctgatgctgatgctgcaacagctaattatactccgtttgttaatgaccgcgatccatacctgaatctgaatttctgtggaatttgcaggattcaaaatgtctttttatatatataaaaaaaaggactatgtttccgaatgctcagacattatcttctgcaacttagctattcattattcatgcagcgatcatgttgtgcaacgtagttacatgtggtgctcgtattttgggagtttgcgaccaatgtatatgcaatcaagttaattatagtttctgtagcactgcaattatcatttgttttgcgcgcgcatgtgaaatttgggcgaaaatggatccttgttttggggagaacattttggatcctcatttctcatctagctgtataaaatggatacgatattgcagcagcttgcaagccataatctgtctcatgtgtatatatgctcccaataccagaactggattgagtcatatctaactgattagatcgatagattgttacatacgtatgtcaaaaaaaaactcatgatcaataagcagagatgattaagtaggtagaagaacaaggagactgacttacatgg

SEQ ID NO: 6186 - DNA, 905 bp, Oryza sativa
gtgattcactgagattttacaatttgtgattcactgagatgtataactttgtgatatgttgtatggatctgagatgtataatatgtgatgtatttggtttgtgtataatttttttaagatttgtgatgtatttgatttgtgtgtacaagtaacttaagatttgtgatgtgaatgttttgggatgttgggtttgatttggaatatgcatcccacttgatttgggagaaaatacagggattaaactctggctaaaaaaaacaatgaaaaaaaaagaaaaggagacctaatgggactgccgctaccctctcttaggtatctttagtcccggttatttcaatcgggactaaatatggacatctttagttccgcattgctagtctcggttggaaaaccgggactaaagtagtcccggattgctagtcccggttgaaaaaccgggattaaaaagattggaatcgggactaaagaggggttaccaaccgagagtataaatggtttctccacccgtgcatgcaagcagcaggtggtggactccacgtcttcacctccgttctgcattgccatcttcgatcttccttgggatcgatctagtaaatcgacagctctaattaattaaaaagtttatagtaagaataatgtcaagcaactctgtggtcaacatcagtcaccagcgcggcggtacaggtcatcgaaaccctcatcagcttcatctggcagtttgactttgtcagtttcatcaatggagaacatctcgcatgatgctaggattgaaaagaggagggagtcacgggtactttattttatggtttcttagggagattgttaattttgggttaagcttgattgattttgtgcaaaattagctattgctccgttgcgattgctgcgttagttataggtataag

SEQ ID NO: 6187 - DNA, 1809 bp, Oryza sativa
tgtgttgcttaaggaacatttgatttattgaattacatgctgcatatacatgcatgcacatacatgctccccccctatctgcagcctctgttctctgaatgtacgtcgatctctgcagatcgatgttgatctattcaatccatgttggttgttacgacttgaaacctatgtagctacccatatttacactgtgtatgaaagcatggaaacctagagctatcaaagggcacacaaaacccctggtaaaaaaatggcagcacaagtacacaaaaaacctctgttctctgaatgtacacaaataacataactgaatattagcatctacaattagcaacatggtaactgaagaaaaatcacactgggtttacattgtaaatgaagcatggaaccctaaaaaagctatcaaaggggcacaaagaaatcctagtataatggcaccaagttttcattatgctgaggctacaacatgaaatctgactcatggcctgtgcaagcaaatgtgcaaatgccaaaatagagaaaaaaaatagaaataccttcaaattgagcaagagatccaccaccacttgtgctctctgagaggatgcagagagggcgcagcaaaagagagcccgagatccaccaccagcactagcccctggatgaggaagagagagggggaaatgaggggatagagctagagaaaaaacaaatgccccaatcgcacactgatttgcgcagttaaaatgcccaaatctctccacctctcccggcacaaaaaacgcacacaaatcgctccacctctccacctctaccggcaaaaaacacacacaataatcgctcccccctccacctctgctggcataaaaatcacacacaaaaatggatcgctcctctctctccggcgcaaaaaaccacaaccacctctgcacgccgcagcttaccgccggatttggtggagaggaaaccgcagcctctgtttccctccccccctcccccacaactaccggcacgatgagagaaaacgtcgcctcaaccgcggattccgccgcctccgccgttgattccaccgttggcgcgacaggacgaaacagccgtaaccttcccccctcccaaaccgcccccgcggctacgtctccggcagggatttggccggagattctcgccgcctccgctctctccctctctccgccgctctctctctcgagcgccacaggaatttttgaacagtgccaactctctctctctcggtcggaaaaagtgcgactcgcggtcgggacaagccgacccgcggtcaggacgcgcacgcgtgccggatgaaggccacgtcgcccgcgcgccgatcgacggctccacgcgcgtcgcgcgatagcgctaaacggagaggcctctccgtttagattatacgatttaatttatgaaaaggtataaaagtaaaatattgaataataaatatatggaattaaataaaagatttaatatcttagatcccgtatttatgagatagatcccatatctagacgagcgaaaaagggaaaatacgaggcagaaagagtttgagaacgaacccaagctgagcagcagcagcttcagacgcatgtgactgttagtatgtgacgatgacgtcacggccccttgctttttccagcttccaaggcccaaggggtcgcttgccgtgccgtaatatccatccatcggattccaacggccacgattacacgtgcgccaccgcctccccccctctcttcgtcacctcaccccccaacccgaccaacaaaaataaaaacgacgaaaagaaaaaaaaaaaaagatcgcgcacacgaccccccc

SEQ ID NO: 6188 - DNA, 1454 bp, Oryza sativa
cggcggcagcttgcgtcggagctcgaccaggtgcgtgggctttccaagcggctgaaggcggccgctgaggccatcgcggctgagtctgcagcggcccttgctttgcctgtggtggtgccgccgcctcagcttcctgttgggtatgcgcactcgcagttcgcactcgctgatcctgtgacgcccatacctggtcaagttgctggtgctattgttccggtccgctcagtgatgcagcgcgggccactaaccgtgtcagtgactcacacagagtccttcgagaaggagaagcggacaccaaaggcgaatcagttgtatcaaaattcagagttcttgcttgccaaggataagtttccgccttcagattcacatggtcgtaagaaacccaagcaccacaagaagaagcatcgttccttagcatctcatggtgctggttatgatgctgagcagaggctatactctcatgcttttaagaaatctatgtcgctgctttctaggctaatgaagcacaaatttggttgggtgtttaacaagcctgtagatgctgttgcgcttggtttgcatgattattttgctattatcaagcacccaatggatcttggcacgataaagacccgactcacgcatggccagtacaggaacccgagggagtttgctgatgatgtacggctgacgttccataatgccatgacctataatcccaaggggcaggatgtgcatttcatggctgagcagttgttgggaatctttgaggcgcagtggcccgaaattgaggctgaggttcagtaccttgcctcatgtccgccattgccaaataagtttccacctccaccaattgacgtgcgcttccttgatcggtcagattctgtaaaacaccatatggtgttggactccaagtcaaggccattaagtcatactcccacttatagtgccaggactccatcgatgaagaaaccaaaggccaaggatccggataagagagatatgacaatagatgagaagcggaagcttagtaacaaccttcagaatttgccaccggagaagcttgatgttgttgtgcagatcattaagaacaagaatctgtctgttagacagcatgatgatgagattgaggttgaaatagatagcatggatactgagacactttgggaacttgatagatttgtggccaactacaagaagaacctgagcaagcaaaagaggaaggctgagcgagccatgcttgcaaggcaggatgcagagttgcatgcacaacatgttgccccacaacaaccagtatgggcattcaatcattcctattcctattctataagtagcactatatagttaattgaattttatgattggtgctgaaagttacagtttcttggattgcagagtcaagagcctaatattggtgtaaaatctccaaagcaaagtaagttagatctgctctattttgtacttcatctaattgt

SEQ ID NO: 6189 - DNA, 3195 bp, Oryza sativa
  unsure (1)..(3195): unsure at all n locations
atagccttcagtagcgacgagtgtgcgacatcttttgcagcggtaagtagtgcctggatcagtggtttctaggtcaccataagttaccccatctgtgtactggtttgtttctgcagggtttggattagccactggacttgtctccagctcagtttgtactgctggtttaatatcagtttccgcgactttgtcctggcttatttccgcaggcttttgatcctccatggatcctggcatctcatcaacctctggttctgactttttctgttcaactcccaattctagcgcctggatggtttccatctcctggttgatttgctcacccctgcattagtaacagttaagacacaagtggtgtttctacagtgcttggtaatgtgcaaacataaataaagtccaagctttgcaatgttgctgttgagatattcatttatgtgcaaacataaatagtgacttttcaattcaaaaagaaaataccgtttctataggttgcagtgaatagtaattactcataaatgaagaacacaactgtattcagtattggaaaggcaaacatgatcacaatgtgctcacttgttatggaccagcgctatgggagtagatacgggtggcgcacacgcgaagaaatgcagcacccagagtagcatagcccggttacaattagatataagatatataattagtaccaattccctaattttggtgagtatcctagtttatctactttgtgctaaactatcaagaatgcaccgtgataanggattactattccattaagaaattcaggaaaggacaatctgccatcctatccagcagcaagatttcggcctgatattaaactcaatagctacaaggattataaactcaatgattggcgaaaaagtaaaacaaaatacgattaacgaagcagcacgaaaccaaatattagcagcagcagcagcagcaaaagattgacgtatataataataccttcacatcaggactaatagtagtaatccaaccaaattctggcccccagctaattaacacagaaacgattgcgggctgactattattatatacatatatacagaaaacaagggttcgtcccagagatgaagacgccaagaagatgaaatcggagcagggaaatccaggattcaaggtacataccctagatgttagatccgaccacccaagcggccgcaagcggagggctccttcgtcgacaccgcggcgcggcagcggcggcgacggctacggcgacggcggcggcggaatcgggagcgctgcgcctacgtctccacggcggtggttcttcttcttcagttccgcttcagcaggggacgaaatattagtgaaaacccaagtatatggacacgcagcaacgcaccttaactcctaatcggaagcagaaacggcccaagcccgtgcgatagttggccggcccattaacgtcggtgcaccttttactcagagtaagtctgtttttcctccctcatctctaactcaagggtataacgcttttcccatctttgaaaacccttctgaccatgttaacttaatcccaccaacaaggggattgagaggatgggaggggaataattccacacctattcaggtatggaattaatcccttttaatctcctccaatccctccttcacgctcggtggttttagaaagtggttttagaagcggtttctaccgatataacagtttgaccatgattgacccattgagtcagcagatgaaacccacgtggtaaagactttcttcgcttctcatcttcttccccgtctctcttccaggagcaaagagaaaagcgaggcatgatagagttattccttaattcgtttcatcgtcggttggtcatgactcatgacgtggatccatagcaggataacattaccacatatgggcttgttggcctccatctcaatcagactaacatgatcatgggactcaacatatactggagctgaataaattatggacaagggcacatcagatgaattttaagaaaaaaacattggaacttcattgtgcagtctccactggaaagaaattccatggatttgacaagtgatatgcactagcatagtagcatacaagtacaagaacaatgtatcaggcaattatcaagaacatatactagcaacgttctataggctattttcactcagaatgttgccaactaaaagacggcactaacacatcggctcactcagccatatttcacaaggcctcatacatgccacaccccatattctcatgcgccctaccatttagtctacaacaccacgatcaaaactccagggaggctgctgcatcagtgaagcatcaattttgctcctgcaaggtacactgttactccaaattgaaagtccgaatgcaaacagcagcggttctgagttctgatccttgtgtttttccaccgtttactgtgaaccccttggaatatgaaaaggagtttctgatacactgaaaacaaaaagagagtttcagtgtggattgtagagtattttatcagtgaacgtaatagcaagagctggtatagtgtaaatatcagggaactaaattgtcgatacataattaaacaatggcgacagttagatgagactttcttttcttgctaacaaagaattataataaaccacattatagtttttaactcaatcttaaaatttgcacggagaggatggtcaagtaagcaattacctaacaaggatgaccatgattttcatgggctgaacttgtgaggtaaacaacagggaattctcagtttctcacatgttgcggacattgcgatggctggctatgcagtcttatctcacctacaaccagaagaaaatacacaatttgtcatagagcattctttgagacatcagttaaattttagagataatagtatatcacgttataattagaacaaataatctatattgtcaagtaccacccttgagttgtatataaaataaaatatccatccattttgagttgtatataaaataaactatccatccatttttaaagtttctactacatagggcatgcccacaatattttgtgggcatgtgttctctaataaggctgtaccatgtccattattatttcaacctaggattaaatccaaagtttaattcatagcattaggtttgactactcattgcattccacgtatgatcaaatcactcccttcattagtgcaatcaatt

SEQ ID NO: 6190 - DNA, 491 bp, Oryza sativa
tgattaacactaaatacaggaaacattattcgcaaacactatatacttaaactcctaatcaactaaagtacgcagtacgtgacacagtcggggagcttgccactacagtgaagcaagctcgctcgctcactcgagcttgcccttgtcttcttccttggtgacggggacgagctcctcctcgccggcgacgatccccttcgtgtgcttcgctatcccgtacaccgtcgcgcccaccgcctccagcacgtcgcccaccaccgtcgtgtcgtcgccgtcgccgccgccgccgctgccgatggtggtggtcgccgatgagttcttgccggactctgccgctcggttctttgcttcacctgctccgtgccctgcctgagcgatcgtgtcgctcgtcttctgcgccatggctgcggctgcgtccttcactgtgtccttggtctgcgccgccatggcaccggccttgtgcgccatgcctcccgttgtgtcgctcgtcg

SEQ ID NO: 6191 - DNA, 1344 bp, Oryza sativa
ttggcagtatgcagaattaatttatttaatcacctctattgacttgaaaagtaaaatctgcggggctaaagagtaaacagaaagcagcaggatgtccaaaaatacacacgtcatcgattatcacaacactagaaacaagatcccgcccgagaatgcaagagtccccatacgctctaggcacgcataagagggatacggatacctccctcagcgaggagcggagcggcgacagagatctctacacacctggatgcgcctcgatcagaagccctaacaggtggacgtgccggaggcatggggaggctgctgcggcgccaattgtggccacggccatgggtgagagaaggagaggagagggtttagggcttggatgcggcggcgatggcgagacggagaagtggggaattctcgacgagacgaggaggggaagagatgagatcggacagggtaaatgggcttcatgggccgcctgagtaagtaagtagttgggccgtcgagctctctctctgctcggcgcgtcggcatcggttcgtcggcaaatggcggcgccagcctacgtgtcctctcgccggcgaatcccacatcctcgctgaccaacgtgtcatcccctcgtgcacacgtgtcaaacccgaaccgcttaagctccaatattttaagcctcccgccgcaacgctgtcccgatcatgtacagcgacccgatcactctctcactgtctcgttcacgtagctcacctgctcgacacaatggcgtcgcagcagcagcagaagcagccgaggaaggcgaagcagaaggaaggggaagggcactcggcggaagaagcggcggggctggaggagatcggcaggtatcgcgcccaggcgcagcagaactcgatggacgccatccgcgacgccgaggagcggtacgccaaggctaaccgggagcacggcggcgcgacgcgggcgcccggcgccaccgtggtgtcgtgcgtggagcgcaagaaggagcagccgccgccgccgccgcagcacgggaagaagcacgaggcggcggaggagggacacggaggcggcaaggcggagaccggcggccaggagggggtgaccgccaagaaccgcggcgaggggcggcagcagcatggcgagccggacgccgccggcgctgctgcccgggagaagagtgctggcgccacgcacggcgccaagcaggccggctcgaccgcggccacgcgcgccgcggactacgccgcggccaagcgcaccgaggccaaagacgccggcgcgcacaccgcgcaggccgcgacggagaaggcgaaggtggccgcggggacgcgccaccgactacgccagacaggccgcagcgaa

SEQ ID NO: 6192 - DNA, 1333 bp, Oryza sativa
ccggcttggcgcaagaggcgcggccgatgaagggaggccggattggcgcgaaagacgcgtccggtggaagaggccggcttggcgcgagaggcgcggccggcggtggaagaagcgacctaggtgtgaggaagaactgccggtgggtgtggcgcgattttcggcgctcgaaggctagccggcgggggacaccggtgcaggggtcccacaggtcggtagagcttgtgtggtggtggggcatcggtgcggcagtcgtggatttgcaggatctcgtctgggtccctttgttggtctagtggcggtcggtcacgcttagcggcggccggtccggtcctagccttctcctgggcttgtgtgttggcgacgtcggtgtgggtggtggtttatttttcctttttcctggttacgaccctccagattgtaatcttgtaatttttttctactctatcaatagaacttcgcaccgtctcgtgcgagtcgttaaaaaaaaatgatggtactgggaacagatcacaggttgcaacgacaaatttatcttatacatagcaaaataatcccaagagattgacatgtgcgcatagtaaagatgatgtcgttttaaacaaccataatttggatggatgtacattcataaccaagtggcagtggcagtggcagaatttgttggtaggaatacctgaagaagagattagtttcccgtttttttgacaaattgacccttttcaaaaacttaattcgaaactaaccactgccaaaaacttcaaccaaaactaggccgtcggctcagcgccaagcgcattggcgctgaggttggccgtgtcagcgccaacgggactggcgctgacattgtgcaccgtggcggccgggccgatcccctagctgacgtggcagctacctcagcgccaaccgcttcggcgctgaggtgcccaacctcagcgccaagtaagttggcgctgaccttggctacttagagcccggccgaggccgccccagccagttcttcctccgttttttccccagccgcccgcctagggttcggtcgccaccgcgttctcctcgcccaatctcccccaaaaacctctctaatcgaaggtgatttgtgcggcattgagtttgggatcggaagagaaggtatacccctctataaaccctaagttccccaaagttttattggatattttgcattgttttggttgtagacgtggtttgataatagttggctaaggatggattattagatggataatatgggtggggatgaagtgtggaggtggcatatctttatccatttggttgttattgatacatttagcgaaatatatttgggatggatgtt

SEQ ID NO: 6193 - DNA, 375 bp, Oryza sativa
cgcgacccgagagcgagagagagagagagctaagccgccgtgcgccacgccaccaccaccaacccatcccaatctctctctctctctctcctcgtgctcctagctacaagaagaaccccctcacccccaccccggacacctacctagccgctacccctctctcttcctcttcttcttcttcttccctcttcttgtggaggcgggtttgacccaagaacggaggagggatagggcgggcggagatgggggcagttcgggggattttggtcgtggcggtggttcttgcggtggcggcgattcttgctggggcggtggaggggaaggtgaacgggaaggctaaggggaagtacagggcgctgttcaacttcggggact

SEQ ID NO: 6194 - DNA, 1881 bp, Oryza sativa
gattgtctccatacatattttgccaccgattcttttaaaacctcgcacatgggttcgagtgggtgtatattatcctcgtgagtttaattcgaatagcagtggcttgaaaacaccacaaataaataaaatgacacattggcacgttttccctacctaacctttttacctttttccaaccatcgtgtgtatcacaaatttcaacatgtccttgttgcggggagtacagacatgtaggaattgctctgttagctgagccatcctttttggtgatccacttctgttatctaatgcttgcttaccttgctggcaatgaccttttttatgctttgtagttagtgctttttaattagagggagcatcagcaggtagagttatgaaatcttctgcatagtttaatggccaagttgggcatcacggttcaatggccttgtcatctctagatcacatccgctagcatttctctttcattgtgtgtggtagcaacaaacacatctttggcccatttaattctgctaatagagactgtttctgtctcaactggtgaagaaaaaggattcagatgcattattgttgattaaaaattgaaaacatctaacgttcttgccttttcaattcaggattttacaagcagctacctagggcatgctgcggggctcctgggtccgttgcgaaggccgcttacaacttcaatgtcacagccaaatgtggtgaggttggtgcaaccgcgtgtgatgatccatcaacccattggagctgggatggcattcacctgacagaggcggcttacggtcacattgccagaggttgggtatatggtcctttcgctgaccaaccgatcttccaatcttcatgagaaagtcacttcttccgttgtaattgtagaggtgtatcacgatagtgcactgaaatggagcagggaaagtagttcttccatatggttccaaggttgcatacatgtatattttcattctattacattcattgcagtcaggtacaaaggtggaatagggctgtcaaaagcttgattttgtttatttgtcaggcgacataactatgaaaatgtaacagacacatgattgtgtaaattgcctccggaaatatgatacaaattgtctttttgagtatctccggtttccctggttcaaatctgccctgttattagcagcagcttttgtctgaacatgttgctgcgttcttgtacagaaaatgagctctgcctgaaagtttatttttggtgcattttagctgcaaacaattagcagaaggtgagggttactagtgctaattgaactgaacatggcgaggtaacgggagaagaatcctgaatatacaattggcagtgatggatgcagaattcagaacagtgcatgcaggtgggagttgaaactaatgaactgatctgaagaatctatttttattattgcgttgtacgttgcttgccatgtgattcgcacttatttttagcagcccacgaactgacgaaccctggtttgttttctcctttttgttgtcagtgtatccctataagttttgaagtatgagctgtcaatggagatatcaaaagatatcgaaaagcaaagaaatttcctttggtactagtaggagtgattactgaagcaagtacatccaagttaactgaagaaaattccagattgcattagtacttcttaagggaaaaaagattcgtttaaacattgagcattaggacaaacgagagacaaaggacatacttcacattccagaagagttactttgcaagtgacacatctcgtgtttcagaatcccacatggtcgtactagtgcactagttacttacgatctgtccaaaagaacgcaattgttatactacatgtactagtacagtatattgtcctactgccc

SEQ ID NO: 6195 - DNA, 2639 bp, Oryza sativa
  unsure (1)..(2639): unsure at all n locations
cataaaaaattattgatctgacaatgttgtacaatctagaaataggcatgacaaattgcatataaaatattgcgtacctttgtagatacatgccggatgtatctacgaaattagtagattaatttaaaaaatcaatctcctaattatcttgttgcgtactcgttcgatatcatgtgatctgacnatcttttggtacgcccgcggagcttgaggggcttgaatgatctcgatagggccaagttgttgacgacgatggttccgatcttgtcgaggcacgtactctggtcaagttagatcctccatagccgaagttatcgagtagtatgctgtcagagaatccatctcttaaacccatctcgtcgaaaccttgaagcaccaaaagatcccttacctggcgcgccactgtcgacgtttgatgttgcgattccggtatttgcatagtatggggatcgttggtgctaggatatatgcaatattgtagtaaaagagatgnggacgagggattttatataggttccggcccctgaatggtcaggcaataactctactcctgttggccgaagccggtattgctcttattcaccataatcacaccagtacaatattgggggtggcctatctaactgtggtcgatttggcgatatgtagtattgactcgtattcgacaacagggtagccttcctcctcgaatccgcatccggcgagatcaaagacagtgctatatctatcctgatggtagccataggcaccgtaggggactagccatgcctatatctgaagtcgatatctgacgtcttgtcttacgtatgttggcttgtctgtggattttttgacttgatctattgttcagggtcccctctcctcctagggggtcttgagtttatacccataggtgttcccttgtccaagtagaattaggaaaaccatatggatacaatccgagtagtccttgtcgtttccatgtagaactctattcatccttccttatacggaatttctcctgtatccgaaggttgtttctgtataagacatggtatgtggtgggtcctgccgagatttagtcaattactattaggtatgtggtatccataacctgacagtttagatctagtctagtcactgtaacacactaaaaagaaatgtgtttatatcagggctaacttaggatgccatcgtttggccaattatggataataaaccaaacgtcgtattagtgataaaaaataatttatgaataaaaactaatgatttaaacgtcaatgttaaaagagaaactattataaaaaaacttaaaataactttaaaaaatttaaaatttttggtatcagcatatacgttacaggaaaaaaagatgtggcccttaaattcaacacgttgataccaattgttggaacatttattaatgcgtcggtcttacaaacagcagtgcatatacacacagaatccccatgctgcacgctctttcctctatgaaccagcttttagggtattgaaaagcaaaagctagcacaaaatacatatagtactatactagttatcattatttttttgaaagatcaaaacatttactgtaattaactgagcagatggaactcacttcagggagactnaaacaagtagccgacagatataaattaagaaagaggctattnatcactctataaacctcgatgcttttgatattgtttcccgaatctgatatgcagatgctgctaggtggccctcatcgtcgacgacgaactgatcatagctcagtgatgctgagggttgggccccccggggctgagcctcttggacccctcgtaaaccgtctcgtcaatctcttctccatcatctcgctgccgcggcaatactgtttcgaccgccgtgccgctagtcctcgccgcggccggcgcagctggcggcggcggccgcggcgggggttgactgacgacggggcggcgaccatgtcgtgaagccggcgatggtgatggagcactgggcagcggtcgccggagacggagacggagacgggagaggacgagccggtgacgaggaggaggaggaggcagaggcagagacacgagagggttattagtttcatctgtccggcgctggtaattagtgatggtgttgatacatgtttatgtagaggtttaagctggcctggaaacgtctatttatagtccaaacggcagtgctgcttgacttgtcaattacgtactggtttcatttttttgattcacaagtatatattttttttaaaaaatgtgttcatcctgtagtatatactacaaaaagagcccaaattatactgtttttattcacaagcagaagtattacgtgcaggcaccatacggagcatatacaatgttctttcttcttttcccctttggcagatttacaagctgacctaactctcaacattttacagcggagcatttagagtttggtgtgttgatgtactgatcgatgtatgtgtatgtgtgtcttttagttttaggagtataattgaaaagagaaaacgtttgaagtttattttgttgttgtttcagaagttaaaattgctttcctaaaaaaaaagagagttaaaattgcttgcatgtatatatgatctcttcatggttctaactcaatcaggtaagacatgggagtgtatg

SEQ ID NO: 6196 - DNA, 1443 bp, Oryza sativa
taatataaggtcctattcagattatagccaaaataaatcttactaaattttagcgttgtcaaaatattggcaagatacaatattatcaaaattgtagaagtatttcttatgtatttaccaaatttggcaacaaactaaatatagatatttttttagcaactgtgccaaaaaaatggtatggttgaaaatggcgtcaaactgaaccggtcctaactttttggaagatttactttgtttctacaggacaatatcgatacacgtatagatgtttttattcacatataatatctatattttactagttaattattcaatttttatcgattacaataattttatttcgtaccttacttctttcttatcaacgatcaacattactctacttaatttgtaatacttccaagtacgttaacataccgtgaaagttctcatcaaatacatttgacttgagggagtagaaagtactataatttgtatagtacaatcatatcgtacgtcctcggcaagaaagaaagaaaagcctttatcgtacatttgaattagtgatgctgatgcgagattaattacgtactaattagacgcgcgcagagcacacaatccgatcgggctatgcgtcgtgcaaaagcaaacgcggcatcatcgatcatatcgttctatatgcaaacgcattgctgtgttgttgtgtgcttcgaaggccgtgcatgctccacgcgactaattaacgatctgctcattgatcaccttgatcttgcttacgccatatagtacataatgtaactgtatatatagagctagcttagctagggtttcgatctgctaattgttttttttctcattaacaattgctgcgcacacgcaattatcttgagaacaaagcaacatcctgttttttctcgtttagatggatgcgttgcatcgtgccatgcgatcgatgcatggaattaaaataacccttttattaatgaattcaaattcatttaagtgatgtacgcagtgatcgatatatgtaagggagagtgatgatagataagggagagctgtgtagagatggtactctcccagttttgagtgatctccaatcaaaagtagcattgcatataggtcggttcttggcctgcagcatgcttggaatgcagaaatttgatagtgcaaaattaagaaggatgaaatccaattttagtcattatacggttgtttttcaacctcaattttcaaaaggaacagttttgatttactccctaaactttgagcgtagtccgatttcccatgaactacaacaacaaacattcgatatctgtgaactttaaaaccggacgaattatatctccttgctatctaatcaaccatataagaaagacaatttatataaaaagatctatctagacacacctatcattcattatatatatatatatatatatatatggatattcttttctcttt

SEQ ID NO: 6197 - DNA, 766 bp, Oryza sativa
agtctattaggacttgatatctaactggtatcatcctgtttttgaacggattccggtatatagcagcttttttttttcaatgcacggtatattcatcagctggttggttatttagccaagaataaaaagatagaaaaatgttcttcctaggcccgagggccgagagctgttcggtatggccgggtggacgcgttagcccttagcagcttattgggcctgaaaagccgaaacagtgaacgtcgtacggcccattaaagcccaggcccaaaagagcccacccacctcctctcttatctatgggagacgcgctctccctctcgcctcgcggtcgcctcgctttctccctcgccaactcgcctaccctccccacccccgcgtcggcggcggcggcagcggcagcggcagcgacggagcctcgccggcggcaagcgtactcacccggtaaccctggctcctccccccctccttctccgtacctcgtatgcgtgttcttctgcgctcgtgcgtgcggtgtctgccgccacagaaaaccctaggtccgcctgcggcgtgtcagcgagctcgcccgtcaccgcttagatccgcgcgggattcggcggtttcgcttgctggagatgccttgacgagcggtttaacgagatagggaatgttctatttgtttttaccccgtagctgcaaggtttctgaatctcagatcccctcctgccatgtcggggttgaaggctagggtgttgcttcagagttgtcgtgaattagtcatatatgc

SEQ ID NO: 6198 - DNA, 9836 bp, Oryza sativa
aaaatcggaagacttgaacttctttcttctgacctatgctatgtgcacggtcttgttcttgcacatcagcttgtggattcctgaagacatcaacacattaacactaaatattcaacatacatattcatgggttcagaagaaaacaatttgcacataacagcataccaatcactatcataaagaaccacaacatcagcagtagcaaggttgatgccaaggccaccagccctggcgaaagcaaaaaaacaaacttttcactgcctggtttgttgaaagcttcaatggatgcatcacgatcttctccaccagtatttccatctatccggcaatactgatagcctctgtacataagataatcttccaatatatccaaaagcctggtcatctgtagaatggacataaatgtcaaagtcaaacacaagatttgaagaaaccaaattatgtgtgacgttaacatgcttaggaacaatagagaactcagatcatatccacacatgaattatgtacatgttatacacagctaagtatcataaaatcaatgcacgtagtataaaagccatttgaatctcatgaggatggaatataatcacctgtgagaaaatgagcaccctagaatcacgatccttcagtttgggcagcaatttatctaacagaaccatttttcctacagatattgtgaggagggaaggttaaatattgaactgtacctttggcaacagtacaatggaaattgtgacatgaacataccagcattctcaactagatgttcaccagttgtgtaaggtggaccagttctgctccttggaataaatatggatggttgcagcacttgcgcaactgcatggctatgttaagcaatcttttgcgttcaccaccagcattaataacctccaaatctttctgaagcagggcacgatagtactgcttttgcatctgagacattccaaccttaaggatagtttcctttttggggggtaatcccttttcaacatcagatttaagccttcgaagaagaaatgggcgaagaaccttcatagaagaatttacatgaatgaactatgcaggttgtcccaaattattagcataatgagccattgagcatgggagttatattactcaccttatgaagctgttgaacaacctcctgctgatcattttcaccagaaatttgaaaccattcatcaaatgtttcagcagagctaaatatttcaggcaacaagaagttgaggagagaccaaagctcatggagattattctgcaaacatcaatcatagcatcaacgaattatcagaataaaagcaaaaaaatgcttgaggatgtaaaccaacataattactttgaccatggctacagtccaaaaaaagagcacagccaggggagacctacctggagtggtgtgcctgtgataaggagacgataattagtattataaatcctcattgtcttggacagaagagaattctcattttttatgcgatgtgcttcatcaataataatgtaacgccagctgaaacgcttcagtgtagttttttctttgattgccatttcaaaactagtgacacacacatcaaattttcctggctgcaataggttctcccttatatggttctgaccaaacagaatgcaaaatgttcagtacaacatcagaagttgttcataagaatggttggagagcggaggctaagtaaactaaccctctcttctggattccctaagaatttcacagcacgtagaatagggcaaaaccgttgaatttcctttatccagttgccaagagtagactttggtgcaacaaccatgtgcggaccagttattcccctgaattcatgcagatagcccagcagcgaaatagtttgaagagttttcccaagaccctgaatgatgattttataagtataagcacagtatcattcaataatatattggggacattttattgactttggcttaggagtacacaactaacataccatttcatcagccaatataccattgataccattctcgtacaaccgtatgagccaattaagcccagctagttggtagtctcgcatcttcccctttatacctgcagagcaaaaaatatattacattttaacaatttattattcaacttatattaacagaatggtggcagcatactcttatgatacagttacaaataattgtgaagggaaaggagctcacatgaaggctgtgaaagcaagcgtgttccccctgaaccagcaagggcatcttcctcttctttaaggtattcttcatcttcctcctcttctgtcatctttgaggcatggcgtcccctacagtttaccaatgttagacaatcaaatcatggaacatcaaaaaagaggcacaagattcctaaaatcaattacatattatgaccctgcacataaatagcaggtgatgtgtcccaaatgcccataagaactataactatgcaaggttaattgtatggctaaacaaatgtattcagaatttccttaatcccacaaattgaagtaataataatatagttaaaataaacattatgttgcattcttaaaatcattaattcacaatttcgtaataccaaccagatgaagagaccaacaattactgatatctacaaacatatcaaacagaaatgtttaccatgtacgtttgaaacaccagtccttcagtatggaattattttaacatattccagcatcaaagtacacattctaaattatatcccagttccagcagcacgacaaacaacagcaaagatctatgcaatttccaggatggttgaacacacaaagtaaagtactatctacacaaacaaaaccagttttaccttccacgcggtttcttctcttttgattggttccctttggcaaaatgtgcaaatatttcagtttgctgcagtaggtacttcaatcgtcctttccctttattgttctgttaaaaaaatattaatcagggcaaaaggcaacatacacaaaggtattcaaagcaggttgaaataaattatgtgcacatgatatgccatatcatgtgctgaaaggcatttgtattgacggattcttataggagcaaaccatgtcagcatcaactgcagcattctgtgtatccaatatttcttgtattttctgcttcttcaatttctgcatttccttgagcctggctttctcacgtttccctactactgcacctccttcagcctgtaatgggaaaagttaggcaggactcgacaattcagaaactaaaccctacttattgctcctaataattttgcgtagaaatacacagaatgacacttaaatgacagctacattgcagcacataatgcaaggaaactcccactgttaacacaaccttaattcactgacaacaaaatagaggcaaagctagaaaaaaaatgcaggcataggaaatggccccccaaactcgtacaatttacagaagcagctcaatatattaccaaaatattataaatctaatgggcaccacccgaatcccggttcgaccacccaaaccctagccccctcagctcacctcatctgcgtcgtcgtcctcccccacgacggcctcgtcgtcctcagtggactgcgactcctcatcgccctccccgggggcggcggcggccgcaccgctttcctcctcttcctcgtcggcgccggcaccggtggtgacggcttcgatctcctcctcatccacctcctcctcttccccaccagccgcctcgccggccgccgccgcgggcgcctcctcctcctcctcatcctcctcctcgccagatccggacccggcgccgtccgactgctcctcctcctcctcgccggaggacgagacctcctcctcctcctcgtcgtacttcaccggcttcgccattggggcggcggtggcgggctagggtttcgtagattcgattcgagcgcggaatgtgtcgacggaggcggtgggggttcgaaggaccgagcgatttgggggaaaagggaggagagcgcagctaatttatacgagtggccttgtatccgcaattttttggcagtttgcattttgccccttttctattgcagtattgcatattaatcttacattcgttctaaaattttgatttttttttttgccaggacataatgcaaactacgtgactttctgaagtattagctatttatttcattctaaattctactagtactgcaaataaaagtaatctctagtggaattcaacataattaagcctcgttgcttctattgagtcctaactgaaaaataactatgtgaactcgtagagaaaatattataaattttaattaagcaaaaaagcacattattgatactaattttcccaaaagttttcgggcttggctacaaaatcctcgaggacagcagcaaaagatatgtctgtctcaaaaagaaatactaccagcggcaaaagtggaagtgccttcatagccgatcggaggctatggaacgaaatactgacgtgtcagggatgcatgtgaaaaaatgcagcacgaaatgaaattctcgggagcacgagcgcgagggattctcccgtgaacgtggtccatggcgagcctttcctcagtgggtcccagcgtcagggtcacagttccggtggcctaccgaagaccacgcgtacgaagcgtatttagcaagagggaagtgggcggggctccgttcccgccaacgaggcggggatgggtttgaggcatcccgcccgccgactttgggttcggatccgtccggaccggacgaaggcggttgggttcgaccaggttttgcattctggtgcgaccgacgaacggcccgagcccacggttggtagctgtgggaccatcctgtatagacacgttcgaagtcatgctgggccagcctttggtattggtagccccgtttttcttttggtattggtattgttttttcttttggtaaacgatcgaaattccttttttttttgttgataggacaaaagttgccgattcactctgataactcctagagttcccttggttcatgttttgtaaaaggaatagttctatcgtataagatttcttattataccctggaaatggatttttgtcctttgaggggacatcctctcattttatgtatggcgttcagaaagttattaaaaaatttattaagatagattaatatatgatatatctttttgtaaacatgcgagttaaaattcgacttatacaatttgaaacaaaaataacaaatttgactgtgaattacgctttctattcatagtcaaatttgttatttttggttttacttgtataagtttaattttaatatgtatatttgtgaagtgacatatcatatattaatctatcctactaaattttttaatgactttttaagtgacatgaaaaagggatatctcttatgggtgtttggcaccctattttcccaaccgatctccctcgttttccgtgcacaagtttttcaaattgctaaacggtgcgtttttttgcaaaaaaatttctatacgaaagttgcttaaaaaatcaaattaatctatttttgaaaaaatagctaatacttaattaatcacgcgctaattgaccgttccgttatccgcgcatatttcggttgggaacatggatgggcgaacacaccctaagggatgatttgagatttccattataccttgttttttacatgtatatagtcttctcaactgttcaccaatgatgatgacggccccatcgtttggctttttctctaataagtcaaaacggggcttattagggaataaaaataaatttgtatataaaatttttatagatgtgttcttggtgacttaaaagtcaatgctgaaaaagaaattacgttgaaaatatctcaaaattaatatcaaaattaagtttgaaaatttaaaatttggctttttttttggctgaataggccatccgatgggagcctgattcttgatgtaaagttgtcaattcctttcgttcttgtagctgttttgtgtttatcttaataaaaatgataaacaggtattgaagtagtccaagaggcaccaaatggcatctctagcatcaaggagattgagatatttttgttgcttggtgggaaaaagatttggcaaccgattaaatttggagagctgtcgccgcgttgaatgcaatcagggagcaagatttggacaagatgtcatcatcatcatcatcgggttggagctccaagaaggtgtgcgtcgtcggcgccgggatggcggggctggcggcggcgcgcgagctgcggcgagagggcctcgacgtgacggtgctcgagcagagcgccgacgtcggcgggcagtggctgtacgacgcggcgaccgacggccgcgacccgctcggcatggccggcgtgcacagcagcatttactcctcgctccgtctcaacagcccgagggaggtctgcggcttctccgacttcccgttccgccccaccaatggcggcggcggcgacgcgcggcggtaccccgtccacggcgagctcctcaggtatatccgggagttctgcgacgtgttcggccttatggacgccgtcaggctcgacacgacggtcgtgcgcgtcgccatggcgccgccacggcgcgacggctcgttgcggtggacggtgaggagcaagcacaacggcgatgcggagacggaggaggtgttcgacgccgtcgtcgtggccaccgggcaatactcccagccaaggcttccaagcatcgacggcatggataagtggaggaggaggcagctgcatagccactcgtaccgcgtcccggactccttcgccggcgaggtcgtcgtcatcgttggttgcaacttgagcggtaaggaagtcgccctggagctcctccgcgtcgccaaggaggtgcacctgagctccaagtcgacgaaggaggccatgacgccgtcgatgtccaagatgctcgccaggtacgacaaccttcacctgcaaccactggtcgaacacctgtgcgaggacggccgggtggtgttcgacgacggctcgttcgtcgtcgccgacgccgtcatctacggaggggaaggtcaccgtcgacgacaaccgcgtcgggccgctgtacgagcacgtgttcccaccggcgctcgcgccgtcgctctccttcgtgggcatcccggtcaaggtgatcctgccgcggttcgccgaggtgcaggcgaggtgggtggcgcaggtgctgtccgggcggaggacgctgccgtcgccgggggagatgctgcgcgccgtcgaggagtacaaccgcgccaaggaggccgccggcttgccgaagcggcagacgcacgacctgttcttggacctggagtactgcgacgagtacggcgagcgccactgcggcttcccgcggacggagcagtggaagaaggagctgatttggtcgtccatctccgacatgtgcgacgacatcgagaacttccgcgacgactaccacgacagcgacatcgtccgcgacggccggcgcctgcacggctgggcttcctctcctcccctcgcgccgcggccgcaggagaaggacgacgaccatgacaaagaagaagacaagcatttgggatttggccctagtaaattcagcttaagataagcaaacgaaattaaatgaactccttattttgttcactttatctaattattattactaccgtagtttactactccctccggtcataaaaaatatttaatgcaatcatttatcttatcaataaaaaatatataatattacttattttgtaataacttattctatcactaaaggtacttaaatttttatttgttccaaaattttttatcagagaatggttaaagtcaactatatcaaacatatggctgaatcaggtgtacttaggacttgtttggatgactactccaacttgccaagccacaagtttggtgaacgatttgagagccacaacttagaccaaaaaacatgtggcaaagtagttcatgagcacataacttcttatggcaagctaatatgtggtaagcaaacaaacaatatgctaactacctgtggcgcgtcaaacttgaggcgccgcaaactgtggcacctatcaaacaggcccttaccaacaccagaagtttcattttatgacactgtcatatgactggcagtatgtatatgtcacatacatacaaacttgtgcttctgagaagcctccccgtggaatccatgcaatttttctgatgcaaatcgtttttcagtttatttctataagggagtttaccatgatgtaaaagaaaacctgtttgatcacgtgatacaagctataagtataagtatttatagaactagaaaatgccccacacattgccacgggacgcaagattacttgtctccaacattagattaaagcaatgcatggtatatatttatttttgtatggttatatgatttttataggaaaagaaatgtattcagtttgaaaggaggatgatcatttgagggtttgcagtagtggacacaaggattttccttcatctgtaccattagtttttttttaatctatatctatactaataaaaaaggagaagttttgcatagcaatcctaccgtgaaatcaaaggaatggcagcccacacatgggatccctgccaccgcaaattcctccacgcgagctaaatcctcagcaaatcgcttcccccaatcacgccgcgcccactatatccctaacatgcacctccactctgagccacggctgcggccttgcgatggcctcatgctccaatccctagctatcccttctcctaccgtctcgccatcgacgaccaccatatcaccctcactatcccctctcccacaactgtgtctaccattgttgtccctgaaggaggaagcgcggaagcgccagcttcacgatagcagtagaccaaggatcccttccattgaacctacatcgatgactgaaaagtcggcccgcttccctccctgttgccgccgcggtccccgctcggcaccgcatcacggtgacagcaacatcagccgccgcgcgccggacccaaaatcagcgatgtccctgttttggtgttgtccatctcgccgttctgtggcactgtgatgtagaggctagggctcatggagcttccttagtcacaccgttgttgcatgaatacaagagcgtgagggtccttccctggtcgcgccatgagcgagcgcgcggtgttgcatgaatcagtcgcctcactgtttttccaccatccctatatctggaggcctcactattttcccaccttcgcactctagagcgtgcaaacgacagaaacaacaaatcgggctcccaatctccctttctcaagctcacatgatatgctttttattgccaacatgtcatgctttcgtgggctcttatatgatagcttccaacaaataatttagttaattttactggcaactctgatattcttcaagttgttaggaatggagattatgaacttatcatgatggacatcacgttgggtttcaatcattaaataatgcttcaactgaataatgtgctatcaaaggttcgtcagtcaaaaaatggtgtttatcctatttgagtgcgaatcttcatcatgctacaagcaaataagcaatgtgctgtgaaagaacccactgtttgtttttacagtatacaattccaatcccatttaattgctaatcttttgcttttgattgagttactgtaacatgaagtagcagatatttatttattatttttaccaggctggtgtctgtttacttttgtcggtgacatgggaccggggatatcttgactagaggtttggggcagccgcggtcacccacgtggcctgaccccctcgggggggtcgggcccgagggtgatgaggccgcccctccctctatctccccgaggggt

SEQ ID NO: 6199 - DNA, 17017 bp, Oryza sativa
  unsure (1)..(17017): unsure at all n locations
cccctgagggtttggcgccacgtgtgtgggttaggtgagcacagcggcgctcacctaaccgcgtttattgcgggttggacgagcgccccacgccgcatttaatgtagcgcagcacactcatccggtccgtgatcggtcacagtgtgtgaccggtcacagaccggtcagatcgcgggttagggggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctaaactgacacgtggtggacaagaatgaccggtctgtgactggtctgacgccggtcgcgtcatcggcaaacaaccgtgcttccacgttgcacctgcttccggcggagtggaggttggtatgacccatcccatcggagggtcattcggacaacagccattgcaaatctccgcccattaatgagggaggacagggttatcccggtgtcaggcaaaggtacgagccaagttttggtcaaagtaggatgggtccccacccaaaagaatggtaggtagaaatggtgtatgtggtatccccttgagatataaaaggaggaccatgcctaccaagagaggggacggacaaaaagactggagaagacctgagctcgtagaggggactggggaaaaagagtagggagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaccattccacagatcaagggcttagaacctcacccagcgcccctggccgaaccggcaaaggggggcccgcgcggtctcccggtgaggagccccacgctccgtcaactttgatttcacttgtttcatgttgtgcggtacatggtacccaggtacacacggcaaggccttgggccgtgaagcatggggtgggccgagtgccctaggcccatgcggactgcttggtgattaagaaagggattaaaagacaaggctatagatcttatcgtgtaggcacgcggacaccgcacgatgcacctccccgaatcgtggctgctgcacactactgaacttgtgcaacgccattcgtccaactcattgatcccacggagcatgttgcaccacgcaatgcgaccgggcagctccgcgtcgcgccagcagtgtcgcacgcaacgggccagtccacgctatgccccactgcgccgtttctctcggccgaccccgcaccgctcctctcggccgagctcgagccagcatcgcgctgtgccaccatctttcgcaccaagttgttaacgccaaaatttggtaagcccctaggagaattatcacattatcaatagttggattcctgctatattcggttaagaaaattaatttatcaaatgaagcttatccagaagtgaccgagttcaaggaggatgcggcatgccaagttatctattaattaggaatagtttgttagtttctttttatctttaggaaagtgtgtttagtgtcttataaggactttatgttttccttttatctttagaaaaatttctttcttgtcctataaggactagtatctacccatgggtataaatatgtacacccgaggtcattgtaaatcatctctcgatcaatactactctcggcgcatcgccaccctctttcccgaggtttttacttatcatccggcggaatttggcacctgacgcggggctgcatcggttcagttcaatctccggcgaaggggtaagtcctacgttccgccggccctagtgaatctattggctacgttggtgttgttcaaggctgcatcgcttcgatctcttggatcgctctggtttggttgatatatttgcctacctgatatctcaattctatctctaattgcattatgtttagagacacatcggtttagttggaactgtctcggttaggtctgatcttctgtcttagccgacatatctctacaatcacaatgctgttgtaaatagatttgttctatccatcacattagacagatctattggctcatcgagtattagattatcatatacaatcttgtgctgcatcggttaggttcgacctactagattgttgataatataaatcggttaggttcatgctagtgttttatcaggatactagccgataagttttttggacgttgcattggcttataaggattgcatatacatataagttggatttagccgatgacaacagaggtttcattgatttatctaatctcgtggattttatgatatcggacctctagccgatgtatgctttaaccatcggatcagtacttgttctatgatatcatattgttagccgattggtttttctactggattatattattgttatattgcatcatcatcagccaactgcctttatatcattatctacattggatatattgccaatagctcaaaaccctatcgatatcggctggaattactccattggcttgtcagccgatcggctcattgatctgctatttgtatatcttgtcagttgcagggtcaaattgactggcacgcccgcatcctatcaacctttggactgtactggagctaagcagatctcccaggccagtgtgtgtttttcgcgtcaacacaggtcgaacccgactgtgtgacgtgccaagctgcatcgcccttccccatgtgctgcaccaatcaccacccatatccccctcgctgatgttcttcctttgactccctcgcctcgtcatcgagtctcatccccggccccgctgccacagcacatcactgaccaaacatcaacacaacagatcagcatgccgccactaccgaatatccatctcactgagcagcaccctccgctccgtagaaaaatcaccgcgcctcctcacctcggccggccctgcctcagcattgtgtctcgtcgctggtcccgcatcactgccaccgcgcggacccgctcagccatactgccgctgcgagatcgttgacccaaaacaccacgcgcgacctccttctggcgccgtctcctcctctgcacagaagtctagcgcctctgtcactgttcagccccgcttgaccttgctacagcaccggataagccgactcaacggcgaacaccaagaatcgccatctcgccacaccgtccatcccgccgctcagtgaatctgtggtcgagtagccaaccccctcctcggcgccaatggattgcatcgaacaccaagaagcggacacccaacactccttgttcaccaccacaaccacgccacctcaccatcaatccaatccagaagcttcctatccgtcaccgacaagtggaacccaccgtctcgttgcctccccattccacatcttctcaagcaagccttcgtagcctacaaataccaaattcccaaactctccgtgtctcggcccaaaccgagctcaaactcaagcgagcatccatggtcaccttcctaaccaccaccacctagctgcctcatctctcttttccttcatccacctacaccccaagcttccaaaagaccatcgccacagttgcccaaccttcccttacactagctcggctccaccattctgcgacaagtactggacattctgttgaacacctaattggcatccaggagcatgcagtcctattttttctccaccgccactgtgatcggccacatttcgcccctgcttcaccatggtaaaataactctctcctttagaatccccttcattccctacatttcattattcatgtttcctcgaccgattgcaccatctagaaccatcaccaccctggagcccttcgctcgtgtcgcttcctccctagagcgacacaagaagcgaccgaaaaacaccgccgccgcttctccttcttcctcctcccaccttgccgctgctcgagtggcacgtcggcaaagtcggccgaccatgaggatggcggcatcagggctttcccctctctctcaaggaaggatgaagaggtgatgccgcctagatccaggccctgctcgtcctgatccggcgaggagcggtgagagggcccccatcagatgatttggatggtggccaaggcatccaagcttgaggagggagtggggcatcaatagccaaatctggatcctgcgcagccagacccgatgccctagtcccactggtggatacggaacatccacgctgaatttggccggagttgctggagcggtggagcatcagcagtgggaggcctacacggacgtctacgggggaggccctggcggttggtggcaacgggatgctgtagcagccagtggcaaggaggtcagcacgagcaacaatggcggaagggctgtgacggctggcggcaacggaaggctcacccgactgtggtggtggcggggccttctctctgggcgcatggagatgcgcaggggctgcaaccgcatggcggatgactagcacgcgtggacggcccattaatttcacttgtaaattgctttaaattttaatataaattctaggaatgatttatttaatgatttttaaaccccaaaagaaaattggggtgtgacagagctctcctccatgaggaataagccattcggggcagcggttggcttcgaggaataggcggttgagacactcctcgacatggcaaagcttttgacacaagtggcatggggcggcggtgagcattggacagaggatggcaacaagcgacggagcgaggacgcagcatggggaacacaatatttggtgcggcgagctcgtgaaggtgtgtgtgtggggggggatgtctagtggtcccttttataggcttgaggggccatgaacaaggtgggagctgcggtaaccgtcagtagatgtaggtggcgatgtgggcagggtgtgggctcaagtcagcgcctatttttgtcgggagagagggggatgtgggtgtgaatatggcgatgaccaaatttgcgttgtttgagagtgagggaaggagcggggctcgtggatcaggtgggtacgtgggagctacagcggtcgtcgacttcggctagtggtaggaaatgagcctgacaggtgggcctcggtcctacctatcattgagaggaggaaaggcaagccaagcatgcccggcgtgggaggtgggaggaaaggctgaatcgggtgtgggtgagatgggctgacaggttggtgaccccaaaaggagggggcgtgctgagttaggagttgggctagcaaataagactgggccatggggaaagagaaacaaagagagatgttgagcgacctgcgactgcgagagagaggggaagaaggaggagcgggtgggccagactactattggtcacgtgcgatgaggagtgggtcggaaatgatggcccacctggaaatgaggacttttaattggtttttcaatttaaatattctctgaaatggactttgtgctattaaaatttgatgttgatctctgaaaattctgagaaaattatattaattattttagggcatggataatacgagaaaaatattcccaatcatgatttattaaaggaaatgttattttctgaattaacttcacttgtaaatttctttttattttaatataaattctagaaataaattattaaatgatttttaaatccctgaaggaaaatcaggcatgacttactcctacctcggagttaggcctctaacagtcaaaaattctatcgcaggtctataaaactaactagatcggatactttgatcccaacataggaaactccgattttaaatggcaagccagactgagaaccaagttcctcccacgaatactcaaatggattagacagtccgatagaggtcggatagtgtgatgttgctaagataaaaatataagaactttttactccagagtttgattttgatgatcttggattccatgtaaaggttggttatagggctatcaaatccatcataaacaattgtccaaagataaatcattttgagaacttaagcaaacacatttgtattcatcttaccagtacaacattcctatactcaatccagatnttaattaaaaacaccgagaccggtaaaggatttgaaaaaggatgcttagtttcattatacctttgccttgtgcttcttcttgtggacttagctggacaacgcataccactctgtttagtcacattcatttattatgatgtttggtcacattcatttcttccagccacttgatgcctttcaacttatgacgatatcaatcactgttgatgtggatcaacacatgattcccatgtttcagctcttcatcttgagacatacgtgactgttgatggtcattatcgatcagtttcgaccatcaatattatcaaaataaaggagaactagtgatgcttgcaatacataaatatgttagatattatcaggggaggttgggccgaacctcccttgacgctgttggatccaggttttggctggacggcatggatcactccccaataacggttggagggcaattccgaccattccaactaccacaaccgtcattggcagcctatttaaggagctcctctcctcacttcactcacacacctcaagcaagagctctctcattcctctcaagtttagtttagtagtatctagctggtggaatagaattagaataggaatcaggagtctggaagccttcggaagagttcgggtatggctctagtagctttcctttcctcttttgtaagctttgtactttcattagaatactcttctagatacatttctggtattgaaatattttccgagtatatgagtaccttctttatattatgttcatgttatactgaatatactgctagcttatctgggatatgctttggtgcaggtatagtgtttgcttatgcaattattctatatcatgacgatgatattagagtagtatctggtaatttagacgtggtgtctagattacgggatatcattatttggggttatatattgcggatgagaggtgggccgctgatggtgacagctcagtacgagtattcctccgtgcctatatataatccttagttaatttcctggggagggtattcctctgtatttagccccggttggatggtcatgacgggctgtcgtaaagaactcgacagtcaggggtggcttctcgaagtaccaggaaggcatcggataaatggtattagctagtatatcagttaactagaatgtatgtatactatgtatattagaagtataggaatagattctctttctcttttctttccacctagcttagattatttattatgaggataagtagaaaagcttgtgtgtcactctacccttggattatcataacccctgcttagaatatgattatcacaagtaatatataaattattagttgagttctctctacatgatctttccacgtgataaaataaatacgatacccttggaatactctcgggtgaaatgctataatggtatattcgtgtgcttgcggatgaactctgtaaccataatataccagaagtatttctgcgccattgctgggaattatatttctagtaacgtcgttaagaaataccaacagtgacttgatctcacttgagcatcaacattattttcatttcttggtatctatttctttcattcaactcaataaaactgttagtcccaatgatctggtagtcaacctccacttgttgaccaaccgatcgcatataaaatgatatgaataaattgatgaaaatcaacaacaccacaaatgtcatatactcacacatatacacaaatgtaaagatctcaattaaataaaattgattaacttggatcacacacatgcataataaaatataagatatacttcccccaaaatatatgcatacaaaatatttcgagtgaaataggtgtatgcataatttttgatgaatccatgggagtttatcctatacaagaaaagaaagcatgtgtaaagagagtatagcttgatttcgatgtgtttcatccttattgagattaaagtcaaccatcaatggatacatttctatcccaactcatatgacatccgagaacaacctatttgccaactcatggaaaaaagtaagtcacagtaacctggtttgtcataaatcaccagaacaacatttacacattattgaccatagatcttttgatcatttccgttttggtgttggatgacaatccaatataaaatatgatcatttcctttttggtgatggatgacaatccaatataaaatatttagagttcctcaccctatttgggaaccattagagagataatttagaacacgaggaatttaacacgtacctctcatcatttttatttttcatattaattgagactatgcaaaataaatgtttatatataaaagataatagtatcatataattggatttggcattagtcaccaaaactaatccaattgcacttgaacttacatcgtcgtcgtctgagttaccacgcccgagccgccacggtggtcgagcaactgggggaggcgcttcaccagcactggtatggacttggtggtgatgatgaaggagactcaccagcgctggatccctgtggcggtgtggtcgacgtcgtcgtcaccctccccttcatcatcgccgccgagtcctccacttgctgaggctcaccaaagctgcctgctactgccagatcttgcggtcccgaggcctaccaccgtcaactctgatggtaccgaagctagcccaccaccgtcgttaggatctttcgctggtagatccaccatcctgagctacgggagctgcagtcgttgccggtcatcaccattgcctttacttgcttcctttcaatgtggagagagagagagagagagagagagttcatgaggtagtagtacggtaggcctgtttcaaaataggaagaggagaggaaggagaggcccgccaacacgatgactggctgctgtcgttcgggaggagagtgctggggggagggggggtggtgtcggtgacggagatggggatggagggaggggaaaaggagaagtgaggcaagggaggggctggccaggtttttcttttatttaagttggggttagctagaccggcctaaaagtcatctagaactactcctaatgtgtggaaccattacggataggagatacatctgtaacggctcctacaggagctattacagatgaggtgcaaccatttctaatggctcataatggaaagccattacaatcatgaggggctcgtttgtaacggctcctcaacttaaactgttacaaagttggtagatgacatatgtaacaactccatataactggagtcgttatagatcagtgctaatccctaatggcttgaatgtcactcgttatagacacgtgatatgtagcggcgcacttaagcccatcatagataatagatgtgaggatatgtggtagtgacaattaccgagtgtttttcactatttaattaccatgtgtttcgggcacaagggagagattcccttcttagtgtctgtagttttgatagagatcacgattactgtgtaaaataccatatcatagatggattttacgaaccatagtaattttacattccctgtggaggtaccataagctaccaaaaatttagggtaaaatttggtacctcctagtacctagataccaaaaggtaccaaattacaatagaaaaagtggtacctcctcaagtactataaaattgctcgcaagaatatatatactactctctccgtcctaaaatatatgcatttttagcataatgacaagtcaaacatttttaactttgactattaatagaaaaaaaataaaaaaagatcaaccatgtaaaattgatgttactagatttcttattaaacaaaatatcgtaatatgcaactcttcttatttgaaatattttacttttatagatattgttggtcaaaatagtatctcgaagatcgtgttagtcataaatgcttatattttagaacggatggagtaattcttttgatttatagatgtgagattttgacggaaatagcaaatccaccttttccagagatgatatattgtactaaacacatgcgtacgtggctagctgttattattatatattcataatatatgccagatatgtgcaagcacactttatggagctcgcgtggtatgttcctgtacaatgagatccaaggtcgaactaaagcaggtatgcaatttctagggctaattaagcaagcaaagcatatgatgaaaagatgatcaatatatcgtgtggcggatatatgcttaccatcgatgccattaccctgtagacaagctacttgaagtagaatgtttgccaggggccaattaggcacatatatgcgcacgatgtcactttggcctttcccgcttttggcatctggttcactgccccccggtgggtggctgcctataaatgcggggtgtaccatatacatgcaaccatgcagaaacgaagcggtcgcacgttcttgtgactgcacaacacaccaacacctcgatccctgtcaattctctctagcagcgcgcacggccaaaattcatgggcacgaacggcgcccagggctcaaaaggtgcgtcgtcgaccaccactaacccgacaaacgatgacaagaagaagaagccggctcaggcgcccggcgccgatgccgatgccgatggcggtggcaagaagaacaacagcgactacgtcgacaagacgctgtcgacgacggccaacctggtgaagctcctccccacgggcaccacgctggcgttccaggcgctggcgccgtccttcaccaaccacggcaggtgcctggccatcaaccgctacatctccggcggcctcatcgccttctgctgcgcgatctgcgcgctgctttccttcaccgacagcatcatcgacaggaagggccggccgtactacgggctagccttccccgccgacgaagacaccggcaagggcggcttcgtccccttcaactacgagaagccgcgccgtcccagcaacggcgccgccaccgccgccgccgacgacgacgatagctgggaagtttacttcgtggatttcgacccagaggacactggtggagaaaccctttgtagtcccggttcgtaaccccctttagtcccggtttccaaaccgggagtaccaatccgggactaaagatcgctatctttagtcccgggtgaaataactgggactaaagatcgagctgaccttttttttttttgcatggatattggtactcccggttaaaccatgcatatatatgtttcaatacatatatatgcatacatatatatatatgtatatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgttgatcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttttggatattggtcgagcattgcgacgtttactttccgagggtcgatgaatccagtatcgaaaaccctccgccgtcgggccctttgaatctccattctacaacgataaaagggagtatattattttctatagtctacttatatacaatgacctaattagttaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctggggggcccctgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccatttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccatcgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttcttgtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggatgtccatcttcttccacttccgttatgatgtgccgaccctcaagcttgttcgctacacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcaaagtaacatatatatatatatatatatatatatatatatatattgcatttcacgttaacgttcgtcctcgttcgttcgctcgttcacgttcgatccctcgttctcgcttgtcttcgttcgatcgttctcgttctcgctctcgttcgttcgatcgttctcgttctcgttcacgttctctctgaaacgtacgttgacgtgttcgctctcgcttctcgttcgttcgatcgttctcgttctcgttcgttaacggcggtgtggcggcatcgggcggcggttggcgcggcggcgtggcggcggcgtggcgacggcggcggcggcgtggcgttgcggggccgtggcggcggcagcgtggcgtggcggcggcggcattgcgcgcccggcggcgaaggcggcggcggcgtggcgacggcggcggcggcgtggcgttggcatgcggcggcggcgttgcgcggcggcgaatgcggcggcgtggcgcgtcgtcgtcgtggcgcgtcatcgtcgtggcgcggcgtctcgtggcgggcggcgcgacagaaagagatcgagatctgagagatcgagatgcatgaagggagatctggcgggggcggctctcaccccattagatgcggcggcagcggaggaggcggcgaggacgactagctcgagacgacggcgagatactgcggcgtcggcgccgggatttgccctaggcagtggcggcgaaggagagaggccgagagagatcgatcggccgaaaacttctaagtgttggagaagaagacgagggcccaccgagatatatatacccccggatctttactcccggttg

SEQ ID NO: 6200 - DNA, 4989 bp, Oryza sativa
  unsure (1)..(4989): unsure at all n locations
aaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaatgaagtggataaatcgtaataagcaaatatatgacttataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattacatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatgttaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacatcgcagcacgtactttctcctcactattgttccctccttgtgatcgctgcgtgagtaaggggtgtcttcatttgataggaagatgctagggtcaatcgtcaccgtgaaagggggttgcccatccaactgatcgtaatcctcatcagtcttgtcctcaactctgacgatttttcttttgcctgggagaaccacttgacgcttaggctcatcaggcccttctgcccttctttcctttgctagacatgtccttcacgaaaaagacttgcgttttatcgttggcaaggccagaatgttctacagagtacctaccggcataagagtctgcaatggtcatccagctgtcgtcaatcatacgtcgttcaccagttacctgtaccattgacgccggatcagaggcacctcattagtacaatagtcaggttcctgtatgtctccgatggcacgtgcatatgtggcagttgttccatcgtgtcccatggcatagactagatcagcgatgttatagattgtgctattcatgtcttgggctgtcttgtagaatgcccaccnnnnttgttatacctttggaaagccgtgatggagctagctggtcccgtgtcatgataggcaagatgttggttgatagactcgtaacccataagatgttgtcgtagccacgcgcggtaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttgcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttataatctatccggatcgatgaccttctgcgaaattgcgttcatgaatgcacatagctttgttattgttgcccggacattgtctggaaggataccccttattacaactagtagcagttgtgtcatcaacacgtgacagtcatgagactttaggtttgtgaacttcttctccttcgtgcttattattcgcttgatattcgtggagtatccagacggtacctttatgctctccaagcattcaaacatactttcccttactctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctagaagccaagaaggtttacgcaaaggttcttaagtgagcgtgcatcacgtcgattgcgtggcgcacgtccaagaattcccaatatggtaaaaaccaaaatatagagttctttttccacatcgccgcgtgaccatcttcgctctttatatgctggctttcaggcccctttccggaacagtactttaagatctttaaccatagcaaacactgttttcccgctgcgatgtttaggtttcgtacggtggtcggccttatgttcgaagtgcttgcctttcttccgtaccgggtggtttgctgcaagaaatcgacgatgccccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccacgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccatttttgcctttcattgcaacaactccagagtggtatccaactttttgtgcccctgctcgcaacctgggtacaatgaagttctgtggtcctccaacatcttgtccaatttatgcgcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcatcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggatcgcctgtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaaacattggaggatgaagttgcaaaccttttaggcacctctgatttgtatgtaatcaccaaaataaattcaatagaaattttggcatgacctcccctcttttttgaagaaattttgaagcttgctcgggcagctggaggaggaagaagacatatatatatataggggtgggactttagtcccggttggtagcaccaaccggggctaaagatcaccgggatctttagccccggatggtgctaccaaccgggactaatgtcccacccctatatatatatatgtcttcttcctcctccagctgcccgagcaagcttcaaaatttcttcaaaaaagaggggaggtcatgccaa

SEQ ID NO: 6201 - DNA, 635 bp, Oryza sativa
ttccattacatatgtgatttgcactatatattttcccgggatgaaaggtggcgagcacttttgtttgtccgaataaaggacgcacgcacggcgtgcgattgtgctacgtgcttctcgtatctgctcttgtacgtagagcccacacagattgttgggttggctagggctgcgttctatacccatggtttctaacttccgtcacttattttccgcgcgcacgcttttcaaactgctagacggtgcgttttttgcaaaataaattctatacgaaagttgctaaaaaaaaccatattaatccatttttgaaaataaatttagcaaatactaaattaattgcgtgctaatcgtactaaatactaaatggggtaattgcttatttgaccctattttgaaagctaactaccaatttgaccctattttttttcagtttgcttatttgaccccgcttttcaaaatcgaagaggaaagctgaccctattccgttaagacgagttaacaccgttaactaagtggtaaaatgacgaaaatacccctaatacatccatctatcctcttaccactcattcttatccactctctctctactctctctctctctcaccagagcactgccgacggcggagggagcggcggca
